United States Patent 7,482,117 (GENETIC POLYMORPHISMS ASSOCIATED WITH MYOCARDIAL INFARCTION, METHODS OF DETECTION AND USES THEREOF) - sequence listing, part 9

SEQ ID NO: 17771 - DNA, 84409 bp, Homo sapiens
cagacacttagcctgcctataagttcataaagttttgtttataacctaatggggctcttcttcatcactcctcatagaaagtaactgggggcatcagagagaccattaattgctcaaatcaaggtaatggaaagtggctatgttaaaatatctgaaagagatctcattgaatttctctattgttgacataggtctcaacacctattcttaactgctcagaggcaaaaccacgtgttccttactcttattctttctccatttacaatgctaccaaaacattgaggctgtttttccaaatttccttcatatactctcctgtgagtggctaagacaatagacaaaggtcaatactctgcttcaataccaaagagatgtactgagagctacagtgaatccctccatgcaaaatgtgtgcttgctcaaccaaacccagaaggcagaggcaagagctcctagaccttaatctctatgatcatgtaggaatcactctaatcttgatgtttcccccaagtcctttctttgactttgagacatttccagaggaccctctaacagtggagaaggacaaatggccactcatgccccaatatttttaataataaatacattcatttgttggggatgggagcttttttcctcagcttctcccaatttgattttaggctttgaagttttctatggccaaataagaggaaaatgctgcagccatagctgaaaattcaactatgagagtctgttatttggataaaaatatgctaccagggaggaaaaacatccactgttctgttggtttggattcatgtatgtgattagcttgctcagctaagggctgagggcaagtgacacaagatgccctcaaaagaaattgatttatgtatttactgaaaggaaggaggaagaaagtgacaggactctggagttaaatattgtcgaatgtttaatttagcctaaaacactttctacctttcagggagaaactgttcccaatattccccttataatgagccctcctgaaaatcagtctactggttttccccagtaatttctatccttaatgaccctctctttcatcttgttttttttttttaatcattcattcttgtcttcttgctgattttagatgatgggaaatgccccttgaatcctcacaggtaaggtagaaatgttttatgattgagtaaattttgctaccttaactttataattcactgtaatatgtcagaatgattacatgcaatgcctgcctcctttttacaatgtcttttgcaatgtcttcttttctactctgaagtaaaatacacagataacaaatattctaattaaaatataaagtaggaataaaatgaaaagtaatttataataaaaacaagatgcaaaaacttaggcgctgtgccagtagatgcaatgaggtcatcagaagcgtgcaccttccacagaatcactaggaaagcaacgcccacgcaggtggactgatgggggaatgttgtattagtgactcaaagagcattagaactgtggccaacaccagcctaatttttcaacatggtgaacaactccggtaaagagtctgaaaacctgtgataattgtcctttgattcatatggcaattgcattttaaagatgcaaaaaaatgcttaatatttacatgtaaagtgcttgagttccaggctcagagatttttaacctgtatgaatatcgagcagatattccaaagttatgtgggatgttggacaattcttttgtgtcctgtaccccttgctatttataatctagcaatagttttcaaaaagggacagtatgcccccaagggtatttttttatttttgtaatgaacaagagttctactgacattgagtgggcaggaggcaggggtgctggatatcttttaaagacatttccgtcctggaggacatggaaatccttatatgaactctattgtcgtagacatccagcacccttgccccatacccactcaatatcggaagaactcttggttataaaaatcaaaaaacacccctaggggtcatattgcaccctttgaaaactatcgttagattatcaagtgttaatgccaagaattttgtaactacctcttgtcacctagaagaggttgcagcaacttagagggtataacaggtattcagtacataaagcatgaacaataacttagtgtgggtgcaaaatgcaatgcaaattacccagagctggtaagtgggatatcgaatatttctttggcatttatttttctttcctttctaaagcagaattccaagggtggatggtaatttgtggtttctggaaatactatgtgttggactgtgttgtcgagaactaagcagtatattgttgccatccttgtgtttctgttctttagccacctaggaacatatggagtttttacaaacgctgcatttgacccgagtccttaaggtaagatccctataaagatatttttgaaggaaatagaacactagggaaaaatggaagactataaagcttaacttttctttacataatcatatattaaattttaagtatgtattaaattttcaggcatgaaggaaattgtgttggcagtaggacacaggtatgacaatggagttacaaaagagttcacaaaaggattttcatttcctccaggacagaaatgtcctaacaagacataacttatttcaggatgtgtaacatttccattattaactgctaggtggtgatgatgtggccttgcctgcaaagcagaagtcaggactgctgaaaaatgtttacgaactgttatggagtcaattccctatgctacctgctggaaaaacaaaaataatctgatgctatccctctcccaaaaagtgggtagttgagtgtcctacaaaaagcctgaatggcagaatattcgaaatctagaaagaaaagattatgctgcgcctcagggtgtagatatgatgagcaatttttttctttcttttatttttttaaggaaatgataattatttaaatttctttggtctcatttccagagacctgtccttttcctggtctcctcattcagcctccatatgatcctgttgtgaacatcaagtttcctgctacactggacttaactataatgcatttgctgcaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaagaccaatattcaaatgcgtaattaaaagaattttccccaaatgccgtgttcctctattttatggtttgttcagtaaggtctgtatacatcacattgtttaccatcagtgtaataacacacaattatggttgtcctatttacacctcaaccattcattcagtcagcaaatatgtatcgcacaccctacactgcaagagaaaatcagagaaatggaaaaattcttcatcaccttaatattttacagggaagaacaaatgtgttttacatgttctttaaatcccatgtttaataaataggtcattgaaagttatatagtatttatctggaactgatgttaaaaaaaatagagagccaaaaattatagtagtcatcttgtctctgtaaaatgtaattaaataaatatgtcatgtacactgtatatacataagcaaacatgcaaataaaaaagcagcctactcaaaggttacaataatgttgcaacaattctggtagtaaccttgggatttagggacacagtgctttcaaaacgtttctctgatacactgccagtagcatctctgactgcttatttaaatgtcaatcagtaggctaggtgttctaggactttggtctcaaccctgtttcctgagtcagaatctacattttgtaaaagttcccctgggaattctgatggtctgccaactttgggagacactgataatattgtagataaagaagtgtaagcaactgttcagttagggagacaatagatacctgcatggaataacaaaaggtaattaacatgattatataatttgaatagtgttgtaatagttcataaaatggaaaagccaatttgagcccagaatctgggagataggcagaactctggactgtaaagaatggcccagcaaagaggaagaaaatgggcattctaagttggtgcaataatatcagcacaggagaaaagacagaatattggggggagtggggagggaggaagaggctgttgatgagcctgatatcattaacagagacctcatgtgaggtgccagattacaatttattgaatgtactgaatgcataaagcataagacagaaacctggagccatgcagatacagggaacccaggacaagtcattatgatgcctcagacaatataattcgcagattctctatcaatagcaaagtaagatttaaggtgctgtgaaacagtcagatccttcaagaaaaacaagaatacaaggggtcctggagacaggaaaatatgatcataataataaatttgtgattccttctttctctctttttctctttctttctttttctttctttcttttttttttttgatggagttttgctctcgttgcccaggctggagtaaaatggcatgatatcagctcactgcaaactccaccttccaggttcaagcaattctcttgcctcaatctctcgagtaggtgggattacaggtgtccaccacaacgcccggctaattttttatatttttagtagagaagggtttcaccatgttggccaggctggtcttgaactcctgacctcaggtgattcacccgccttggcctcccaaagtactgggattacaggcgtgagccactgcgcctagcctctgtgtgttaagtgctggaactatagtttacagtagcattttatcctcccaacataccctatcaggaaaaattattattgtcatccttatttcacagatgtcaaaactgaacagagaggtacagtaacttgcccaagacaacacagctagtaagtgaaactgaaatctggacaactgatttttttcagccaagctcttcaagcccgctgctatgctgcagcttagctggcgacaggcccttatcaaggcagaactgtgccttgatagaggccaggaaggcgattcagagcagtaggccttgtccatgtgtttgttccctgcttcttcaccacttgaaaatagtgtttcagtgcccagtaacagggcacaatactcttttcctcagattaaaaggggagccatctgcttaaggtggttgggtgccactgcactgcacagaaggttctccaagtgtgagcttggacccaggcaggcctcaggtcagtggtaacggacgactgcttccgtggtgttggcaggtggaaatggagggatacagctttgtccggctcatgaatccctgggcattgtcccgcctgctagagcctctgatctctgccccttcttcacctgcagtaaaacagtcactagtttggttgctctccctaatacctctggtcactgggagctgtgatctcaccaaacccctgccaggaaaagccccagaaaaagcggagggagtgagagccagaggctgctgctgccgtttgcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgrgcaccagctgggtaggctgggggagccaagggacagaagcggcacagctaaggcagttctacgtggctgctcagggcatcagttggagctaccgacctgagcccacaaactcaaggtaactcaggtgtggagtccgggtgggcttctctagagaggaaaatctatttcttttagagaacattccctttgcaatgtcatggctttttttttttttaacttcaggtaagtaaatataactaataggagagtatactgaattaaataaactgggcaaatgctaattttgcatccaacaatgtagtttatcattctgagggtttagaaagcaccctatttgattggttagatgctaccttcttttcaagtttattttcaatacagttttgttagtatgtttgtgttggcttatatattggttaattcaaaggcaccaggcacttgctccctcattagcccttcctgcaaactcctgttccagatttttagttgtatagtatttttatgagactcctagttacatattatttattccattgtctacatagcttcatcttctaaaactaaaaatgaacaccttgtgctttttgtcatataattttattgctgccttataaatgactttcaaaatatcatcagttcttgtatgtttttgtactttcaccttttttctgcttcatatttgacttatttatcctattgaatgtgactcttcatttttttttctctctgttcatcatgtcctgggatatggtttaccttggctacttaaaggcatatgtaactgagaggaggtttaattcagataaaatactatccttgagttgcaaactattttttctaattgaaatgttaaaaataagacttctcagaaattaactaaatcatacagtctattcaatatttccagttagttattttttaaatggtaaacctgctagtgtgactcactttttttccttacatcacacttcattatgaaagatgtgttcctcttttacaattacaaaaccaaagtaatctgccaaaaaataatgtaatattttgagatcttttagtgtataatattaacctttttaaaactctcattgtaactgggttattttggagggtattacataccatcttggtcttataataagaagagatccctccttctcaaaaataatcattttaaatatcgtacttcaaagtgataatctaggtcacacccacaccctttgggaactgccgtaagctaaaaccccaaggaaaataacagtccttctaacactaatcttgcctgctcatgagtagaatgcagacttggttgttggctttcttgtagcatgctgggttcatgcttgggagttttttctcttgtctgtagttagcgttgaaaataacaagcaaaataccggaggcagaaccagatagggcaaaggtctgattcacatggtgagtacacagggaaccatgactggtcattctgtcccctcatcctgtgggtaagtttccaaagttctggagattcgttcctctggtagsaattgttgagtcaaaaccatagaaacacaacccagacaaactgtcatattgtttaaccctaaatcatatcatttctctctagcattttcttatgaaaaatctaatccatatatctggctgcttaaactaagaacttgttctaacttgtcctgcccctagagctatgatactcactaggtgaatatcaacatagccaactccatcttttggcaaagtgtattttagcacaaagcagacatctatctacttatttcatataatattagcaggacaatgccttttaaaggtaaaatgtatctattattcttgctccaagtctaaggtgaacactttcaaaaatttccttagaaaacttgtttagtcactcacatgtatacaaagagatattgaagaaaagatatacatacattttccttctagggttctagctttatatgattttgtgattatgaacaaatcatctttaaacaatccttataaatgaaaaactcgtcgtacacattgtttgaattcatatgatctgtaactttttaatcagatagattattttccaatagaaattgttcagatcaaaatagacatacctcagtatgaatacacagcatacatagtaaaaacatgttaggaaacatctctctgttgaaattactccacgtaagagactgatattttttagtaaagattttacaccatcatctacatttctgtattaaagatctggggcaggggaggacaataacttttcaattgtactaaaaataaataaataaaaatggacttccacattagggacattagtatatagaatcctggaattcttaagttagaagaatgctaagagttcatttaattcatattcaacttccacgctttaaccttctacttttcccctttccctcagcaccaatgaccttaccaagtagttgtctaatttctacttgaatgcttccagtgatggagaatccactaccttctctatctagctattctaaaagtacttacgtgcctcctttaattctgcccccacatattaacacagtttctgtattccacatattacaatttgtgagcattactgtaactacagatttgtttttgctttctgagaaaacctgaagggtaaagactaactcttattacatttacaaaataatattactagctaacatggattgagtatttctagtgtgccagctctatgccttttgcacatatcaacttatttaaaattatacaacaattctgtgaaggagatttcagtattaatctcatttcatagttgtagaaactgaggcacaaatggatgaagtaaacttttcaaagtaaaacaataagaggtagatataggcttcaagtccagagatactgaattcacagcctgcaccctagccaccgcgctgtatagaagtcatggcatatgtgggtgctgttatgtcttgattatggctgggccactgtccccacattaggaagcaaaacaaagccactctgatcaactgatttagacatttgcaaggtattttctccaaattctctttccttttaccctcatctttgagtttaagacaaggataagactgatttgcctttagaggtacagaacaataacaacaacagcaaaaacaggaaagtaacccaccactcacaactctccctgttgtctgtcctctctctaattttatttaaaatcatgaatgcagtggtttcacattttttaatcttggttctgccacttatcaactgtatctcttggacaagttactgactctttccaaaacagttttttcatttgtttgtttccaatatgaatcccagggcttttaccccattagccatctctcacctctcaactagaaataaattccaccaaatcaatactttttcacaatgttccccagtagattaaaactatatttgattgatcagttgaaaaacagctcatatatttattcataaaggatttggtcatattttaatcatataaaatctaaacctacagtttgggtttctactgtgatattgggttctttttagaaaattgattctgaggaatgatattagggtagattaacttgtgaacaaatagttatcacaacaggatatttttgaagagaccaataattatttcattaactttacttattgatcatatttataaaactgtggacttctgaaatacaataaagatactrgtattctactagaagtctgaagatatgagagatctactttttttgtaatgtgagaaatagatattgaatatgcctttcaaattagtttttgtattttatttccagtttgaatctttctgtaacttcctttaagaaaattgtctacagagagtatgaaccatattttaagaaagaaaaaccacartctaccatttcaggtaagcctgaaatatacttttttaattttaaagataaatttctatgggtaatttggcattcacatgcatctaaaatatccatttactgaaaatttatagaaacgtgtggttttttttttaagaagtactggctacataatatgtggggcccagtgcaaaatgaaaatgtgagtccccttgttcatattattgaaaatttcacagtgactgcaaagcattaaaccaagccaggggccctttggggcatggggccctgtgaaactgcccaggtcacatacccatgaagctggctctgtttttaaccttgattaaaataactaaataaaacttataagtgtttgaatttttattcattcatctaaaaaactgttattgagtacctggtatgggctgggcattgaaataggcattgtggatgcaatagtggacaagacagtctcatatcctgggttcatggagattatggtctagtttaatgagcatagatgtgccttcgcaaaatgatattttgcttccatttggctccctagattcattcaaaggaactatgtatggctgactcttttgcatctctttcccgtctattcttctgtttatttagtgtgatatatacaatagccataatttttaaagaaaatctcttattttttcctcatctcttcctttatcaagaagactgggttgaatagggttctaatatcttaactatgataccatattccgcagggatgatagagaccatcaagggagaacttcctccagttgaatccccttgtcagtaattcacctgtccctttccccaatcagatgaagacctgctgtctttcccagaatcatcctagtctgtcctgcctcttctgatctcctttaatcttcaatatttagtcaatgggagtcttcctttcagttaaaaatcaacgactaaaccaaaaccaaatcaaaccatgtccagttaactcctatctagaaaaagaaaaaaaaaaatctccccttgaccctgcctgccttttccttttctctcctttccttcactaccagttttctgtatgagaactctgtatcattctctacatttcttcgcctatattccttccctaatctgctttagtatgaataagtctactaaaattactctcacaaaagggcacctaggacttgaggtgccagagcctatgttcttttactactagacattactaggacatttaacactcttcctttctgaagctctcgctttacctgttttttctagtgccacttccccttggttttctcagacttctcttaccactcctgctcagtatccccaccagatattcttccccagggttcgaatctcacccaaaaccaaggctttcactactacctacccagaagccactttccctctgaagctacattgacaccccctcaataccagcagaattaaatcttccctcttctatacatccccagtaccttgaattaatccctaccttctaaagatattaagaggatcaattgagttaataagtacaaagtatttataatgatgctgacacataataggcactcagtagaagttagctacattattgttattgttgctgctattactaatcataacttagatcatatatatcatagtattatggatatctatatatctatatttctccactcatttatatagtcttcacatgtgttcatttatatatttatttaattttaaacagatctgcatttaaatattcttttatttttaaataattgtgtattgaggccaggcgtggtggctcatgcactttgggaggccaaggcagatggatcacttgaggtcaggagttccagaccagcctggcccacatggtgaaacccmgcctctactgaaaatacaaaaattagttgtgcatgrtggtacatgcctgtagtcccagctactcrggaggctgagacatgagaatcacttgaacccaggaggtggaggctgcagtgagctgacatcgcatcacttcactccaacctgggtgacagagcgaaactctatctcaaaaaaaaaamaacaacaacaacaacaacaaaaaagtatattgagaacctactacattctaggctctgggataaagtgaataagacatggaccttgatttccaggagccaatcagctattggggataacctatggatagacaagcaatgacagtagagtaataaggaagaactatgatgaggattctgtagtaggacataggagacctatctccagtctggtggtcaggaaagtatttctatttctagattgatagctgaaaaaagagtaggatcttggaaagccaagtggggaggcaaggggttgggtgatagatgcattttaaaccaaggcacagaatgtttaaaagtttggaggtgagagtatggtatatttgtggaaccataactggatcagcacagttggaccacaaacttcagggaaggaattaacaagagatgcaactagatggggatcagggatccatgctaggctttatattgagaggaatagggagtccctaaaaggatttcagcaggagaaatatttgtcctttagaaagattatgttgtccaattatagagaatagattggagaaagaccagtccagagccagagaaagtagtcatgggactgttgtatcaatccagatagcagagaagctgagatggagtccaaagatatttaggagctaaagttgattaaacttggtgactcattagatgcagataatgaggaagaaaagggaattgttatggacttcaaggtgtctggtttgaacagcagaatggatagggtgccattcagtgagaaagaaaatgtaagaaaaggagatagtttgtgagagaaggtgataagtatagatttggagtctgaggtgtgtatagaatatctacctagagatgttaagtgagcagacgggtgtagaagtttggccctcaaaagagagatctgagctagctgtcaacatttgggagacatcagaacaaagatggcaaatgaagaatttagagggtgtgaactcacccagggaggatgtgatgagaagagaaggctgcagacagagctcaaagtagcagcaaagtccaagggatgagccaagaaagaaaagtttaccaaggagcttgagaaagcctgttcagggaggggagaagaaatctagagaatgtgttatcctggaggcaaagggtcaaatgctattaatataagggtcaaaatatggtccctttgttatggaatagtgggacaagaccagatggcagggtgttgaggagtgaatggaaggcgaggaaactgaagcacaagggtcttatagataactcttccctgaaacttggttccagatgggaggagagacagggtagtttcgggggtgggggtgggtactgaggagcttaaggacatttgagaattttataaaaaggaatacagagacttaaatatttaagggaagactctatagaaatgccatgaagtcctttccaatagaaaatgtggggataaaacatctgagagagaatgattaatggagacttagaagaagcaggaagcattgggattcaaaccttgggctggcttggccttaggtagaatggctaccaccttcatggggggccaggaaagcagaggataacgttgcaaataaaattaagtttgtagttatgagtaggaagttgaaggatgtcctgtcctatatcacagagtctattcattttcatagctccagctccaagcttagcatgtacaatagatacttaagaactatttaattaaattaaattgtaggtagatgaagggaatataaggtgggaaacatactcattagggccaggaaaagaggattggggccggtatttgaaggtgtaccttttgtggcttttgccaagctaagcaaattttaatccctttgctgtgtgagacattgtgctaaatgccataagagacggaaaggactaattccaggctgaagacttttaaacaataaaaaggcatggatagcttttgaagaaaagggttctgtgatcaaagtcctttcagatgattaaattttttagtgatttcctgatttaaccttgttagaggtagactctgacagttggtgagaacagtctccaatttatgtgtgaggcctttgcacctttctgtcaacccctgtgtatctcagaatatatttgtttcatgtggacaaaggtgtttcgacgtccattttaatgtaatctcttcctgaatgtccaaagttgcttaactatgaacttatgaagtgcaggagtggtatcttattcacctttgtaactctatagtagttgatacaaggaggcaaatctggcgtgaaggaaaagccttttattttgactgagaagatctggatttgaacactgccattaactatgtggcctctcccattccccagactagtcctgtgttatttgtacctttcccctatgtcctgctccactcatctgctgggtgtgattctagctgagccctgaaaaagtcatgagcctcactcctgcagcatgaactattgttgttgttagttcttgtaattgtagggggctgggctgtaggattggaggtatgaagatgcccatccaataaggtttgtggacatttgggcaggtgagggagtacagctggggtcatttttaggaattctgtcttgggctttaaaatggctagtcttggctgggcatagtggctcatgactgtaatcccagcactttgggakgccraggtrggaggattgcttgaggccaggagttttagaccagcctgggcaatgtagtgagactctgtttctatttaaaaaaatacatacatatatatatatrtatatatatatatatatatatatatttaaattagccagacatggtggtacatacctgtcatttcagctactggggaggctaaggcaagagggtcatttaggacaagagcatcacttgagcccaggagttggaggctgcagtgagttatgatcacaccactgcactccagcctgggtgacaaaataagacctcatctctaaataaataaataattaattaaattggctagttttgagtctgcatatttttcagggacaaattataaaatgtttgtccctgaaggagttttgaaatagctgcaacaatcactaccttgtgttatgtaatgcattgttcacctaagagcaggggattggattagttgaccttctgcagtcctttccagttccacaactgcactaaattgggtacatgctgtgctggcttccccaagccctgaagtaggccactcctttccccaatccagctttgggcactgaggagagggttagaagggttttaggccatctggctgttggaggagctaaagagcagcttgaaaaccatttagccatgtgttttcctacatgcgtgaaagtatttggtatgcatttatgaaaacatccttttgttttgccttaaatctgaagaagcaggaggggaggttgaataaatactccaaactgtccactgaagtaataggtcttattaggttaaataacttaggagactttctctgggcatctggtatttgcaggcatgtgatgccaacaaacaaatcaaccaagcaagagaaccatggcaactaaatgcggcacacaattggcagcatagtcagcaccctgttgggctcattggcagctggggtaggtgggaatagtcagtggaaacttccatcaggagccaagacagagggtagcagctggaagaggggggtcagtcagtggagtccgacatgtcaggagtcaaaagaggtgtagacatctggactattctataaagatgggggyctgagcctgcccygtggaaggaatagggagagctttggctcaggagtccagagatctgagttctgatcccagcaatgctaccagatcactgactgaccttgggcaagtcacctttgtcccccgattcctacctcccaggctttgttaactaaaataaggactgaactttgtgacctccacagtcctgtgtaaagctaacataaaaacaaacaaaaagcttcaggcacaagatcagaataaactccagsagtaggagttcaaggaaaggaataggacaaccgtgggtggcaagacaggggtagggaaagataggacctctgtcccagaaatcagagtttaccattgcttctgtaaccagttactgcaaacttagtggctaaaacaacacaaatttattcttttatgattatatatctgcagaysagaagtccaaaatgggttttattgggctaaaatcaaggtgttggcagagctgcattccttctggaggctctgggggagaattgtttccttgtcttttccagttactggaagctgcctacactcacgggctcatggccccttcctccatcttcaaaaccagctgagtagcatcttccaagctcttcctaactcagattctcctgcatccctctgataaggacctttgttattacatgggatccacctggacagcccagaagaatctcatctcaagattcttaatmatagatacacagtcccttttgccatataaagtagcatatttccaggtcccagagattaggacrtggacatctcagcagggrcacattattctgcctactacacccaccaaacaaagccctcccacggtgtcctccatctcagagaatggcaccctcctccacccagctccccaaaycagaacctcatcagccatccacagcaactgatgtcctttattctctaccccacatccaatccatcttcaagttccaactattttatctcataaatacatcactaatatattctctcctcatcatctcatcataatctcagtcaccaccatctctcctggagtcttctatctgttctctcaattgttctctgctcagtctcctccgagatcatcctccacaaatacagccagagattttaaaaccaaaatctggtccatgttgcacccctgatgaaaactctttaatggcttccagatactcttaggctaaagggaaaactctatgaggcttacaaagccctgcatgatgggactctgaggatgccttcggcttcaccttctgccccttcctttcacatactaagctccacctccccactggataactgtcagttctctaaaaaggccacattttctggcacctcagggcctttgcgcacrctactctaactttttagaatgtctttggccatcccttttcctctctgcctttggacctcagttaaaggattaattcctcgggaarggattccccaactcacctccaattggactagattccactgtcaaatactcttcagagtattccctccttttctgtcataatatttaccataggtttaaattgaatgtttttgtgatcatttgtttaaaatctgtctttcctactataaaaacgtataaagttatagaactataaaaatgtttgacttttataaactctatgaaggcagggagtgggtgtatctattttactcttttacgcaccattgcaattctgatgcctaggataatataggcacttgatattcattgaataaataaaggaatgaataaaggaatgaatacaaggtggaggtgtagtataaagaagtggcttaaaagtcacgatctagagacagacatattaaactttaaatcatgatgctgtgtgatattaggcaagatatttaaactctctgaggctcagtgtcctcacctataaaatgaggatcttaatatctaccttaaaaacttgtgaggattaatgtagggacttacagtgcttgaatgtattaagggaaacagtacaggaaagccttattatgattatcatcaccactgcaaacaaatgctggctgaactccatgagtgcygtgacttccttctcctgcttctaggaygcctaatggcgagaagccaatcccatgacacttgtggatggctcagaaatgacagtagttgatttctgtcacttgtctggaatggggcttttggtcatagattctcaagatttcaaagacatcaagatcaccaaggagcacacgttaaagtccagattcccaagtttcacctccagaactcagattcattgaggctgaggtgatatttggaaatctgcctcttattaagaccctaggtgattctgatgcagagactccaaggactacactttggaaattctagtacagtcatcccttggtatccacagggtattggttccaggactactcacagataccaaaatttgcagatgctcaagtcccttatataaaatttcatagtatttgcaataacctatgcacatcctctcatatactttaaatcatctttaaattagttataatactgaatgcaatgtaaatactatgtaaattgctattatgttakagttttatttgtattgtttttattgtttattttttattgttgttttttgaatatttttgatccaaaattggttgactccatggatgtgtaaccatgaatatgaaccatggtcatggagggctgactatatayaattcctcaaattctgactcagccatcaactttttccctaactccccagacagaatttgtgcttcatcctctcttcttctgtaatattttgcccatatctcagcagtcrctcctatcatacatctatctccaaactagcttgtgagttccttcagtacagggactgtatttgatccaggtagccagaaactttctaacacagtgcctggcatgtagaaagtaaaacctcattcttgatttctgcacccataacctcctgtctctgctgtgttctcccattgcagtaactaataacatcatttacccagttgttctgataaaacaccttgaggtcatccttgacttctgtctctcacaagccacatgcaatccatcagcaagtcttgtttgccttacctacaaaaatgtccagactccaaccactactcatcacgttctgctacatgtgctggcccagtacactgcagtctctttcctatactgcctaatctctctgcttccattcttgtccctacacagactattctctacacagcagctatgatgaactttttgttttaggatgaacttttaatacacgttatactatgtctctgctgtacaaagtggtttttcattttacttagaaatgctccatttcacttagacgaggcgtggtggctcacacctgtaatcccagcactttgggaggctgaggcgggtgtatcacctgaggtcaggagtttgagaccagcctggccaacatggtgaaaagtcatctctactaaaaatacaaaaattagctgggtgtggtggtgcatgcctgcaatcccagctacttgggaggttgaggtaggagaattgcttgaacccaggaggcggaggttgcagtgggtcctgagattgcatcactgcactccagcctaggagacagagcgagactccatctcaaaaaaaaaaagaaaaatgctccagtgatgtcccatttcacttagaagaaaattcaagttcttaccrtagcccatagggcctcccttgttctacacacctaccatccacctcatctcttctttcttcccgtactgtttttcttactgttccttagatacatcaagactactcctgcctcagagccagagagctgtgtgatttggttcctcaattcatctaggtctctgagcacacccatgtcagagaaatctaaagtaactaccctctcgcatcaccctctgtaattgaaatgaacatctttcttaagcaaagaaagttattgctaaggaatgacagtgggtcaaagtgggcaagacttggccagaactatttctcctactctgttgacttcttttgggtccaggacaagtgtttctaccattctattgtgatctgtgtacatgtaatgttgagttaatgagctgctaaaaccttctagattgaaaataagtgagtcagcctcaggaccaggaggaatggtagcaatcactcttggtatcatctgtttgtttttcttgcttagcaactctgcctttgatgaccctgaatacagacatagtttaaatatttgttttcacaggacttcttgggcctactttatatgctgaagtcggagacatcataaaagttcactttaaaaataaggcasataagcccttgagcatccatcctcaaggaattaggtacagtaaattatcagaaggtaagataaatctaatatttttctgaaaagggaaaatgtctaagtctttaataccagcatcaacatttaaaactatactgttaaccacgtgttgttagggaaatctcttgcaactggtaattataaaaattgttgctgttgtaagttttgagagaagaaaaggaaaaggttttggagtcctctagacctgcatttttcactgggttcttactctttaatgtttgggagggcaagttatctaatttctctgaattctcatatgttcatcttaaaatgggaataataatacatacattgaaagatggtttaaggcgggggtcagtaaatttttccgtaaagggccagatagtaagtttgtttggctttgcaggccataagatctctgttgcaagtactcaactctgccttttagtacaaaagcagccatagacgatacctatttttttggctttggttacagatgccagaactaattaactttgttaccgtattctttccctcaagtcatacaccagagtaagaccgcctctgacaatacaattttatttacaaaaacaggaaattggttgggtttggcccatgagccactgacatagtgacatagaactagcctgatataggcttcctggcacatagatgacactcaataagtggtatttggtggtggtgagactagaagcattaatagtattagacttttggacatagtgaagtggttaagaaagtaagctttaaaggcagacaagttaaaattctagctttatcatttctgattctacgactttagcatctctgagcctcagttttctcatctataaaatggaaatgattataaccacccataagattgcctgaaatttaaatgaagtcacttaggtagagtactaaacatggttcctgggatcggataagctctctataaataatgatgacaatgatggcaataatcataaagataatagtcatgcaagttattgtatcagccgctgaatagtaagtacctgatgttaatatggttctaattatcccattatgmygatgttcagatcattgtaagcatagtagagttccatcaggcactggtataaaaaattgtatccatattataatagttgttggtatgakaacattttaaaataatttcagacttttcatggttcacatttaaatatctttccttctacatgttccagccatcatacctttgagagaataattgagtaggagagtggtttatgtgcaggttttagaactagactaataagtgcaaatcctggctcagtgacttttatgaagttatttaacctctgtgtgcctcatctttctcatctgtaaaatggtaataataatcatgtctctgtcatacaggtttgttgtcrtgaaatcttagaataatgactggcatataacagataataaatattagccatgatagtaaagataattcttcaattaaaatgtgttcaaataatttagtatttatcttaaaacttgttagtttcagaaaaaatcagaaagtaatttttaaatttattgttttctatataaactgttgtcaaactcatacccactaaggtataagtgactgataataggtcaatgaactaccttccttaggagtacttgcattagcacttaatctttggcttgaggaaaaacaatgaagcattaactgtggcactgagatttcttccaaagtgaatttggcaagactctgggtgaggtagtgggaacaggagtttctcctatgttcttaaaatcatacagtgacatagtgaacaaccacttcacctacttatgaggcttctagacgactgcatcagaagttcagcaatgtaaagaagaagggggagaaacctcaaaatatcaaaatgtcacatgcaggtttcatttcaaataagggaggaggtaagaattgtagactttggaccctacctgggctgtttgcacagtgaatgaaccttgcaacactatccctcttcctttactgtttatttgtccctacattccctacagccagcaattatttatgagcaattgcttaaaatgctcccacagctttcactggagacatgattattggcatataatattgcctctggtcctatgaatctaagaaaggtaaatacatattggtagggaaagtaaaattttaccttggaaatgagatgcaaayctagtaagcagatagtatcttttatggtaaaagacaagccttataagttgattttattatgccctctgcattaaaataaaacatctcctcctccatgtctgacactcaccctcacctatagcctccctctgtggtttgagctatttttttgggagtggggataaactaactgcatgctgagccagttacatgagaatccagattcctctatctcagaggtagatatttgagagataggtggtagggggttaagatagtattacactggcttgagaaaccacaacagaacataagagaactctggataaccctttttgacagaatggacaaacggtgatttgtaaaaatgcttgtaaggacatttcctttaataatgtatttaataagactgtcttagatcagggaataaagtatctgcaactgtaactaatcacttaaaarctgtcactaaagggtttcaatttgaggttaaattttcagaaactctgtaactagcatgcatcaaattgacttcaatgctgcacctttgagcaaagtttgttgttcagtaaaattttcaaagtcgttttggtcaattacctttaaaaagcttgtttcatggagaatttaatattattcttttcttttagttatattctcatattttaaatatatgagttgcatatgaatgtgatgtcacmaaattasttctataatatatagccatctgctggtaagccagctctccaaataaaacacrttttctgccagacattgttcgttgtatctaagtgttgccaaattctctatacaaaaatttgctcttctagatttttccaaaacattccaatgcttgacttaatgtaggtgattacattttttcacttctcatctgaatattttggccttatgtagagacttccttgagtatatgataaacacctgaaacaaactataacggctatagtttgtatatttaataaatcacaaaaatgtggatcccttttccaaagagacttgcaagtcctgtgcaatgaaatcagctctttataaaacrtcagcattgattcgcccattgcctacattatagcttctaaaagaatattctgaatctttgaatgtagtgaagcattcactaagtttattaacttaggagaggaaaagagttgttcacaaaaataagtaacaagggaagagttactgagtgagcaccctaatgagtaaccaaaaaggctctttatgtaacttcactttcccaaagcttgtatgcaccatttttcatttttaaaaaatactgagagcctttggcaagtaattagtacatcatgacaagaataaatacaatacaaagctgactatcgactgagcaggaaatgaacagaactgagtaaatataaatgaagagctacccttgtgtaaagattttattccagcaagcagctgaacaaggacttcttgtgctctagcacaatagttgtccctgtccatttctcttcttttcagtttagagcttaattttttttattttgattacaaagtcaaaatcacattcaccaaaactgcatctcacaaatgcttcctcttaatagytgtttgtattttatactttatattaatgtatgttgyaaaatcaaagatacaacaaacctgttttattctagactaaaggtaaaataatttgaagtgaaaagaataaaagcattgataaaattacaccccaattgtctcattagccatctcactcagtgtaattatagaatatatcctatgtacaagtctatatcattcactgtttcaagatgctcataattcaacttttagtagtatactaaacttaattaacatcattcatttaattatttgaaattcatcttatatgtaactgacaggcgaatgtgaaattctgagtaatttagtttgatcaattagacagacattaatttgtgtgactagagtaacctttcattatctatctcaaaatatcatgtacacaagtatatacaataattttttaagcccagtatgtgttaaaataaatctaggtgtgaaacattgattgtttacagataggttcaatattgttagaaaatcagtcaccctgctatacctagcacaagtgttatagcatcttgggcaatttttagatacttacattggttggttctcattccagattgacagtgtgttctaattgtagccctagaagaaatctagaggtcaaacctatcacaattagggcaccaacatgtaccctagagttaactaggcagagcccctcaggggcccaggccctktcttctttacatttgtactctggcatttagcacagagcctggaacctagtggatgatgatggtcatgatcatgatgatattaatcattactgaactaaactgaggggccgaggactgattagaaagtaaggactatgcattatttttcccttgctttaaaattattgattttgctgataattttgagcaggtactttgtcttacttattaccaaaaaaaaaaaaaaaaagtacttttaccaaaaaagtcttatttactttcatcgcctttggaatagatacatcactacaatggattggaagtttgtgtcctccaaaaattcacatactgaaatctaacctccagtgtgatggcattagyaggtggggcctttgggagatttttttttattatactttaagttttagggtacatgtgcacattgtgcaggttagttacatatgtatacatgtgccatgctggtgcgctgcacccactaactcgtcatctagcattaggtatatctcccaatgctatccctcccccctcctttgggagatttttaggtaatgaggatggagccctcatgatgagattagtgcccttataaaagggaccctctcactcaccctctttctaccatgtgaggatacaaggagaagatggcagtctacaacctggaagagaccctgcaccagaacccaaccatgctggcaccctgattttaaacttccagcctccagaactgtgaggaagaagtgtccgttgtttataagccactcaatccagggtactttgttaacagcaacccaaactaagaaaatcaccaatttctatcttactcacatgtgttaccagaactcragcacacttaagatctatcttatctaaagtagaacataaaggaaagaggctgtattaattgcaacatgactgggaaagaaaatacttaaccaaaatgtgaacatgtattcccacaggctatcagagcatttgttaggagccagaaattttacaaatattttccagtcttcataacccatcaaaaaggataaagttatctctagaaaaaggattatattatcttaaattataaatgaaaaaactgaggttaaagggacttcaagaaaccttcccaagttcccacagttagcaaatgatacaaccaccaagatattttcaactctgaccctgaagttcaagtgctttctcccactatctagcagaaaaaagtatcgttaaccatatagtctcacaaatactgaattacaaatggcgatgagtgctgtcaaaaaaccaacaacaaacaaacaggtatcacaatcagagatcaagaagggtgtaagatgatatttgatctgacatctgaagaatgagcacacatttacccagaaaaataaagggaggaagaacttcaaaagttatctcctaccctgcaaagaatataatgttttgcccttaggggagcttgtgaaggcagtggaaagaatatcattttctactatagaaaccccatgtgatgttttaacagttgaaacagtggaagctgcctgtccagaaacatcatttttcaactttatgaggccatgtagcaagaagcattgaagaagggctgtcatgcttgattcaaggtagatggtgcagctcatcaactagccatgctaatttcagttaatagacaagttctgacctgagagggcaactctccttatcagtcctgtttgtgctttgttaccaaagctcttttgtaatctttcacagataatgcttcctgcttattagtggagactttctccataaactttttttcttttatagactagaattatgttatmacttacaggaagtgacttaagcttttatcatttctcagctcttgacagttttattatcaaagtgaaagtacagcctagagtaaatattagttattagtgtcaagctatcctttggggtgtgttgggggaagacacaacaaagtccactttatgctagygcaaagttcacaaactcagatgcctatagtagccagataagtagttcagtgaacaaaattggtccagtaagdactgatcatcagaaagcagaaaagggcagctaagatccagatccaacaaaattctgtgcaggagtttggtcctgttgytaaccagatctccaggtttttgttttttaaagagaaaccagtaatccaaattcttatataatttctccggatgtttaatgttggcatttaatctattttaacattacgcaatcataacaacacacagccatgagctttgacttgttgacctaggctgtagcccataggaccttaaattttaggagtttaataaatattcactgagcatcttcttcatgttcatgttccatgcttctctaggtacctatggaaggcaccagagacactaagacaaatacaatccagcacttttccttgaggaactcacacttgggtgaccaaaatgtgcaggacacaaatacttatgatctagtagaagaaaatgaattagtcayataatctcacaggcatttaattacaaattgtgatgggtgctgtaaaagaaaaaaatgtgtatcagaattggagataaaggtagaagtgaacagatattcaaggtgatgtctgaatgatgagcacatatttatcaaaaggaagacgggaggaagagcactctaggcagagggaatggcatctgcaaagaccctgaggtaggacagaacttggatgtctggggaactgacaggggacccaagggacaaggagcccatagtaaacaagagaaaagacgtatgataagactgaagagagaagtagaggtaaatcatacatggacttgtggtccacgttaaggactttatgcaagaagtaaatctagatrtacctactcaacttatggtttccatgctcagaacctcatgagatacattgcacgttactgtagtacctgaatccttcattgctattgaatggatgtgccttattttccactcccacctggrgaatccaaacatatgctgatgccatgcaaactcatgcaaagcgttttgagtggaatagattttccacagttgggatggggaaaggtacaattaaagaagggaagctgacattgctgtaatgtaaaaaaatattttatatggaaatttagcatctcagactttggcttcagaacataaggaacmagatttaccctttttctcaacaactagacaggcagacaaaacatataaaacagaagttttcagacatcgaatgacagacaactcaagacagtaaaagaagwgtaacaaaccagatgtgccctatgagcacctaarcttactgcttgaagagtgtttccagggaacagcacaagcagggagaacccagacagagtctctatgggttgaggaaatagagtttggacttcggagaagctcaaatggctagaatttgtgattttagggcagagtcctgcagaggacagtataatcacagagaaagagctctagagaatctacagagaggttttgtcaagttgaatactgatctgcacatacatgtgaggaaagtactgagggtaagaaaaatgtcacttgaaaggaacaggtggaacagtccctggaccttactcagggccggtaatcgtttatgttcctaccatcaaacatagaaagacctcctaataaatgagcactggatagaattgtcagaaggatttagaaacagtgggtggataaaattagactacaggctgctgaggaggcaacagaataaaaaacaagatttgatttcaagtatcttaactgtgaataaaactcaatactagttaacaagaatgcaacaaacaacaatgtaaattcacaatgttaataaaaataaacaagcattagaagaagcagaaagagatgactcataaccaagaaaaaactcaacagattgagaagtgaaagagagaatagaagcagcaggcagagacagtaagacagctatcataaatcttctcaatatgttccagaaagcagagaaaagcatgagcatgatgaagatagagaatataaatatgcatacacagaacttctgtagatgaatacaattgttgacatgaaaagtaaaaaataaagcatagaaaagaaaggtaaaaaataaaggataaaaaaatatattataaactgaaggataccactaatacaacaaacactggatgaaattaatagcacattagacactgtgaaaggaaatagtagaaaatattaatacattgcaatagaaactgcaaagtgaaatacagagattaaaaaggctgaagaaagtgaacagagcatcagtgaactgtgggaccatatcaagtgatctaacatatgtgtaattggatcccagaagtagcaggaacagaaaaagtatttgaagaaatratgactgaaaaattcccaaatgtaatgtaaactacaaaccaacagattcaagatgtttgacaaaactaagaagaaggaacatgaagaaaaccacaccaagccacatcactatcaagttgctggaaaccagtgataaagagaaaatattggaagcagtgagagataaaaacacacaccacatacaggggaacaaaaccaagaaatgatagcagacttatcgttagaaactatgcacaccagaagacaattagggacatctttaaagtgttgggagggtagaagataggggaatctgtctgtttagtattctataccaagtcaaaaagtcttttttaaatgaaggcaaaataaagagtgttttagacatacaaatgcagaaagaatttctcactaacagagcagaaaaaaatgttaaaggaactcctttagatagaagaaatattatgtcagagagacatttagattcataagaargaatgaaaagttccagaagttgataaatatagagaaattttttcctcrttttaatctattaaaaaggcaattgattatctaaatgttaaagcaaaatagtaacaatttattgtggggtatattatgtatatataaataaaatgtatgacaatagcacaaaggctgggagggaagaaatggaaatatattattgcaaggttcttacaagtgaaatagtataatattatttgaaggaagtttgtgacaagttaaaaatgtactatatattgtaaacggaagggcaccactaagaaaacaaagctaagaaggcaacaatggagattaaacatcactaactatactcaatccaaaagaaaacagaaaggaaggggaaaaggaataaagaccagatagacaaatagaaaataaatataaagatggcagttttaaattcaaccatatcatcaattacattaaaagtaaatggaaagaacactacaattaagaaacaaataagattgaataaaaaagcaatgctaaactgtatgcagaatttaagaaatccactttaatgagagagacaaagataggtaaaaaataaaggatagraaattatataccataccagctaacactaatccaacacaaaagggtgtgtaatgatgattccattgatatgacattacagaaaagccaaattatagtgaaataaagcagattagtggttgtctgggcccrgagggcattggctacaaatggcatgaagaaatgttttggaatgatggaactcttctctatcttgattggaactatagctataagactgggtaattgttttaatcaaagctcagcaaatattatacttaaaagtggtaaatgttattatatgcaaattatacctcaatgaggataatgaaaggaagaaagagagggaaggagggtggggaatagggaaggaagaagacaaagaaaggaagaaaggagaaaagaaaagaaactaggaaaggaaaaagaaaagaaagggaagagaaaggaaggggagggraaggattaatcatttcagttttcaaaaagtgtagttgcttcagtaagagkagttttattggccttttaccccatcatgtaaaacatttcaggcttttttycccagatccttgttgtctgcctacatccacactgatgttctcaccttcttctcktaaagaatttatcaagttattgtaccaaacaaaaataactgcatcccaaagagaaattctgtcaccagctgatgatagggaatctttcacctaattaaatgaggaattcctcaggcagaggaaactgttcattccacttggctmtctatggcactcacctctccccttcctgacctcacttgctccattttattattgaaaacctcacccaaccctctacacttcttttaatattgagtatctcagttccttctcttcaataaagaagaccaatttcttcatcctctccctctcctatcagtagggaaagtccaatatacatggaggtgttaatgatgtgtctttgggtgcacaaagtacaaagtaagacatctaagtttcaggggatggacacrtttcatattcatacagacaaccagcctgcataggggagttagacgctgtggctcgggggaaaaaattgagataatcagatggctaagatgaaataaagagataaaacaaagctgaggatcacagcagttggaaagaagatctgaaatagcaaaacaaaataatacataaacagctctgactatcctcccatctcatgttaataggctaagtatgtcttattaaasaccacaaagaagatatcacccattcttatattctgagatggtttactaatcaaaggcgattcaattctctgattatatttaaataataattgttcaggtaccctggaaaattaacttgctaaactttaatttacaaataacatttgttattcttaagatcaccatgttatcaaagcctttgtaagtacatgagcatagaaatgggcatatgtgaatctttccaaataataaaagttcactattgaaggacatatgcatctccagagarctcatcttagctatcmccagatktgagagtggtgaaaacgcaatcctcagaaactgcccacatgtcttgatggctgttactcctccaggtgcttcttaccttgaccacacattccctgcrgagaagatggacgacgctgtggctccaggccgagaatacacctatgaatggagtatcagtgaggacagtggacccacccatgatgaccctccatgcctcacacacatctattactcccatgaaaatctgatcgaggatttcaactckgggctgattggscccctgcttatctgtaaaaaaggtaagaacacccccaccaaaagattcaacaactaaaygttggaatggtcaggagttctgtcatgggacaaagcttgggagcatcttggtaacttcttgtacatcaagcagaggaagacggcacggagaccagatcattgtttgacaagagaaaaaaacacctgctatttcagggtgtggatccacctctgtttcttctcattcctccttcatctcagtccttaaggttctcccaggcaaattcctgtttgagagtatgttctgatgtcatgcttgtatgatctgtaacatttacctcaaggccaaagtcttttagaaagtatacagtagcctatactctgctgaaagagctcttggaaagaactttggctaacatgtttgacatatctgaggtttgggctggtaatttgctctataaacacgtgaaatgccagcttcctttcttacaaacaagttgaaaactttgggtggtaggtttcaaacacactcaagtgactttacaagaacttttattggctgggcttcttaggagcaagcttggattttcattttatcccatgagaatccagcccatctttcattaaaacaaacaaccacagtgagccacagcatgggaaataacgtgatggactcaccatctgcctatacayacacgctcagrccatacctacatacatgcccaatgtatttactcattatacaaagactttttttccatttcctggtatatataagatactgtgatggtactgaaaaaaaccktaaaacttacaaaagactcttcttgcattttaccatcagcagcatgtttttctcatagtgagaatggattaatgctgatacttccacccaattatctaatgccccctttcatatacaaataagatgacagcattaaacttggggcatgatgcttttaccaactgagctaacgtatctatatactcttctattgagactgggggaaatggatacttgtacagagtcttgagagtcaccaaatgttttcttcccaagctggatgaaataaagcctgttccccaaagcaagaaggtatcaaagaagacagtgtggcaccagattttaaataaccctagaaccattattacttgataaatatgctattttaaaaaataagaatttcttcaagttgaaatcattatggttgattgcttgccctaaactctttgctatccaggaaagctaatgagcrtcttctatctgcagtgctactgaaaacatgtctttcctttcatagggaccctaactgagggtgggacacagaagacgtttgacaagcaaatcgtgctactatttgctgtgtttgatgaaagcaagagctggagccagtcatcatccctaatgtacacagtcaatggatatgtgaatgggacaatgccaggtaacaygagggctgtgtaccattaaacaacagtaaaatcattagtaatttttcggtcctgttttcttcaaagcactagagaagttgaccatactcactgttttscaactccctatcaagaaggaaatattttctctttttttttttaaacaggaaatagaagagacaaattagaagctagagaagaaatgtgcagccttgttaggtatagtgacctgagtaggtttcaccttggcctgtactttgaataagaccttaaggtatcagctcagccactctctccgagttctgcagttcctctatatgatgaccatggcttcttcaaggacaagccctagcaggaaggatcagcaggaagattgcagtaaagatgaacagattaggagtaatcctcaacacacaaaaaaaaccagcatttcaaaaggtgacagaagagtaatattcartggcatctagaatattttctctttccatttgcatttgggcacttatgagaaggcaaaatcatagcaatcgttaagagaaaaaataactrattcccacttagaccacatctcttctatttctctctggtagaactgacctacaactaaagatccagggtatatgatactagcctgagggaaaaacattaaaaaattaaaatgccactttactaaataaaccatatttcaaaacactaaacttcttagaggttattctctaatgccatctgaaaatcacaaatagcttcacttactaaaacacaaatattgttaagagttgagatctgggtagtgtttttaaattgtattctatttcatttgactacattttccacttggttttctgaaaatatactcatatgactctcaatgttgatcccaagttccaatactaggagcttgtaaaaactggggcttagttaactgacctcgaccttagataatctgagttcagacttcagattatcagactaccttctgtggccctggataaattagttgtctcaatgtgcttacttacaaaagtggactaaccatttatcctaacatctatttcctggcagagtgaacaatctgtataagtatatggatgccaagaaaagcaaaaccatatgcacaaaaataaaaataaattgatctgagcttagagtttacgaatttatagttcccaaaagaataaytgggggtaaatgggacaaggtagggaaagaccatcagtagaaactaagaatagtaaacatttgtaaaaaccctctgccttataaagcagaataaattgaatacatatgataaatgctaacacagatatgttaattgctgaactcaatataagcatttctttggcatggataaacgcttccaccaaagcctcctagtgatgcaaggaatcctggctttgttgcaatggtctcctaaaaaaaacaagcctttgtgtgggtaaggaactgattctcagscccattatctagtatctagtgattatgtatctgagatgtaaaacagaaacctaaaagccaaggatggagtctccccacagagcaaatgagcattttcccagtgactgtaggagcaaagaaggagcaaaactaagtttttatattcagttatcactactccttccatgaaaagctcccaatggctcagcataatgaggacttgtacactgcattttaaggagagtgtgtaaccccaaagtgatttcgttgacttgtcattaaaacaatcaaaaagtaagtaaaaataacaattgaaaatcctcayatcatcttcacatcttcttcccttaggcagagcttcgaccactasagctagagagctgagaggattaagtgcttgaactcagccctattggcggttctggtgatttgactccctccagctgagatcagactggggtgaccaaacattccattttgccgtggactttttaccagttctaatagttaaagtcctgaatcttgggaaacccctcagaccagaamagtcggttaccttcttggttcccttcttggcctaatcctttagcaatccctgtgtttytgagttcacatccaccatctctaagctctgttgttacctgtataatgccatttatcacaatgagttrtcactgcttgtttgctggtcactcagatgtctgcttttgcagggcacaaactacaactggagtgtctgttccctcaaagctttatacaatgcctgacacacagcaggtgctcaatacacttggtgagtgaatgtttgatcacagagtacttgactgaatgcttattttggcctgtgtctctccctctttctcagatataacagtttgtgyccatgaccacatcagctggcatctgctgggaatgagctcggggccagaattattctccattcatttcaacggccaggtcctggagcagaaccatcataaggtctcagccatcacccttgtcagtgctacatccactaccgcaaatatgactgtgggcccagagggaaagtggatcatatcttctctcaccccaaaacatttgcaaggcaagaaactctcctgacagtcttgcttctcaatgcagaatcctttcttcccatgcactaactccctctttctccyttgccctttcaagccacctgcaccgcagacaaactttcctcrgttcctaacaaccaaacttagatattttgctcttagatttataacttgctctttggggatggagaaagcgaaggaattggcaaaggttttttttttttttttttttttttttttaattaagcaaaagctaaagagatctctaacttcctcgaaagaagaaaagaggaagaaaacaaatgcatacatagagatattctttcttcgggttacttcatatgcaaaaaagacctagatgctagcacaagacaaactgcaaatttacagaagcactaagttgtagaaagtgtaaaagtttagcatgaaaacattaacctttacagtgggatgaacacaaagtctagcacagagaggaactcaatgaatgtgtgttgaatggatcatacatggcatatactgaggggtgagctccaaagaacactggggaattcaggtgggaaaataaatcaacccacgttatgtggtatcgtgtaaacaaaataactgattgttctactacacatttttgctttaaaactgttgagattagagttcatataaatggagactaaaatctaaggaaatgatatcacaataggaaatcattttgttaccaaaataatgtataagcaacacatataaggaagagatacttcatgagatcatttctgtttcttttcacacgagtagtcaaaattatatttgaagtaataaaaccatcatgatatccgtggaagatagagttcccaataatattaaaacaacaatgtaacttttgtttctttgttgaggataagtgcattatgtattgttattaatatttaatttttaacaacaattttattaggtactggtgctacttcattttatagattaagggacagatgacagaaaaatgagaatttaacaagacttaattcataaggtcttaagaagttaaaaattattagaaatttgcctgctcaagaagaaataaagggaatctttccaaattttttccctaacccctcctccttttcccccttttaaaattcttgccttttctggatgccacttaaagagttccaaactaaaatgttcaaaaattgcctgagcattactttcactcttattatattaatataaaccttccacaagttgatttaaaggatatgcatttcaatcaaccataatttcttctcttgagttatttcattgtctttctgtcctaactcagctgggatgcaggcttacattgacattaaaaactgcccaaagaaaaccrsgaatcttaagwaaataactcgtgagcagaggcggcacatgaagaggtgggaatacttcattgctgcagaggaagtcatttgggactatgcacctgtaataccagcgaatatggacaagtgagttgttggggttcataccactgggcaaaggttcaagacacattccatagggtcctagatgtttggggtgaaatgtaagttcacagctctcaaggggacacatgtattggtttctattcaagtctttttgtaaaaattaatcttgaattacccccaaatcaccaaagaaattcagcctaataataataaaaatgacaacagcagctaccttttgttgaatgtttgccattgccaagcactgtattgtccctttctgagagcttcgcttcaactctacaaactagatactgctcttatttctttttatagatgaggaaatgggtctgagagattaagagatttggaaattcaaatagctcttaaacccttgaaaagttactcaaattcactcataataacagaaatgcaaattaaacttcatgggaatactacttttatctatcacattcacaagtccagatgacatcatctgttgacaaggctgtgagaaaaaagaactatcatatattgttcgtggaagattaaattggtaaaaggattctgaagaataacttggcaatatgtatcaaaattctaaatgcatataccctttgactcagctatctcactctggaaatctaactatacagatacacttgttcacaggtgaaatgatgtatgtacaacatattcactgttgcaacgttagtagtagtaagactggaaacaacycaaaatgtccatcagtagaaaactagtttaataaattaggatacattcatacaatggaatactaagcatcaaaaaaagaggatgcaaacactctgtatgtactaatacaaaaagttctccaagataygttattaaattaaaaagctgggatgtagtatagcgtgtatayatagctgccttttgttaaaggagtgaaagggataagaatatttatattttcttatttgtaagacataaaggtattctggaattacacgcatgaaattaatatatggctacctagaaaattcagggagggtagggaggtcattttgagagtcatcagagaaaagtgagagttttcactgtaataaaaattatgtgaatgtattttctattaaaaacaattaaactaggaaaaagaacaaaaaaaatttggccaagattatagaattgttgacagaactgagataggaatccaggagtgtttggcaacagtcagtgctttccactgggaaaaataaattcataaaatgatattccatcttaaaagattgctgggttaaatgatatttctgactttaggtcttggaggaactgccatactgtcttccacaatggctgaattaatttacattccaccaagagtgtataagtgttcctttctctccatgaccttgccagcatctcttctttcttgacttttcaatcatcgccattctgactggcatgagagggcatctcattgcgtttttctttctttttttgagacggagtctcgctstgtcgcccargctggagtgcartggcgcaatctctgctcactgcaagctccgcctcccrggytcacgccattctcctgcctcagcctcccgagtagctgagactacaggggcccgccaacacaaatacaaaatacaaaaaatataattttttgtatttttagtagagatggggtttcaccgtgttagccaggatggtctcgatctcctgacctcgtgatttgcccgcctcggcctcccaaagtgctgagagtacaggcgtgagccaccgcgcccggcctcattgtggttttgatttgcatttctctcatgawcactgatgttgagctttttaaaatgtgctttttggccgcatgtagttgcttttgcaaactaaggtaataaagagggcaggggaaaagtggttcatgtttctgctcccaaagtatttatcccagtagctacaaaagatgggtgaaggaggttgcttttcagtcagctcagagaattggctagatggtggaagagatagcccaatagcacagaactatgattaacaatgctagtaaatgtttcctggggttggaagttgcttttagggattaagaaatacctttaaaaccaaaaaggctatcatagaataagtgataggacagactttagaaaaattcctagtatcttttcagccagtataggccttttcccagagatatcaaatgtctgctgtagcaataagaatgacaggaagatctaagtagctgcttctaaccagttacctatgacttttatcagtgatgcaggagacaaatcagaagtttccagttttccaactagacagaaaacataaggactttgcaaactacactaagaaatttttagagaactagtatgttagctaatctaagagcagaatgtttaagcacaagggtttccccatcctaccgagatctctatttgagaaagtggtttaatttttttttacttcactttaagaaaatacaggtctcagcatttggataatttctcaaaccaaattggaaaacattataagaaagttatgtacacacagtacgaagatgagtccttcaccaaacatacagtgaatcccaataygaargaagatgggattttgggtcctattatcagagcccaggtcagagacacactcaaagtaagtaacacaaatacagaatcatgggagaaattacatagtaaaatattatggagtacctggttattttttaattttaaaagaaaaagatgctcatataattttaaattcaaatgcaacttttagtttttatttagtatttgtatttatttacagcttrctcagtaatacaaaggatctgagacagtttctcaagttataaaggcataaaacaaggagtctatgtaattgggatagaataygsggacaaagaaaataaagccacagataagtagataccatgtgaccctgtaaggctgtcttcaaattttgtcctaagctttatggcagtcagtgtaaaaaaggaaatatgtcagggtgaagtttacatcatctacaaaaagaaagcaccatttatcctgatgttaagatctaagaggaacttctttaatgagttctacaaaagagagtgctgagtgatacagtagatggcatccttgataaaattcttataaccagcataatagattaaaagttgcataaaataatagattaaaagttgcattaaaatatttctcattatagctaagatataacagtaaacacaattgaatagaaacaatttttactcattttttaatgtagtctaggtatgcagctctctaatggttggactctgatgaaggtaaactccatgtatcaagagcacggagttttcctcagacaattctccttaaatgtcatgtcacttcaccaagatagataagaattggacagcagagaattaaaggttgcaatctttgacaaaatcctagagtgtagwtaatctacagacaaaggatgatccaaaggctttgacaatcaaccaaatagaagataggattaaggttctcttttgcagattaaagagcctaactaggactcctgtgtgttttatgcacctgacaaggtctattctgttcatttaaaatagccaaaggacaaaagcagttttttttctccatgcctctttcccttcttccatttctgatcccttttatgtgctctcagcaagtgtagacataccttattaaaagttcaggatctggctatttgtctgtgcctctcaagcaagtagcttttcccccycaccaagggtcttactctgtcacccaggctggagtgcagtggtgygatcatggctcactgcaacctccacttcctgggctcaggcgattctcgcayctcagcctctcaagtagctgggactacaggcacacgccccaaygcctggctaatttttgtatttttttgtagagatgaggtttcaccatgttgcccaggctggtcttgaactcctgagctcaagtgatccacstgcttcakcctcccaaagtgctggggttacaggtttgagccactgaacctagctgagaagatgacttcaaagacagtgtcctaaaaaatctaccgggcaggggaaggggatcatggtctagagatgagaagcagattcaaaatgagatgtggcccaagctgaaaagagaagggcaggggaaggaggacttgcttggagagagtgatactgtgaggaaaacgtcacttctcctaacctatcctctaaagtcagacttctctttccattttccaccttaatgtgtgagtgaaacactctctccaatgctcctgccaagtgatgaggggaggttactgctcagataaacagatctaattttccyactgtgtgtacacatgtatacacacacaccatccaaaaggtgaatatgcaaagctagtatcttatattatttgtcatgatcaaccttaaatcctagaataaatttgatttaactttgtagatcgtgttcaaaaatatggccagccgcccctatagcatttaccctcatggagtgaccttctcgccttatgaagatgaagtcaaytcttctttcacctcaggtttgaatctttcacttctactgaatccaactagtaacttctgagaggctgccacatttttctgctattctccttgcccggtggtgtcactactgcagtcaggtagtatacatgtaggagtatcctaaaaatcacagccaaacccttctcacttcaggagttttgtctcttagtggtaacaaaatatggtgtcttttattagtgtcatagtggcctctagtggagcattatctaatggctacatgttatccaggttccaagtagaatatttaaagaattcaattgaacaatgagaacatttagacacaggatggggaacatcacacacyggggcctgtcggggggggggggtggggggcggggggagggatagcattaggagatatacctaatgttaatgacaagttaatgggtgcagcacaccaacatgrcacatgtatacatatgtaacaaacctgcaygttgtgcacatgtaccctaraacttaaagtataatttaaaaaaaataaaaataaaagaattccttttgcaatattaattggttccagcgaaagcttatttatttatttattatcatgaaataactttgcaaatgaaaacaattttgaatatattttctttcaggcaggaacaacaccatgatcagagcagttcaaccaggggaaacctatacttataagtggaacatcttagagtttgatgaacccacagaaaatgatgcccagtgcttaacaagaccatactacagtgacgtggacatcatgaragacatcgcctctgggctaataggactacttctaatctgtaagagcagatccctggacaggyraggaatacaggtattttgtccttgaagtaacctttcagaaattctgagaatttcttctggctagaacatgttaggtctcctggctaaataatggggcatttccttcaagagaacagtaattgtcaagtagtcctttttagcaccagtgtgataacatttattcttttttttttttgtcttgtctatttttatcagtaccatcactgccgaaggcaagtctagagtgtgataacatattttgtcttagtttcaaattccaggtctgttggtatyggatgtgttgagcaagttgattagcctttcctaatttcttccttttatcaaatgggtaataaccctcctaaaaatgttacaggtctgtttgggggttcagtgagataccatctggtaaaagtataaagctctttaccagtctttgctatttttagagacctgcaatagggagacagaggagagattctctgaaagcaaccaaatttagagacatagttcctagtgaaattggacccagattatggcccatctctgttgagactaaagtatacagaagaatgtgaacaaagatactgaatttctgagtttgtcttcattgaagaattgtagtctcatattattaaactaaaattcccaattatgctaaactgtaaccaaagaggtcttatctcaaggcatacaaaataaacatatgcctagaaaaagcagaaatgaatttctggacatatggaagatcctgatttattgagctaggaaaggaaacaggtagtagaagcataaggcttttctattgcaaccttctctttcatcctttgcacttattcagagcatattcagtcaatcattcatgttgaaaggtgtgcaattacagagatagacagactttcagctgccatagcgaaatgagatttttcttttgggatttgttttttttttttttttcttttgagacagagtctcactctgtcwcccaggctggagagcagtggcaccattttagatcactgcaacctctgcctcctgggttcaagtgattctcctgcctcagtctcttgagtagctgggattacaggcgcccrccaccacccccatgtaatttttgtattttttagtagagacagggtttcaccatkttgkctaggctggtctygaactcctgacctaaggtgttccacctgcctcagcctcccaaagtgctggtattacaggtgtgagccactstgcccggctcttttgggatattttaatctctgaattttcttatctgttctgtttgcttttgcatattacctttagctctaacaagtgctgtgtacacaatggactctcataaatgcctgaattatatggcttcagtagttccaagaactatgtcactttggtttctgagaactcagtggtgtagataatttgctgcaatgttaatgactgaatacagcacttttttttcttttttttttactcttaagttcaggggtacttatgtgcaggatgtgcaggtttgttacataggtaaacatgtgtcatggaggtctgttgtacttactacttcatcacccaggtattaagcctagtatccaytagttattttttctgatcctctccctctttccaccctccatcctctgataggccccagtatgtattgttcccttctatgtgtccatgtgttctcataatttagctttcacttgtaagtgaaaacatgcagtatgtggttttctgttcttgcgttaacttgcttagaataatggcctccagctccatccatgtccctgcaaaggacataatcttgttctttttgatggtcacatagtattctatggtgtwtatgtaccatattttcttcatccagtctgtcattgatgggcatttgggttgatttcatgtctttgctattgtgaagagtgcgaaaatgaacatacgcatgcatgtgtctttataacagaatgatttatattcctttgggtacataccaagtaatggaattgctgggttcaaaggtatttctgactttaggtctttgaggactcaccatggtatcttccacaatggttgaactaatttacactcccaccaagagtgtataagtgttcctttttctccacaaccttgccaacatctgttagtttttgactttttaataatagccattcttattggtgcgagatggtatctcattgtggttttgatttgcatttctctaatgatcagtgatgttgagcgtttttttcatatgctctttggccacatgtgtgtcttcttttgaaaagtgtctgttcctgtccttggcctactttttaatggggctgtttgtttttttcttgtaaatttaagttccttataaatgctcsatattagacctttgccagatgcatagtttgcaaaaattttctcccattctgaatgttgtctgtttactctcttgatagtttcttttgctgtgcaggagctctttatttcaattaaatcccatttgacaatttttgcttttgttgctattgcttttggcatgttcgtcatgaaagctttgcccatccctatgtcccaaataatattgcctaggttgtcttccagggtttttgtagtttggggttttacgtttaagtgtgttgttgttgttttttgtttgtttgtttctgttatttttgagatggagtctcgttctgttgcccaggctggagtgcagtggyaygatctcagctcactgcaacctctgcctcccatgttcaggtgattctcctgcctcggcccctcggcctcccgagtagctgggattacaggcataagccacgatgcctggctaattttcttttcttttcttttcttttcttttttttttttttttagtagagacgggttttgccatgttgaccagactggtcttcaactcctgacctcaggtgatccacccgccttggcctcccaaagtgctggtattacaggcgtgagccaccgcgccaggcctacatttaagtctttaatccatcttgagttaatttttgtatatgatgtawgaaaggggtccagtttcaattttctgcctacggctagccagttttcccagaaccatttatggaatagagaatcctttccctattgcttgcttttgtcacagatcagatagttgtaggtgcgcagccttatttctgagttctctattctgttccattggtctatgcgtctgttcttgtaccagtactatactgttttktcctccagagggcagcagacatcgaacagcaggctgtgtttgctgtgtttgatgagaacaaaagctggtmccttgaggacaacatcaacaagttttgtgaaaatcctgatgargtgaaacgtgatgaccccaagttttatgaatcaaacatcatgagcagtaagtcagagtactatttttgttcatcagtttttcattcctgtggttgaaatatgactgtgcctagagtcagagacatggattaaaatctactcgctaaggggcacctccaatcctcacttccagtccaaagacttggtgatgaaatccgtgggtgacatcatagcaacatttttaagcaagaggtcaaaggctcacatccttagaaatgcgtttgatcttctattccaagcgtgtgtgtgtgtgtgtgtgtgtgtgtgkacacagacatactctgcgtggtgaggaaaagggtgagrgagtaggactaatggaaggtgttatagtccatgtcaatagtatcctagactgagttcagggtgaatatatggcyaggacagaaasaaggcaagtaatccaaagatggattgacacatcaaagtagagcaaaatgagtatagggacccaagagtcttggaaaggcatgcatgaagacrtttcaagtgatcagtaagatkttcagaacaaaaggaattccctgaatgagggttccggcatttgctgcagttctaaagttcagtggccaaaagcactgccatggcagtctgagagaaatgtcactgagccagctggaagcaaacttctccacaacagccagggtccccctactgatcctcagagtctagagtcatggtaatcaccttctctagtaggtaatcacacatgtgaggatgatttctgcatgttctgttcatatagcttcagatgacygacagctagggattatcagagctgacaggtgccaggtcaaataattcaaacagaaaattactctcagctttctttgcataacttccttttggcagtgaatctatcatagttctagaccagtgctgtccaatagaaactacgtatgagctayatgcgtaatttaaaattttctgatagcaacattaaaaagtaaagagaaataggtgacattaattttagtaatatgttttacttaactcagtatatcctgaatattatcatttcaacatgtaaccaatataaaaattaatgagacttactttattactaagtctttgaaattcaatgtatattttatactcacagcatatctcagtccagtctacccatatttcaagtgctcgataaccacttgtagccagtggctaccatattgaacaatgcagttatagaccatttagaaaaacatctagaatgaggtataaactaataatacatcatgtaaattattaaagtcacttaagtgatttaagtaggtatttaaatatttgttaatgccagtcattatactggtactaaggctaagagtggtaatsgaggtagacatgagcccygcccttgtagaaatcatacctttggttttttactatgcttagtacataagtaaataaaaatattgcctacagcagtgtcccttttaacaataatgaaatgtatgaactggatactcaaatggaaactgtgaatactatgtagattataagacagcaataaaaactataaaatatgctaaatgggctttatttttagggacattacttcttacccaatgactaatatatcaaaaagatgaatttcttatattatgcttttcctccaagtggaattattagaatatctttaaaggcagagaatggagcacaaaatatttactatacatttgaygaatgactaaatcaatgtaaatggaaggctttatctttttcctgagatttctcctttggctaatttaggagaataatctctcatttgaaaattctgagtttgatcttctagtcacatgttagactagataaagcttatcttggataatcactgctttgacacaaccaaattaacatggagacatttatcttaggtataattagacacatgcccttttgttggcatagacttggaattttaacagattttacactttcagctatcaatggctatgtgcctgagagcataactactcttggattctgctttgatgacactgtccagtggcacttcygtagtgtggggacccagaatgaaattttgaccatccacttcactgggcactcattcatctatggaaagaggcatgaggacaccttgacmctcttccccatgcgtggagaatctgtgacggtcacaatggataatgttggtgagtaagagtctggacactcacagaggaagcttgctttgaatttctggtctataaaggtctgctgcaactctccaggctaccagtgctcctctatgtatctccctgaccccctgcaggcttttctttcaatgtttctcatgatttctctttgagaaattaatgacttaaatggatccagttctttagtgtgggttatatttttccttctctgggcaaagtaggaagtaaaaatatacaacagcagaaaaataaggcataactctgaggaagaagcataaatattttggccacaaaagagcatttcttttatcaaaatgccctattcggttttttgcaacagtcatcttcaatcatcaggtacagtgccttaaaggctgcttcagcaacagctttggagtttgtcagactggaatgcaagtcctgatctgccaatcgattgctgtgtaaccttacacaagttacttggccacactgagccacaagtcatttatctggaaaacagtgtaatcacatctcacagagttactttgaccattaaaatagtaatatgygccaagtgcctagcactcagtagacaccaacaatggtaactattggagactcaccaagaaatctttratgttccagcaatgcatgccatttcagagattcaaaattgtcctcgtgaattattacttagaaacatctaaatgtctcttatttgtggggatagagctcatcaccatccctttaattctaagacaagatgtgctgttaggatatttatgatattaaaagtccattttattcttgattcatccctttcttaatatattttaaaatagtgagcaactatctgtgctgaaagaccttttttcccctctaatctccactaagcaacacttttgttttttattctgttaagcgagatgaacgcactggtcatgtgcttagagtcacagcaatgtcaaattgctttagaaaaacaaaagtttactaaatatttcattctcatttttctctccttrtgttattttgacccagtaatcaatagktcacagacaagcagtggtccacagcccatacttgaatattcctgacgaaagtttattagaaattacctgccacaatggattattgtgttttcatgtcttttcccagacttccagatctctcttctgtctgtctctcttctgtaggaacttggatgttaacttccatgaattctagtccaagaagcaaaaagctgaggctgaaattcagggatgttaaatgtatcccagatgatgatgaagactcatatgagatttttgaacctccagaatctacagtcatggctacacggaaaatgcatgatcgtttagaacctgaagatgaagagagtgatgctgactatgattaccagaacagactggctgcagcattaggaatyaggtcattcygaaactcatcattgaaycaggaagaagaagagttcaatcttactgccctagctctggagaatggcactgarttcgtttcttcraacacagatataattgttggttcaaattattcttccccaagtaatattagtaagttcactgtcaataaccttgcagaacctcagaaagccccttctcacyaacaagccaccacagctggttccycactgagacacctcattggcaagamctcagttctcaattcttccacagcagagcattccagcccatattctgaagaccctatagaggatcctctacagccagatgtcacagggatacgtctactttcacttggtgctggagaattcaraagtcaagaacatgctaagcrtaagggacccaaggtagaaagagatcaagcagcaaagcacaggttctcctggatgaaattactagcacataaagttgggagacacctaagccaagacactggttctccttccggaatgaggccctgggaggaccttcctagccaagacactggttctccttccagaatgaggccctggraggaccctcctagtgatctgttactcttaaaacaaagtaactcatctaagattttggttgggagatggcatttggcttctgagaaaggtagctatgaaataatccaagatactgatgaagacacagctgttarcaattggctgatcagcccccagaatgcctcacgtgcttggggagaaagcacccctcttgccaacaagcctggaaagcagagtggccacccaaagtttcctagagttagacataaatctctacaagtaagacaggatggaggaaagagtagactgaagaaaagccagtttctcattaagacacgaaaaaagaaaaaagagaagcacacacaccatgctcctttatctccgaggacctttcaccctctaagaagtgaagcctacaacacattttcagaaagaagacttaagcattcgttggtgcttcataaatccaatgaaacatctcttcccacagacctcaatcagacrttgccctctatggattttggctggatagcctcacttcctgaccataatcagaattcctcaaatgacactggtcaggcaagctgtcctccaggtctttatcagacagtgcccccagaggaacactatcaaacattccccattcaagaccctgatcaaatgcactctacttcagaccccagtcasagatcctcttctccagagctcagtgaaatgcttgagtatgacygaagtcacaagtccttccccacagatataagtcaaatgtccccttcctcagaacatgaagtctggcagacagtcatctctccagacctcagccaggtgacyctctctccagaactcagccagacaaacctctctccagacctcagccacacgactctctctccagaactcattcagagaaacctttccccagccctcggtcagatgcccatttctccagacctcagccatacaaccctttctccagacctcagccatacaaccctttctttagacctcagccagacaaacctctctccagaactcagtcagacaaacctttcyccagccctcggtcagatgcccctttctccagacctcagccatacaaccmtttctctagacttcagccagacaaacctctctccagaactcagccatatgactctctctccagaactcagtcagacaaacctttccccagccctcggtcagatgcccatttctccagacctcagccrtacaaccctttctctagacttcagccagacaaacctctctccagaactcagtcaaacaaacctttccccagccctcggtcagatgcccctttctccagaccccagccatacaacyctttctctagacctcagccagacaaacctctctccagaactcagtcagacaaacctttccccagacctcagtgagatgcccctctttgcagatctcagtcaaattccccttaccccagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagmggtccagagcagtgaagatgactatgctgaaattgattatgtgccctatgatgacccctacaaaactgatgttaggacaaacatcaactcctccagagatcctgacaacattgcagcatggtacctccgcagcaacaatggaaacagaagaaattattacattgctgctgaagaaatatcctgggattattcagaatttgtacaaaggtttggccagttttctccttttttattctcatttttccattactgctgmaaaaagtagctactacaattcagggggataattgtgggcaaattatactaagaacagtgtggttcccctattgcaagttggcctgttctttttcctttgtcaattccaagattgcttctttaccttagatgacccctggacaatataagaacaatcactgtgagaactctataatattctgtaattaagcatttttctgtgtcctctcctcttactacccatgtttctactgactcttattgctccaggcagagcccaacctatccatagctatatgctaatcaatatgatttaattgaagttagcctcaaatccaaactcaaatatgatgtagaaatctcctttttgcatttacttgtttagatcagaatttctaagagatccaaatcccttttttaaaagaatatttacaattcagttttgcttasgggtagaaagccatgttgaactgggctctttgttctgggatgaagatacagaaagagaagagagaggaggaaaggagcaaggcttagtcaactacaaattctcagggatatagcatgatgactgtgcatcagctgtctagatatgcccacagcttttactaaagctgttacactaatcacttaaaaaaccaaagtgtaattacagtaggcaaacacaatgtatggtgtgacttatgcatatgagttcattaatctgatgcctgacatctccacattagaactctgtttaaaacaccttttcctatgacttcctatwtaaatgttgcactcaataccacatgagaacaactagctacctgagtatttctaagcaaggccccgagggagtgagatgcagggcctgtccagagtgaatagggatggaaccaccttcaaaatcttgtattccattcaaggctcacaacccacttttatggcaktcggagttgctttacccactcccttgtgttctgtgagtttgcatgttatgctcagagtctggaaagatgggattagtaggggaggtagaccagaagaaaggcagaaggagattctctgttgatgactcacagtatatagcaaatattatgggtttgatgggtgagtgtttggcttgtttccacaggcttgggaaatgtgagagtcagtgggagaattcgacatgcttcagtcctagactgagccaatgaactagatggaaataatgtgctttatttatttatttataatttgtaattaaactttttattttggaacaaaaataaaatagattcacatacagtcaagagaaataatacggagagatcctttgggtatcctgagtattctttacccagtttctcccaggggtaacattttgcaaatctataatactatatcacaaccagcacactgatgttgatactgtcaagacacagaatgttcaccatcaccataaaaatccctctcattacccctttatagtcacatctgccttcctcccaccatagcccttccttattccctggcaaccagtagtctgatctccatttctrtaattttgtcatttcaagaatattacataaatggaatcaggcaacatgtaacctttggggactggtattttttcactcagtataattctctggagattcatctggttattgcatgtattccattatatgggtgtaccmcagtttttttgttgttgttgttttatacacatttatggtgtaaacatgatgttttaatatatttataaattgtgaattggctaaatcaagctaattaacctatgcattacctcacatacttttttgtggttagaacacttaaaatgtactcagcaatgttaaaaattcagtgtgttgttattaactacagtcaccatcttatacaacagatcttctaaatttatttcttctaactgaattttatcttttgaccattttctcaatgctccacctctgtatccctttgttaaccactgttctaccttctgcttctatgagctcaatgtttttagtttccacattataagtgagatcctgcagtacttgtctttctgtgcctggcttattttatgtaacataacgacctcctggttcagtcatgttgtcacaaatggcatttcttcgttttcttttttttaaatgctaaatagtatttcattgtttatgtagatcacatttaagaaatccattcatttgtttatagacatttgggttgcttccctatcttggctaatgtggctaatgctgcagtgaacgtgggacagcagatatctcttcaacatactgatttcattttctttgggtatatacccaaaagtgggattgatggatcatgtggtaattctatttttaatttttaaaggaacctcccatactgttttccataatggctgtactaatttacactctcaccaagagtatacaagagttcccttttcttcacatccwtgccaacatttatctcttgtcatttttataatagccatcctaacggtgtgaggtgagccctcattgtgattttaaattgcatttctctgattattagtaatgttgagcatcttttcatatatttgttggtcatttgtatgtcttcttttacgaaatgtctattcaagtcttttgctcattttttaatcaggctatttgggttttttgctgaattgagttccttatatttttaatattaatattcttatcagatatctggttttcaagaatattctcccattccaaaggttgtctcttcactctgttatttcctttgctgtgcataaacttttgagtttgatggcaatcccatttgtctatttctgcttttgttgcctgtactttcgaggtcaaatccaaaaaatctttgtccacaccaatgtcaagaagcttaagaataatggacattagcaaaaaacaaatgtgagaagagtggctacttttagggtacaaaacattcacccatccagtgactttcataagtgtgaccttctaattaatctgaccattgtcacctgatagccccaagctctggcactgtcccattacatggctttgtctgcctttgatcttaaaatttggtgtgttaacatacgattatatttatacattcatttatatgtttgacaaaaatttattaagttcctgctgtgtgtcagataatgtgcttaccactggagagagtactatgagcaaactaggcacaatggctgacctcatggcacttatacccagtgagagacagatattaatagataatctcacaaataaattatatataatctacaatatataytctagagatattataagaatactacaggaatttactatatatactataataatactatagaaatatgagaaattgatatagagacttgacctagtctaaaaggtcataggaagacttacctataaaataatatttgagttaggaattgaaagatatttactggcttttgtttttatccacttatatatttactcatttatccaccaagtatttattaaagaccttctctatgctagatgctatatttagaaagagacaatttcctaaattctgggaacagtctttaatttcttcttttacacaaatagtattattatttcagggaaacagatattgaagactctgatgatattccagaagataccacatataagaaagtagtttttcgaaagtacctcgacagcacttttaccaaacgtgatcctcgaggggagtatgaagagcatctcggaattcttggtcctattatcagagctgaagtggatgatgttatccaagtaagtcttttgagcactgctaagatcttcggaggaatttccacaagcaccagagggttgtaaaggtgcaggtggcaagagagctataggtgatttgtttgttttccaggattaatgaataattacatttcttttcaaagactccttgccaagcaatttggcaatcttcgaactaaaaaaaaaaaagatctcattttttaaatgctgaaaactatataatctgtggaaaatctttctgtaatttctatctaaagctaacctatctaaagttaacacagaaaattaatatattcaagagcaattgaattgggtttcatagcagtggtggtggtggtggcagtagcagtgctagtagtaatagtaatttagaaatatcttcaggtgttttcctaaaaattaaataaaatgaagttaaataaaatgagtaaggaaagtaaagatgtctccatgccctccaaaagtgagcaagtttcttcagtgtcttcctagttctggtaatttctttcaaaatcttgtgtccagacccacgattataacttgcttttataacaaagtttacttccgccatttttgctaaccgctcacrttcaaaaacccagaaagaaccctgattctaaagtaagctattctagattttaaaatataatctactatacctgtgtaagcattcactacattttcagtgaccatttgctctttttaaaaacgtaaacaagtacatagggatataagaatcttaattattctaaattttccatgaagctatgggaggcaatattctcttttatgattaggggatcctttttcaagatgaacgataatttaacacaatatttaaaaaacttattctaagtaactcaggaatcaaaaaccagacactgtatgttctcacttacaaatgggagataaactgcrggtatgcgaaggcagacagattggtataatggacattggagactcaaaagggaacgggggatggatgaaaagctacctattgggtacagggtacactactcaggtgacaggtacactaaaatcctagacttcaccactmtacaattcatccatgtaaccaaaaaccacttgcattcctaaagcaactgaagttttttaaaaaatttaaaaatcaaaattaatgcacgaaagccacaataaacaaaacctcacaattgtgaataaagacaggataagtaacaatgttgcattgagacatactggagccttaggcaaaaggaaaaaaatcaaatactgaatctttgttttagccctggatttcactagataaaaatgacttcatttgtgtatttttaaaataattttaacttttattttagattcagggggcatatgtgcagttttgttatctgggtatattatgtgatgctgttgtttagggtatgattgatcccatcatccaagtagcgtgcatagtacccaatagtttttcatcccttgctcatctccttccttcccccttctagaagtccccagtgtttattgccatctttatgttcatgagtacccaatrtttagctcccacttataagtgagaacatgtggtatttggctttctgtttctgcattaattcacttagcataatagcctccagctggcatccatgttgttgcaaaggacgtgatttcagtctttgttatggctgcgtagtattccatggtgcatatgtaccatattttctttatgtagtccaccactgatgggcacctagattgattccatgtctttgctactgtgaataatgctgtgatgaacatcctagtacatgtgtcttttcagtagaacaatgtattttctgtctttctttcttttttttttttttgagayggagtctcactctgtcgcccaggctggagtacagaggtatgatctcaactcactgcaacctctgcctcccaggttcaagcaattctcctgcctcagcctccygagtarstgggattacagscacccrccrccahgcccrgcyaatttttgtatttytartagagacrrggtttyaccatgttggccrggstggtctcaaactcctgacctcgggcaatctgcctgcctcagcttcccaaagtgctgggattacaggcrtgagccattgcgcccggctgaacaatktattttcttttttggctatatacccagtaatagaattgctaggtcaaattgtagcaggacaagccacagacaaaaacccctcagacaccaagttaaagaaggaagggctttattcagccgggagcttyggcaagactcatgtctccaacaaccgagctccccgagtgagcaattcctgtcccttttaagggctcacaactctaagagggtccacgtgagtgggtcgtgattgattgagcaaggagggggtacgtgactgggggctgcatgcaccagtaattagaacagaacagaacaggacagggattttcacagtgcttttctatacaatgtctgtaatctatagataacataaccgattaggtcacgggtmgatctttaactaccaggtccrkggtgtggcgccgggctgtctgcttgtggatttcatttctgccttttagtttttactwcttctttctttggaggcagaaattgggcataagacaatatgaggggtggtctcctcccttaaaatagtagttctgtttcaaattctttgagaaacccccaaacttctttccacagtggctaatttacattctaagcagcagtgtataagcattcccttttcttcacagcctcaccagcatctattttttgactttgtactaatagccattctgactggtgtgagatggtatttcactgtggtattgatttgcatttctctgatgattagtgatgttgagcatttttttcacatttgttggctatttgtatgtcttcttttgataagtatctgttcatgtcttttgcccactttttaatggggttatttgtatttcgcttgttcaattgtttaactatcttatagtttctggatattagacctttgtcagatacatactttgtgaatattttttctattctgtgtctgttcactctgtagatagcttcttttgctgagcagaagctctttagtttaatttgtcaatttttgcttttgttgaaatgcttttgaggaattagtcataaattctttcccaaggctgatatccagaatggtgtttcctaggtttttcttctaggattcttatagtttgaggtctgacatttaaatctttaatccattttgagttaatttttgtatatgatgaatccagtttcattggattcattggggttcagtttcattcttccacatatgggtagccggctattccagcaccayttattaaatatgagtccttttccccttgttttttgttgttgttgttgctgttgttgttgactttgtcaaagttcaggtggttgtaagtgtgtggctttatttctgggttctttattctgtttcattggcctatgtgtctgtttttgtatcagtaccatgctattttggttattgtaactttatagtatagtttcaagtcaggtactgtgatacctccagatttgttctttttgcttaggattgctttggctattcaggctcttttttgattccatatgaattttagaatagctttgtctaatcctgaggaaaatgattccagtagttgttaaaaaatagtgttgaatctgtagattgctttgggcacaatrgctattttaacaatactgattcttccaatacataagcatagaatgtttttccatttgtttgtgtcatctatgatttctttcatcagtgttttgtaattcttcttatagagatctttcacctctttggttagatgttttcctaggtattttgtatgtgtgtgtggctatgtttaatgggatttcgttcttgatttcgctctcagtttgaacattactgatgtatagaaatgctattttgtacatttgtacattttattttgtataattgattttgtacattaatcttgcatcctgaaactttactgaagtcatttatcagttcctggagccttttcatggagtctttagggttttctaggtacagaatcatattgccaatgaagagagatactttaacttcttttcttctttggttgccttttatttctttctcttgcttgattgctgtgactagaatttccagtactatgttgaataagagtgatgagattgggcatccatgtcttgttccagttctcacggggaaggctttcagcttttgctcattcagtatgatgttggctgtaggtttgtcatagatggctcctattagtttgaagtatgttccttcaatgcctagtttgttgagggtttttatcatgaagggatgttaggttttatcaaaagctttttccacatttattgagatgatgatactgtttttgtttttaatgcggtttatgtggtgaatcacatttattgatttgcatatgtggagccactttgcatcctaggaatgaagcctatgtgattgtgatgaattaatttttaatttgctgctggatttggtttgccaatattttgttgaagatttttgtgtctatgtacatcagagatattggccggtagttttcattattcattgtgtctttgccaggttttgttattagggtgatgctggctttgtagaataaaataaggaacagacaattagggagtctttaatcactagaagttatagaagggctgggaggagcttcatgggtctgactgctggggtgtgaagacttctcatatggcatttaagtcctttaccatctggccccaacctgctccttttctascctcatttctcaccaggttccacctgtccctgtgcatttcacagcccagttccaccgagatccttgctattccccaaactcttcctttactcccctgctcacaggcatccttctgcccttctgagagtctgaaatgtctttctagctcctgttcattctatgatggccaattccatttcctctaagaaacttaccttaattcttccaaccactcctaaatattcaaccaaattgttcctccagggcattgtcatctgaacccacttagactttgtatatagcacctgttgtctccagatttgtagtgtggatgcccatgtgcatgtctgtttcagcagtagcttaaaagcttcttatgaacaagaatcaagcttctttcatcttcacatctccactacctatcactctcatttcattagtagataatgtcagtactttagccttgagcctaagaacaaatatcttttggtatttctggagaaaactacttgggccatatctcacaggatggttatgaaaattaaatgaaataatatacataagttattttgtaccttatatcttagctccgattttataaccagccattttgacttataatgctgacatttttgtggtttagatttttgttaagcttaagtacatttgtggatcattccttttcctaggttcgttttaaaaatttagcatccagaccgtattctctacatgcccatggrctttcctatgaaaaatcatcagagggaaagasttatgaagatgactctcctgaatggtttaaggaagataatgctgttcagccaaatagcagttatacctacgtatggcatgccactgagcgatcagggccagaaagtcctggctctgcctgtcgggcttgggcctrctactcagctgtgaacccagtaggtactttcattgaaagtttttctcattcccctaacctcgtaatctgaagtccaccaaatggaagagtcrgggttatttcttgtcaaatgtctgtcttgcttttcatgaggaatgcataagggtgtggttaacagtctgcatttatcataaccagggactctccatgcagctcttcagatgacagagagagaaacatttattcagtggagaggaggaaagattacttgaatgattggccatgaattagaatgcctacatttacagaagatggcatttatttgaaattttcttgaacaagtattagctatgttctgctctttctttrtgaaaagaactgcaaagtcaagactcctttatctgwcattctgcaatgtatatatacttcaaaacaatatgtcatacacagtatatgcatacaattttatctgtcaattaaaaagagaaacaactcctccatttcaggcatagtggaaagagcacagactcagatttaaatttttaccctgtcaatgcataatcctaggaaattccttgacctctcttagcctggtatcagaagttaaaaatgagataacagtacatagtgcatggtaagcacttggtaaatatttgttcaatgaatgaatttatatttaccakataagatagttgtcaggattaaatgggagattgcaggcaaatcatttaatatagtaatagattctcaataaatagtatcccttatattatcaatttattattatcatcattgttactgggataaagatcaatcagaggaaggaggattatgaatacaacagaattaggtgataaatatccaggcttattaygccattcatttataatcttcatcttcaaattcagagcctatcagaaagtttccttttctatatgatgagtgattatcagaagagcaaggaaattcctgagaaagaggcaatacaatttactctgtttttccaggaaaaagatattcactcaggcttgataggtcccctcstaatctgccaaaaaggaatactacataaggacagcaacatgcctrtggacatgagagaatttgtcttactatttatgacctttgatgaaaagaagagctggtactatgaaaagaagtcccgaagttcttggagactcacatcctcagaaatgaaaaaatcccatgagtttcacggtattttcctyrgactttgatctaatctcctaattaaatcacactgggtcacagtgatttctgcccttagatattcacaagattagacatgagatgcttctgagacacccagagctacaactaaaaccggttccttaacattccagagggctgatgtaatctggcaggtgacactgtgggtgaggcaaaaagagaaagtctgaaagatagcacagagaagctgctgcaaaacaaaccaacagaaaaccacaacaacaaaaagccagtgtgcttcagctggtaacatacattgaaaaggaattaacattgttctgcaatttaaagttaataagcttgtttctggatctctaaaggcacaagtgtttatataaaagaaatgatcacctgtgtgtcttttctaaaataagaatgacgctaacagttttagctctcagcagctaccaggtggcacccaaagcatatgagaacaaaatgagataagaaactaggtacccaggtaataggagaatagtggcaagagagcatttgggtggtcacactgggaaaagtgtgcctatttggaaattcacaaggaaaatttgccctgtaagctagtaactgaaacagaaactgagaagagaaaggtacgagcttgtgttatgaatatgtagataggtgttctcacrcctgatataatttgaaggatgcccaaatgatctcaacccgtccctctccaaaaattcacctgcctggtttctgaaatttcacagcagttcctctaacttaagaaggaggaaacaaagcacttccytcactttggtttcagttaaacgtttggtaacactaaactttatctttacagttttgtgttacatttttaaggtgatcaagtttctcaggaactttttaaaaaatccgcgtattttactgtggggagagtagataaagcctgagaaccctagttatctaatctgagaagtgggcagaggagttgtcataccaataagagaataaacatgacttgctatggttgctggatacaccaaygataaactcctaattttataaactcctagacttcctaatttgcctgaaactttctctgaatttagaaggccttaaggtgacatgctgcatatctccttgctgactctaatccctggagtttactttgtctgcccatatttgtatttatcttttgtagttaaggaaaattaagactgttaatggaaagtatacacgggtaaagcacggaactgtaaaagctgaggaaaagagtgataaactgcttggaaagggagttccccctgccttctgctgtaggctggtgtgaatgatatgagaaggactagtggttctgctttagcctctcactaatgtgacatacaagagggccctttccatggctaggtaggcctgggaatgcagaatcatgaggaacatgggtgttgagtgggttgccccatatttccttaccactcgccctctctgtgtcaacagatttttaattgatttcaactctttgtcctttcagccattaatgggatgatctacagcttgcctggcctgaaaatrtatgagcaagagtgggtgaggttacacctgctgaacataggcggctcccaagacattcacgtggttcactttcacggccagaccttgctggaaaatggcaataaacagcaccagttaggggtctggccccttctgcctggtaaagattgggtaatgggaagaggtccctgctaagaaatacagggaaaaggcaatctgtaactccttctcatttcttccttgtgcatatacttcctaaggggtcagaacacagggttctggcatagagcctaggcaaacccatagacccaaagtatatacggagtacaaaaatgtcacctaatttatgaactatttgcagcaccacacaggctaaatgtgtgacccaactcagttgcaacataacatgcagtttctcccaagccactgtrtgtcatacagatgaggtcttaagcagatgaaaaaatgaatcccacagggctcaggcagctacagctatctctgctgggagggtttccagattcttcagttctgctcctcttctaggccctatcaccctaatatctttgggcaagtgactccaggaatcacattcttaaactgacttatagactgtttgaagaggaaaacatttttaaaaaataataataaaagttaaagaataacaaaggtatttagaacttttcatgtgcaaaataaagataaatgtagatttaaacagtctacaattatacagaagggatgtttctgtgccaatgagttgtttgtaagtgtatctacttgtgcagcagtataaaaacctaggaagtcagttaaaatgcagatgtgaaggcagagggattttgttctcagagactttaaagtagattttgggcagaattccaaggagtctgtatttttaacaagcagccttccttctattttgccttctattaaaagtaatggcaaaaaccgcaattatagtttgcaccaacctaacacatgctgcctgaggagttagtgaaggcagcccctcgacagcactttgggtgacgttgtgtgaatctgcctcagatgcagrcacagaagtccaaatggactggtttgattaagagcagggaaaaaaagagggttcttattggtttttcacatgccagtaactcactaatacatctagagagtattaattgtattatattaatatcatattaattaattaatataataattaatagataatttattgtattaaaatcagagacagaagagattcagtcaaatttactcatcttttcatcaagtattagaagatcagtcatccttcctatcagcctgcagacagactgagaagctaggattggctggtgtctctaaatctgcaaacctaaatacctgcattggagagaggaaaactggagacatttttcagtgtgtttgaggaagataatcatatctattcattttcacccacaatctgggaaacagtcataaattatagtcaacagaatttaaatattaactgccagggggtaatgttaaataccagaatggatagccagaggttttagaaatctcattctttcagtgttttttctgagcaatttatgtaaatctctattcaaatatgtaagctttatggaaaacttgaaaacatggaggaagaaggttttatttttattttcttatataaaaaagagaaaaaagcaaaaatgaaaagagggaaaggaaacatgtatgatatttttgaagcccaatgatgtcattcgaggtcactttgataattaggactgtgaagctgtattgtatgtgagttaatttgtaacattatatttagataagtgaaagtttcttctagtgaggtgtggtggtgatttaaaattttttttagttatctctgtgtatgtgttgttattgttttgtttttatctgttatactttcagtcctacctaaagaaaaatggttaaattctatttgaaagcctcttgtgaagcaggaattttaggattcttagagaactatcaaccacaatatttacttgttaatttttgcaaatgtaatgttgttctttttattttaggttcatttaaaactcttgaaatgaaggcatcaaaacctggctggtggctcctaaacacagaggttggagaaaaccagagagcagggatgcaaacgccatttcttatcatggacagaggtatcacaagagccatgtgatatttggtttggcaggagagtgcctattactagaatattaccaacttttagattggaaatattcaactctaagaactctgatgtgacaaaggcataatttgtagccataattgctttyattccggcccatggtctgattgcattgaaaacacatcagtcagatcaaaagcattcctgtcaattgggaaacctgtgtaaagcatccttcttcatgacttgtgatccatggacaagtgcatataagaaattttccagcttccaagagttgaggagggaaaaggtcacaggaatttaacaatgactgagtcacyaaacttgacatttcagcatttaggaaacacagttttcatctgtccatctgttcatccattctttaagccattactaagcactgttgagtatgaagcactgtgccaacatccaggtagcacagtggctggtatcccttccttgatcaagatataaataaccttgtaactttgaggtcaacttttgagaacatagtctcatcaggactagaactttttttcatatttttatattttgtatttttattttttttgtagagaagaggttgcccaagatcaaactcctggcctcaagtaatcctcccccctyrgcctcccagagtgctaggattacaggcatgagccactgcacctggccatggatggtacctaatgttgtaaaatagcataatttaagataaaagcagragaaaatcagtttaaaaartgattacatttcaggatttcagttgctttcttctaggatgccactatatctattaaagcaccagtcttgttagtgcatttaccattttataatcagatatatttaagtcagggccacacaaggtaggtaaaaatatctaattattgagtcagaaacataatccctaaccatggagttttactttattrtatatattttrtaagcaaaaattattcattttttttctgtttttcatagactgtaggatgccaatgggactaagcactggtatcatatctgattcacagatcaaggcttcagagtttctgggtaagttgtagcaccatggtctgtgaatggtaccccctacagttgtgcagcatgcagcctatgaaaccatacatgacaatcctatctatgaatcagtttttctctttatgcttttctctackacaatgtagtgaagcagctccatttggggtacatatatggtaaaggaaggaacactayggtaggagctaaaggcctgttagtgtgctcttaacactgccacctcttctggtgtataatgatcccaaagagtcttttccaggaaaaaccgatagctgggggtcattgatttctctacataaaaagcccagcctctctgcagggatttggcaaggatcagataccttastcttatgaccacgcgcccatttccaaaactctcctcagtcatcttttctgggtttgaccacacatgtagtatttcagccagattcacagggtcttatcagccaggcattatagtccccattaatatggccctttgcctgtggcaaccattcatctattcagaaaactttgttgaacctccactatatgtgaggaactcctccaaagttttcccacactgcctcaaagcccttcccaagatcaagaggtcatgatcaagaggatgatgaggctcccatatacccttccatgtcttcctgttaggcaggcacattcagcattaggaatataaacacaacagaaaaaatcaaacatgacctgtgtgcaagaaaggggataggaggtggttggcagttgaccaaacacagacctgaagcccagatttcatcatcaaggactggcctagtagctgaggcccatgcctagactcctgactacaacacaggtcctccaaggatctggttttccactggattaaactcacttgagaaattgctgggtttttaaaaaattcagaataaatctttttcttcccttgagtttaggttactgggagcccagattagcaagattaaacaatggtggatcttataatgcttggagtgtagaaaaacttgcagcagaatttgcctctaaaccttggatccaggtttgtcttaatagactgataatatttactgctatcgtaataataaaaatgaaagtgatttagtaattccttgttattgttcttgcaatgttgttaggggaaatagcaagtactaagtgtgaggcactgttctaagtactttatatccttaaaatcaaccctctgaggttggttctaataatatcttgttttatagattaaaaaacaaaaggcacagagatactacctaccttcccaaagtaacacacagctaattagtcattgagttgggattcaaatttaggtactctgtgcccaaatatgaattgcatgtagtcattgtatcagtttgctaagatcttatgtgctagctctttagttctraagaaagctgattgtataatgaatttaggcagtgtgtgacttgttgacaaggacagttctgtttactggctttcctatattgcaggtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatggtttgtgtgcatatttctatctgaatctctagactctagacttggcctagaattattatgactatacctaatgattatgtattttaaaaaatacctttctgggtattagaaatgtgaatggctttctaagggtcatatggagaaaagcagtaatatgataggtctgtgtcttacaaattaaagagagaagcagggttactgaaacttcaaaaccccacaaaactttaaaaaatcattttatcatcaaacaaaatacccagatttctcagactggccaatggtatacggcagagtagaacatctggtcttgcrcctcaaggagctcatgctaaaaattggctaccaagacttttgattttactattgtagtttgttttgttctttatttcagtgtacctgaagtaaatagtagtgttaatgctagtaagcctctgaggcagtgtgattctcagactttttggggggccatgcctgaggaatgacattctccttctggttcttccaggggctcagccataagccctaactcttctcctcctctctattcccttccccaaagaagtctgaatgcaaggagtctgcctgccattattataccaataaccttgagtctgtttctgcttatattttatataaaattatttactgtttattagttacctatttttaataattatttatactatgtctcagaaccattgaaatcctaaattatggttcttactaatcagtattatgagagaaaacacagattgcagttgagtccatagcataaagattttgtcgtctatgttcatgagaggatattggtatatagttttatttttttaattgtctttttctgtttttgataccacagttatactagctttcataaaaytggtaagcatgctcttttctacattctaggagaaaatgtctgcaattggtaataattctttaaatatttggtaggaatcactagtgaaaccatctgggcctgcagatttctttttgggcagtttttaaattacagatcctatgttctaaatagttacagggctattaaaattatctatgtcatattgggtgaattgaaatactttgtatatttcaattaactggtcaattccctctacgttgttaagtttatatgtgtagagttgtttgtatattcccttatcctttttcatgtttgtagtgattttgcctgtttcatctctgatattgtcatctgcccctcctttcttttttgtgtgaatcttgctagagatttgtcgattttaaaaaaatcttcttggccgggcgcagtggctcacgtctgtaatcccagcactttgggaggccgaggtgggcrgatcacgaggtcaagagatcaagaccatcctgaccaacatggtgaaaccccctctctactaaaaatattaaaaaaaattaggcagggtggcgtgcacttgtaatcccagctacttgggaggctgaggcaggagtatcgcttgaatccggaaggcagaggttgcagtgagccgagatcacgccactgcactccagcctggtgacggagtgagactccgtctcaaaaacaaaaaaaaaaaaaaaatcttttcacagaaccagccttgttttattgatttttctctattgtttttctgttttcagtattaccgatacctgctccaatcttctgttttaaaaagttggctttttctgacattgctctgtcaggaaaaggggtagggcacagcctgtttactgccaagtgggggtcaaagtccaggttccccactccattgccacctaagaagggattgttccttggtggctgggtgggaagggaagttccccatttggcmtccactgatactgcaggggcaggagcttcattaggggctggagatgaaagccctaaatccctacatggccttttctgacacaaccccagtgagggtgtagggtgcctctttagcctcaggagcatagaagtctaggctccccattcagcctttgctgttgtgggttggggaggggcctcaggtttttctgtggtgtttggctaaaggasagaagtcagtgtccaccagttttctatcatatctcgctatgctgccctttactggtactttggttagagaaagcagattttatttgggctttttcagtctgtactcattggtgtttccaggttgccggcttcttcatctctaagtctgggatttatgaggcaaaaagaaaattcaagacactgatcaccattttgttccttccgagaaccctagccagtctgtcttctgagctcttttcagggtcttatgtttctctgagctataatgtccaaagtttttagttgtacttagcaggaggaatagggcaaagtacatatatacaatcttcctggaactggaattatccccaagtatattttataaccaaattgatttagtttggaccccatgaaaatgtagtattacaatattaaattagatcaaaattttaatataaagtcacttyatagatcattgttacataactaaactttcctcttttcttctagtattttaatggcaattcagatgcctctacaataaaagagaatcagtttgacccacctattgtggctagatatattaggatctctccaactcgagcctataacagacctacccttcgattggaactgcaaggttgtgaggtaaatggtaaggtacaaagatgcattattttctcactgccactcaaagaatcaagatttgggaggtataggagaatgagtagaatttttagttcttttcagtgacttaggctcctaggaaaacctttgtgaaacagaggttctactcaggtaaactctcagtgtgatctagaccaagartggttctgccaatcagagtgccgacagcatctctgtgaagaaagtgcctggattatatagacacatcacaacyctccaaggaagggctctaatttggaattacctccatcagcccattttcaataagacctacctgagattcaaactaggcctgactcttccaaagtcctcaggtcactcaaacttcaatgtcatgacagtatctggcaacatcactgccatatatrtggtgttcaatgagtgtttttgaaatctgaattggcttcccaacttcctgaaaccacaattcttctttatattttctttcataccctgtgtaggtactcaagtcttttctatgttagctgctatttctcaggggctgtaatgtgacctgtggtataaataaatccaggtaatcataaatggtcataataaaattctactatatatagcaaggatgtttaagagtcttaactgttcttcttggactcttaaagcagtgctttccaatattttttacttcaaagcacacaaagaaaataatatctgcctggcattctgaggtaaaagaatgaagcawtaaatctaaggcttggctgatccaggccccacttggctgctgaagggctggaggtgggaagagggatcaataaataggtgcactagaaacctgccrtgrcacacctgtcaggagttgcagtacttccctttgggtggagagaagccaccatgattcacaatggagaaagtagctgaaacctggaatcagtttcctgttgaagcagataatggcacagtatacccttggatggatatgggtattttgccaatgtccagatagcagtagtctaaaacatctcccaaataaaacacagatcttgtatcggcaggaccactccttgaaacagttccataagtcattgcgtttttttctttccatatggtataaatagatttgttcagatcctaataaactaccctaaaatgtgacattcaattctgctaacttatttaaaacatctattttttatacaagaagcattattttcttcttattcattttcttgatacttaggtaattattagcagtgggtattatttttaggaccctttgtttttttcatggagaaagtaaggcatcacttcaagaaaatttctgcatgatttaccaacaagaacaaagtgtcacagagatgatgggtggtcagccaggttcactcactagctgtgtttcttacagtcacaggtctgccttgctgcctatgatattcaaattacaccttggaaaaattccaaagggtacataactcgaattaccctctaagggttgaaacagaaaatattaaatagtgactgagggtccattgtatcttcttggtagcttttgttagaagaaacagagtatttttatatatagataatttaggattattgtcacctgaaagcaaagaccaaagtttccaagactctcagaaggaggaagtgagtttaaatgtttagaacatggtatttggtatcagattgtctgaactcaattcagtttctgattcttgtggctgtgttaccttagacaagttactgtgttttggctgtactaaaatggagatatttatgagcattatataatacatgtaaagcctgagaacagtatttggcacttggattcaataaatcttcattgttgtggttattgtttttgtcatttgttggtagtaatattatttcttatctcctctgcagtgcatgaagccatgcagggaatattggtgtgtaattaatcamgttacttttcttttgataggatgttccacacccctgggtatggaaaatggaaagatagaaaacaagcaaatcacagcttcttcgtttaagaaatcttggtggggagattactgggaacccttccgtgccyrtctraatgcccagggacgtgtgaatgcctggcaagccaaggtcaagtatactctatgcatggtgttctcttagggctccagaagaaagcaaaggccctcactaccacaaacatggaggatctgggaagcaggagtattttaatctgtttctgcagattaaaatcctaggtccaagagtccaggatgtctgtggacttgatagctttgactataactttgtctcagagagaagtcatttatcatctctgtggtttttggtctagtcttgatttaaaccaataataagcaaattaatttttctgcaaagggatagatggtaaatattttagtctttgtgggccatacattctctgccataactactcaactctgccattgtagcagtaaagtagccataaacaatatgtaaatgaatgagctggctgtgttctaataaaactttgtttacaaaaaacaggcagcgggccaaatttggcccatggatcatagtttgccaactcctcatttagacagcttacattagtgataaaaaaatgatttagatttgcaacatcatctcttattttttctttacaatttagcaatattttttcattttcctaaatgaaatgtcatctaaacttttttgttctcttccccgccctccttattttaagagctttgtgatattccttgaggcaactagaagcatagtaaaatgttgcaaaaccagagttataaaatcagtgatctaagttaaacaaacaccttccagagagttatactgtccctgatattagcccactgagtaattcaggtgatttaatttgggggtaactcttaatatttgactcatttttattaattctttaaatgacctgagatatcagaatggcatgaataacttgatgatcccttcagccaactaaatccaaattccctamtttctatcctcatatctccctcccttaagatacctacactccaatttcctggctttctatagaattccagggcctatccttaaattaggccactagaaaggaaaaaagaattgtggtgctggtggggtaaatagaaaagattggattccacacagtcttgggaactgatatctgtgtcttgaaactcattctggcccaatatggaatcacagaatgttacagtagcaaggagcaaagcatctggtctagatttttccttttaattstaaatacacaggagattaaataattttagcttagtttggtagcagaatcaggactagaatcccattctcccagtaaacaggccatgctccttccaccatttgaagcagcccaaatacctcattttgcaattttgcagagggcaaagctgacacccagagaagttaaaataataaaaatagtgttatattacatttatataatttacatagcaatataaataataattaaagagatgttatccaattctttttcagatgactctttagacttgttcatggtataaccttgtcactccatacttcattttacaatcttttaaaaaaatttgcactctctataatttgctcttagtctttgtsatataacaagggyctcaaagataaaatgctaatttttaatggtgtcatttcaaagttagaattcgggatcagaaatatgtgttttacttaacccccttccattcacatgaaatgtctttatatggtctctttagagaggttgaaaatcaaagctggacatatgcagtgatgcacatagatgctgttctctccataactaaaatgtctctacctcttttatgcctgtgaaaacctctagctggttatactctgcatcactggtacaaccttgatatgaagacwcactaagataccacccagatgtcactagaggatgttatagacttaaaagttttctcatataatcattctaattcagttaatttgcttttaaaatacatatagcatgtgaatttttgtgtatacacatatatacacatacacctatatatacacatacacttatgtatgtgtgggtgatgttgaagaaacatatcaatattatttcctttagaattgaatgaggttatggtagacgataaatctcccaaaggtaaaaatttatcttagatgactctaaaactcagtttagaccttctgatctttctccaaacacatatcaccaaccatgtgattaggcattttgttaggccagagacaggacaataactgtactgtgtatcaagctctacttatggttttatcaggtctctcaaatgttacatttatttgaaatattagaagaaattgaactatttctgmtctttgacattaacagggggaaagagaagttgtgttttgtaaaacaggtgaaatagagagagaatgctatccaattatttcccagataaccctgcagcaatattaccagagtatttaaagaaatttgcttaagaaaataatattcacagataatttagcagtttaattatttttccaaataaagctcatttattcattcatttattcaacaactatttattgaacaccaactgagtgtcttaacattgtggtgagtaccaggaaacaaaatgaaataagcctctacccttaagcagtaaggaatgctaagaaggaaacaattatagtacaatgtgtgaaatacttcaataaaaatttacacacatattgtggcaatgaagaagaaagagggaaagcttctaggagactgtgaatcctaagggataagatagaacaaaatccttttgagctctgtgcttttttgcataacttggtctaaaaaaaaagcaaaggttttaacatcttccttatctatgtgtttttgtcattttcrtaggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaaggtagagtggcatctgggcaaagagaaagcaatctgaagactgtgctataatgagaataacagtattttgcatttgacaaatatgcagtgacatgtaccacctctttaagtcttctaaatcttagttcttmaggtgcctggtctcagacaaactcctggttgtctgttttggtttgttttatttctcactacaccaggttgccctcataggaggataaatatcattgtcataaaaaaaagagtgattttatttctggtgtgtgtaaaccttggggaacttgctgatgatggaagggggaaagttatacactttagttgaggatataaggtacatgccaacaagaataaataaattaaaatgcatggtcacattttaaatgttagcaatagtcaaacatttattggtggccacttcctggcacttactatgcacttacgttgacatacatttttaaatatttacaatgacttctgtgaggtaaaatgttattatccttattttgccaatgaggaaatgaagaatcagagaataagtaacttgttcagtcatacagctaatacagacgggctgaaggcagaaatggttttgcagctgctccacagcaccatgtgagacttgtttatttttcactaatttaagtcagatcactggtgagatgaaatctatctggcatgtgatttcataactgatagaggatcatctctgtgagagtgttctatgtgttctttgatatgctcattttgagctaataggataaaaaattttctgggttgggcatgatggctcatgtctgcaatgccagcactttggaaggctgaggcaagaggattacttgaraggagtttaaggctgcagtgagccatgactgtgccactggactcaagcctgggcaacagaataagaccctgtctaaaaaaamacaaaaacaaaaaaccttagccatttatgttgtcattaaagattttctcttatttggctttcagatttttgaaggaaatactaataccaaaggacatgtgaagaactttttcaaccccccaatcatttccaggtttatccgtgtcattcctaaaacatggaatcaaagtattgcacttcgcctggaactctttggctgtgrtatttactagaattgaacattcaaaaacccctggaagagactctttaagacctcaaaccatttagaatgggcaatgtattttacgctgtgttaaatgttaacagttttccactatttctctttcttttctattagtgaataaaattttatacaagaagcttttataatgtaactccttgctaccagtaagtaagataatggctattacttctgcattaatttgaatacaggtaggaaaatatcaagaaccaacaagaaaagggcttatctttcttaatgattgaaaatgctatgaagtaatatttatgtagttaaaatgcttcattataactcttttaaatcctttacacactagtaaaacagatattactttaaataataattgatagacctggataactttcacaaacacatgattttttaatggtttttcttgagtgaagagaaaaacaatattatcaaatgaaataagtacttaaaatatcctgtctttcccatataacaatgatttttctgactttccatgagtaaaaaaacagccaagcatctttccagtagccccattgaaattgtgaatccgtcctggtctccctaaggactgcacacattgatattcaaggttggtggtcattagatatggaacagaactgaaataaccatggtagaactgaatgtgtaatgttggctttattctagctggtactacatggcacacagtttcaaaacataatttcacctactggaaagctcagacctgtaaaacagagcatgggaactgctggtctaaatgcagttgttcctgctcaaagagacctctggccaaactggcaagcagttaaagttttctttcagggccttcctctctatggcctcaacttcctcctctctcttcttccagcaacttcccctttcatcattcctttccctggggacttggcattcagtgatcctgtagatattgcacaactggggaacctttagacatccttaaaatcacatgagatagacagtcatttggggtgtctgaaataaaccaccccaaaacttagtgttaaaagagcaaccaaaaaaaatttatgtgagattatggatttgttacttagcttgatttaatcatcctgtaatgtgtacatatatcaaaatgttatgtataccataaatatataaaattttatcaacgaaattcataacaatctctcagaccacagagaaatcaaattagaactgaggactaagaaactcactcgaaaccacacaactacatggaaactgaacaacctgctcctgaatgactactgggtaaataatgaaattaaggcagaaataaataagttccttaaaaccaatgagaacaaagagacaacataccagaatctctaggagacagggctttgcttttgctgcattctattcgttgtgaacacaaattacaggccagtctcgattcagtgtagaagggaactgcataaggaccacataccaggaggcataattcactgggagcatctttagaaactaccagagttacctgttgcccataccagtggggtaagccctatgaatgtatatgagagtttcaaacatccacaaaacattggctttctaatattcgtattcccactattcctttcttttcatgattcatgtcattgtcccatcaacatttctaagatttccattccgttaagagcaaaagagaatgttggaaggtgggggaaaacatttctttgttttctacagggccagcttcttggatgtgtgtgatctgttcagttgcaaagggtcacatgctcagaaggaccgcatgctaaatttaatgctttgcagttaccctcttgaaatcctttattttttaagaaggaattcgacatttccatttttcaatgagccccacaaattacgcagctagtcctgggcttctctactctgaaattgggcaggatctctcttgatctagaatttactaaggcataataggggcaagaaaatcttatgaaataatggggggtagggaagagatgggaatggagcatgagatccagcttcgttattctctacttgagaaaaataaggccccaaagattaaacaacttgcccaaggatattgcttgttagtgtcagaactgaaaccagaaaccaaatgatcatatccctagacttttagtctgctttctcttccataaaatgaaacttataatgtttctaatccattgctcagacaggtagacatgaatattaattgataatgactattaattgatctggaaaatacttgtttggggatcaataatatgtttgggctattatctaatgctgtgtagaaatattaaaacccctcttattttgaaataaaaaagatacccactttttatttctctctctgaactcacttagatgaaattacaagtttgactacatagtacgtctccagtgacataatccactgtttgttacaactgggtgctttggaaagaagttaaatgactcacggtagaatcatgacttaagagaaaccaacagataaaattctaaacattattagtcattctaattgcaatttggaaaagaatagctgtgaatgtatcaaaaatatgaaaggactagaagaaacatgaaattatttctccagaattctttcaagttattaaaagaaataacaaacttcatgccatttttataatcattttgaataaacaccatattttgagttcagggccattttggcaaacccagggaaaagctcttgccaaatagcttggatgttcccaagagccatgaatatttcaccatttacttctctggacagaccaggaaggaacaatttactaggcagtgaattttggttttacgaaatattggcacatgccccaatgcagtgggcctaacacatacttaaaaatatctgatagctccatgttagcatttttcttgttttatatttcctaatggagaagtattttatggaaaattctgaatgcctaattctcccaagttcatatattctcatagcctagagatagggaaagctgtagacaaagacaaaatgattatgtgtggaataatatttacatggtcaatgcccagataacaaggtttttcatatccaagtacttaaattgttgggagagactacagagctttaagattttattatctctggcttgtatgaactgtccccaccaaaacatatacatgtattttgcatttggtacatgtaaagaaaacttgatattaacctctctacatgtaccatcattttaattttttaaaaagtattaagctcattctatcgacacagcaaaccactatgacaggcattgtaggggagagtatataaaggaaataaaagacacttctctggcttattcaaatacatcatctagttgcatagagaagacaaacataagaagcaaatagacactatgagcctattaagcctaacagattacaccctgagtagtaaagaaaaagacaattagatgagtagccttgtgggatggaatcagactgtgaaaacttttggagatgatttaacctaggtcatctgatattagatgtgtatgaaggcaacctgtgcagaactccaaagaagagaggactgggataaggatcaataaaaaccaggataaataagagctttatgctcaaattcagggcccagttaagctttctctgacatacctactcattttccctaccctctctatatagtctaataatgacttatccacctccctccatctcctgtaccatgcccataaatccagtgtatgtgcaaggtcaaaacaaataagaattacctgggtagaactgatgatgtgagggtggggaaagacacaaaaacagatacaatacatatccctaatctccaaatcgtgaattacagatggtagtgaccagattaaaagtgggtcacctttggaaatattatagaagacgcccatgaggaacaggattctgacttgcttagggtgataggagaatgacactggagtggggagaagacgggtaaaagtatgttgtatgtgagaaattgactaatggagagatgagacaatcattgaggatgtttggacaatgacaagagttcaaagttcttatgcgatggttttatttttaccactggtccacatctaaaccacttctacctcatctgtactttcatgttttacacttagaagaagcttctcaatgtcttaggaatggtgtgcagttaatttcataccccacctgctttttattgacaggaaatttggtaatggctttaccgtcttagttatctccaccttgtattgaagttccttcctgctgattaaaaagactttctgaaagtctggaatgtggcaaccttgtttacagatgtgacaagtaaaaatgtttaaaaagcttttcttttatgaatagactgggagaaatagtgacaaaggctataattctatgattgcaatagtattggtacatagtaagcattctatcagtatttattattagcattataatgaaaatatgatatactatgaatataatggtattaattactaatattaatttctactattctctaatgctttttaatactgctcattacctctttagaaattgtagtaaaatacacataaaagttactctttaagtgtacaattcagcggcattaagtacattctcattgttgtgcagccatcaccaccatccactgctcattactttttattgcagctctattttctacccatacttgatgctcttcccagtaggtggcatgtctggttcaactgtacttagccagagttctgaagacattcacatagaggtcaagctttaattattcaggctaaacaaataattgaacagcttgcatggacttttttcagtgggtttaactgacctaattatgtttttctcaggggtagggactattggcattagtttacatcctgagcccacaggcctagtataggattcagaaattatcaaactatccacaaatttgaagatttaaataaaatcaagtaaaaattttctctccaaaaaaaaaatcaattagttgccaatgaaggagtttaaatgggagaggtaaataaattgtgccagaaaataaactagaaagaacagtcagcatgctaggttatagtagatattgtgaaaactgtacttctctgcaatacacaaagtaggttattaaaaattattggctggtgatgatagtgtggtttcatatttgccagcattatgaataatcttctctgcactcctagcagctagaattttaaataaaaagttatcatatttcttcaggtggcaaaataattgtgaaacacaatgttcttggcagaaaataaaacccaaatgactaaatacaacatatttttaggcatgtgtgaatgaatatatttctctctcatcttgtccccccaagacttaaggctgcttaaaaaaaataaaaaatactactagatgacatatgttagaagtagggaagaaagcaaaaccggaggtagaaacataaacaggaagcagaaaaaagctaacaggaaaatgcatatcataaagctatcgaccttgctatgggtgaacttgggtttaagtgaactttttaaacagccaatgcacaaaaaaaccttatcagttataccatatggtgtccccaaaaaatgtacaaaaggagcacacttttattgagactgaagttaaaaataaacttctcccaaaggtccgcagaaagaggtcactatgtaatgagcagaatgcctctaacaagagcacattatataggctgctttctgtgcagaaggtgctgaggacttcccaccaaagcacagttcagtaaaaacaagtcttcagaggccactgctgtgtggtccatgtgcaggggctctttgctggtctggcttaagccaaaggtagattttacagcctctaaaaatcattttccttcaggcaaaggctcatatcataaatactgtttctctaaggcatgattttgttagctactctgtgacaatgagctcaagattgtgtattctgcaaggtgtaacaactgcatttttacaaaattgttatgttcttgcacaagattctatcataagcaaatggcaatagaaggcaaatgtttcagaacaattaatgcaaaaaaacgtaaatagagaaaattatt

SEQ ID NO: 17772 - DNA, 43103 bp, Homo sapiens
agcacagccttcctggggttccttttggaaatgctgacttattaaataaatatgagggaggagtaccctctgcaaggagagaaggtggggaggggcacaggaagactaagcactgtcttcatcattttgccatgtcccgctagtggccatgagcagccctgtccctgggtctatctcttcaggcttatgatcctatttaatcctcatgacaaccgctaaaggtagmcaaggttgcccttgtttttcagatgaggagtctctagaaaagtcgtgtggcctgctaagctaactgttcagagcctgggctctggagtcacctggcggtggtttcaaacataaatccggccccctcaagagctgtgtgactttgcaaatgttccttaacctctctggccctctatttcctcctttgaaaaggagagttaaaatcttgccctctcggcatgaggttattgggaagaatcagaggtatgattgatagggtcatggcacagtggttaagagtatgaaccatgatcccagatatcttgggtttaaatcccacgtctgctatttaccagctgtgtgactttgggcagtatacttaattctcaggttttctatttctcatctataaagggaacatcattatagtacctacctcataaagttgttatgagaatcaaatacatgtcaaatccgtggtacaggggttgacaacagtaatccaagtttgctctaatttgaataaacgcagttcttcttactatactgtaaagactatatctgaccaggtgcagtggctcacgacctgtaatcccagcactttggaagtctgaggcaggtggatcacttgaacccaggagttcgagaccagcctgggcaacatggcgaaacccagtctccactaaaaacacaaaaattagccgggcgtggtggcacacacctgtagtcccagctactcaggaggctgacgcacgagtatcatttgaacccagaaggcggaggttgcagtgtgctgagatcacaccactgcactccatccagcctgggtgatggagtgagactctgtctcaaaaaaaaaaaaacaaaaaaaatactatatctggctacagtagtattcccaatgcctgccacatagttggtgatcagtaagtatttattttaaaaatgatctgggatttcaacccacatctgcataactcaaaacatttatgccagtgattctcaatgtatgatccagggctgtctgcctgaatgggcctgaccccaagaatcagagcccctggctggccagaactctggatttatcctctccagttcagcaataggctcacagtgtaacctgggccagttctccctctctaggtctcagtttccccatctgtaaaagtaagggctctctggggtgaggagctgtttatccacatgaccagccctgctccatgggggctcctggtatctcaagacacgcaaccttcaagccacaaaggatcgtcactgacgttactacttttattttgtaagcccgcatgtctcagggctcatgtgtgtgtgtctgtgcgtgtgcgtacacaggcacacattcagatctgcaggtgatgtggcttggggagaggctgccataaatattaaactcccaactccaaagtaccctgcagagattcagaactgcaggaattcataacatcattctctttcaagagtcagtgttctcaggagtgtgggcaccgtcatagaaaactatcgaaaaggagagtgaagcattagagaactgctgagcttggagggaactcggagctcatttagtcccttgttcccgaagctccaagcacaatccgtggtcagcagcatcaccctcaccagggagcttgttaaaatgcagaggctcagccccaagaggaacatgatggatcaagatttgcatctaaacaagatccctgggggacttgactgcacgtctttgtttctgaaaagctgtcctagtccccagccctcatctgcatttgggggaaacatgaggaacagagaggggtggagtttgttccaggtcccccagcccattaggagcagggccttgacaaaaaacctgtaagactttggaaaaggattcaaagctctctgcgagaggcaggcgtttgcacaaaagatgaataagtgcagaagaaatgctcagtgttgctaattgtgtccaacagggttcaggcaagaaaagagaatccaactgcattggttcttgggatttgaataaagtggctatttctagagttgggggacaagcttgaggaaaccaaccagggactgtttttcctaaggctcaagcagcaaagaaaagcatctgggtatcccagcccaaggagataataggagccaaggacaaggccttatcaggagggacacagccaactgccacacttgtgatctagagaagacagcagggaaaagtgccctgacatctgacctcctgccatgccaccctctggctgaacccaagtagagatgaggaaactgagtcacaaagtgcccaaagtcaccccgtgggggagtcaggattcaaatccaggccatctggccccagagtccataaagataaacataaggtttgtttattcctttggcaattatctactatttgctgctcagtattctagacactatggattccaaattctgggtttttcaaaatcttttcagtaacacttttgtagtgagaatattatcggtggcgagtccgcaacactcccagcccttgtcttctcagaggaaagaattcaattgagagacgcaggcaagttttaaagcagaggcaaaggtttattgaaagaagcaaagtacaactgagagatcaagtgccccgctcaacctttggctcggggcttttatacactggcttggttctggggtttcttctcctccttgattcctcccttcggtgggctgctgcgccctccctgcatgcgcaatggcctgccagcacttgggaggggccgcatgcgcagtgtgtttactaaggttgtgcgcatgctcacttggggtgattttcccttactggtccgtcgccgcaagaaaaaggtcatatacaagtcagactccaacatttgcccttctgctcgaccttaccagggaattgtggtttgctggctccagatgatgtcaactatctgttagggaactcctctccctcttggcgccattcgtggccacttatcatgtcagagggacagttttatgatcgcctgtccatcatttgatgcactgccatttctgggggccctctcctgcacaagaacacaataaacagccttgttaaaagagtccctatttcactgcaataagactgagtggtggccagagtggtagcagctgttgcttttgtggaattggatggacagcctggtaggagaaaggcccaggggttctgaccagcagtggggtcgtgctgctccctgaggcctctgctgggtcctgggccatcagcagggaccttagccagcagtgggcacctgcaggggtggaggccaggcctgggccatgtggcagctctaaggtccaaagattgctgctgtgggaaattcccacccctgcaaatgactcccagccagggacatccttaaactgctgccagaggaagagtgacatctatgtccccataagatccttatgctccagaatgtcctcccccactctcctcccctcctgggcaggctgaggtccaggaagcaaaggcccctaggcacactggggatgcacctgtgagccctttcctgctccaaagcctcccaaaggctggctccttaccctgaggcctctgctcagcttgttgcctcccaagagaaccctgccctgaccagagttttggaatggcatcctgcagacctggacttaaattcctgctgggtgactgcagcctacatcacttcaccctgccaaacctcagtttcttcatctcaagacaagactaaaatatccacctggggttgctgatgcaaggatgagaggagacgtgcagcttaaccagcacagcgcctgcacatagtaggtgctcaataaatatcagtttctttccaatttctgctgggtgctgcaaggatctcaggaaatggaagactcagccgtgcctgcaaggagccatcagactggtggtgtggggactgaggggagggacggatgaggatcccaacaaacctcagccccagtgacaggagcaacacggtacagaggagcagagaggcctggactgtggggttccctgtgcttaacgtgggacattctgatcttaacctcagtgcctgccagtgctgtttgtgacctattgggagtcaccctgttaatcccaccacattcagttggttgaggccatcatgaaaacctgcccaatttcaagggaagggggcagaaacattaccttttgatggaaggaatatcaaagaattcgtgggcatatttttaaaggaccacaattatcaaaaagcagagtggttaatgctgtggtggggaaagcgcaaagggttctgggacctcagaggggaccctttctagaatccagagaagcatgggagtggtcagggaaggcttcctgggggtgagggcaaagcagaactcacaaatgtaagcagggctggggcaaaactctaaaaattaaacacagtctgtactataaattttgttttccagaatgaaattttactatctttacttactgcgaatatatgcccgggaccatacccccaagaaaataaaaattttagaggctgggcatggtggcccaagtctataatcccagtattttggaaggccaagcgggaggcttacttgagctcaggagttcgacaccagcctgggcaacatagcaagacctcgtccctactaaaatacaaaaaattagctggacatggtggctcacacctgtagtcccagctacttagggggctgtggtgggaggatcacttgagcccaggaagttgaggttgcagcgagcgatgttcatgccactggactcctgcttgagcaacagagtagactttgtctcaaaaaatgaaaaaagaaaaaaaaattgtacgtatcaacaagcaaaaacttttttaacacttataattctacccccacaaccagagacaatgcctcatgactccttgctaaatattttccagattgttgaacatagaagcctattttgaaccccccaaaatagaaccttactctatggtgccattggaaacggatgcctcatgacatccctttccttgccaagaaatacctttatttctgcagcctcactttaagggacatgtcataattcatttaaccaatgcccttctggtggatacatgaggttgggtctcacttctcctgtcctgtttcccacagcatagcagtggtatcttggagcagtgatttactggcacactgactcaattatgtatttaagggcaagtccctgaaattgaattcctgggtcacagggcatgcaactgtttaaacatttgccaattgccttccagaaaatttcaccaccagcaaggtttgagaaacactgttttcccattgggggaaacatttattttttaaataaacgagccaatatattttaaaaaagagagtttggttggtgccagatgtagcttcactctcaaccctgccgtctgctgggggtgagatctcaagggagctatgtggcttttttgaacctcagtttcctcatctgctaaaccaggccttcctagccgagctcttaagagactggctgagatgaggcaagatgaacagtgatgaatatggggtctttctgtggggagggtggacagggatgatcataggagtcaggcttcctcatccactgatctaggcagtgaaaactggcttctaagtatgaccttatgacttcagtgatgtcgcaagcaggttccagtccctgtgcctccccttcccgctcccaggaacccatccagcctcaggaactgcccccagccatcgagccttggctacttaagggacctgggcccaatccacagytgggacagtcctggcccactgcactgggaatctaggatgggggccttggccagagccctgcygtccatactgctggcattgctgcttacgtccaccccagaggctctgggtgccaaccccggcttggtcgccaggatcaccgacaagggactgcagtatggtaagaagccacatctgctggctggacttggcaaacccacgctccaggctgctctgggtacagtggggacagggagtggggacacagaccggaccctctccctggggcagtgccaccttctgggtcaggtggctctggctcctattctggccttactgcccaccagctgagtgccctgggcatgttatttgtggtagtgaggtcctccaccagccaacagaacacagctttgcgtgcaagtagttgatttgggaaatgattccaggaaacactgtagggaatcggtactgagatgaggaagggagggcagccaggagagagtgtgcaattaaaccagccaccacctctgatgatgggaaccactcagctgggaaaattctgcgtaaagtttggaaacacatgcctctgaactggaagtcagaattgtggtcacctctagaggcaggcagagaccctgaagggcatgagggaggtctgccggggtgctggaagttgccatatcttgatccaggtggtgatcacattcctgtataaacattaaaaattatttagcaatacctttaaaatttgtgcccgttaggtactttatgtatattattcctcaattttaaagaatgggcaggccaggcacagtggctcacgcctgtaatcccagcactttgggaggccgaggtgggtggatagcttcaggccaggagttcgaggcaagcctggccaacatggtgaagcctcgcctctcctaaaaatacaaaaattagccagtcttggtggcagccaactgtaatcccagctacttgggaggctgaggcaggagaatcgcttgaacccgggaggcagaggttgcagtgagccgagatcatgctgctgcattgcagcctgggcaacagagggagactgtctcaaaaaaataaataaaaataaaacaaagaatgagcaaaagtaggagtatttttttttaaatactgaaacaaagcctcccgactatccaggtggcatgggaactgggatatttatacaccacagtgattgattgagggcttctgggccgggggtttgtcaactccccagcacttctgtcctgttgcatgtacctgctttctgcagttccaggacaaaaagcctcgggacatacaggctcagggaggcagacattggcagctgggagtcaactgtcactcactggaaagactcaaggatatggacaggcactgaccacatgtcttctcacatccctagagcctcaattgccttacctattaaatgagataacaacattcccttagatagggttgttgggagcccagactggctcgagacaggcagagggaaatcagggaaggattccaggatatagtaaaatggaaaagacagtgggaattacccagggacaaggggtagcgttccaggcggaaggaccccaacatgtgcgtttgctagagggagaagagcaaattggaaagaggtgaaaggggaggctgctggtcatctgtgtacccatgtctgccttggggacagaaacctgggcccctcagatctcggaacagtgggacctggtaactgctacttgcattgaaactgtaaatcagggaagtttctcttttgttcctttgcactgtgcacacacaccatgtttatgtaaccagtcctctgaggttggacattttggtcctttccatattttttttttttttgaaacggagtctcactctgttgccaggctggagtgcaatggcacaatctcagctcactgcaacctccgactccctggttcaagtgattctcctgcctcagcctcccgagtagctgggattacaggcacatgctaccacgcccagctaatttttgtatttttagtagagacaggrtttcactatgttggccaggatggtctcgatgatccacccgcctcggcctcccaaagtgctgggattacaggcgtgagccactgcgcccgacccctttccatatttttaataatataaaccctatttgctgttccaggcatttactgagtgcctgctgtgtgtcaggcaccaagctaggagtgcttgttatcctcacagcccccttcttgctttgcagtttcaatggcatgccaatgaggaaagtttagtttagtttagtttagtttagtttagtttagttdwgtttwgttttgttttgttttgttttgtttgagacagagtctgactctgtcgcccaggctagagtgcggtagtgcgatctcggctcactgcaatctctgcctcccgggttcaagtgattctcctgcctcagcctcctgagtagctgagactacaggtgcctgccaccatgcccggctaatttttgtattttttagcagagatgaagtttcaccatattggccaggctggtctcgaactcctgacctcaggtgatctgccctcctcggcctcccaaagtgctgggattacaggcgtgagccaccacgcccagcaaatgtattgttgtcattgctatttgacagatgaacaaagtgaaggttgtttggggactttgtcaaagtcacccagctagaaagatgccctctttctctagcccccagatccttccagtttcttctacacaggccagatgtcatggagaacaagaaggaggactatccgtccaagcgcacagcacttttgcccttggggatttgttggcaaaggcattccatttcctcatcagtaaaatgggcatgaacctaacaatgccacagaaatgcagggacacctctgaatgtccctcatgctacctggcacacagaggggctcatatcctgtcattgtacttaatgctaataaggatgttggcccctctcttgaggacaggtgggagccaccgtagggtttagagcaggggaggaggcaggcagatcaagctgactcccagctatttcctttccacagcggcccaggaggggctattrgctctgcagagtgagctgctcaggatcacgctgcctgacttcaccggggacttraggatcccccacgtcggccgtgggcgctatgagttccacaggtggggctctcccttctgctgcggctctgaagtggctggagctggctgtcagggggaattggagagtgaggaagagagagcctcaggattgggctgtggggggacctctccggggcrgacagtgggatagttccctgaagagctcagaaggaaattctgggaaggaattgagctcctccactcagtcacgcagcaaatattaaggaagacctactggctgtgtgatctgagccttgatttccttatctgtaaaatggagttgatctacttcctccttcagagtgctcatccaagatccaatctggccactagatatagtttggaagagaagatagaccttacactttaaatgtagtagcccaacggttagagctgaagtttgtacttgggggagtcagggaaggcttccaggagaaggtggcatttgagccaagtcttcaaaagwttactagacttgagcagctgatgctttaaaagagcgtgaactgctttttgagggatgggcagtgaagaaacgacaatcagactcgtagcacattgtacccctccctgctcactgctgttgggcgtttccttcattcctgccttcttttattcagtccatcagcaaaaatctattgggcacctactatgtgcccggcaaataaaatagaacttgaccgttcttttcccactgtgacaaccttgctgacttttttggggtcttatcttaaggctgccaccatcttccctgaatctgtttcccccctacctggatgtattgagagagaggagggttagcaggaactgcaaacccaaagggatatgtctacggaccttctcaggatgccaccgggggtcattagattcatgggttctgatgcagactgcaaaaccgtgagcaattgcatcccttcctcaaggttctatttccccctttgtggaaagggagcaagaacactgctgaccccttcagtgtggcccatatggcatgaagaaagtaacgtgcttagcatggtcataagatcgatgcctggggcacagcaggtgcttacctggagcagatcctgctggtctagtccccactgkggagaggggaggcgcaaggtccctggtgaggctgggtccaggcccagggctgacacctccttccatgtctctcccttcagcctgaacatccacagctgtgagctgcttcactctgcgctgaggcctgtcccyggccagggcctgagtctcagcatctccgactcctccatcyrggtccagggcaggtggaaggtgcgcaagtcattcttgtaagttggctctgctcccaggccctgragctcttggccttggccttcgccccatccttcttaggtccaaggtgttcctagcttatcagaaaggccacgtgatggacagatggagtccaagcccggaggtggcctggggattgagtcctggctcttggatgagtgtctttctgtctctgagtctctacttcctcatctcccaaaggggacgggcctgcttccttgatggagtcatgggagggctaagtgcggtaatatcatgtctccttggtttgcttcccacagaagcagactttagggcaagaattccagtgcaatactttatcttggaagcgatctgaggaaacccacaggggagtggggaagtgaggaagggaagggaagggaaggaagtcagcctggtgggcaagtgaagctctgtctagctggggaactcagggacagyggagaacacgcctctgagttactccagccccacgctgtcaccccrtcctcctgcttgccattggccaagggctgcttccaggggctctggctctcaggcactttgaacagttctctgacctcagaggcacttggatggaaggggtattcatgtgctagggctgccataacaagcatagactgggtggcttaagcagaaatgtgttttctcacagttctggaggctgagggccaaggtcaaggttttggcaggcctggtttcttctgaggccactctctttggcttgcagatggctgccctttggcaatktcctcacgtggtctttcctctgtgctcaagaaatcccatttctgaggccatgcacgttggctcacccctgtaatcccagcactttgggaggctgaggcgggaagatcacttgaggtcaggagttcaagaccagcctggccaacatggcaaaaatcagtctctactaaaaatgaaaaataaattaaaaatttaaaaattagccaggtgtggtggcaggtacctgtaatctcaactactcaggaggctagacagaagaatcgtttgaaccctggaggcagaggttgcacagagctgagatcatgccactgtactccagcctgggggacagagcgagactccatctctaaaaaaaaaaaaaaagaaaaaagaaaggaaagaaaccccgtttctctctgtatgtcctaatctctttttataaagacactagtcacattggattagggcccaccctaatggcctcatttaaatgtaatcacctcttcaaagggcctatctccaatactgtgacattctcaggtactggggatcagagcttcaacatctgaatttgggaggcaggtggtgacacagagcagcccatagcagaaggaacagcccaaatatgggtgatatgaccatatttatacttcagacctgcactgcctaaaatagaagccaccagccatgcctttactgagtacttgaaaagtgcctggtacaagttgagatctactctaagtatgcaacactggatttgaagatttaggattaaaaaacaaacaaacaaacaaaaaaacagcagctgagcacggtggctcatgcctgtaatcccagcactttgggaggctgaggcaggtggatcatttgaggtcaggagttcaagaccagcttggtcaacatggtgaaaccccatctctactaaaaatacaaaaattagctgggcgtagtggcgcatgcctgtaatctcagctacttaggaggatgagacaggagaaycgctgtagcctgggaggcggaggttgcggtgagccaagatcacgccactgcactccagtctgggcaagagagtgagaccctatctcaaaataattaattmattagttaattaaataaaataaattagccaccacacctggctaatttttaaaattatttattataaataaataaawctcattaatattttttatattgattacatgttgaaatcatactatgtattactaaaattaatttcagctctttctttttatctttttaatgtatcttctggaaaatttaaaattacatgtgtggctctcattctattgctttagaaagacggctggtttatatgttacctacatatgcacatttgttctagttccatgaaaggaactggccacactctcttaccctggcttttgtcactgaagtatcttaaatatctctttctatgggcatatgactatctacctcattttttttcacttttttgaatgtgcttttaaaaattgataggaaattcacggaacataaaattgattatttgaaagtatacattcagtggcatgtagtacattcacaattttgtgccatgtccacccctatctgactccaaaacattttcatcatcccaagagaaaattccttacccattaaacaatcattccccatttcccttcccccagctccagacaaccaccactggggttggagactcctggaatagaccacattttgccccattgttctcaaaggctgcataacattgggtgcccacagcttattcaacctgtcgctgctagcggacatgtaggctgcttcctttttttttttttttttttttttttgctactgcctatgatgcttcagtgagctgccccacaccacgcgtatatcttggcaggaagagctacgggataaaggcttagaagttaaattactgggccaaagagtatgtrtgttagaacgaggagagatctcactgatttgtgtttcagaaagcttgtgccaatgtgcactctcccagccacagtgtctgggacttctgtttactcgtacattcaatagcattgagtactaaaacttcaaaagttttttttgaatctgataggcgagaactggtgtcattgttattttcatttttaatgacttttacatgcttattttgtactgcatttcctgttcatatctttttttttcttttgagttgttctttctttccttgttaatttatattggcttgttctttgtatattagggaaataagcycatatattaaggaaattggctctttagatgtctcatactgcaattttttttttactttacatatggcattttttttgtccactgaagttttaattttctatgccgacaagtttatcaaggatttcctttatggcttatgagacttggatattgcctagaaaggccttcatccagccctgcctggaaatactggatctgggctttcttctagatcttttatggctttatttgttattcttaaatctctgctcagctccatgtatttggaggtcagaactgagccttctattttccccacaaatggtggcagacccctggtctaggaactaaccatggcttctcttacctcctccagcaaamtacagggctcctttgatgtcagtgtcaagggcatcagcatttcggtcaacctcctgttgggcagcragtcctccgggaggcccacrgttactgcctscagctgcagcagtgacatcgctgacrtggaggtggacatgtcgggagacttggggtaggtctccatcggggcactgccagcyggactcctggttgcagctccyggccaatccagcgctcagcctggcctccgataattgcaatgatccaggtggcttgcacaggcacttgaagatcattctctggggaaccctgttragatgaacagacttaagccaggaatattggtgcatcattttcattaaaaaaataaactttcattcacctgacaaggggacccttgtcaggtgaatgaaatctggctatttggaggaacacagaaactttggttgaaggagagtttgcgaaaaacatacaagtccttggacaagtcatttcatctcttctagtctcagtttccttgattagaaaagtgtgaccgggtgtggtggctcacgcctgtaatcctaacaatttgagacgccaaggcagaaaatcgcttgagctcaggagttcaagaccagcctgggcaacgtggtaaaacctgtctccacaaaaaaatacaaaaattagccaggcatgatggcacatgcctgtagtctcagctacttcaggggctgagttgggaggatggcttcaggccaggcgacagaggttgcagtgagctgagattgtgccactgcactccagcctgggtgacaaggtgagatcctgtcccccacccccccgcaaaagaaaagaaaaatgtggattctcaagccgcttccccaaatctgctgaatgtgatcatgcgattgggtgccgcaggcactgggaagccagacacaccgaatcaggctggatgtgctgggacacagcagggcgccrggaaggggtggagagggctccctttgtggactggcmtgascagggaccagggcctggctttcccaggcacccggccatccccaagttcagtggcagactgtgcttctctccccaggtggctgttkaacctcttccacaaccagattgagtccaagttccagaaagtactggagagcagggtaagaaggtccaagcctctggcctcccccgagcttggcrarggctgaatggaagacctcactgaccaatggccctggaccaggccatgggggctggtttagacgtacttgggcccaaagcccagggaggacaaatcatttgcccaggtcatggagctgttgtggggcaygctggggacaaagctccaagtccgttcggttgggcagaaaatggtcaactgcttgaccaagggttaaacagcaggggctaaacagagactccagcccctccctctgctccaccttgctcagtgccccacactgccytgcattccaccaaggtccgaaaggaaaccattcctcaggcgcctgcaagagaccaggcaggaaagctcagcgagggcgtgggccaggtgggaactgggcgagctcatgagcaccagccctggatggggaggcagcaacactgtcagactggcctgttaaaaaggagtatgtgaaatcttcagagtgtatcatctttgactaaatcaaaaagatgtcgtgttaactttcagttcctctaaacactcattcatcccaaaatcccgtttctgagatattagccaaatggtatctgtagcaatgactgtgggaagggagaaagtgatggaggaggaaagggaaaaaaacacacacacaaacacacacacaccacaccccacacacactccctcccagcacacacacaccacacacacatcctacacacaagcaccccccacacaccacacacacacaccctccacacacacacccacacacatcccacacacacacacaccccacacacaccctccacacacacccccacacacatcccacacacacaccccccacacacaccctccacacacacctaacacaccacacacatacacagcacacacatcaaccccctcacacacaacccacacaccctgcatcccccccacattcacccctcacacaccacacctcccccatacaccctccacacacacccccacgcacataccacaccccacacaaacacaccccacacacataccataccccacacaaacacacacaccccacacacacaccctacacacagacagcacccacacacaccacacgcaccccctacacacacaccacacacaccctacacacacaaaacacaccacccacagaccacccacaccccctacatgcacacaccacacacaccctccacacacacacaaacacaccacccactcacaccccccacaccacacacacgcgcacacacacacacacacacacacacacacaccctcgtctgtaggtccaacctctggtttggctttgagtgccccctcgtggttgaaacaggaacagcaggcaaaccccgcattttgggtgtggccagctgtgctctttcttttctggttctgggtccctgggattaagtgaccctgagaaatatgccaatctactcaggcaccctgttgccatattgctgtgcataacaatagtaatgtagcacaattataattatcacagtaatcacataccataattattgttttgataaatgtatataattaatgctgtacagaatatattattgtataactattctgatttataacaaaaatggctgctatttcttgagcctgtagcttggccagggataatgggctcagcagttcacgtgcacagtccctctggatctctctttttttttaattgagacagagtctcactctgtcgcccaggctggagtgcagtggcgcgaccttggctcactgcaacctccacctcccaggttcaagcaattcttctgcctcagcctcccgagtatatgagaccacaggcacgtgccaccatgcccagttaattttttgtatttttagtagagacggggtttcaccatattggccaggctggtcttgaactcctgacctcatgatctgctcacctcagtgtcccaaagtgctgagattacaggcgtaagccaccacacccagccagtcccattggatcttaacctcgaccttggaaggaggtgccattttccacatggacagaggaggctgaggggtggaktagctttcccagtgtcaccttgctggtgagaggctgaatcaggattggagcttcctagaatgtggagcagcttgtaccaaagcccttctagggctaggtgtcttgggaaagatggagatctcacctgacccctgatccttagagatcttcgaattatcttccagaaaaactaagagcctgacgcaggcctttctaattccccactcagggtgggatgtggtacctggaccagcaaggctaaggagaagaataagcactcacgaatgcttgctctctgggcgatatatactcactatctctatccccaacttcccaaaatattaccagaaaggggtcctgatccagaacctcaagagagtgttcttggatctcacgcaagaaagaatttggggtgagttcataaagtgaaagcaagtttattagagaagtaatgacggaaaagaatggctactccacaggctaagcagcaacatgggctgctcagtcgcgtatacttgtggttatttcttgagtctgtgctaaaggggtggattattcatgagttttcctggaaaggggcgaggacttcccagaactgagggttccttccccttttagaccatatagggtaacttggaaattgccatggcatttgtaaactgtcttggcactggtggtcatgtcttttagcatgccaatgtattataattaacatataatgagcagtgaggatgaccagagggcactctcatcgccatcttggttttgattggtttggccagcttctttaccgcatcctgttttatcagcagggtctttatgacctgtatcttgtgataccagtcctgctgacctcctagctcatctggtgactaagaatgcctaacctcctgggaacgcagcccagcaggtctcagcctcattttgcccctgttctagatgaagtcactctagttataacaccactgacaaaaacaccctgggaagcacttggccttgccattgtatcttgtgagtgagaaccaaaaagcagagagaggttctgcaaaggtcaaacagccattggggactgggcaggatttgaatccaaatttacctggctttcctgctgcacccctaaccactaccccagtcgcatcctcaggaggccctgctgtgtgtctgcaactcaggcatcccatgcctcccctgcccagtccttcgggtccctaaagactggggcatccaggctccaggcttttgggatggtctgatgggctactgtctgaaggaaaggcaagaaaggagcggtcttcagggagatggatggagtttcttggttcccttgcaatcaaccacgaatgttcctcaccacacttgaccttgctttctggcagctcatcgctgctaaactcctctcccagaaaatggagcagctgcaaagagaggttaagatacagccctttgccctcccagcccccagcgtcacccttccatcagcaacccagcgtctgatggatggtgcctgcttacccttcagcacagaagccatctgtgacccctgcactaggccagggctctgcatgtccctctccttcactgtacatgtggattcattgcacaagaggtggtagctggctaacaaaaagagctgtttaaagtgaggactttctcatcgcacatcaacaaagaaaatattgacgtatgaacccaaatgttttaatggtggagtttcaggcagcgtctccagtgccccctcttcgagctgtgtcagtgaaggcccacagctattctttgaaaatggtctcttgattgacattgcccttggtctttcctgcataaaacattaaactgctacaaattccatcccaggtttctttaactgcaatgagaatttaaagacatttgcaaagccatcccagtgtagaatccttcttgatctttatgattttttttcctcctaagattttctgttgtctgttccaaatttaatcttgcttttagaggggtttttttgtttttcgtttttttggttttttggttttttttgcacctcacctttccagagtatttatcttaggttttcrtagaaagaacccttatagctggggccgggcatggtggctcatgcctgtaatcccagcactttgggaggccgatgggggtggaccatttgaggtcagaagttctagaccagcttagccaacatggtgagaccccagtctctactaaaattacaaaaattagcagggtgtggtggcacatgcctgtaatcccagctacttaggaagctgaggtaggagagtcacttgaacctgggaggcagaagttgcagtgagctgagattgtgccattgcactctagcctagataacagagcaagactgtgtctcaaaaaacaaacaacaacaaaaaaaaaaactcttttctcaatgatattgcattagtgtacataataaataattcgagtaattacaaaagcaagtacagcaaacaggtggtaggctttcatgtggactccagtagggcccagttggacttttcaaagtctatcccaaggctgcatcataaataattcgggtgattacagtggcaagtacagccaacaagtttggaaatgcacatttccttctcttgagaagcaggccgcacaactggtggcaattgtgtgtgagtagcctacagaccccagcattcagtcttccaggagtaccagcaggaatggggaatactgatcagtccagccaatctgttcaggatgaccattaagaactatctacaggccgaatgtggtggctcacgtctgtaatcccagcactttgggaggccaaggcaggtggatcgcctgaggtcaggagttcaagaccagcctggccaacatggtgaaaccccgtctccactaaatatataacaattagctgggcgtggtggcacatgcctgtgatcccagctacttgggaggctgaggcaggagaatcgcttgaacccaggaggcagaggttcacccaggagggtgagccgagatcgcaacactgcactccagcctggccaacagggcgagactccatctcaaaaaaaaaaaaaacaaaaaaactatctacattaactgtatgtttatttgtgtttatttctagttagtgtctagttctgctattaaactctaaattctgagaggccaggacctcccaaaggaaaactttgtaatggtggagtttcaggcactgtctccagccagtgccccctcctcaggctatgtcagtgactccctagctcaggtgtccagccctgggacagactgaaaagtccaactggaccctagtggagtccacatgggkgcccacatagttttattgtttgtatttccttggtacctggctcatgacaagcacttataaatatttgtaaatcagtgatcactgagcacaygtgtggaataatgtgactgcagtgatcagcacsgggccagaccagagctggggaactcactcagkyattctcttcccatgtttttcagatttgcgaaatgatccagaaatcrgtgtcctccratctacagccttatctccaaactctgccaggtaggacaccccatccatcccgggacacttttatttctgttaatttctataagagcatatatatatcttataaaatagtaaatggggcaaaaatatagaaartaaaaattaagggccaggcgcagcggctcacacctgtaatctcagcagtctgggaggccgaggcgggtggatcacctgaggtcaggagttcgagaccagcctggccaacatggtgaaaccctgtctctactaaaaatacagaattagccgggcgtggtggcgcatgcctgtaatcccagctactcgggaggctgaggcaggagaattgattgaacccagaaggtggaggttgcagtgagccaagatcacgccattgcaccctaccctgggcaacaaagaccgaaactctgtctcaacagaaaaaaaaaaaaaaagaaagtaaaaattaaaagttcatttttctcccccacttttcttccaagaagtaacttctgttttgggtgtatcttttcagatattttctttgtatgtacaaatataaatacatgtaagcatataaatagacattcatgtatgtattattttgttcatgaatctatgtgtatatgtattattttaaatatatatgttcatatacatatagtataggcattgttccagatttcttttttttgagatggggtctcactctgtgtcccaggctggagtgcagtggtgtgatctcggctcactgcagcctcaaactcttgagctcaagtgatcctcctgcctcagccacctgagtagctgggactacaggtgcatgccaccacacccggctactttttgtattttttgtagagacagggtttctttatgttgcccaggctggtctcgaactcctgggctcaagtgatctgcccacctcagcctcccaaagtactgggatgacaggcacgagccactgtgccagcttgatttcatttttaaaaactttttattgaagtatatttataaagaaaagtgctcaaatcataagtgtgctgttaaagagtttttacatgcatgtaaccagctcccaaccgagaaacagaacacggctggtttttcagagcccctggtgtccccctcggtcactgcccagccctccagggtcaccaccatcccaacttctaccagcaaagattagttttgcactttgcacatgaatggaatcagacaatattttgagtctcttttcaaaagccagaaggctttctttgttcaactttaaaatatgaggtcagggctgggcgcggtggctcacgcctttattttttgttttctttttttttttttttttttttgkgagacggagtctcgctctgttgcccaggctggagtgcagtggcgcaatctcggctcactgcaagcttcgcctcgcgatttcacgccattctcctgtctcagcctcgcgagtagctgggactacaggcgcccgccaccacgtctggctaattttttttgtatttttagtagagacggggtttcaccatgttagccaggatggtcttgatctcctgacctcgtgatccgcccgctcggcctcccaaagtgctgggattgcaggcgtgagagctcacgcctgtaatcccaacatttwgggaggccgaggcgggtggattacctgaggtcaggagttcgagaccagcccagtcaacatggtgaaaccccgtctctactaaaaatacaaaaattagccaggtgccgtggtggatgcctgtaatcccagctactcgggaggctgaggcaggagaatcacttgaacctgggaggcggagtttgcggtgagttgagattgtgctactgcactccagcctgggcaacagaacaagactctgtctcaacaaagaaaaaaaataataaataataaataaacaaaataaaatatgaggtcaggtcaggcttggtggtgcacacctataatcccagcactttgggaggccaaggagggagtatcacttcagttcaggagttcaaggccagcccgggcaacatagcgaaaccccatctctacaataaatacaaaaattagccaggcatagtggtgtgtgcctgtagtcccagctacttgggaggccaaggtgggaggatcgcttgagcccaggaggtcaaggcagcggtgggctgaaattgtgccactgcactccagcctrggccacagagtgagatcctatctcaaaaagaaatgaaataaaataaaacatgaggtccatgcatattgttgcatgcacctgtagtgtagctggtttattctccttgctgcatagtatatcaccatgtagatgtttccccatttatttgttcattctactgttgaaggccatctggggggtgttcagttttaggccattatccgtagtgctgctataaatgtcctagtacctatggtcgcatgtctttgggtatatatctgggagtgaaattgcaagctcgtcatatcatgtgatatgcccagattcagcattataagatcctgccaaacagttttccaaagtggttgtaacagaccttatttgttaacagccgtgtagtgttccatcacatggatgtgtcttcatttatttaataagtcccccactgatggacatttaggtgctttgctgtcccttgctattgccaacagggctgcaaggagccatctacaagtggagtctctggatccagggtgcacacattaagctcggagggggagaccctggcaaattatctgagatgttctctgatgccttakctcctaagcccctatgcggttatttgctgacatcacctttaccagaggtccaggtcggcaacccggtactgggacttggaacattcatccattcagggttttggaggggagtgtctgggccctctggacatgccatgcctgaccttcctggttattggctcagcattaagctccaggtgtggctggagaggtgaagcctggactcatggtgtgtgtgtatgtgtgtgtgtgtgtgygcttgtctggaaactgcttaggccctaggctgagcatacacccccaccattgttaactcatccaagggaatccatgtagtstctttcttgaagaagcaattctttgcctcagggccgggctagtagggggattctgaagaaagtcacagggaatgtgartcagccagagcccttgcccctcctccagcagctgaaagtgtcatctggcccctaattctgccctgtcctcattcacagttacaacagagattgacagtttcgccgacattgattatagcttagtggaagcccctcgggcaacagcccagatrctggaggtgatgtttaaggtgagggtcctggggccgggctgcgtgggtgaggctttccctcagggtcagccattctttgggccacctgtccccccaacttcagatctrtcctcatcctcccagtggttcccgctttgtcaagggccgggtgatatggagtggtggggagtgtttccagagctaggattctcccacggctgtcttacacctctcaggtcttaacgcttccctcctccttcttcccctactttgccttgcccatcatgcagaaaaggccaatcagagcgggtcttagggagtgtagatgggcctagggcatatagaggggctggccaggacttcctrtgggttaatgtagcaaagcttctggtgagcttttcattaaaagacataacactgcctttaatggtggagtttcaggcagtgttccagccagcgtcccttcatcggactgygkaggggaatacctagcccctsccccacgataggctttgaaaagtccarttggaccctatttccctctccagggtgaaatctttcatcgtaaccaccgttctccagttaccctccttgctgcagtcatgagccttcctgaggaacacaacaaaatggtctactttgccatctcggrttatgtcttcaacacggccagcctggtttatcrtgaggaaggatatctgaacttctccatcacagatgacatggtgaggatggtggcaaacaggtctctcaaatgaacacataacctaccgctccttccttctttccttttcacccctgttgacatcagtcaaatagtgagttatagctaagagaaaaatcaacaccaagaaaaatatgttagcacaatctccctttttactttggcaaccaagaaactcaaagccaaagttctttctcccatggctgggtgtggtggctcacgcctgtaatctcagcactttgggagcctgaggcgggcggatcacttgaggtcaggagcttgagaccagcctggccaacatggcaaaaacctgtctccactaaaaatacaaaaattagccaggtgtggtggtgtgcgcctgtaatcccagctacttgggaggctgaggtgggagaatcgcttgaacccaggaggtggaggttgcagtgagccaagatcatgccactgcactccagtctgagcaacagagtgagaccctgtctcaaaaaaaaaaaaaaaaaaagctcttcctcccttataacaactgtggaagactttgcagcttacttatctgtgttttgcttttctagacctgtttactagtctagacttgttagtctaattcatattttctctcatcctgatgatttctggaggtttattaaaaaatattttagtgaatgaggccgggcaaggtggctcatgcctgtaatcctcgcactttgggaagccaaggtgggyggatcacctgaggtcacgagttcaagaccagcctggtcaacatggcaaaacctcatctctactaaaaatacaaaaattagctgggcatggtggcacatgcctgtagttccagctacatgggaggctgaggcaggagaattgcttgagcccaggaggcagaggttgcagtgagctgtgatctcrctacttcactgcagcctgggcaacagagtgagactgcatctcaaaaaaaaaaaaaaaaatatatatatatatatatatatatatttatatgtgaatgaggcaagataatacatgcactgataaatgcatatattttcagagaaaaggaaataaagaccaagtgaaaataaagcacaattataaagacactgagcccttaaattaatttctttaacatctcaaacctgtcggggagcttccttgtagctaaagtgaaaaagatacatgatttcatgattcatggtgaaaaggagagacagtcttcctcacacccccaaaacaactgtttccaatgtggctttgtataagggagactgaattttacagtggatctcacctttaatggttctccagtttatctaatatttctgggtttcaaaaagttgtttcttgaagcacttcataaaagttgaggcctcatgaataatgtcaggatggtgggagaaacagtgtggttcggctcagacggtccagcttaccctggtataagtcaggggccgtctggtagatcgagggtcattttgtccttctgatggcctcctacacctgcacaggccttcgcttctggcatcgtgtttggtttacccatcctactgcggcacgggcctctctttcaatgggatgataatagctacgttttatggagcactcaccatgtgctgggccttgtgctaggatgttcgtttaggcctcacagtgactcgraggtggggactattgttatccccattttatggataaggaagttgaggttcagggagatggaagggctggcctgagatcacaaagtcaggacacaaaccgaagtctgtgtgaccgcaaacctcaccctcgcagaccctctgagtgggagccacacatcagctgccccccggggagagcrggcaggatgctgaagtcccatgtgctctccttgggtgaatgcaggacaggcatctcctccctgccagggtaacccaggctgtggagaagcgacagtcttgcacatccccctgyctccccaatcttctttagaccttcagctccagcrggagcaccctaaaacttcttcrtgtctctttgctgcagataccgcctgactctaatatccgactgaccaccaagtccttccgacccttcgtcccacrggtaaggagtcccttagttccccatgwgtgcagaccgagcctactagactccagaggtttctctttaaaacctctgcatctctcagcttgaccaagagtgagaaggccgggatgagactcccactgaaggctggggtgctgctccyttcaaagcctaaataacagaggccacgccccatatcttgtgggaccrcagcttgtccaatcttttattggtgttatctaagaatcccaaggaatgctggcatagtccataaaatgtaccctaatgaacagcagctaacaattacagggggcttcctaggtgccaggcatgttcttggttctttaaaaaattattttttggccaggcatggtggctcatgcctgtaatcccagcattgtgggtggccaaggtgggtggattgcttgagtccaggagttcaagaccagcctgggcaacatgaygaaaccccatctctacaaaaaatacaaaaattagccaagcgtagcggcacatagctgtagtcccagccactggggaggctgaggtgggaagatcacctgaggctgcgaggttgaggctgcagtgagctgtgattgcaccactgcactccagcctgggcaacagagtgagaccctgtctcaaaaaaaattattaaaaatgttagtttttgaatgggaaataaattctcaaggttcaacattcaaaagatctagaaggttatagagtggaaagtctcacatccactcctattccctaaccacccagttcccatctcaagtttgccaatattaccagattttacatatctttctgatgatattctatgtatatacaggttcactatctcttatctgaaatgcttggaaaagcaactctgcctaccttcttagtgaagcattttaccccctcagccttccaaatgtctcccttctagaagaggatgtaggttttacatatacataaccaaaaggttcatgggagtgctgtttttccacgaatagcctcctaaaaaggaagagtcttgccccaaattaaactctgtacctatctctagtacacagaaaattaagagcacttttgaaatggtggaatctagggctggtcgtgktggctcacacctataatcctagcactctgggaggccaaagtgggggggtagcttgaggccaggagttcaagaccaacctggacaacatagcaaaaccctgtctctattttagaaagaaaagttaaaaaagaaagaaagaaagaaagaaatgttctgtggaatatcatattaaaagagtaatacgagaaaattaaatattttttttaaaaaagaaatggtgggatccagctgtgtcatatttcgaaaacactggcatctgacctcagcatgcccaattagcagaatgtgatgaggggatggagaaaccttgggagaggtagggagggagaaaaaatgggcccaacttttctggaggacaatttggcaatacctgccgaaagttttaaaagcattgctggccaggtgcggtggctcacacccgtaatcccagcactttgggaggctgaggcgggcagatcacctgaggtcaggagttcaagaccagcctggccaacatggtgaaaccccatctctactaaaaatacaaaattagccgggtgtggtggtgcacacctgtaatcccagctacttgggaggctgcagaaggagaatcgcttgaaccccagaggcagaggttgcagtgagctgagatggcaccattgcactccagcctgggtgacaagagcaaaactccatctcaaaaaacaaaacaaaaaaagaaagcattgctgtccttcaacccagcaactccacctctaggaatgttttcctgaaaagaatagccaagggtgctcacaggaggtgktcattataatggcaaaaccctggagacaacttgatgcccaatagagtttaatccatcgcaggacccatacataacgaaatacaacacagccgtgaaatagatggtgcagactctgtgtctgacatggagagatggccagttttgccactaggagaaaaaggcacagagaattttgttggaaataaaatcaatcgaaagcaacttccagctttatctgactccctcaggcctctcctggcagacttgtatattttcttctcttgatgtaatctcctaattctgytcccagttagccaggctctaccycaacatgaacctggaactccagggatcagtgccctctgctccgctcctgaacttcagccctgggaatctgtctgtggacccstatatggagayagatgcctttgtgctcctgcccagctccagcaaggagcctgtcttccggctcagtgtggtaaggttcagagcctttgcaaatgctgtttccttttccccacatgcttttcccttttccccacatgcttttctccccactcaccacctgggtaattcctccaggtctcaacttaaatattacttcccgagagagggctttcttgctggcccttacccccaatctaccttacgccccttgccactttttcttgtaacaccccattatctttcttctcagcgtttactacaaagatactttgtagctgtctgcaggtgtatttgtttaatgcatgtatctctcactatgtgagtctgggctattgtggggagaaaggtatactggtgtttgtctatttgtctattttgaccttggaagactacatttcccaagcttctttgcactttgatttccacccaggtcaaccaatgggaggtactgtcaggagaatgatggcggggaggaaggatgaagccagagtactatttcctctttctttrccacggcagaggctctggctgtgacwatgtctcctcatggtgacttccataattccacctccactctttgttcctctagtcctggggtggatacagcctcctgtctctggataatctctgggtggcctcaccaactctttactagcttctcaacaattccatcacttgtataaccaattccccgtattaaattccctctgcgttaaacaytgagagtcagttttccttttttgatggactctgtctaatagggaagggatgttgggtcctttgggggccttgctccctggatggagaactctgctctcttgtttcttgacttttgaaatcaacaagtcaaatctctaccagggtaattcttcctagaggctatatctgcaatttaatattgttgttattgttatcaaaagtgtcattattaatatattttaaattaaaatataatttactgtctgggtgtggtggctcacatctgtaatctcagcactttgggaggtcaaggcaggagaatcacacaaggccaggagtttgagagcagcctgggcaacacagcaagactccattgctacaaaaaagaaaaaacaaatagccaggcctggtggcatgcacctgtagtcctatctactcagggggttgatgtgggaggatcgcttgagcccaggagattgaggctgcagtgagccatgattgcaccactgcactccagctgggcgacagacagagactccatctctaaaacaataataataatttattawtgttgttactagggctgaatcttgacctgagataactagaaatgatcctttttagagctttccaagggtaggtactctataccttctcttagtagtctgttcaaagtttaactgctaacataaacaacaatttcaagtaaaaatgttcaagtccaagttcaaatattgtttgagcacctacagtgagccttctgggagtctatgatctagtgggcaaatttcctgctttagctcattgagctgtttgttgagaggagacagttggtccctcgtcatcatccttcctatacatacaaccttcatcacttacacctgcttccttcttctggcatttccaggccactaatgtgtccgccaccttgaccttcaataccagcaagatcactgggttcctgaagccaggaaagtaagttggcctcctacctacatgggggtgcccagctggactccatctgtatgctgtagctgcttctctgtagctggtgggagggggggccaccatttggaaaggacacttacatttcaccccaattggcccaattcttctgccccactggtcctgcccccacaaatctcaaattgttaaagaattcactaagactgttacttcttaatgtatgaattttagamgccagctatatgaacttcctgaaatgataaagagtgagctttttgacactatctcatctgccctgtgacagtcttcccgatgtcattgtatcactgcttttagttcctcagtcatcttttccactcctgctcccgccctacctttggccctgtgccttctcaagcccatcctttctcgcttctggggacccccgcattgcttaaacttgcataaagcccacacyttttaatcttctctgattcattacagggtaaaagtggaactgaaagaatccaaagttggactattcaatgtaagttgtttttattgatgacatgattagaatgttaattaatttggggtgtttcctaagcaattgctatggcacctataataggaaatacaaaaggagaagagttgattttttgccctgcagaagtgtaaaaggtctcgaaaacacaagacatagggccaaggaacagttatatcctagtataaaacaatatataattaagtcatctactgaacagaattctcttaactgcaagagacagaaagccaattgaaatcatcttaagcaaagaggagaaatatataggattatataattgaaaagcaaaaataaacgaaaaaactaagaccagaggtttcaggcatagctggatccaggtgttctaattagtgcatcaagaatctctctccatctctctgttctgttttcatttgtgttagcttcactctcaggcaggctcttccaattggtagcaagccccagagtttcctacagtttcagttttttaaaaaatttgcacacacacacacaaaatctctgtgctagctctcattggactaatcttaggcacccagtcttaagccaagcactgtggccagaagtcagcccagcatggatctcatctacactccaggaggcaggatttgcagtcagctacatccaaagcacatggaccaagactggcaaggagggttgttccctgggggaaaatagactccgttatcaaaacaagagggattgagtgctgagcaggtaaatccaagaagtgatttccacaaggtagaaaaagtggtgaagtagacggccccaaataaaaggaggaaagagaacgtgaaaatcagtgtgggccaaagttatggagaagagctttctggaaagagggaaggaggagctgggtagactttaatgtgtagtcgttggcttctcttttaccattccatgatgctggcctccactgaccacctccacctgtgccctgcctcccagactttcccgaagcacttatgaagtggaaacaaacacagaggcggtggggagagatgcagggaccctgaagctaactcctttcagagaataaagggtggagtgaataatggtgcactcatattgtatctgtgcgtgtttactgcaaagtaaaacattcaagtgagaagtttcacaaaaatccatcctgtcgggttttcagagcatgaaatgtaaaaacaaaaactacagactcagatacatttagattcgaatcctgatgctgctgcccagtttgtagtaagtccctttcattctgtaggcctcagtttcccgatatatggaatagggacattaatatgaactttgaggggttgttgtgaagattgaatcagacatgcacgtaaagctctgagctctctgcttggcatatagtgggggttagaagttgtgtttcatgattttggtagagaagcttattttgtttttattaaatttttwaaattatgtaggtagttcargaaaaacattctcactgtaaataaaaccgatactaaagataaggctaaggacatgtcaaatgttgatgttcttcctttagaggaaagactgtcgggtgtgtaactttccaaaatttttctattcacttgcataccaaatgttcatctcaaaagagttttatcttataaaatagtagcatgatgtaatactagtttgcttttyccaagcgttttgctatgttggcacacacagaaccaccatgtggccctgtggcgatgtaaatatatctctcctgttctcttccaggcagagctgttggaagcgctcctcaactattacatccttaacaccytctaccccaagttcaatggtaagaatcactgtggatttttccaagtcaaaagtgaacactgctgtctggaggaaagagagttggacttggaaaacagggctctcctgggggctgtatgaccgtgggcaagtcacttctctctgagcttagtgacctgcctgtgacatgggatygttgaagttggcctcatctcccyccagggctctaatgagggttgggggctgggacagctctttggagcacgggaaacctccttataagcgggacagagggacacatggaagtgccccacatcctgaagaggcaggtcaaagactgaggaccaagttaatatagaaggcacaaggcagccgcctctgaactcacatctcccagtcaattgcccaactgcctagtcaaaaaagaaagcaaaaaacttaaatcctgtttccatgaagctttgcttcttttggctgcaacagagaacaggacgggcaaagggcagggagtggaacgccctgttctttatcttatcatgaatgtgtgcttcctccagacagcaccatgcctgatagcttaggctcccaagtcagcctccctgggtttaaatcccctttctgacacttcctgtgtgacctagaayaagttacttggccactctgtgcctcagtttccttatctgtaaaatggaaagaataatcacacctacctcatagtcttggaaatcactaaatgggaatatactgaatatagagtttgcagagaacattttcggtaaaaatctgtctctaattattatttattcaccaatctctttcaatgttgtgcttcaacctcyagataagttgrcygaaggcttcccccttcctctgctgaagcgtgttcagctctacgaccttgggctgcagatccataaggtcggtgggttcaggggggctctgaggatgtgtgagggaggaggtggtttgcatgctagctttggggccatgattcatgggtgacacccagcccagccctgcagctgggaaagtctggccaggggcaggacgggtgctcctgggccttgccatatgccacaaagccatccacatgtccttcagaagtggcacctctgctggtgcaggtggcatttgacacagccctatgccaccaccacatcccatccctaccatgaggggcytgagggaagctcaagaccagctcgttttgaaaatactgcgggccgggtgcagtggctcaygcctgtaatcccagcactttgggaggctggggcgggcagatcacgaggtcaggagtttgagaccagcctggccaacatggtgaaaccccatctctattaaaaatacaaaaattagctggacatggtggcaggtgcctgtaatcccagctactcaggaggctgaggcaggagaattgcttgaatccaggaggtgaaggttgcagtgagccgagatcacgccactgcactccagcctgggcaacagagcaacactccgtcaaaaaaaaaaaaaagaaagaaaaaaaaaagaaagaaaatactgtaagtcctagacgtagcattaggtcaggttctgaaagtcatttgtaagttttaagcttttcttctaaattttaaggttgaagagctttattataaatacctgtttggcatgcctccccatttaaacaagtactacaaccatatatacttttttttttttttttttgagacagagcctggctctgtcacccaggctggagtgcagtggtgcgatcttggcttactgcaacctctgcctcccaggttcaagagattcttgagcctgagcctctggagtggctggaactacaggctcccgccaccactcccagctaattttttttttttttttgtatttttggtagagacaaggtttcacaatgctggccaggctggtctcaaactcctggcctcaagtgatatgctcacctcagcctcccaaagtgctgggattacaggcatgagacaccatatacagccaacactatatatgtttacaaaaattattcataaacctattgctccactacaagcacagtttgaattttggtgtacttctagtgctttttgttttaagggtttttttttttaagtttgtttgttttgcacagttgcattactagtgctcatacctgttttctttctttccctttttttttaaaacttaaaacaaatttttttttaggccaggagcggtggttcatgcctgtaaccccagcactttgggaggccaaggcgggcagatcatgaggtcaaaagtttgagaccagcctggccracatggtgaaaccccatctctactaaaaatacaaaaattagctgggcatggtggtgcgcacctgtaaycccagctactyaggaggctgaggcaggagaatggcttgaacacgggaggcagaggttgcagtgagctgagatcatgccactgcactccagcctgggcgacagagcaagactccatctcaaaagaaaaaaaaaattaacttaaggttctttttaaagcttaacttaaaaactattttaatatcaagtgaaatagtgaaaaactattttcattattcaaactattattctgaccaagcattttgtggtctatctgtgcttccaattttcaggttatcttttgaggtgagatgaactgggttggcggactcattagcaggagggggatgctgcgctgtgcctggtacattgttaacaacagaaaataatagccattaaagggaatgaagggcaggggggatgattagggacctagaaacactggccaactgttctatctaaaaaacaaatgtcgaaagcccttttgggctctgagatactcagcacttaactgctcttgagcatttataagtagtcagacagatcgttgttcaaagcaaagattgagtgacagttcataccatcggcctcagttttctcctctgtaaaacgggacataaccgaaatgtcagtgggcttttgtgatgatttagagggcaagtatgatagcttctagctcaatgtttgacatgtggaaagtaattagatttattatatattataatattcattagaattttgaggtcaactctgcccatgtgtctaaccgtctaaaacaaaggatggatcactgtgggaaagaactgaacttggccttcggttcagaattcctgcccctctgggtgatggaaacgtaagaagagcaggagagtacaccctagcagttcacaatttttcattatttgccaaagagagaaaatttaggtgacgcaaaggacacttagaggcctgccgggcagcagcagctcggggaatgacagatcgatctctaccttggagaaggtagctgggaagagctgtgctttacggagagcttggggactgaggcacactcgcaatttatgcactgacctggattctggcagagcttgtgtttcgtgagacgtgggctccctttcaatcgcagatgcatctttttggagtagaggatgctctttaccatcctgtcctgtcctgtttttcctaggacttcctgttcttgggtgccaatgtccaatacatgagagtttgaggacaagaaagatgaagcttggaggtcacagctggatctgcttgttscatttccagctgtgcagcaygtctcagagattcttgaagaatgaagacatttctgctctcagctccgggggtgaggtgtgcctggcctctgcctccaccctcctcctcttcaccaggtgcatgcatgccctctctgagtctggactttgcttcccctccaggagggaccaccctcccygactggcctgggatatctttacaagcaggcactgtatttttttattcgccatctgatccccatgcctagcagagtgctggcacttagtaggtcctcaataaatatttattaaatgatgagatgatggaatcacctggtattctagctgagcctcatcactgcctgccctcttctgacctcaggggtctttggatagtcagccacatctatggtctccaaggcccctttctcatcgccgctgctatgggagcctcaatgagagaaccagggattctgtacatcatgtagccctggatctggcgctggtgctccgtctctaaggcccttgtcctgtctcaggcaggggctcacttcgacatcgctccctccctcatttcttgcctgctacagccaagggagccaatgatctcccggagcaaaaactcagcctcccgctgcttttccctcattgaagcaggtgtaaattaggaggaaatggatctgtctaagtttttggtccaaccccaataaaaagctcatccaactgttgtttatgagccccaagcctggagggagaggccgtgatttctaattactgaacaatgagcctttgatcagactaataaagagtcatttccaagttatgtagttgggctcccagggactgggagtcagaagactcgtttgataattttttttattgtgttaatgagcagatggatggagcttcaggctagcagataattcacagggaataatcccatttaccctgtgtgtgacagagatgtgttccaagatgggacgatgtgttgtcgcccagctggtggcagggtaagctgtggcttcaagccctctctcctctccatttttgttcatttgtttgccaccatccatccctatgaccgactggcaaaggacacaggcttcatccagtactagccatgtggccttgggaaggtcactttccccctggggtcctcatctatgaaatgatgatgatgattatagtagtcaattcctgggactgctataatgactgcattgggtaatctatgtggaaggatttatttagccaaatggggattccatatttattggctgggtgtgcttactaagcacctcctatttgccaggctttggggtcctcatggggagaaatacatggagcatgggctccattcctgatcctgcttttaagagtgatacttcctctccctctccctctccctctccctctccctctccctctccctctccccacggtctccctctccctctccctctccctctccccacggtctccctctccctctcccctctttccacggtctccctctgatgccgagccgaagctggactgtactgctgccatctcggctcactgcaacctccctgcctgattctcctgcctcagcctgccgagtgcctgcaattgcaggcgcgcgccgccacgcctgcgtggttttcgtattttttttggtggagacggggtttcgctgtgttggccgggctggtctccagctcctaaccgcgagtgatccgccagcctcggcctcccgaggtgccgggattgcagacggagtctggttcactcagcgctcaatggtgcccaggctggagtgcagtggcgtgatctcggctcgctacaacctacacctcccagccgcctgccttggccccccaaagtgccgagattgcagcctctgcccggccgccaccccgtctgggaagtgaggagcgtctctgcctagccgcccatcgtctgggatgtgaggagcccctctgcctggctgcccagtctggaaaatgaggagcgtctctgcccggccaccatcccatctaggaagtgaggagcgtctctgcccggccgcccatcgtctgagatgtggggagcgcctctgccccgccgccccgtctgggatgtgaggagtgcctctacccggccgccccgtctgagaagtgaggagaccctccgcctggcaaccgccccgtctgagaagtgaggagcccctccacccggcagccaccccgtctgggaagtgaggagcgtctccgccaggcagccaccccgtccgggagggaggtggggggggtcagccccccgcccggccagccgccccgtccaggagggaggtgggggggtcagccccccgcccggccagccgccccgtccgggagggaggtgggggtcagccccctgcccggccagccgccccgtcggggaggtgaggggcgcctttgcctggccgcccctactgggaagtgaggagcccctctgcccggccagccaccccgtccgggagggaggtgggggtgtcagccccccgcccggccagccgccctgtccgggaggtgaggggcgcctctgcccggccgcccctactgggaagtgaggagcccctctgcccggccagccgccccgtccgggagggaggtgggggggtcagcccccagcccggccagtcgccccgtcggggaggtgaggggcgcctctgcccggctgcccctactgggaagtgaggagcccctctgcccagccgccaccccgtctgggaggtgtgcccagcagctcattgagaacgggccatgatgacaatggcggttttgtggaatagaaaggggggaaagttgggggaaaagattgagaggttggatggttgccgtgtctgtgtagaaagacgtagacatgggagacttctcattttgttctgtactaagaaaaattattctgccttgggatcctgttgatctgtgaccttacccccaaccctgtgctctctgaaacatgtgctgtgtccacccagggttaaatggattaagggcggtgcaagatgtgctttgttaaacagatgcttgaaggcagcatgctcgttaaaagtcatcaccactccctaatctcaagtaccccgggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaataaataaataaataaaaagagtgataggtgtgctgaaaagagccagtattgattccagcctacctgttttgggtccctgggcaaggtatctccaagcctcagtgtcctctcctgtcaaatgaggctgggaagagctcttggcgggattattttggaaattgatgggttcaggttaagcttccgtgggtgcccagagaataaccaggtggtggtcaatggatgacacaattagatcacctgtcatacttggtgtccccagaagcagaccctgaagaaaagaggtgagtacaagtatgacggtgttgcaaaagtaattgtggtttttgctgttactttctttttttttttttttgaggtagagtctagctctgtcgctcaggctggagtgcagtggtgcaatctcagctcactgcaagctccgcctcccgggttcacgccattctcctgactcagcctcctgagtagctgggactacaggtgcctgccaccacgcccagctaattttttgcatttttagtaaaggcagggtttcaccatgttagccaggttggtcttgatctcctgacctcatgatctgcctgcctcagcctcccaaagtgctgggattacaggcgtgagccaccgcgcctggcctgactcccagtcttttctccagttaatctttcctgggtttttgatgagattcctaggaagggggtcttaagataattgcatttcttttggaaagaagttttcttattcagagaaggaaattccagacagagtcccttctggtgcttcaggaaagaggatcagagagctaaggaggtgagggaagatcagagggagaccttgagtctgcttttttagttcagcatatcaatgtgccatatattggcgtattgttttcygagccccaacagtgttatatctcgatggggtagtacaggacaacacagctggccctagagtcccatagcaggttctgacgccctgaaatctgactgtaaacatatgagtatcctggacagctccaacctgtagagaaggactggccttgggacaggaggttctgatctcaataaccggaagaactggactgtcaaagaaccttcaagagaccacagactcattgctgtgtagatctcattctcacacaaaaccaagatgccaccttggagcgcctcctcttgactacaacctgttcctcccttctgcccttctctgatttcccctctcctctcctcaacctgatcaagacctctagcctcaccggtgtcttccaggccgctattctgatttaatttgtctccataactaagcacagttcatcatctctaacagaatcctttcatctcctgacaatcctactttccacatccccagcctggggcctaggcgtaggtaagagaattaaattactggaggaaaaggcaggcaggctatagccagttgaggtctccttccatcaccaaaaccatagttctgtctgaatggcctgagcagcagcaacagcctagaaattggaatacatgatatttctaatgaggctctcaggtaaggtctcagaacccattcagtctcaagacatgctttttgtttttgtttttgtttctttgagacaaggtctggctctatctcccaggctggagtgcagtggcacaatctcggcaaacgacaaccttcacctcccggactcaagccatcctcccacctcagcctccagcatagtgggactacaggcatgcaccaccatgcccagctatttttgtgtgtgtgggtatttgttgtagagatggggttctgccatgttgcccaggcaggccctgaacttgtgagctcaggtgatccgccggcctcagcctcccaaagtgctgagattacaggcaggagccaccatgcccagctgcatttcttctttctttttatttattttttttgagatggagtttctctcttgttgcccaagctggagtgcaatggcatgatctcggctcactgcaacctcggcctcccaggttgaagtgattctccagcctcagccgcctgagtagctggaattacaggcgcccgccaccatgcccagataatttttgtatttttagtagagacttggttttatcatgttggccaggctggtctcaaactcctgacctcaggtgatctacctgccttggtctcccaaagtgttgggattacaggtgtgagccaccatgcctagcctgcatttctttctaagagcccaagatgtagcttagaagaaaagacactagcatgccaggatagtccatattgtgctgtaagtgaaggcagcatggagaagtcttggcaatataggtaacaaggtcaggggcagccacaggtctgaataggtggaaagatgagagctgctgggtatagtatcaaagggttaggcaaacaatagaaccaataagtgtgcgtgtttggaaaggacagaagaagaaaacaaaataaacaaaaccaaaaccaagtacagcattgggccccagggattagaaagtcaagcaggagctagcacggccaatgcactttgcttctttcactggaaaagtccaaaatatattttcctattagtacacagagatcttctgcatttgatttttaaaatttaacacagctacataatattccacatttgtgtatgtacaaaacaacttcttcattcttatttaaagatgcataggatctcctggtgaaagatacaatttatttaaccagttcctacttatgggtcatcaggttgttttaaaacttttgcttttataaataatgtttcagtgaatacctgtattcatatgccaattcatacgtgtggaggtacattgtagaataaatgcccagaaatcaaatcctataactctgactctttggttaatttagcagattgtcatttgctcactttctcttctttccagactttccccttctcttgaggtggtgcctgggtatacagggatgttgaaggggtccacatggcatcatgagagtggagtgaagcaggacatagtaaagaatttaaccttgctcaaagagagacatggcttttgtccttggcccctggaaggtaatctctaagcccttggaatgcttgcctggtaagagtgcctttgtttacctgggggcattggtccataacagatagtctaacaaggggagccacggcagggcttttgttcacatcatatcagcttaatctctgaagatgctgaagactgagcccagccacatgggcagccaaccagattggcatgatcaaggccccaaaagactctggagcttttcagatgattttcaggagaaatgactgagcccaaagaacaatagcctggaaggaagttcctatgagtgctgtgggaagtggtgggaaggtgaggggcggaacttcacaatgcacaaaggttgtcttatt

SEQ ID NO: 17773 - DNA, 86893 bp, Homo sapiens
aactgtggactgacagcagccggcacaaatcctgatgttcaataggtgctccagaagtgtttgttgaatgactaaatgattgaatgagtcctgttaggaaaccagaagtgagtatttttctgagcacttcagctgatttcactcatggtcactcaacaatcacgtttggagaaaaaagattatatttctgctcaaaggtgtgttcatttaaggtgagaaaacaaggcactggggcttggcaaagaatgccacaggccagtggtgagattattaggcagccatgagcaagagctggaggaacaattttaggctttgaaaggagaaagagggagaaaaaggctgggcgcggtggctcacgtctgtaattccagcactttgggaggccaaggtgggcagatcacttgaggtcaggagttcgagaccagcctggccaacatggtgaaaccctgtctgtactaaaaatacaaaaattagccaggtgtggtggcacatgcctataatcccagctactcaggaggctgaggcacgagaattgcttgaacccaggaggcggaggctgcagtgagccaagatcgcaccattgcattccagactgggtgacagagcgagactccctctcagaacaaaacaaacaaaaagaataagaaaatcaacccttacaagggagccactaattaactaggcacagtgctaggtgcatacatacatgtgatctttgctgaattccttagagagagaggaggctcttctcttggttttacaggagaaaccaaggcttacaggttgggcacagtggctcatgactgtaatctcagcactttgggaggctgaggcaggaggactgcttgagtccagaagtttgagaccagcctgagcagtatagggagaccccccatctctgcaaataaataaaaaattagctgggcatggtagcatgtgcctgtagtcttagctactcagaagactgagctgagttgggaggattgcttgagcccaggacgtcaaggctgcagtgagctatgggtgacagagcaaaacaaaataaataaataaataaataaaggaaagaaaaaaaagaaaccaaggcttgcagatgtgacttgccccaggtccccagggctggtcagtggcagcgctgagatctggacatctgtgtgaaggttactcacctaatgctcctctgtctccctgggtccttttctcttccaggggcaactggattggcgagtccccgtacaagatgggaaagccgtgctcctcctgtccccccagttatcaaggcagctgcaatagcaacatgtgcttcaaggggctgaaatccaacaagttcacgtggttctgaattttctctgggctttggtgcgcctccagctgggcctgaccctccatgtcctgccctcaaaaaactgggtggagaaataattgtttctttaaaggatatgagttagaatcaccccctgttraattttccctcctagatccccttcttaaatgtccaacatgggtcaaaagaaaatgacctccttgccttccttctttcctagttgcatctttcttttcttgggcctctgggaaagagccctgcatctttcattaattcggttctcagagaaccaaggctggaaggcatagaactggcaccttgggaccaggcataatggctcacacctataatcccagtattttgggaggctgaggtgggagaatcacttgagtcctggagttggagaacagcctggaaagcctggcgataccccatctctatttagaaacaaacaaacaaacaaataaaaaacctggcacctcggttttgtaactctcaggctttgtcaaacccaaatgactttgtccatccaatgaaaggaattccactgggtgcggcggctcacaccggtaatcccagcactttgggaggctgaggcaggtggatcacctgaggtcaacagttcgagaccagcctggccaacatggtgaaactctgtctctactaaaaatacaaaaattagccaggagtggtggctcgcgcctataatcgcagctactcgggaggctgaggcaggagaatcgcttgaacctaggaggcggaggttgcagtgaacagagatccagcgactgcattccagcctgaggacagagtgagactctgtctctaaaaaaaaaaaaaaaaagaaagaaagaaaggaaacccgctttcattcgtctcataacagtcaaccagtttctgggcagcctttgaggactcgtgattcgctccctgagttgggcacatttcaggcccatgattttgaaaaacattgaaattggcttgtggacatccgccccccsacccccactgcatggtactggagccacgacagagtccaggcccccctttttacagatgggtacactgaggctcagagcagggtgtaacttacccagagctgcatagcttgtctttgatggccaaggttagagctcagtctctcacagctscttcctgcttcctcggctctcagaactgagaagtgaaaaccaaagttggcctgaggggactctctctgggcctttttttctctatctctgcctcggtctctctctcttttgtctactgtccgttctatctctgcctgtttttgttttggtctctgcatctctgattctttttctcccatataatcttactctcattccaataaaccatttcccctctccccccaccatcccacccagggatcatagcacacaaaagtccttttgtctccagagayagtaaaatctcctccctcagaccttgccctgcagctggggcccactccctgcctggctggagagcttttcctttgaagacccgggatggaaaacaggcccttttccatggagtccctacgttgtcctggatggaatgaattttctcatcctgtgcatgtcaccccctcccattccacccccaataaagtcttttgagatccagtgtagtggctctttctggtccctccctctcttggctcccaagagggtcaaaacacaaggaatgggaactgggtgggggaagatgggtgagaggaaaaccagctcaactggaagaccaggggaaggaactaacagcgctttgggccccgctctgcagaaggctagatcaatgcacaagtgcatgcacgtatactattgctccactttacagatgagataaatgaggcatggggtgagtactagcttccaaatgctggaaatgagtgaaataagagaattaagaggttgggcgtggtggctcatgcctgtaatcccagcactttgggaggccaaggcggcagatagcttgaggccaggagttcaagaccagtctgggcaacacagtgaaaccctgtctctactaaaattacaaaaattagccaagcatggtggggcacgcctgtaatcccagctactcaggaggctgagacaccagaattgcttgaacccaggaagtgaaggttgcggtgagccaagactgcaccactgcactccagcctgggtgacacagcaagtctgtgtctcaaaaaaaaaaaaaaaaaagagagagagaattaaggacactgttgtgagttcattgttcttagactatatctttcctactttattttttggaatgggctctcgaaggcagtatcagaaatggaaaaccgaagagatcacgtggaattcccaccttacagtggcacttttggcttgtctcttccctggcacagtggctcatacctgtaatcccagcactttgggaggccaaggaaggtggatcacctgagttcaggagttccagaccagcctgaccaacatggtgaaaccccgtctctactaaaaatacaaaattagccaggcgtggtgctgtgtgcctgtaatcccagctacttgggaggctgaggaaggagaatcgcttgaacccaggaggcggaggttaaagtgagccgagatggcgccattgcactccagcctggacaacaagagcaaaactctgtctcagaaaaaaaaaaaaaaaaaaaagaacagatttaatgaaacttcttgaatcccagtttttacatctgtaaaatgggaatattgacagtgacaattcaatgacgttaagaatatacaatgctgacaaactaaagagttcataaatgccagtggttgtcatcctcattatcctggtgctcaggaaggcaatgtgagacctgttgaaatagcacgggctttggggtcagatgatgctgaattccagttctgtgttggctccttcgtagttatgtgacctcatgacgccacttcatgcagggggttacgtaccacttaaatctccagaacattttgggsaattgacatagggttagcaaacctcccccacccccatataaaaatattaatacttttttttttttctgagatggagtctggctctgtcgccraggctgcagtgcagtagtgcaatctcggctcactgcaacatttgcctcctaggttgaaacgattctcctccttcagcctcccgagtagctgagattacaggtgctcgctgccacacccagctaatttttgtatttttagtagagatgggattacaccgtgttggccagcctggtctcaaactcctgacctcaagtgatccacctgcctcagcctcccaaactgctgggattacaggcatgagccactacacccgaccaagaatattaatacttttttttaaaaaatatcgaagttatttatttatttatttatttatttatttatttatttattttgagatggagtctctctctgttgcccaggctggagtgcagtggcacgatcttggctcactgcaacctctgtccccctggttcaaacgattctcttgcctcagcctcccgtttgccaccatgcccggctaatttttttatttttggtagagacggggtttcaccatgttggtcaggctggcctcaaactcctgacctcgtgatcggcgcgcctcggcctcccaaaatgctggggttacaggcgtgagccactgcacccggccccaaaatctaacgtttgttatcactgttgttttagaaaagaaaggacattttaatgcaacccatgcccatctgtaggggctgaaggtccctctgaggtgattgataaagctgaaaaaagagactatgggaagagaagaggaatattatcaattagctattttagaagcagggcaaactatgagctaggtattcctataaggaaatgaaataatttactaaaaaacatacagcaagaaaataatagagctggagttttctgatttttctgagtccagaatttgtttcactgttctcatttcagctctctctaacaggatgaatgaccttgatttcagaatccccaagcaggtggtgagatccaaaactgagacaaaagaaacggggctgttccaaaaaaaaagctaggtggcaggtgtctaacatgccagggagctaaaacagagtgtgtgagtttcagcagcaggttgaatttagaatggggaaggagaccagaggagacgccagacaggatgactttgtcccattggcctggaggcagccccatgtttctccacccctcatatcactcaccagtttgtaatagtatctttgaatgacgatctgattaaggtccgtctcctccattagtccacaagtttcgggggtacatctactttgctcatttccatatccccagagtctagcacaaggcctggtacatagtaggtgctcaataaatatgttagatgaaaggaagataacacctctatgtactagcagtgagactccaggcatgcaatttctctctgtccttcagtcccttcatctcaaggtttaatttaaatatggtaacgcctgtatgcaactcccagcatccagtaggcactcactaaacacagttctccaccctccttttttcctctgcccctccctcggttttcccactacttcctgcatggtgacacacccatagtttggagccataaaacccaacccaggttggactctcacctctccagccccttctgctccggccctgtcctcaaattggggggctgatgtccccatacacctggctctgggttcccctaaccccagagtgcaggactaggacccgagtggacctcaggtctggccaggtcgccattgccatggagacagcaacagtccccagccgcgggttccctaagtgactggttactctttaacgtatccacccaccttgggtgattagaagaatcaataagataaccgggcggtggcagctggccgcactcaccgccttcctggtggacgggctcctggtggctgtgctgctgctgtgagcgggcccctgctcctccatgcccccagctctccggctgggtgggcttggccatggtcagcgtgaacgcgcccctcggggctccagtggagagttcttacggtaagtggggctgggggaagactggacagggcgggactgcggtcagctttgggaggccatgggacacctccccgtgtgtttcttacgggcccaaagctcctcctggagctcctctggaagggcaggaagccccacggaggcaatgtgaccgcttccctaagctctcaagccggggcatggcctgcttggtgcgagaagtgctgggaggggccgagaagccctggggcagaggcttggctcattttgtctgtccagaggccttcctgggaatgcatctcaggggtctttccaaaaccccacagagggtggggcttggaagcaccgtcctgtttcgatgcggggcaaattgaggtccaccaggagaggcttgctgggcctaggtcacgttgctggtgcattatcaagctgggcgtgggaccgggcagctcggtcgctccgcacctccgttggctctggataatggggaggaggtagaaagcgccgcgcagggtggagcgttggaaaatgagaatatcttgtgcggacgtgtgaaactcagatgcagggctagaaagcatgtgttactgagagtgaaaggctcaggctcactccttagggtgacccccacattggaagcaacccaatgtccctcagcagagggaagacgggtaaataaagcgtgagacgtctttacagtggaatgctatcccattgttcaaggaaacaacgcacatctgtgtgtgacagggaagaacctctcagttaaattaagtgaaaacggtacactgaagaactgtgtagttgctgatagcgaaacggatatagatgtatatatgtacacacgcgtatacgtgtacattccacgcatagaaaattcgtggaatgacacaataaaattggtgacaggtttgtttctgaggagggaaattcaagagaatgttttatcttttggggacacattttggattttttaaaagttgggtgccttttataaacctgttcaaatcacacacccgcacagaacttggtctctggaatccagcagacctcggggtctagttgtgactctgtcacacggctcaacattcacgtgcctcttgctttctttctgaagtggagacaggactaggatgtgtcttaagatcatggtggatgccgtggggaacaaggatgtaaagcccttgataccacgtgcattgcaaagacacaatcaacatttatgtcatcaattgctgaggacagagrgccagggaatgacagaatcagggcctgatctcctgactctagtcaggaagaatcttctttgctttgacccccatcaaacaggaatatgtgatgcactggaaatggcagaggctgaagaaaccaacagcctgggaacccatcccacacaccagctgtgtgaccttgggcaagacatttcccctctctgaacctatttcctcatctgtaaaatgaagataacaacaggacctatctcccagagagcggggagattagaggagatagcatagaggagattaagggtgaggccacccttaatccacaattttaagacctggagtatagatgccaatggatgacttggttgaacctgtggctaggggaagacattgtctctcaaaggggccagacagcttctggggaaggacagcccaggtcataaggctaagctaggggtgaacagaaggccccacagtgtctcttaaaggatgatacaataatataacctgacagcctttcactgtctcccacgtctctgcaccttgtaggatgtcctcatgtctcttcatctctgctcctgtgtcatactcattatatagcaaacattcagcaattattagaatggttgcttctatcgacaggtaggtgggtgaatggatggatgaatgggttagtgaatgttctactattatctctcagacagctgtttcattttccaaacggctgtctgagataaataatattgtaatctccaaggacagaagaaaaaactaaggttcaagattaaaaaaaaaacacaaacaaacaaaaaatgtcatctgactcgagacttgacacaatccagctgttgctggccctctgctctaggccacagatatggctggacagagaaaggagaactccagtgaccttgcagtacatccacaaaaaatgagcacttttgtcctggggcagtggaacattcactgcagtgtatgtgtgcctatgtgtatgtgtgtgagagtggctgaaagaccctgatttgatatttttgataaaatacacctgggttagcatcctagatctaccttatttaaaaaaaaaaaactaaacaaaaaactgtgtggtcttgtgagtcaaatcattacccctctctgagcttcacatgttttatctgtaaaatgagctactgaagtctgctggaaggctccagaaaaaaaaaaaaaaaaaagaaaagaaaaatttgctttctgagaaaagaaacaagtgctccgaggaaacaaaacccctctcccaggctgggtgcagtggctcacgcctgtaatcccagcactttgggaggctgaggcgggcagataacttgagattaggagttcgagaccagcctggccaacatggcaaaaccccgtctctactaaaaatacaaaaactagccgggyatgatggcacacgcctgtaattccagctacttgggaggctgaggcatgagactcacttgaacctgggaggtagaggttgcattaagctgagatcatgccactgccactccagcttgggcagcagaacaagactctatctcaaaaaaaacaaaacaaaacaaaaaaacaaaaaacaaacaaaaaatcttcttctggggttctctaatggggataacattaatcatctcctaagatgactatagtagaggtgcattggtgggtcagggacatggcacatagcagagcctcagttagaggcagaggaagacatggctgttgtgaggatcaaatggaaggatccatgagtgcttagaacagtcctgggtccagagcaagcacgcaagaaatcctcgttgtggtttcatgtttttgagctttagcaggattctaaagagctgctctttggtgtggtgatgctgggtggacttggccctccctggacttccggtgcttccacggcacactggttttggctttgcggttctcgtcatcgctctgatcagatagttgctggtgtgaattgtggtgtctggctgccccaccagactataaactccgtgagttctgggacctgggtagtttgttcagccttgtttgtctcactatgtctcacatggtgactggcacagaagaaatgctcaataagcatttgttggatgagtgaaatgatgggcttaaaacagcgctacaatgatgatcatcaatgtcagccagatcccactctcttsccttccttcctctctgccctcctcactgcgttgtctttggtccttgtatttgccccattataacccaaactggctgtcccagcttcagctgtcatgtctgcacttacgtgtctgaagctggaggcaggaggagaagaggttttcctcagtgcccttgtttcttttatccaaaagcaaaacttccccagaaacctcctggcagactcccctagttcaaggaaagctgggaagacaagtatgtagtggaaagagatgggaaagccaagatggacctagaccagtgatttttctcttggggtgtggcacactcctgctccaaacagaactgaggctctggtataaatgagtttctcagcctcagcactgttaactttctggcctggaagattctctgtggtgaggggctgtcctgtgcactgtaggatgttaagcagcatccctggcctttactccccagatgccagtaacatctcttcccatcagttttgccaaagaaaaaatgtctccagaaagccaaatgtaccctggggcacatataaccccactgtgttataggagaacaaggtagttctgggagtgtctaccacaatggagtagagtagactgtgactcttgtgttgttctgctttgagtgccaggatcttgctcagtgccaatctggtactaccctgagtaactctgaggatgagatgctaaacatgcatatctgtgtgctaacctgactcctggccttattacttttctacccttattttccctttaacaagtttcccttggttatttattttgcttctttggtagttgctcatttccgtaagtacctcgaatctccttaaaggaaaggtctgtatctatctcattctttttgttatagtccagccttccacagggcctgatcccatgtagaccttgattgaagattaattaagtggatgaatgaatgggaagatggatggatgaataaatgtatgtttaggtgggtggataggtgaatggactgatgaatgaatgtgatgtgatgaatggatgtgatagatgggtggagggatgcatgaatggaatagagggagaaatagctggatggatgagacaaatgaatgagtaactggggagatggctgggtggatagatgggtggatggattaataaaaagatgttatgggtggatggttgggtgtggaggatgatgcatggatgggtaagtagatggatggaaagatatgtaggtgcatgtgataaatggatgaataagtagctggatagatgggtaggtggttaggggaaggatggatggacaaatgatgtgatgagtgggttgatgaaaagatggatgaatggatggataagaaggggtgggctgaggtagcctggaatagcagcatcttcaartgctctaaacaggacaagtgaagagataggggatgtcaacaatcttccatcagggcaatactgtatatctgtttttaagtgccaggtgagcctaatttttcctagctatgtaggcctagtccctttgaccaatagcatcagcttgaggacagatcagaggccattgtcggagacagtttggtgatgtggctctgccccttgaagctctatgatgatggtgctttgcttcacttctctggtcctcagtttcttcacccatcaaatgagccttggttgttgtgaagattccatgagctaatgaaagagaaaaggtaatagaagctataacaaacatgccgtgtccttgtgaagggtggataggcccaaaatcgagtaggaccccagatgctggctggctatgggaccgtgtccaatatcaggctatggctgttcccacccttcattcttaaaatatggcccctctccagcccttcccctatctcccctcccacatcaccttcccatcctacrtcaattcagtcttcagcccctatgattcacaaacctggttgcacataggaaactttttaaaacaattttggggctccactccagacccagtgaatcagtctcctggggtgagttccaagagtctgtaattttttgagctccttgtgtgacttagggtatgcagttcagttgaggtatggaaaccattgcctwactttctcccatttagtaaacagaggaactaaatatccagagtgcatcttgcctcaacccagaagcctcccgtattcattaattcattgttcatttgttcatttcttcaacaatcttccactggaggcttatggtatttaagacattttgtaaggcactggggaaacacaggaggataaaactttgcttcacgtggtggctcatgcctgtaatcccagcactttgggaggccaaggtgggtggatcacctgaggtcaggagttagagaccaggtagaggcagaggttgcagtgagccaagatcacgccactgcactctagcctggcgacaggagtcagactatgtctcaaaaccaaaccaaaacaaaacaaaaccaaaaaaaaacaacaaaaaaaacaactttgcttcagatcttaaactgtgctcagtttggcaggaggacagacaagccagcagcaaccaaagacagagtgccatgataaggacagcaaaggcactgtgggatacagagggacttaggagaaggggaaggggtcacagacttcttgaccttggaggagtagactgatatctaagctggaacctcggtttagcaggagtcagccgggagaagagacggtggggaagagtgttcccagctgagggaacagcatatgaaaaggcctggagcctggccacacactgctctgattttacttatatttgactgcaattaattccatcctttactgaaagtatcttgagacttgtctggttgtttcatgattgattaatcttattcctaaaagcatgctgaggctgggcatggtggcttattgtggattacacgcctgtaatcccagcactttgggaggctaaggcgggtggatcacttgaggtcaggagttccagaccagcctagtcaacatggtgaaaccctgtctctactaagcatacaaaaattagctggacgtggtgccaggcgcctgtaatcccagctactcrggaggctgaggcaggagaatcacttgaacgcaggtggtggaggttgcagtgagccgaggttgtaccactgcactccaacctgggcaacagagggaaacttgtcttaaaaaaaaaaaaaaaaaaaaagcatgctgagatgcttaagtgaaggaattgtgccttccatttttcctgactcatatgcctgtagcataaggatgggtcaatgataacgaaaggaatttgttttcatttaagccccttttatgtaatgggcaagatgttggctatttgatatgttttctcccttttaagccttgcaataacccatccaagtaggaaatattatctccattttataaacaaagaaattgagattcagagttgttaagtcacgtttccctgcatcgccttgcaaataggtgattaaaatctagtctgacaccaaatcttcattctttcagctattatgtcataatagcatccaaggagtttaccaccttctaccacctactagctgtgtgaccttgagtgaatgactcaattctcttttttttttttttttgagayggagtcttgctctgctgcccaggctggagtgcaatggtatgatcctggctcactgcaacctctgcctcctgggttcaaacaattctcctgcctcagcctcctgagtagctgggattgtagctggggttacaagcgcctgccaccatgcctggctaatttttttttatttttagtagagatggggtttcaccatgttcgccaggctagttttgaactcctgacctcaagtgatctgcccgcctcggcctcccaaagtgctgggattacaggcctgagccactgcgcccggccgacccaatcttttttgcctcagtttcctcatctgtcaaatggggttgatgataataccatttacttcacagggttgttgtgagacataaagtcaatatttgtaaagtgctgagtgtctagcacatagaaagtgctatgtgaatttgaacgattattattattatacctatagtgtgtgcatctactatatgcaaaggactggatgcttactaggtgttagcatcattttggctgttgtagaaacaacagagatgagtaaggaatagataactggtcccaggatgcaactgtctctggctggagactaaggacaaggctttgttgcaagccttctggggccctgggatgcccagggtctcctcttgggggtgctggttcatagatgggggcctgtgtggctccttcacagaggaggaggcagatgagaggcatagaaagggaggggacagacctatcctcatcagagacctgggagatggctctggccctggccctgggtagctgtttgtgacctcactcaagtccttctcctgctgtttctccatctactcttttttttttttttttttttttgagacagagtctcaatgtcacccagtggctctatctctgctcactgtaacctccacctcctgggttcaagcaattctcatgcctcagcctcccaagtagctgggattgcacgtgtgtgccaccacacctgacaaatttttgtagtcttggtagagatgggtttcaccatgttggctaggctggactcctggcctcttgtgatcctcccacctcggcctcccaaagtgctgggattacaggtgtaagccacagcacccagcctccatttcctcttttgagaaatggaggtatgacaaccatctggctcagccattgtcacacagtattccctgggtcctaagagtcaggaaagatgctgcagggttccctttgagggtaatgtgggtagggacgtgttcaaatggactagggcttagcctctccccacccttcaacctctggctccatcagagacacttctttttgacttttgtatatttctttttattttattttagagacaggggtctcgctatgttgcccaggctagcctcaaactcctgggctcaagcaatcctcccgcctcagcctcccagcccctgggattacctgctcatgccactgcacccggcactctgttttgacttttaaatgaaatatttaatggagggtctccacagttcaaaaatatttggaaaatcagaagaccacaccagtgtgtttcaaactgcaatcttaacccaggaataggtcatgcaatttttttyttattttttttttctagatggagtcttgctctgtcacccaggctggagtgcagcggcacgatcttggctcactgcaacctccgcctcctgggttcaagcaattctctgcctcagcttcctgagtagctgggattacaggtgcccaccaccgcggccagctactttttgtatttttactagagacggactttcaccatcttggccaggctggtcttgaactcctgacctcgtgatccacctgccccgacctcccaaagtgctggggttacaggtgtgagccaccgtgcccagccggtccttcaatttattgggattatattagttcagacaatatagcttatgtaacaagcaaatgcagactttaagttagaagtttattgacctctgtggcatagtcatccagggacccctaaggtcaccctagcccagaaagacactttcacttctactcacattccattggtgagaactagtcacatggcccttgccaaatgcaagggggtctggaagatgtggtccctagcggggcgggactagctgtaaagtttgtaaaggggagcgtgaattagttggtacacagttgatcgtctgtgcagtagggtcatgctcacacgtccctccacacacacacgttaaatatgtataacaagtgtaaatatacaatttaaaaaagtatcttttttttttggtttgtttttgttttgttgttgtttttgaaacagggtcttgctctgtcatgtgggctacagtgagccacaatcatggttcactgcagcctcaacctcccaagctcaagcaatccttccatctaagcctcccaagtagctgggaccacaggtgcatgccaccatgcccagctaattttttatttttatttttttgtagtgacaggtcttgctgtgttgcacaggctggtttcctactcctgtcctcaatcttcctgcatcagcctcccaaaatgccgggattacaggtgtgagctactgcacctggcctttacaattttttacataaaatgtttcaataaaaaagtgcatagatagatacagagatagcaataaagcaaatgtgacagaatgcaaccagttggtgaatttaggcgaagggatacatcagtgctcactatactagtctttcaaactttaaagtttgaaatttttcaaagtaaaatattggagaaaatgaaattcttaaaatttactagacctataagtagactaaaacaataagttataactaaagtaagatttggccggacgccgtggctcatgcctgtaatcccagcactttgggaggctgaggtgggtgaatcacttgaccccaggagttcaagaccagcctgggcaatatggcaaaaacccacctctacaaaaaacacaaaaattagctgggcctggtggtacacgcctgtagtcccacctactcgggagrctgaggcaagaggattgcttgagcccaagaggtgaaggttgctgtgagccgagattacaacaccacactccagcctgggtgacasagcgtaatcctagtgctttgggaggtcaaggcagaaaaattgccaccacacctggacttaaaaaatatttttactgaagtataacattcaaaacagaaaaaggcacaaatcatcaatgtatcgctttatgaaatttcacattttaacaaaagaatgaaataaaataaaatagaaaatatcayagagcatttcatgtagtaagagtaagatatgtatgtttttgaaacttttgttttatttatgtatatttatggatttgtgcttgatgttgtgataatagcaaaaatttatagagtacttactagggttttacacatattaactcctaattctcaaaatgtccctattggccgggcgcagtggcacacgcctgtaatcctagtactttgggagcccaaggtgggcggatcacttgaggtcaggagttcaagaccagcctggccaacatgctgaaatcccatctctactaaaaattcaaaaattagctgggcatggtggcacgcacctgtaatcccagctactcaggaggctgaggcaggagaatctcttaaacccaggaggtggagattgcagtgagccaagatcacgccactgtactccaacctgggcaacagagcgagatcctgtgtcaaaaagaaaaaaacaaaaaaaacagcatactttgtattaggtgaacccacaaagtacaggggccaattgtaggtagtccacaaacacttttaaatctttgtgcatttattgtatgttagaaaaatttatacatagcatattaaagcattaatataaaatatcttttaaaaattaaggtatatcttcaaaagaaaggaaaacatcaagtaaacaattatagataaataaagtacaggtaaaaggcagatgtggtaacaattgtatgaagaggaatacaagtgtctagggcttgggggccacacactaaacctggcatcagaaggcccagatctgggacccrgctcatttgttttctagcactaggttgtttttcatccttgtataacaccatggcccaggtactactctaagcactttataaaaattaactcctggccgggtgcggtggctcacgcctgtaatcccaacacttttggaggccaaggtgagtggatcacctgaggtcaggagttcaagaccagcctgaccaacatggagaaaccccatctctaccaaaaatacaaaattagccaggagtggtggtgcttgcctgtaatcccagctactcgggaggctgaggcaggagaatcacttgaacccaggaggcggaggttgcggtgagccgagatcgcgccattgcactccagcctgggcaacaaaagcgaaactctgtctcaaaaaaaaaaaaaaaaaattaacttcttggccaggcacggtggctaacacctgtaatcccagcactttgagaggccgaggcagacagatcatgaggtcaagagattgagaccatcctggccaacatggtgaaatgccgtctttactaaaattacaaaaattagctgggtgtggcacatggctgtagtcccagctactcaggaggctgasacaggagaatcgcttgaacccaggaggcggaggttgcagtgagccaagatcgcaccactgcactccagcctggtaacagagcaacactccgtctcaaaaaaaaaaaaaaaattaactccttggccagacatggtggygcacacttaaatcccagcactttgggaggctgaggcaagaggctcacttaaggttaggagttcaagaccagcctgagctacaaagtgagaaaataaataaataaataaattactcctttaatcctcacaaccgtctattgaggtaggtactgtcatcatacccatttctgagaaaacaaagtctcagagagactaaatagcttactcaaaaccacgcagcgcatgagaggcggagctagaattcaacatcaaggattgtattagaaaaggcaataccagcttatcaacccaaaacacgagaggagagtttatctctccttcacgcagttgtccagggtccccaactccttcctccctagatggaagatgggctttttttttttgagacataaatatatatatatrtgtgtgtgtgtgtgtgtgtgtgtgtatacatatatgtgtgtgtgtgtgtatatacatatatatatatatatatatatttttttttttttttttttttttgagacagggtctcactctgtggcccaggctggagtgcggtggtaccatcttggctcatcacaacctccacctcctgggttcaaacaattctcgtgcctcagcttcctgagtggctgggattacaggtttgcattaccacacccagctaatttttatatttttagtagagatgggattttgccatgttggccaggctggtgtcgaactcatgacctcaagtgatccacctgcctcggcctcccaaagtgctgggattataagtgtgagccaccaggccctgccaggaagatgggttttatttgaaccactgggccctactgggatgggtagaattttctgtatcattctgggatccacatcctcctctgaaaatggggttaataatgctagttctatttacccctcagggtagctctgctgctcaaggggatagaggcaagagtgtcctgcaaactgcaaaaagttccttgaatgtaaaatgttagtatgtattgttaatgatattgaccaaagctacattaccatgttacagtgaagattaattgaaacagtgcatggaaagaccttggttcacatacagacaaagtcagctgtgagtaatagccataatagtaatgtggttatgcaatttaaaatattgatttatctccaaattgggatatagttgtataggatctttcttactagcaagttaacacattacgtctataactaaaaaatcaagaagtcttgatttcttgagaagtcagtataaccatgatgtttagaaatacaaacaagaggctgggcacggtggctcacgcctgtaatcccagcactttgggaggccgaggcgggcagatcacaaggtcaggagttcgagaccagcctggccaacatggtgaaaccctgtctctactaataataccaaaaaaattagctgggcatagtggcgggcacctgtaatccctgctactgtggaggctgaggcaggagaatctcttgaatgtgggaggtggaggtttcagtgagctgagatcacgccattgcattccagcctgggcaacaagagcaaaactccatctcaaaaaaaaaaaaaaaaaaaaaaaaaaaaactgggccggccacagtggctcaaaatgctgtaatcctggcattttgggaggatgagtggggggatcgtttgaacccaggaggtcgaggctgtagtgaacaaacatcatgccactgcactccagcttggatgatagactgagaccctgcctcaaaaaaagagaaaggaaaataaataaataaatgaaaatttaaaaggaaaagaaaatatttaaacgctatttcaaacaatctcaaatgtacctggaaacagttgggacaggaagtcatgaagggaatggggcagagttagagaaggtcagagtacagccatgtttcacatcccagctgaaactcctccaacagctttgtatcgcccttcaaatacaacctgagctctttttctttctttctttcttttgtttttctgagttggagtctcactctgtcatccaggctagagtgcagtggcatgatcttggctcactgcaacctccgcctcccaagaagctgggattacaggcgcgtgtcaccatgcccagcaatttttgtatttttaatagagtcagggttttaccatgttgccaggctggtctcaaactcctgacctcaagcgatttgtccaccttggcctcccgtgagccgccgcgcccggccctgggctcttttctttgaccaaaaggctctcacaggctctgactcttgtctgatggtctctcgtctttctccctttggtcactgcagtcagccacactggacttttgttttttttgtttgtttgtttgttttgcgacggagtctcactctttcacccaggctggagtgcggtggcgcgatctcggctcactgcaagctccgcctcccgggttcacgccattctcccgcctcagcccccccaagtagctgggactacaggcgcccgccactgcgcccggctaattttttgtatttttagtagagacggggtttcaccgtgttagccaggatggtctcgatctcctgaccttgtgacctgcccgcctcggcctcccgaagtgctgggattacaggcgtgagccacaacgcccagccacactggccttttgacaatccttcaatcacgccaagcacactcctgccattgggcctttgtacttgctgttctctctgccaggaatgcctcttccccagatctttgcatagctgatttcttctcattgtcagggccttagttcaaatgtcctccactcagagcagcctcccttgaacacccaaatctaagcctgccccacctccatcccttgatagcaattccattatcctctacagcgctgaaattacgtattccttgatctgtttatcatctgtctccttcacagaagttccatgacagcagggagttaggctgtcttgtcccctgctgtatccccagcatgtagaacagtgcttgacacacagtaggcgccccataagtatttgcggaatgagcaaatacagatggggacagctgagtcagtagggtgagcagctggatgggccagtagtggagggaggaaacggcagcctctgcctgggccttgccctgggtaaacagacctctctctccccagacagccactgtttgacgactgtctgccatgggcctggctgagcctgggccgccaaactgccaacgcctctgtattctctgggacaagcagtggaggcagccatacctccagcagagtttgtgaaggagcaggtcagaaagttgtccaaacaggcatgaggaagggcagaggaggtggggagacagggagagagcaggcggccctgccctgggcagagccagagaaactggagggaggcctgggtgctcccctgggcagcttcccaggcaaacccagctgcctgcagggctcagcgctgggagcaggttgtggtcccagctctagccctgacacacacaggatctcaggtacttgacatttgtaggccttagcttccttacttgtaagttagaggctatgggcagattagtggctttcaaacaattttttttgttgttgctttttgtttttgagacggagtctcaatcttgtcgccgaggctggaatgcaatggttcgatctgggctcactgcaatctccgcctcccaggttcaagtaattctcctgcctcagcctctggagtagctgggattacaggcgcgtgccactactgcccagctaatttttgtatttttagtagagacggggtttcgccatgttggccaggctggtcttgaacacagcaagattctgtctctacaaaaaatacaaaaattagaggctgggcccggtggctcacacctgtaatcccagcactttgggaggtggaggtgggcagatcacttgaggtcaggaattcgagatcagcttggccaacagtgggaaatcccatctctactaaaaatgcaaaaattagccaggcatgctggagcacgcctgtaatcccagctacttaggaggctggggcaggagaatctcttgaacccaggaggtggagattgccgtgagccaagatcgccactgcactccagcctgggcgacagagcaagaycctgtcaaaaaaataaattaaagaaaatcccaactttcacctcctttaaaaaaagtgaaggtctagcaacactgatacctatgagacaacagtctcctggagccactttagattctcatgcttcctctaatttgcygtagtccccactattccttagtgtccccatacggaaacttattaatgaacataaatcaccatgtttgctgtattgtttttcttagaggaacgtgtgaactttgctcacaccctatctgttccatttatttcagttacttctctgggtattgagggcacttgagtgtgggacccctgatcactgagaccaaagcagagttcatttatttgcacgagcaatcttctatttcatagatttaccatgtttttaagtgactacaagaaaagtttaaattatgtctgtggctcacattctatttctattggccagcactggccgggtccctcagattctatagcagtgtacgtgtgcttgctgctaactcattctgcctccattttccattcttgcgtagaccaatcccagtcaaatctcttgggctggtgtcttctccccaccccacagttatctttggtgcctccaccctggttagctggccacctgtctgtccagaggatccaggctccagaactccaggcatgtcttctagaattctccacatgggaaatctcactcccaggccccatctggcagccattgtgttttctttatcagacattcacataaaacaatagtcaatttgaaagctaaatacacatccattcttctgtctccagcctgtaaatttaccccaaatccagtaatttgggaggtggagttggtgggaagaggtttttttttccccctcttctccagggcaagtcatatagtttttctggagatgaggtggactgagtttgggggaagaacacaggtccatctacagtgaaagcgctgactttgtttttggagaagatggtgtcatggcttctctggggagatgagatgagggaatcctgaagacttagggggccgggaggaaaaggaatcttggcaatgatgaagacaccttcaaatgaaggggctaatagggtagtggctgagaatttgtgctgcagtcgggagggcttgggttagagctacatccacagtatgaccttggacaggtgactttatctctctgatcctcagtctcctcatctgtaaaataaggataagaatagacttgacttccacttcaacgagaagtgaaacgagatatcctaccactgygctttgcacataaaggctctataaatgtcagctgtcatcataaagagccaaaagtggcatttggagtaaatctgatttgtttttaagagatagggttttgctgtgtcacccgggctggagtgcagtggcatagtcaaaacccactacagcctcaaattcctgggctcaagccatcctctcgcctaagcctcacaagtagctgggactacagacacacaccaccatgcctgtctaacgtttactttttaatttttttaagttttaaaattttctgtagagatggggtcttactgtgttgcccaggctggtctcaaactcctagcctgaaatgatccttccaactcagcctcccaaagcactgggattacaggtgttagccaccacacccagcctagtttaattcttttttaatcatccttctctgcatttttgtaattcctctaccatgaacctgctttagttaagtaagaaacagttaactgggggaggagaaataaaaccaaacccctaaaaagcccctaataaacccctaaacgtggggtccaacatgaggtgttatggctgggaaaaggtaagagatcaaactatacacacccttttttttttaaattaaactttttagttttttcagagacagtcttgctccattgcccaggctagaataatggcatgatctcggctcactgcaacctccgcctcctgggttcaagcaattctcctgcctcagcctcctgagtagctggaactacaggcacgcaccaccatgcctggcttctttttgtatttttagtagaggtggggtttcaccatgttggccagcctgatctcgaactcctgacctctggtgatccacctacctcagcctcccaaactgctgggattacaggtgtgagccactgcaccaggccttaattaaacttttattttagattcagggggtacatgtacaggtttgttacatgggtatattgtgtgacactgaagtttaggctatgattgagctcatcacccaagtagtgagcatagtacccaacagagagttttttagcccttgcccttcctctagaagtccgcagcgtctattgttcctctcttgatgtcaacgtgtacccaatgtttagcttccttttacaagtgagaacatgcagtatttgtttttttgtttctgtgttgattcacttaggatgakgtcctccagctccattcctggtgtggcaaaggacacgactttgttcccttttttatttttttgacactgtccttgaacttggttgaggttttgttcccttttatggctgcatactattccatagtgtatatgtaccacattttcattatccattccactgctgatgggcacttaggttgattccatgtctttctactgttttgttttgtttragatggagtctcactctgtcacccaggctggagtgcagtggcgcaatctcagctcactgcaacctctgcctcccaggttcaagccattctcctgtctcagcctcccaagtagctgggattacaggcatgtgccaccatgcctggctaatttttgtatttttagtagagacacagttttaccatgttagccaggttggtctcgaactcctgacctcaggtgatccgcccgcctcggcctcccaaagtgctaggattacaggcgtgagccactgtgcttggctgatgtctttctattgtgaatagtgctgtgtagaacatataagtgcatgtgtctttttggtagaagaattcattttcctttggttatataccaaatcatgaaattgctaaattgaatggtggttctgttttaagttctttgagaaatctccaaatagctttccacagtggctgaactaatttatattcccaccaacagtgtataagtgttcccttttttccacagccttgccaacatctgttatttttttgactttttaatgacagccattcttcagatatcaagggtggggacaaaaaaagaaacttaataatcattttgactagtgtgagatggtatctcacgatttcatttgcatttctctgatgattagtgatgttgaacattttttcatctttgttggccgcttgtacatcttcttttgagaagtgtctgttcatgtgctctatccactttttgttggggttctttgttttttgcttgttgaattgtttaagttccttgtaggttctagctccttgtagaattgctaagttccttgtagacctttgttggattcagagttcgcaaatattttctcccattctgtaggttgcctgtttactctgttgatagtttcttttgctgtgtagaggctctttagtttaattaggtgtcacttgtcaatttttggttttgttgcgattgctttggaggatttagtcataaattttttgccagggaaatgtttttgttttttttttttgagacagggtcttgctctgtcacccagggtgttaataacttaacaaactgagaccccaagaggaaaggtgattcggccaaagtcatacagtaagttagtggcagagccaagactagaatggtggactgtgggtgttggaagggaactttgaggttgttagggcagcctttcctaaggcgaggcccctcagacaagaaggattctattgttagatgtttgaaaactgctgaattaaagaaagctgcacaaatttcattatccgagaacttctcagaattcttaacacatgacaataccttggccactccaagaaatgcctgcagtgtatagggccctgaattagtttcaagagtcccttgaaggacattgacacctatgcaagctctccctgctctcagacagagaaatgctatatcttagatatactcctagttgcttttaaaaaataggattctagggccgggcatggtggctcatgcctgtaatcccagcactttgggaggttgaggcaggcggatcacgaggttaagagtttgagatcagcctgaccaacatgatgaaactctgtctctactaaaaatacaaaaaaaattagccgggcatggtaattagccgggcatggtggcatgcacctgtaatcctagctactcaggaggctgaggcaggagaattgcttcaacccgggaggcagaggttgcagtgagccgagatcatgccactgcactccagcctgggcaacagactgagactctgtctcaaagaaaaaaatatatatatagatttctagatttttatccacggttgcttgtcattgtgcaaattgttgtcattgtgcaaattgtatgatttttaaaattatactaccaagttgtctgtcgctggtatgtaggaagatggttgacttttttttataatctcatttctcctttttttaaagtaagaaatattacaaatatgcagagaagtatagagaataatattatgaacatttatgtatccacctctcaattttgtcaaatcttactacatgaccatgttttctttggatgttgtttgtttgtttgtttgttttaatgacaaattaaacattacacttagagttgaagccccttgtcttcctgatcccatcaccctgccacccttatcagtggtgatcatggtcaccatttggtatttatcatgtgtatttggtatttatctggtaatgtgtcattaccagacacattttcacagttctaccatacgtggctatataagcaaagtaaaatattttgcttatctggaaaatttatttaaatgatatactgtacatatcctgcagcaacttccttttattactcctcataataggtctctggatcttttcatgatgatacaagttgcaccagaccactcatttaaaatgctgtgtaggctgggtgcagtggctcacctgtaattccaacactttgggaggccgaggcaagtagatcacttaagcccaggagttcaagagccagcctgggcaacatggtgaaaccctgtctctatcaaaaaataaaataaaaaagaaataaaatagataaaatgctgtgtatccatgaagtactatacagtcataaaaaagaatgaaatcatgtcctctgcagcaacatggatatggctggaaaccattatccgaagcaaactaatgcagaaacagaaattcaaataacatatgttctcacctatacgtgggggctaaaccttgggtacacatggacataaagatgggaacaataggcactggagaaaccaaaggggttagagagggagggggcaaatgttgaaaaactacctattgggtaccatgctcattacctgggtgatgaattcattcatactggaaaccccagcatcatgcaatatacctttgtaacaaacctatacgtgtacctcctgattcgaaaataaaagttgaaataacgggccaggcaatgtttaaaaacacatgcagccgggcgcggtagctcatgcctgtaatccaagcactttgggaggccgaggcgggtggatcacttgagatcaggagttcgagacaagcctgggcaacatggtgaaaccctatctctattgaaaatataaaaattaaccaggcctggtggtgggcacctgtaatcccagccacttgggaggctgaggcatgagaatcgcttaaacctgggaggcaggtaaaaaaaacaaagttgaaataacaaaaaataaaataaaagtgtctgtaaatatcctgagtatatttattctgttttgtttatttgtttgttttgagatggagtctcactctgttactcaggctggagtgcagttgcacgatcttggctcactatctcagatgatgctccaaagactattcttatacctgtggatgagagtttctctaggtaacatgcagagatggaatttctgtatcttagacagtggatatcaacacttttaagagatgttgctaaattgctcattcttgaatgccaacttccacttccaacaatagttacagagttttggttgctctacaacctcatcagcacttgattttgtaagatactgaatgtaaaattatgcttcactttcaaatttacatttcctctattactagagaaggagaggctcttttgccatttgagcttcctacattatgagtgtgcttgtttgtatcctttgaccatttatctattgtattatttacctttccttatcaatttgtaggcattttttagcactcttagaaacatcttttatgcatgtatttttttttttttttgaaacagagtcttactctgtcgcccggctggagtgcagtggcgtgatctcggctcactacaacctccacctcccaggttcaagtgatttttctgcctcagcctcccgagtagctggggttacaggcatgcaccgccgcacccagctgatttttgtatttttagtagagacagggtttcactatgttgcccaggctggtcttgaacacctgaccaaaggtgatccatccacctcagcctcccaaagtgctgggattacaggtgtgagccaccacgcccagccgaccatttttaaacgtacagttcagagacattaaatatattcacattgtaatacaaccatcagcaccatccatcacctgaacttttttcatcttcccacactgaaactgtacccattagaaaatagctccccttgggaggctaacatggagaaacctcgtctctactaaaaatacaaaataaatactaaaaatacaaaaaaattagccgggcgtggtggtgcgtgcctgtaatcccaggtactcaggaggctgaggcaggagactcgcttgaacccgggaagtggaggttgcagtgagccgagatcgcaccactgcactccagcctgggccacagagagagaccccgtctcaaaaaaaaaaaaaaaagaaaagaaaagaaaagaaaatagttctcctttcttcccaggccctggcaaaccccttctactttctgtctctgtgaatttgactactttcctgtaggctagtggaatcatacagtatttgttctttgtgactagcttttcccctagcataatgccctcaggatccatccatgttgtagcatgtgtcagaatttccatcctttttaaggctgaataatattccattgtatgcatataccacattttattgatccattcatccattgattgacacttgggttgcctgtaccttttggctattatgaataatgctgctatgaacttgagtatacaaatctctcttccagatgctacttttggttcttttgggtatatactcgggagtacaattgctagatcatatgatagttctatttttcattttttaggaagccgccatactgcttgccacagaagctgcactattttacgttcccaccagcagtgataggaacgtaaaagggttacaatttctccacatcttcaccaacacttactattgtctgttttgttgttgttttataatatccatcctaatgggtgtgaggtggtctcttattgtgtgttttgtttgtttgtttgtcttggttttttttggagacatagtcttgctctgtcgcccaggctggagtgcagtagtgcagtctcagctcactgcaaacttctcctccagggttcaagcgattctcctgcttcagcctcccaggtagctgagattacaggcatgtgccatcacacccggataatttttcttttccttttttttttttttttttttgagacagagtctcactgtgtggcacagactggggtgcagtggcgcgatcttggctcactgcaacctctgcctcccaggttcaagcgattctcctacctcagcctcctgagtagctgggattacagatgcatgccaccatgcccggctaatttttgtatttttagtagagatggggtttcaccatgctggccaggctggtcttgaactcctgacctcgtgatccgcccgccttggcctcccaaagtgctgggattacaggcgtgagccactgtgcctggcccacacccagataatttttatattgtttagtagatttgggattttgccatgttggccaggctggtctcaaactcctgacctcaagtgatccacttgccctggcctcccaaagtgctgggattacaggcatgagccactgtgcccagcctcttattgcagttttgatttgcacttccctaatgattagtgatgttaagtatctttttatgtgcttaatggttatttgtatatcttccttggagaaatgcctattcaagtcctttgccaatttttttgttttcttgagacaggtcttgctctgtcacccaggctagagtgcagcagcaggatcgtggctcaccacagcctcaaactccttgactcaagtggtcctcccacctcggcctcccaagtaagctgggactacaggtgtgcagcatgcctggctaatttttaaatttttctgtagagacaaagtttcactatgttgcccaggctggtcttaaactyctgagctcaagcaatcctcctgcctctgcctcacaaagtggtgagattacagacttgagccactacacctggcctctttgtccatttttaaagtttttggttgttgttattgagttgtaagagttctttatatatttcggacattaaccccttatcagatatatgattggcaaatattttctcccattctgtaagttgctttttcactcagtcaagtgtcctttggtgcacaaatttttctaattttgatgtagtccaatttatctaatttttaaaaatttcctgtgcttttggtgtcatatccaagaaatcatcaccaaatctaatatcatgaagcttttcccttatgttttattccaaaggttttatacttttccgtcaaactcatttttagttaattttcgtatatggtgtaaggaaagagtctgatttcattcttttgcatgtggatatacagtttcccaaacatgaatttggttttgatagtactttgttaattaagacttttgcacctggtagacgctctttgdcctctaacccactggaatcctctcaccatccttccctgacagttgaccatttagcttgggcttaatacttccaatgacggaatactcactacttaataaagcagcttttcctgtggtagaacaattgtattttatagaaagatctccattttgagcctcaagtttcctccctgtagcatccacattttggtcctcgttcattctctgaagctgtaggaatcagtgagagcttttttttttttttttttgagacagagttttactctgtcacccaggctggagtgcagtggcacgatctctgctcactgcaacctccaactccagggttcaaatgattctcctgtctcactctcctgagtagctgggactacaggcacatgacaccacatctggcttatttttgtatttttagtagacggggtttcaccatgttggccacrtgaaactggtctcaaactcctggcttcaactgatctgcctgcctcagccccacaagtgctgagattacaggcgtgagccacttcacccagccagtgggcactcttttccaaaggaaagtactttgttgccttttttttgagactgagtctcaatctatcacccaggatggcgtgcagcggcacgatctcagctcattgcaacctctgcctcccaggttcaagtgattcttgtgcctcagcctcccaagtagctgggattacaggtgactgccaccacgcccggctaatttttgtgtttttagtagagacagggtttcaccatgttggtcaggctggtctggaactcctgacctcaagtgatccacccacctcagcctcccaaagtgctgggattacaggcctgagccaccgcacccggcaggaaagtactttgaattgagtaaataacgcaactatatgctgggcagctacctgccaggtttataaggtttaacacatttactccacaaagcaatctatgaaaaggtcctatcattgattcctattttatagatgaagcaaataaggcttgaagagcttatgattttagcaaggtccaacagctatgtaaatggcaccactgatatttcaaaggcaatggccctgaccactctgctacaccacctttctctcctcttctccaatacccagcccagaactcttttggatctttgattattcttcaaggggcatagctttctttctttctttctttctttttttttttttgagacgaactctcgctctgctgccgggmtagagtgcggtggcgagatctcggctcactgcaccctccgcctcccaggttcaagcaattctcctgcctcagcctcccaagtagctgggactacaggtgcgtaccactacgcaaggctaatttttgtatttttagtagagatggagtttcaccatgttggccaacatgatctcgatctcttgacctcgtgatccgcccgccttggcctcccaaagcgccaggattacaggcatgagccatgccgctgcactcggcctaaggggcatagctttctcatcctctgccatcctaggaaaattttaagtattcatattaaaatgaaaactaaacacaattgtccatatatgctccttaggagtagaatgccaaggacctcttagctcctctgacctgggaactacattctctctaatgatacatacgactgggttagaggtttgggcagctgccaccaagtaaaacctctagaattttgctatgtcactttctgctaaggtagcttttcccatctacactaaataaataaatcatccaggtgatttatttttaaccaatgcagaggattttttacttatctccatggagttcaaacatttctccaggctgggtggggtgactcacgtctgtaatcccaacactttgaagactaagaaggggcagattgcttgaacccaagagttccagaccagcctgggcaacatggtgaaatcccatatctacaaaatatagaaaaattagccaggggtggtggtccacacatgtagtcccagctactctggaggctgaggtaggaggatcatctgagcctggagacttggaggctgcagtgagctgtgatggcgccactgcactccagcctgagtgacagagaccctgtctcaaaaaaaacaaacaataattcaccaaatctatttggatctggatcctgccatcattttataggtaatgcctccatagcactcactaagtgccaggcacacttctaagccctttttatacattaacacaaataatccccaccacgacctaatgccatacacatcattatggtcactattttgcaaataagaaaacagtcacagagcagttcagtaacttgtccagggtcacacagctagtccatgactgaaccagaatttaagcccaggatgtcaagttccagaattggtacactcagcctcaatactgtgctgccttcaaatattctgacaatcttagacagctttggggatccaaaagattgagaagtactcttggggacctcttttttttttttttttttaaatacggagtctcaactctctcccccaggctggagtgcagtggtacaatctcagctcactgcaacctccgcctcctgggttcaagtgattctcctgcctcagcctcccaagwggctgggatattacaggcacatgccatcatgcccagctaatttttgcattttaagtagagacaggatatcaccatgttggctagggtggtcttgaactcctgacctcaagtgatctgcccacctcagccccccaaactgctgggattacaggcatgagccaccgcacctggctcccattttttttttaagacggagtttcactcttgttgcccaggctggagtgcaatggagcgatctcggctcactgcaacctccgcctcccaggttcaagcaattctcctgtctcagcctcctgagtagctgggattacaggcacatgccaccacacccggctaatttttgtatttttagtagagatggggtttcctcatattggtcaggctggtctcgaactcctgacctcaggtgatcttcccacctcggcctcccaaattcctgggattacaggtgtgagccatcacgcctggcccctggctcctttttttttttttttttttttttttaaataaagaccaaaggtccagaggctttgaaaggcaaatagtattaagtcaggatttgatatcaggatttctttcattctgtttattttctcattgctttctacttatgatactgtttcatttggtagtaataatatttctttctaaaataaattgaagtaaaaagaagtgagttgatgtaagaaaaatgttacagatatgaaaaaatcataatggtcattaaaaaattagtgaaactttggaaagactgtgttcagtcaagtgaagtgaagttagcttgcaaccacaaaaaaacccctaagtctcaatggtttgaacagcaaagttaattgctcacctatagtacacgcccagcatgggtcggcagggggcgctccgcgttgtggaacgattcatatctatacttgcttccccaacaagggcagcactggcctttaaagcttctgcccaggtgtgacacaggttgtttctgctcacatctcgttacctgaaacaagtaacatggtcacatctcatttcaaaggaagcaagaaaatgtaatccccatcatgtgccggaaaggagagaaatagaatagttgagaacagccctcagagagactataagtaagggggcataaaagatgggtctagagagataggctgagtcatgactcactgaatttgtctgacgtagatcatgatggcccatcccaccaagtggccaacatttgttcccagaaaagggagtgtgatgatcccccagaaagaacacagtctgacaacattattctgatgagcagacacacctctcaggctgccactcaggagtccttttgggtggggaggtggggatgctgatatttcctaagtggtttcagctgaactctgtgatctttttttttttttttttttttttttttgcctattccctgaagggagatgaggcaatttgggctttggctgagctagggtttggttctgtcaccacttgctatctagggaagggtaataattggaaaggagaggaattcaaggagagggtccaggtgggtagggagcctcacacagggtttggtgatcaggtgattgagaggcctccttgaggagttttcaaagtgcggtctgagggcacctggtatcagaagtgcccagaagctcrttaaacacttgggccaggtgctccatggctcctgcctttaatcccagcactttgggaggctgatttgcttgaggctggggttcaagacaagcctggacaacatagcaagacacctccccccgtctctattttttaattaattaatttgtttgtttattaatttatggactctcactctgtcgcccaggctggagtgtagtggcctgatctcttctcactgcaacctccgcctcccaggttcaagcaattctcctgccccagcctcccaagtagctgaaattacaggcatgcaccaccacacccagctagtttttgtacttttagtagagacaaggtttcaccatgttggccaggctggtcttgaattcttagtctccagtgatccacctgccttggcctcccaaagtgttgggattacaggcatgagccaccatgccccacctctatttattaaatattttcttttttttaatctgatgactaggcccactgttggtcctggcacctggaggtaggaccccaggcatctgattttttttgttgttttttttaaggcagggtctcgctctggcgcccaggctggagtgcagtggcacgatcttcactcactggaacctccacctcccaggttcaagcgattctcctgcttcagcctcccgagtagctgggattacaggcatgcaccatcacgcctggctaattttttttttaatagagacagggtttcaccatgttggccaggctggtcttgaactcctgaactcaggtgatccacccacctcccaaagtgctgggattacaggcgtgagccaccgtgcccagccaccatctgattttttttttttttttttttttttgagacagagttttgctcttgttaaccaggctggagtgcaatggcacgatcccggctcaccacaacctctgcctcatgggtttaagtgattttcctgtctcagcctcccaagtagctgggattacaggcatgtgctaccacgctcggctaattttgtatttttagtagagacgaggtctcaccatgtttggcaggctggtctcgaactcctgaactcaagtggtccacctgcctcagcctcccgaagtgctgggattacaggtgtaagccacctcgcccagctgccatctgaatttttaataatggccccagatgattcttatggacaccaagatttgagaagcattgaatgactgagagaaaatttcttgtaagggtagaagcccagcacagtggttctcagtggagataatttcaacccccaagggacatttataaatgtctggagatagttttggttatcacaccttgagggtagggaaaagtgctgctgacatctagtggctagaggccagacatgctgccagggacaatgtacaggacagtccccacgacaaagaattctctagcccaaatgtcattagtgcttaggtcaagaaaccctggttagccattaagagtttgaacctttctaaatgttggagcacatacgatttttaaatcttcaatttttattttattttccaaaatttctactatatgcatagaatccttttcattgaatacctgttacgcaccgagcacttgaagtttacatcactatcagttcctcttgaaagaccttttcagtcattcatccaacaactatccattaaacacttactaaaatgtattccaggccaggtgtggtggctcatgcctgtaatcccagcactctgggaggccgaggtgggtggatcacctgaggtcaggagtttgagatcagcctggccaacatggcgaaaccccgtctctactaaaaattaaaaaattagctgggtgtggatcccagctactcaggaggctgaggcaggagaattgcttgaacctgggaggcggaggttgcagcaagccgagatcgtgccattgctctccagcctgagtgacaagagcgaaacttcatcttaaaaaaaaaaaaaaaaaaaaaaaaagaagtattccaggcagaggggaaagtatatgcaaaggcccccaagacaggaaagaaaaactttaaaatggctagtatgcctgctgctgataggggtgggggcaagtggaatgaaatgaggttggacacggagggatataaaaacaagggcgtgcatggcctcacagtgttaagtgggagttgtatgagttttgttataaatgcataggaagtcataaaaatttaagtagaagaggatctgagccaatgtacatttgtacaagatcacccttggcccctgagtgaagagtagggggtagggaagccacaggagaaaaagtgaaggggtggggtggaggcaggcggggggggggggaggcggggggggcggtggagcgggggagatcccctccccaaccctggcaggtttaaaaaaaaaaaaagggaagaagtgaaaagacttttgcagacctccagagatgatgcataaggttggctggggtggagatggaaagatggaaaatctagattctgtttggagggtggcaagaactggattttctgatgaactggaaggcatgagaaacacaacacaaagattgtgacttgcaagatgttggcttgaataattgagagaaggtgggtgatgatatatgacatgtagatatgactatcattctcttttgacgactgaggaaggggaggtgagtcgtcctacttcacaaagatagtatatgggctccaggtgtgtctaacccaaaggttataatttttccacactcctatatccacacattaatttttttttttaaattgagacaagagtctcactctatcacccaggctggagtgcagtggcgccatcgtggctcactgcagcctccaactcctgggatccagcgatcctcccaccttggccacctaaagctggagttacaggcatgcaccatcacgccctgcctatcttaattttcataatgggtatgacatttactgatagtaatatcattatacatgccccatacatgctaacatctgcttccacatggaagcagcacaaagcctggaaccttcctcaaagaccccccccacccccgtacattggaacaaggtgctgggaacagaagtttagtaggtggtggaagggcagcggctgctaccctgggaactggttttaaaatcttacgttctgattgctgccgtggccatgtgctggtgtgtgatggggagatgttcttttaggtaactaaatccaacgagctgtgattggtgatcgaaccgagcaggcctcctctggatttggagagacatagtgcgtctgggcctgtgattggcgggattgctgtgattggtgaagtccctaaggctatctaagtttctgaacaccagttcctgcgttggccacgaggaggagcccaggaagcgcaaagcgcagcactgcggagagtcttggccgcctcctccgggacgccctccggcccagcgcggtgcctgccctgccctgcgccctggggcaaccgcgggatgaggtggggcggcaaagggtgtcagggctcccagctgcggcccgggtggccacgcttctctgcacagttcctttggcctcttcccctggctcccagccccacagaagacattggctgacccgaggggtggggctgcgggttcgcgaaggtttgtgaaggcccagatccaagttgcaaaactgtggagtctatcaagtgagacttagcagccccactccctcaggtgcgccccttgccctcctcagagtccttctctcaagtttagcagcctccaccgtgccctttaagatcctcaaagaacttttgcaaagtggcatctcattggagctaaaatgacctgtgcaggcaaaggccactagctcaggggatcgtcctgcccatccccaggtgctatcacatcgcgctgtgcgtcttcactgcacttaaccactgtttgtaattgacttcgtttttcatgtatttacttgcttatgtctgcaacccgcctctccaccaaaacgcaagctctgtgagggagggtgtagggttgcccgacacaacacaggacacccagtttcatatgagtgtcagatgaacaccacagtttaaaagtataagcaggtcccatgcattatttgggacacgctcatactaacgaagtatttcttgtgtatcttaaattcacatttgactgggcatcctgtatttttatttgctcatctgcacccctctgagggggatattttgcccatggtcttccctgctgcatctccaccacccacaacgatgcacgcagaaggtgctgaataaatgttgactgtttcratggacgatttccatcctttattcactcagttattcatccagcctatttatatcaagtgggtcctgggaatacaatggtagatgggacacagtccagtggaggaggcacacaaccagtctaattaccatctgactaaacgatgatgatgtaaagctttgggggctatggggggacagaggaggaccccggcgttctgtttcccggaggaagatgactaagatgggacttggaggatgagaaggcaaagaaggaagtgcgacagctctctgcttgagaccacggggttctggaagctgcagggggctggggagggcaaatgtgcagtgtgggcgtggcagtcaggaaaaggtgagaaggagactcacattcactggatgttactacccaccagccagcacaagagggatgccatgttgctattattgtgcccatcatacagatgaggaagctgaggctcagagaagtgaaatgcctcggctaagtttacagtcgtggagggaaaagctgagcttcaagctcaggtctggcagactctgaagcctgcactcttctagaaaagccactgggttaaggattacaatgccaatagggggatggagaaacacgctcagaaaggtgatagggctctccctgtgaatatggctctgtccagttgagcagaatactgaagcaatgcaagagttatggttttttccaagccctccagagagacaacaggagggccagagcaggacccaggagtccagaccactgtgtctcccattcctattggggttggctctctaggagccccttgcagagccctggggctaattccttgcatggatcctggacaggtctgcagtttccatggagaccgcctcccaccatccctgaaatctcattgtgaccagtattaagggattaactctgcccagcggccctcgcagggtctggggtgctgagaggggccagcaggagctccctcaaggatgaagaggttgtgcactgtgcgggaccccatagcagcaggaggaggatgtcggactggggccagggcttcccccaggacccaccaggtatggtcctgactccacatctgcctggaaggaaggatgggatggtaggagagagacacagaaccaagggggaggattccagactgggagcagtgtggaggatttgtaccctcatcccctaacccaggaacgtccatggccctgatgggtgaatgacgttccaatcagagaaggagaatccagacgacctcaacaaggtgagaggagccccgtagagtattaggggtagtccaaggctgcctaaagaccagatctcttatctctctcattttgcagttggggaaactgaggcacggagagggaaaatgacttgcccaaagccagtgagtcagcaaactgaagcaggtcaagaatccagagggaaccctgaagttccctgagcagaaaacratcggttaaaatctcattgccacttctgccttgaactccaaatcctccttcctgagctccaggcatggggtcccctccatcccctcacccagagcttgtctcatcggccatgcttccctccctgcctctcatcctcctcctgacttcccctgccacccgcaccacctgaggctggcagagagttcctggcaggttctccagtgctgacgggcacagccaccaggcccccactattccatccaggggacaccttcccactgggtccctatctggatgacttgggacattctttgttctacacttcatcctctctttgggatttctgagtccagacacagtgaggaccccgacagcccccctcctcacctcttgtcctgggaaggccaggcctgcrtggcagagatgtaaccagactccaaagctttctgggccgggcttcatggaaggccgtatcggtgcaggggcataaacacaagctctggagccaggtagagatagttctaacaccattgccttggctcactgggaaaatgatgtttcttctctgagcctcagtttcctcacctgtgatgggagacgagaacccttccatcctcaaagcttgctctcagctgctatggaagcatctccaggttgtgatattaaatgaaccaaacaagatacagaacagtgtaagagcagaggctactcatgtatgatcttacatgctatctggtctgtataaagaaaccttggcagatacatctgtaagggatgtggttccccatagtgaggaagtcaaggagaacaggtgaacaggagacagctggaagcaagacttctcaatttacaccttttatgttttgattctgaaccatgcgaatgtagcaccaattcaaaactaaatgtaaagatgttcacaaattaagtaaaatattaaataataataataacacatacctcaataatatgaccggtgtgcagtcaagatttaggcccaggtactagaaattgactcaaagcaacagaggaggcctgtcttcaagtcaccgaatccttgacctagaaaggccctttattttgtcaacgtcaaattgcccataacaacaataatagtcttggtagcaagaatcaggagctccctacttggggaacatggtgccaagcactgtctgaacattatctcatttaattggcattttgattttgtgaggaaacgatcatcattccctctttacagatgggaaaactgagcctcgctgaggttttgactagtaagttgtagtaagtgatagaacttgatgccatcgaaggctttccaggttcaaatttgaagcccccctacagtgggtctcaatattggctgcacaaaaatatagacgcctggcacctccccacccctaccccaagattcgatcattgatctgtgatagggactgggcatctgtctttaattttaaaaaatctttttaaaaaatagacatagggtctcactatgttgcccaggctggtctcaaactcctggrttcaagtaaacctcccatctcagcctcccaaagtgctaggattataggtgtaagccaccatgttcggccaacatctgtatattttaaaggtttcagatgattctatttcatcttcagagatgagtctctgctttgttagacaaaacttctccaatgggaaaccaaggccagggagggaaatgaccttgcccaaggacacacagtggctggaaccagagctggggcaggacacccagcagctyacatgaagccctagggcaaataagaaaaaggcaccccactctgggcaggcagagctccatgggcacttcgcttggcaagtggaacaagggctgggtttccatccctacctgccctcttggctggagaacctttgtgcagtgagcaacctgcacaactgtacagggcagtaactctgatctgagcctcaggacttccaaacacttcaccttagtgacctggcaaatccctggggcccctcagaacaagagtatggggagaccaagggtggcttctgggatgtgggctcagccctcactccccaaaccagagtctgggtcaggcaggggctcccatcagccttcaggccccacaagggccgggaaggccgcatctaattcccaaggtcacccctgcagataaattcaggaacataaacaggagggatgaacataaacaggaggacagcaacaccctcagcccagatgtcataagccacctggcaggaggcagcctgcggagaagctccacccacacagatccaagtcctcctggcttccttcctgatcattctccagaccatactctctgccctacctccggagccttacagtcagcatctcccacagtgccctgctctctgcccttctcctggccatctctcactggcatccctggaagggaagggtagccctggagttagaggcacagactctagagacagactgcccaagttccaattccacttcttgtttctcatcagctgtgtgagcatgggtatatggctcaacctccctgtgcctctggtgtgtaaaaaattggtgaaaacattgcctacctcccagagtggctgggaggatcaaggaagtaacacatgcaaagctcctaaaacagctgcatatccagtggccatgatgatcaatgtgtatattttgcttcatttcattttcatgacaaccctggaagttaagtattataattcccaatttacaggtgaagaaactgaggctcagagaggtggagagagtcagggcagggctctacatctttttttgtgatagggactgggcatctgtctttaattttaaaaaatctttttaaaaaatagacacagggtctcactatgttgcccaggctggtctcaaactcttgggctcaagtaatcctcccatctcagcctcccaaagtgctgatgcctccagagacaggacgtggctgagatggattataacgtagtctccggtttgcagtgcctggctgctggtcatatcctcacagggcccatgggacacagagccaggtgcattcccctgacttgggtcttccaatggctctcaggcacctctctgcttccagccagccctgggaggagggggagaacggcatggcaaggcgtttgcagagccgtcttgttcaccaatgtctttcaagacattgcccgggtccacagagagcccaccattcattcccatgctggctggagcccctgaatacccgaggtgaccttctgtccttggacaagtcacttccccctctgatctccatctccccatctgtgcaatgaggggatggggctgaatcagtggttttccaaccctcaaataaaatattaagactacatgtaaaagggagtcgctggttgaagctgggcctgtggatgcatacccttggctcctgggagcctcggaacccagcttgaaaaaccccagcccacatcctcctaaagattctcctggctctgacactgcagagttctagaaccccaagctcaaagctgccgcttcccatccctgtttggaaagctctcccccagctgcctttatctctctttggtaacagagcaaatttgctcaggacccagcacagggggaacaagcagactgttgactcttgagcaaagcctcttctttggagagcagccgaggtggccgtgggctatgcgttgggaggccagcggcctcttgcataaccctggaggcctcctgcccacccaggccttttcagggttaggggtgaggaaaaccgcaaactcatgcccagttaattttttaaggcaaaatcaacaggctcagcaatgattagcagctgggtaagttggtcttaatcaggctaaggacagggagggaggaaggaggcccagggatggggcccagttatcagttaaccacatgaatgttgcttccttccaaacccactggccttcagccccaagctccctcatcttcctctcggaaatactcctgtgacaagccagtggccacccatcatcgggtgaacaagccagtggccacccatcatcgggtgaacaaacacaatgccactcatggtctgtgatgaagtagaaagtgctcgttgttaagacaaagctcacccaccaccgctgcgtggacttgagcaagtccctttcrccctctgaggctccgtgaggggccccaggtctgggccccaagtctatggttcagtctgtggccagctgccactcccctgacggsctcagtgtttccgtccactaaatgggtgggttagccaaggcatcttttccagtcttgaagctttgtgggtgcctgatttgatyaagccacagtggcctttgccgagtgcagagggtggtatgaktggcattttaggagctcaaggaagagaaagggaggggacctacctggtatctgccgttggtatcagcaagtgtcagatcccagctccaggaagagggctgtcctctcagatgggaggcaggggtccagtggggtggctgtggctgcagggacagcctagcagagcctcttggtggcccagaccccctgtccctggaccttggaagccgctaaaggaagcagcaagaccaggccagctggtggctgcctggactggagtttggtcagtggttggggacctatattgtgagatagttaggactttgtccacaaactggaatttgaaatttcaaaggggcaaaactgaagggccctaccccagagtagagatggctcttggcttctttcctccacgacttttgttctttgtcttgataagtcccagttttctctgcacctctcccggagtggtgggtggggaagaaaagataggagataatggtgtggtgagcgccaaggggaagtgaagatgccaagcagccctggggtggccaggcgtgtggaggatgcccctgcccctgcctataccccgggataaggtgctttacttctcaggtccttgagttcccctgcaagactgaggcagtgaaaccaccagctccagtgccttagaattccgaagtcctttcagggattccaggagtcatgatgcaggcaatgcgtagaggggtgaagccctcaagctctggaggcagactcgggttcaaacaacagcccctcccttacgagctgtgtggctttgggcaagtcacttcacctctctgagcctcaatttcatcatctttaaaatggggatgacaatagcccctatctcaacaggcagataatatgagaaggctagaaggtttttagcaccagggctagcacaaaatttctctgtaaacattagaccttattataatgtaaaagagaaacaatgtggttcgtagtggcagctcccttaccaccgtccacagcagaggcacaagctccctacacatgcctccccaactgcaggttgcccagggcaatcccttcccgtctcaactgggtctctctgtgggctctgaggtcctctgctatcccctggaatctgctgcctcttgagctggggcccgacagcaagtgagcagaggtaaagaacagctgctaaattgatggcattgaggctagtgcttgttcatggctgggtgtgtggtacctggagctgtcctgagcaggggtcctgattccaactgattatgtggccagtgtgtcatgcaatcaatgaccaatgacagtgattgctactattgtactgtatgcctacacgtggtcatttaatgcttgaaccatccctacaaagaaggtatcaacccaatttttctgatgcttaaactaaggctgagaaaagtagaagttgaggtcacagagtttggtacattggcactgcctggattttaacctagatctatctgacccacaaggtctgtggtttattcccctaaagagaggtcaggggaagagaggctaagaagcttatctactctctcatttaaycttcacgacaaacgacaagttagaccccttgtacagaaggagtaaccaaggcttcgaaataaaaacttgccttgtgcagacagctggccctgggcttggaatataaatagtcactggtatacaggcaccagagaccaatacccacaggctaacacccactcagtccacagaaagaagcytaatattttttataagcatagaaataaaaaccaaaccaatactgtgacatttgctctgtgacttcctgtatttattatgtgctcatatgaaagcacctaagcattgtcaggataatgttcttcctcactggagggcgttatgaagttgctttcttttttccactagttaaaaaaaaaatcccttggaggaagggaatgaaactttttataattgatacataataattgtacatatatatggagcacatgtattttgatacatgcataccatgcaaagtatttaggatatccatcacctcaaacatttatcatttctttgtgttgggtacatttcagatcttctcttctggctattttgaaatataaagtaaatgattgttaactataatcgctctactgtgctataagaactagatcttattccttctatctcacttatttttgtacccatgaaccaacgtctcttcatcccctgaagaaaacattctttttttttttttagacagagtcttgctctgtcacccaggtgcagtggaacaatctcggctcactgcagcttccacctcccaggttcaagtgattctcctgcctcagcctcccaagtagcctggactgcaggggcatgccaccatgcctagctaatttttgatttttgtatttttagtagagacagggtttctccatgttggccaggctggtcttgaactcctgacctcaggtgatctgcctgcctcggcctcccaagatgctaggattacaggtgtgagcccctgtgcctggcctgaaactttcaaggtctcaagacactgtacatttaaagtaccccaatgtyttccttttccacytcccgttctttctccttatctaacatgaagaacattgtattaaatctgatttttaaggagtttttgtctgttatgtgttaagggtttgtttggtaccccaatgaaaacattctgcattgcagaccaaagtgtgcttatttcaggggcatgggatcattgcgttcttagccattgtcacaaaatacatggagtcatatttaaaatgtaaagttgtaacatacatatgtttaaaatggaaatacaaagcaaaaagatggatgtacaatgtcatgtgtattcagttctctgtacttagtaaatgtaacaaactttctgtctattactgaactataggtgcaaggacacgtctccagttactttgcatctgtaatccacaaagattctgggcagctgtattatcatagcttggtttaaataaactatgtagtaacaatgaacaacaagaacaaaagaaataatagcttgcctgaggtcacagagccagcagatcttataggtggtgcgtcatttatatgaggaatgtgtatctaggagatactgtttggcgttggctaagggtggaatgaatcatgtatgtaatagattatgcaatttacagtgatgagtggatagatttacttatggggtaggttataatgtggtgggatgtgaatctagaatgtgcctcctaggcagtcatgcagattgtgcatttggtaagtcaggtatgtcatgattcatgtatctaatagctcttcatttgcagtgtccacctagtagctcttggatataacgggtcatggctgtggcatggtgtggttgatcttggttgatcgtagaccttatttaattgaatctaagatgtcatctatggaaaaatgcattgttatttttgttgccartgaaattctgacatgacattgatcacattccccgttaagcaatgtggaactgtgcctcagagtggaagaggccatgtattcctggattgtgtggggagtagctgtgcctgtggcctgccataggtgccaggcaggtggcagaggcctgggctcagcccttggaggctcctcccggagctgccctccacatctcttctgtgtttaccccttggtcggatcttctgtttcttcccacctctgcactgcccccaaggccggtggagccaggtcagatactcctgaggtaggcatgggaggaacccgccggtatttggtctctttcagccccttatcaagtctcatagtgtgggttgcagggggctgcctcttgctccctccctcagagtcttgtcctggctaacagaaaactgagccaggatcatctttctattttacagagggagaaattgaagccctgagaagagacgatgtaaataaagttatcggaatagtgactgagctagttcctaaccccaggtctcctgacrtcaaatctagcctctcttgtcctccacaacagttgctccctctcccctttccctacaggcaatagcactccccagtcatctcagcttcagaggtcagatcaagtggacagaataaagctaagcagggcagagaaagggcttctagcagtggaaagaacatgaagatgcctcctcataccactcgaacacacatgccctgactcccgatttgctcactcattaatccacccacacattcactcattcactcactcattaattcacccacccattcactcattaattcacccacccatttgctcacttactcagtaatttaccctcattcgttcattcactcactcattcatgcrttcactcaactcactcattaattctccctgtctctaattcactcactcctaattcacccactcatcaattcccccacacactcactcattaattggtgctcccactaattcgcccactcttgctcacaggtgtcaccgaggccctccaacctgcccttccagccagcagtggaggacaggctcccaggcctcccaagtctcaggcttttcttcctctgccctcactctctgccttctacatcaagactttacttccccagattgattggcagcccttgaaaatgtctgcacagaaggcaatgagggctggagggagtgagaagaacagagtgcaccatgagcttcagacagccaggaccagctgtgtaattttcagggccccgtccaaaacaaaaatgcacaatcccttgttcaaaagtcatgatgaattttaggacaaccacagcagagcactgaaccaggaaccaggactttctaagggttgggttgcctgtgactgcactggcgatacccccacaaagcccactctgaaggtaggagacgggtggagagaaacagggggatggcaagggggatacgaaacagggagagggaggagggggaagaggatggacgtctaccaggccccacttggtgcttgatttatgccatctcatttccttctcaaaccaccctttgaagttgattgtacattttacagaaaaggaaactgaggctcgkagaggagaatcatttacccaaggtcccagttagtagacrgtaggtgcctgaatgtaaatccaggtctctgcctgctccgggagggggtgggggtgagggaaacaggagaatgtgatgggaaaatccgagatggagccagcctgggccagaaacactgggagctgtgggagacggmgaggggcagggtgggatcacagggagcaggagcggggaattggaggtgaatctggccctcccaaacttccagtccattctgctcccaggggaaccgggaaactgcgggggaactggaagggagctcccagaacaaggatccagaagattggcatctggggcctgggatttaggtttctaaatcgtgggccatggggcagccttatctctgcaaaagcattgagggtagaagtcaatgatttgggaagttattgaattaggggatctcggaggtaggctgtcagtgcctgatagtatcagttagaatgcctgacttggggtgacaatggcttggaggggtgggtgagtcaagggtcaaatgagtgcccgtgagtcatgatgcctgccttgtacaattgataactgaacatcggtgagttagggccccagcagttgtaattagcaccccgggtgtcagccagaaaccaacaaacagccaaatccctgcagccccgcccagcctatccaccggcgggggaccgattaaccattaacccccacccctccccggcagagcctccaccccttcacagaggctaggccaagactcccagcagatcttcccagaggacggtttgaaaggaaggcagagagggcactgggaggaggcagtgggagggcggagggcgggggccttcggggtgggcgcccagggtagggcaggtggccgcsgcgtggaggcagggagaatgcgactctccaaaaccctcgtcgacatggacatggccgactacagtgctgcactggacccagcctacaccaccctggaatttgagaatgtgcaggtgttgacgatgggcaatggtaggtgggggcagatgtgcccaggtgtgccagtgggggcaggtgtgcctgggtccaggagcagatctttggcactcaactttggggtgggaggagaatgatacaaaatggtaggttggtcctacaggccagcacaggtgttgccaagtgaagcccatgtgcccaggcacagtgatcacaggcattctgggtgaagggaggcctgcaagggccaatttccagcaaaagtcgatcccggctattcctcccaggcccttccagtcctcactgcctcacagtggctctgcttggcgcttggcacagtgacrtgatggtgagctcccccttggtgcccagctccagcgattcagcccagcwcggccccttcgtgaaccccttgggcctaggttcagagagacggcaagggatgttgtatccctggagatggtggttggagacataaccgcatttctcggtgtctttgggactttcctagggaaatgaaattggcacttagggaaaatggagctctcagggaagttttgctaactacgaagccaactcagcactgtgtgtgttgtgtgtgcgttcgtgtgtgatagtgagtttccatgtaggttgtatgggtggggtgatgccttcaggaacccatttgcatatgtgtgttcatttgtctctgtgtgtgagttctgggtctattttcctttgtattcattgagtgggtctgtgtttgtgtcttaggagttgcccgtgttgatcytgcttatgtatgtaagtgtgtatgtgtgtgtacttgtgtctgtggatgtttgtacatgtgtgctgtgtgtgcgggtcatagagcacatgygtttgtgcatgcggacctgttggagtgccctgttcttcctgcatctttatcctgtatgggcgttttgtcgtgtgcccatatttgtacctgctgtgtatatatgcagttccctgtgctgcgggcgggggtcagcggtctctggtgtgcacgactgcacagacccaaatgcaggactctgttgttgccactcaccaagtgagattcatatcagcaacatgtccgtttgtctctgagcagattttgttgccgctgcgtctcgccagattgaggcatcccctccgacatcactggagcatatctggaggggtggacagttctccacagggaggtaggggaaaagaggaggcccggaaacccctcctggagggaagagccccatcggtcccaggccmgcctcagaggagagggggcaggcagctggctgaggtcagcctgccaccctgcttccttctgtgtcttggagccactcagccagtatgaggctgcagctccagctgaggtctggaatcttgtggtcagctcagctagggtgaggaggcagctgctgggcactgcttgttgtcagctcagcaggtgctcacctgcccctgccgtccagtcacgtgtgaccttgggcatgtcacctcccctatcctggcttctgtatcttctacaaaacaggcttcattcccccaggcctgctggctggacggcttttaggcctgtctgaggaccacgccaggagcgcaaggcaaaaacacaccagagatagcaaacaagctgctgctgcactaggtggagtgttgtgtggccccacgaggaccactgccctgccctgggctgctccccgcccccatcactttttccaagcccaggaactgtgtgctcctgaggcagaggccaagcccctgaactgggaktcccaaagacaagaccacctccagctcykgaaccagaaagatctgggctcaaatccggcatagatccttccaacctgtgtgaatgtggcaaggcaatttcctctctgagcctcagtttcctcacctataaaatgggaataaataatagtgtctgtctcccagggctggccagaggataaataagatgaggtgcctgggtgcttagccctggtaaagggcctggccccaccatgggtcatctcaagggctctgagcatctgtaagcagggtccccacattcctcactggagtttgaagtggtctgaattggggttatgtgaagttgtcctctgaagtgttttgagtacatcctgggctggtgtctgaaaggctccaaggatatttctcccccgtcctctccccaccccaatggagcagcagccctgggtggctccttgttcattagaggcccagcagacacctcaacatgtgtggcactggctggagtagcccagcaagcctggaccataaacccatggctctgcttcacsggaagcagtgcgatgacaccaggaagccacttttcctctctaagcctcagtgtcctcatctgtggaatagaggtgctcggctgacctcagaggggagatgatagagctgacagcccccagcccatcctgcctcagaggtgggagctacttccccagcctcctgctgaatggccaggagctgtgggggtcagctctccccgggggtcgggggaggagaggccgagggagaaagggcacccacgtggcttaacaattatccccatctccaggaataattcaccaagtggagggggctgcactcctggggacacctgggagtctgcgatggcagaaatgagatgcggcagtgtctgcttgtgcaaggagcctggaagtcctctgctccgagagttttcctatgtggaaaagtttttatttcatgaacactgatatagtgcttactatgtgccaagcacttcacatacacatatgagaattcaccgaatccccataacgaacctaggggaatatcacgttccccattttacaagtgaggaaacaaaagcatagagaagtaaacgaacacagtcaatgtcacacggctaaaaagtgggcaagctggaattgaaccctgggcagaaggacttcagaggctgtgctgttacctacagtgcatggccctctctgggtcttaactggatgcccctgaggaatccaaggttggattcaggatttctatgaatacacgtgtgtgtgtgtgtgtctgtgtatgtgtgtatgtttgtgcatgtgagcatgtgtgtgtggactgtgtgtatgtgtatgtatatgtgtggactgtatgtgtgcacacatttgtatatgtgtgtgttgatgtgtttgtatgtatgcatgtgtgtggactatgtgcaagtgtgtgcaatgtatgtggactgtgtgcatgtgtggactgtgtgtatgtgtgtgcatgtgtgtggagcgtgtgtgtgcttatgtgtggactctgtgttcatgtgtgtgtactgtatgtgtacacatgtgtgtatatatgtgtgtgtgtgcgtgtgtctgtgtggtgtgtggactgtgtggtgtgtgtgaactgtggtgtgtgtgtgcgtgactgtgtggtgtgtgtgcgcgtgtgtgtgactgcttggtgtgtgtggactgtggtgtgtgtggtgtgtgtgtgcttgtgtgtggtgtgtgtgcgtgtgtgtggactgtgtggtgtgtgtggactgtggtgtgtaaggtgtgtgtgtgcttgtgtgtggtgtgtgcgtgtgtgtggactgtgtggtgcgtgtgtgtgcttgtgtgtggactgtgtggtgcgtgtgtgtggactgtgtggtgcgtgtgtgtgcttgtgcgtagcgtgtgtgcgtgtgtgtggactgtgtggcacacacgcttgcattttcccgggggctgacccattgcatttgtcatcttcttcaaaggggtctatctttgctgaaagatttgctgacaaataaagggggttcagctgctgctatttttttaaatttggaaacaaattttttaaattttttaaattttttaaatttggaaacagaccagtcaaactgctgccttttatggttagagaaaatgaggcccagaagaaattgaagcagggaaarcgaagttgcccaagtttacaggcgagttagtggcagcatcagcagtagtgcccaggactcctrgcacccagcccaagatcctctttccacctgcctctacggcccccctcacatttgtgtagatgcagtagcttttgcctgtgggatgggagggwtgggagatgtgtccagaccctcctaggaggccacatgagtgtgactgttctcggcccaagtctttctcgttcctcagagaatttgcggggcccctgggcacacaagctgagatccacccagccctggtcccttggcaagaactgagggacaggacctggttctggggaaaatgcaggggaatgtttctcccttccacagcccccttgcgagttaggaggccggctcccaccccagaaggtggccaggttttcatgccttcctagagaaagctggggctcgtggcctccaccacaggragaygcagaccctcagaaacaagtctgtgaagtcacaaccagccscagtttacagatgtgaaactgaagctccaaaaagtcaggaggtcactgagtggggaggtgatggagtgggaacagcccccagatctggctgaggccgaagccctggagagatccccgcaaggctcccttagatgcctgacattctgytcttcctgaagcctcactcccttctctcctggygcagacacgtccccatcagaaggcaccaacctcaacgcgcccaacagcctgggtgtcagcgccctgtgtgccatctgcggggaccgggcyacgggcaaacactacggtgcctcgagctgtgacggctgcaagggcttcttccggaggagcgtgcggaagaaccacatgtactcctgcaggtgaggagcctcaatttcttcagctgggaaatgggcacacttgggctcatggccccaaggtctgtcttctccctgagtgggtaggtcccagagacagctgcccttcagggccttcaaggctcttctggttttgtaaaagactttgtgaatccaagaagagcatctattctaggaaccacatttactgatcatcaagctactggctgccgtttattgagctcttatcatatgccaggcacaatactaagtctttgtgtgtatttacycatccccttgagcccattgttstttttcccattccatggggcctctcctgaagcctcagtagatgagcccgtcttccagtctggtgctgtttttgggacaaataggagattgaccccaggccgttccacctaccccaggggcttccaccaaccccaaagtcttcccaaggccttggagagccctctttcgaaagcatctcctgttctgggtaatgacaataataaaatcatagcagctgtcaattgcgagcacttgtcatgtacaaagactgtgccccatcggcgcatgacttcatttcacctgtcaacacccctgtgagatggttactgttgttattcccattttatagaggaggaagctgtggcttggagggctaggcatttgcccaaggtcaaccagcttgaatcactggcagagccagggttaacattcagggccccacccatcaccacggtgtggcactgcctctacttcctatccccctccagagagaggcttatgtgaaccgagtattaactctgagccataaccaggagcctgctatgggttctgagcttttataggatgtggtggaaatagcagggctctggtactccagaggtcraggttcccaactcagctctaacaccaaccagcagagygacccaggaccacatgttgcctctctgagcctcagttttcccatgtttagcaggacaggactgggctcttagagagttcatagcacctttccagctcctggtgggttcaagagagaactcccgggatgaagagatgagagcactgaggttggggggtcaactggatagccagggccctagttctgtcctaagaggaggaagttgtgtcttctccatccaaccatccaaagccctccccagatttagccggcagtgcgtggtggacaaagacaagaggaaccagtgccgctactgcaggctcaagaaatgcttccgggctggcatgaagaaggaaggtgagcctcggccctccccgccccaccaccactgccccacctgcacccacagctccccgacagtcatttacaactgtagccacactttatgactcagtggcaggccccagggtgactggctaatggctgagaagagggagggcctggaaatctgaccatagggagcggctgggcttggtcttgagaaagattcagagagataagctcccactcttggctcctcaggctcccagcaaccaccacccctgcctgcctgtctgcgccaccacaaagcagccacgttgtgtgtgtgtgtgtgtgtgtgtgtgtgtgtgtgtttaatataatatttcgaacgttaggacaagcatagagaatgatattgcaaacatctgagtactcactatcccaactttacaaaagggacagccagaggagcccgatgcctgagcttccggtcccagggacaaatgccccagttcccttagtattcattcgtgggtatcacgtgatctccaaagtcttcacattctagaaaatgggaacaagaccccagacccatcctggacaaaggaggagaagaccagagcacaacatttattaaggtcttgccaggcttcctgctaccagcaggtatcagtcactgggctgtgctttttccacacttcagtaggttgggttcatttcattttcatgacaaccctatatgggaaaatgttgtgaaaatgaaatgagcccagcccattgaacctattacaattcctccctttttgtggatgaaggaactgaggcccacaatggttaagcaacttgcctagggccccacaactgatccttggaagatctgaagtcccagagcttctgctatttggaccacacttcagcactgtctattattttatgctctccagataccagggacatttaaaattgttttcagcccaagcaagggaagcaaaaatcttttaactgctttaaagtaacttgaggccaggcgcagtgaatcaggcctgtaatcccagcactttgggaggccgaggcaggcaaatcatttgaggtcaagagttcgagaccatcctgaccaacatggtaaaaccccgtctctactaaaaatacaaaaaaattagctgggcgtggtggtgcatgcctgtagtcctagctactcggaaggctgaggcaggagaattgcttgaacccaagaggaggcggttgcagtgagctgagatcatgccactgcactccagactgggcaagacagcgagactctctcwmaaaaaataaaaaagtaacgagttcattttcgaatctcttcatttcctgctcctctaaactcaacctttcccagctctgcgactagtcccagaccttcccttctagcccacagttgtgccgtaccagccaaaccttggtctagtcctgctagttcggtacaaacacccctcacccccatcaccccagcacaccccagaagcaggaacgtaggacccagcttgctccagggcccactgagaaggaggggaggggaggctttggtagactctctttcccctgtatctgctcctggccccctgttttctctgccccctcccttggaaatatcttctatgtctcatccttatgggaccttagtctgggctcatgagctgtcttggaaaatctgggcttgctgatcccgatgcaggagtgggtggtccccaaggcctgctctgaacgctgcaattctaacatctagatatcagtggttctccaagggcaagaggggctttttaagctgcaaatactccctcctctcccaaacccagttttcaatggggttaagcctgtctcatccacttcaacttccattttgtggactgggaaagattatgaatgggaacctgatgcatgtgygaacagttggaggcaagaaaaagattgagaactacagtctaaggttccaacatttctgtggttgtattagtcagtgattccattatcccaaaagcctaagattttaggcactatgattcctcataggtgtcatccagagggcactgtgtttgagagaacagctctctcacagtgaaagttcaggtctgtgacaggcagatgggagaggggttggcagccctcctgagtggatggctacccacctccactgcgtgtggcctggtcctgcgtgtggtcagttgttataaatgtcttttattagacatccagagtcattttcacttgtgtaatttagggacatttctgtctcttctgggctctagttttcccatctataaaatgaggacattggataatgaacccttcagccctatgagtctcgctcctcactccctgacctacctgcacaagtcacactgcccactaggatgggtgtgtttgttccctggtcccttctttttttttttttttagatggaatttcgctcttgttgcccaggctggagtgcaatggcagtatctcggctcactgcaamctccacctcctgggtgtgagtgattctcctgcctcagcctcccaagtagctgggattacaggcatgtgycaccacacctggctaattttgtatttttagtagagacagggtttcaccatattggccaggctggtctggaaccccygacctcaggtgatcygcctcggcctcccaaagtgctgggattataggcatgagccactgcgccyggcccctggccctytcttgagctgctgcaaagccagcaaaccccttactaggctcctggaagggggatgagagccccagaccattcagccttagctcagccttgaaaatagctgcttgcttcctggcccagggaaacggacatgctgcccggaggataggagagttggctgatggmgagtgagcgtgggttagtcgatgctagtgtttgtttacatgcctgggttacctggaagatcatgacacatgcagtcacttggttgttttgagaacrggccagagtgacaaagtgttcagttgccactgtggtcaagccataggaaatgagggtattcctagctgtgcctgtcttctaggccccaccacccctcctcagcctgctgggaagctcccaaagccaaaagaaagtctcggtggaagtctcactggccaggagagttgggacaagtttttatttctttttcttgatgaccttaggagaatttgaggactgaaaycctaaaatagtccctgagaaccagaaagtgtgagctggaaaggtaggatttcaagaccagctgagtctataagaggtcatcaaatctacctgctccccactttacagaagaggacactgaggctagagaggtgatgtgacgggtcaggggtggagtcaggtctagaactcaggctccccagagctgagcagacaccaagctccctggagtgaaacttgcagtgatcagcttgggaggcacatttcttgatctagatggctgaaactttctctcgaccacagagaggggcttcaggtctcatgggcctataagtctctgccacaggatagtccaccatggctggaaggggctccctggaaggccaaagaatccagggagaaccctgggggtcagtgggccaacagcaggtcaagaattctttcctgcaaccgaaagccagggagacagacacctgccttggcctaagctgtcaggcccaggacaaatattcggctcctggcatcaaaaacccagcccagaaagcggacccagagttgcaggaggtgagcgtaggtgatgggccaggggccatctgaagaggccttcctcggaagcccctgccctgctccccacagccccctacccaggagttccctgggaagacaggctcatcacctctccgcctctgcccaggtcggttaatattcaatagaagttacattaggtccccgaccctgctaatactgagcaaacatttggaaaacatcattccgtgactgagctcgcgccgggcactgataacgcccgcctaaccttgaggagccctatccgcagctgctgacagcagccctttcattccgcccgccggccactcggcgccctgatgggtgggtgygggtgctggcaggaggctgccgtgggaggggtgtgggcgggtggggtggacggcccggtcagggaagccgtgctctgagctggccccgtccacatggtggtctgagaggaggttgcttgcctctggacttctgttctatccactgactcccgggctcaagtgcaaaggatttgacttttattctctgattttaacaatgtgtcaacatcaagagaaagttgaatagctggggtgtcaatgttccctggagaaatagggttcttataagaattagagtttatgaccaggtgtggtgcctcgcacctgtaatcccagcattttgtgaggctgagtggatcacttaaagccaggttttcgagaccagcctgggcaacctaatgagaccccgtctctcaaaaaaaaaaaaaaatttagccaggcgtggtggcacacgcctataatcccagctattcgggaggctgaggcaggaggatcgcttgagcccaggaggttgaggctgcagtgagctatgattgcaccactgcagtccagcctgggcaacaaaatgagaccccatctcgaaaaaaaaaaagaaaaagaattagagcttgtctcttccaatgccttcgttctctcactgcacaaatattcattgagtacctactgtgaaccaggccctgttctggtggctgggactacagcagtgaactagagggatggagttttggccttctgaagctttccttctcagagagagacagatagtaaaggaagtaacaaataattctacaataagtgacttgaagaaaaataaagcatggggggcagggccagggtgggagtcatgttgtgttagacagggtggctggagagggtgtctgaaaggcgacatttgtgcagaggcaggagtgaaatgaagatgctgctgcgctgtgcaggaaagggaaccccaggcagtgaccacagcagcctacaagcgtgcggatgcgtccaggtggggaggcgggttttcgcggacagagtgtgtagggggaagccggtaaaaggtgcgatccgagaggagaggaagggccctggggacttgtgaggttggaaggcactggttttgagcagcaggsgacatgacttgaacggatccctctgtctctgagaggaacacagactgcaggcgcaaggcagaagcagagcccaggaggaggctgatctaatccaggagagacagcrggcctgggagcagggagggagcagcaggtctgtttgtcaggatcacgacagcactggggtgtgaggggaagccaaggaaggtggccaggcttgatgccagtccctgagacgagaaagagtgcagggagccggctggcagggaaatgcctacgggtagggaaactgagccccagagagaggctgcgattgccaccggcacacagagtggcaggttccagacaggaagccgggtctggtgcagcttcaacctycctcctttctgaatcagccaagcctcattccacagtgaggcctcttggactccaagggctatcccatccactgtcgggatggtggaaggatcatcttctatctcaggccaggactgacccagatgggagcaggcagtggarcctggggccccggtgggcgtaggctccagatccctcagtgcctggaacagagcagcagtgggagggagggagacagcgcctggccttgctgatgctgaggttagtctggagtacatgcagctcctgctgatggacaaaaccatcaaggcagttggagcccccagatcctcttgttcaggaatccccaggccatctccttgtcacccagagtaatttgttttgcttgctttactcactttcatttggaaagaaagggacccttttgtagaccagagcttgaacatctttaagctagtcagatcccctcctcaatgctcaagaccaattttaaacccatagccgagtcttcactgtcttgcgcgcccctgctgatgggtggatcactcttatagcctctscattgtgttgggggcagttgtgatatgtggaaagttcttccaccagctgagttagaggccatctcccctcattccacatgctgatgtgggcctgttctctggacaccccccacctcctgctcccactcctcatcagtcacagacacccccaccccctactccatccctgttctccctcctcacctctctgtgcctcctcacagccgtccagaatgagcgggaccggatcagcaytcgaaggtcaagctatgaggacagcagcctgccctccatcaatgcgctcctgcaggcggaggtcctgtccyracaggtaccggggtgatcctgccacccacccagggatcccccacactacagaggagctcacctcctccacctccattctccccagccaggccctggagcagctgacgggaggggcctcagatattacagaagggacactgagtscggtttcacatggcccagtttgcagcaagggcaggaatcgaacctggcgccctggggcactttctaattcatcctactgcctgcatcccacaggccaagcagagtcttcaccttcactgagggcctgcgatcagctcagctccgagagaacagagcagtggctcagtggagagaggtggcaaagtggggcccagcccttcccttgctgagtgaccttgggcaagtcacagcacctctctgagccatggttgcctcattgtcagaaaaggatgatgattttttgccctgcttctcctctaaggctgacagactccttggggctctaaagctgacagaggagggggcagggggcaggtaacaggtgaaggcmcagagggagcccttctccctcatccctgcctcctccctccctccgtttttaccctgagcttccttcagagctggagggcacccactatccagccccctccscacatctgattccagggagggggctctgtgcaggggacagagartgcgggagggcccggacatctccagcattttcttccctgkatctctcgaagatcacctcccccgtctccgggatcaacggcgacattcgggcgaagaagattgccagcatcgcagatgtgtgtgagtccatgaaggagcagctgctggttctcgttgagtgggccaagtacatcccrgctttctgcgagctccccctggacgaccaggtgaggatgggcgtggatggtgggcagtagtgggcagtgggcggggcagccagggggctgctggcccacctgggatatagccgtggactggcttgattttattttatttaacaaaatatgtagtgcacacacgtgtctgaaactttaaatcaccttacaaatattaactcagttagctcctccaacaactctatgaggtaggtactaaggtactattattactgccatctcataggtgaggagattggggcacagagaggttaagtaacctgctcaaggtcacatagctactatccagcatagctgggattagaacctggcaggaagctccaaagtccaagctcctgaccattgtacctgaggctctcccagggggatgttgacagggaccctaggacagggatcaggagattttggcttaagctatggctctaagactggttgtctgcctaatcctgggcaaatgagttcctctctctgagcctcagtgttctcttatctgtaaagtggaaatgataatatccactttagagtgtggttgggaggattgaggacattggtgtctgaaaagtacaaaaatcaggtgatggggcaagctgcacagtggccagaccagagctggtctccctaaacattagtttcttccttgtttcccaccaaaacgattgaactcagcatcgtgtttcccaccaaaacaattgaactgagcatcatatttcccaccgtacatttttttggaatactgaaatgtccctagggggaagaaagggttgaaggaaggtggcgtgtgtctgaggacagatgaatttcggagatgccacctatgaagctcctgcccagagcacccctgggcctccaaagagatgttacccatctggggaagaggagctgggctgggccacctyctcagcttcggagacagactctggtgcattcgcttacccgtttcgcacctttgcataagacactgacaatgcatgtgagtctgtgaaagcttctgagaagtctcgtccaggcagttgtttgactttgcagaggccgaggcttctcaaactccttyggcaagattctcctggaacacctattaatactgcacattgggacactgtgaaaacgctggtttggcttgtccccagcctcatacaggggctggacccggggccctcttccatggttcctccttccattagcagagtcgacagggcaaggatcttggacaatccgcccctaccctctcccctgttccttgtgctctggccccagtcccctctgctggagtctctacattaatgtttaatccctcctgttccttcccaggggcttagcagggcaacaagatacccccaacctgagcaattgttaacctcgatttcccacccaaacctccctggctggggctcagagcattctcagagagcaatgatgggtggccaataacacaggacaatcattaacacaccaccccgacctcccggcccaccccccagaacagctgccatatcagggggttgaacctgggatcagaagggttcccagctccccattcctggtatatgaggagcccagcttgcccaatgcaggtggggcatccctgggaaagtcgggggcattgtcctccaaagggcttcccaattttgttgacattgccccagaaactagattcccagttggtgtgcttcttgggcctggatacaattgcagaaagagattggggcttagagagagacagaaatttgcctgaagtcacagagcaagttagcgacagaactgggattcaaatccaggtcttccgcttcgcgatgtgaaggccactggagtgactgatgaaagacttgcacagtgcccagtgcgcaggaggcgcttggcaatcagcatcctcggcctccctccatactggtcatggaaagtggattttccctcccaggcagtttcctctttttctgttttcctcacaggtttctatccatggggaatagaaggggcaaggacaagtggctgcccaggagcagctagagctagagaggaagtcaagatgtttgctcattcattcattcatttcccctttccttccttcattcaaatatttattgaaggcttattttgtgccaaatatcttcagacaaatgccttctttcctctaacaacaatttcacctccttagaggccttctctgacctccccatctaacgtagccattcttgccccattgctctcaccatcctttccactcccctccctccctccttcccttcctcccaccttttctccttccttctttcctttatgctgtgatcaccctgtgtcctctgtacttatttgttctctactatctgttcatcctctctcctataaatgttagttcgatgagattagagaccttgtctctcgtttttaaacattgtgcctccattgtcttaaaaagtgtctggcatttagtaggcatttaggatttgataactgaaagaatgaacaatcaaattaatgaacaaacaaaggcattttaaccttctagtttggcttgctatggaacctccaaactccctaacccaaccttgaagatgagaagatgagatccttgaggctaccagcctggtgctgttttgtttcaagccatcctttggtcctcaggcaagcactaaagcagatggctctcagtgggctggctatgtccttctgtgagcttgctgggcccctacctatgactccagtcttagaagtcttgccttgtaccccctgcagagaakggtttcatcaagctgattctctgccaggggccagtgctcatacatttgctctgagaaggaccagccctgagacctaacatccacatccaagttcttgtaatgccctctcagaatcctggagtcctgcaatgtcgatccctggagggatctgccagaccaatgatttcccaaacagaattgcacttcagagtcaactatggagctttttaaacacagatccctgggcccaccctaaacatacaaaatcaggatcagaatctcagggcctaagaatctgtattttcaggccgggcgcagtggttcacacctgtaatctcagcactttgggaggctgagttgggctgatcacctgaggtcaggagttcgagatcagcctggcaatatggtgaaaccccgtctctactaaaaataaaattagccaggcatggtggtgcacgcctgtagtctcagctactctggaggctgaggcacgagaatcacttgaacctgggaggcggaagctgcagtgagccgagatcatgccactgcactccagcctgggtgacagagtgagactctgtctcaaaaaaaaaaaaaaaaatagaatctgtatttttacaaagcacccttcataattctccatagctggtccatgggtgggaatttgggacccacagttttggaactttttgggatcatagacctttttgagaatctcaaaaaagaaaaaaaaagcacacagaatgttgcttacagtttcatcaggcacacagaagaggcccagcacgaagcagtttcttgcccaaggacacagcagttcaaggacagagtcagcgcgaggtctctcagctctgagcacatgttctttccccttccaggtttctagttttatgggtagtagtttyatgatgcccatttcacrgttcaggcaggtagaggcagaggggagcattaagctgacttgcccagcgtcrctgagttggctacgggcagccttcccaagggtacagatgrcaaacactgttccttctctctttcaggtggccctgctcagagcccatgctggcgagcacctgctgctcggagccaccaagagatccatggtgttcaaggacgtgctgctcctaggtgaggcggctgcctgccctggccagggctccagggagggtatgcctagcatggcactcacccaggcaaggagattcacatggtggcatgcaagggtgagggagactagtcaggagtggccctgtcctcaggcttgcattggagggctccaggactcagttttcaactgggtaccccactcagatgcaaggaaatrtggatgcaagtcaccaaattcccagcattgaagtcagagcacgatcagggttatccctggaattacctgtgcatccttttttcttttgacagagtcttgctctgtcactcaggctggagtgcaatgatgtgatctcggctcacttcagcctccacccgccacrttcaagcaattctcctgcctcaccctccagagttgctgggaccacaggcgtgcaccaccacacccagctaatttttgtatttttagtagagacagggtttcaccatgttgaccaggctggtctcaaactcctggcctcaaataatccacccgcctcagtctcccaaagtgctgggattacaggtgtgagccaccgcgcctggcctacctgtgcattctgatgttctttctggagtaggagcaagaggtggttaagaatggcacaaagccccagcccgcgtcacctgtgccttcatggcatagttattattttaaacgcttgtacagcacacactgtgtgccagggactgtgctcactgctttgcaaacactacctattttaatataacaatgctatgagggaagctcgattatttatcctcatcttatagataagaaaactgaggcacagagaggttaagtaacttatccaactataaccagctatcaggggcagagccatttaagcagggcagtgcagttccagaatctggtcctttaaccttgatgctttggtgcctatcaggtgacctttgaatgtcatcgatcttgtgagtcatgttggtaaatggagcttgggtcatgtgaaagaggtcctagaaagccaagttccaagctcagccggatgactcaaggcagcttatcttctgaatctgggcctcagcttccttacctgtgaaatgggagtcaccatccctgcaggtcctcctcccacaggcaccagctatcttgccaacttaaaagccaaaactagaggagaggggtcaacccaaggtgacttcccatcctccctccctcccaacccttccaggcaatgactacattgtccctcggcactgcccggagctggcggagatgagccggrtgtccatacgcatccttgacgagctggtgctgcccttcyaggagctgcagatcgatgacaatgagtatgcctacctcaaagccatcatcttctttgacccaggtacagtgcacacctcctaagccatccctgactctctctccagaacgctctgccagacttctcctattgggttctgtacactgagttcacagcctcatctcatgttaacgacagccaggagaggccgttttcatttaacagatgaggcaagtcaagatttgaagagacratatggccgggcgcagtggctcacacctgtaatcccagcactttgggaggctgaggcgggcggatcacctgaggtcaggggttcaagatgagcctggctaacatggagaaaccccatctctactaaaaatacaaaaattagccaggcatggtggtgcacgcctgtaatcccagctattcgggaggctgaggcaggagaattgcttgaacctgggaggcggaggttgcagtgagccaagatcccgccactgcattccagcctgggtgactccatctcaaaaaaacaaaaacaaagggaggatatgacttgacagggcaccctgactccaaaggcctgggctttcccttcttttacttcttccctccatccttctttctctttacttcccatcttcctcttttctttcatatttgcttcttttcctcaaaaaaatttatcaaaataatatctagaaccggatgtggtggctcacatctgtaatcccagcactwtgggaggcagaggcaggaggatcacttcaggccaggagttcgaggccagcctggccaacataacaagacctcgtctctatagaaactaaaaaaaattagccagggatagtggtgagcacctgcagtcccagctactcgggaggccaaggtgagcacctgcagtcccagctactcaggaggccaaggtgggaggatctcttgagcccaggaggtggaggctgctgtgagatgtgattgcaccactgcactccagtctgggtgacaaagcaagacctcatctaaaaaataataataaataaataaataaatctacacatacttaaaatgcaaatacttctccccatcctacttttccagctctaagtctactccccaagagaagcatgtctgattattttaattgtttcttctggcagtttcctcaacaattctaaatgaaagacaaagccttatatttgttgatgcatccattttggatcataatgttcctcctaggatggcagaggattttgcttttctccatcaccattcccatcttttcttccccatttttcccaatatatttttattgctatttttgagtctctgttgcaagttatgtgcttttatctttcctttcttgttctatcaactgtagacggtatctcccaacccttcacattgcaggatgaagaaaaagcattcctaccctctcctgtggctcttggctctcctctccccattctgtccactgacttttgcacctgcatttatacagaatgcatttgtcatcagtctttgtacaaaacttgcttttgtttcccagcatcaaaggtgcctgaactctggaggcttgcttgccttccctgcttacatgttagaggggacctactgtgtgccaggcactgtccttcacgctgcaaatagattacctctagtaataatagtaatgaaaaggctgggtgtggtggctcacgcctgtaatcccagcactttgggagactgaggcaggcagattacttgacgtcaggagttcaagaccagcctggccaacatggtgaaaccccgtctctactaaaaatacaaaaatcagttgtgtgtggtggtccgtgcctgtaatcccagctactcaggaggctgaggcaggagaatcgcttgaacctgggaggcgggggttgcagtgagccaagatcatgccattgcactccagcckgggcaacaagagcaaaacttcatctcaaaaaaatacatatatgtgtatatatatataatatatattatatatatataatatatagtgatatatatagtatatagtgatatattaygtataatatatattatatatagtgatatatattttatatatatatagtgatatatattatatatagagagagtgatgaagtggaagatgagccccatgtattgaatgctccctaaagagctgtttttaaacactttatgtggattgtcttacttaccaacatggtacctgtgaagtaggaattattattatctccattttacagataaggaaactgaggcatgattaacttgctcaaggtcacacaaccggaaaatggcagagcttggatttgaactkcagaccacctgtcaatcccaatttctctctctcaagcccacattcttacctaccacctgctatcccacacttaccagagggtgagatttctagttctagttccctccacagcctggcccagcctgtatcctctgtagtgctcaacacgaggctggactggcagaattgttctgcaaaatgggaaggatcactgatgctgagtcagaggcagcagcctccmgsaatttgaaggggcgggggacctagttcaaggcctggcatgcaggaggtgctcaataaacatgtgtggcctgaatgaactaatgaataagcatgattcagtggagacagcccactagaaatgtgggtgaatgttctttctgccacttcctttgtccatgaaagaggaaataaatgcattacctccatgaaggttgagattaaatattgtatgacygcttaagttcctttcyaggctaaggatctagaatttattcactgatttttttttcattcattcatccagccatctaacaaaaaatatacatatagttatcaataaatatatatttatatataaatatatattttttaaaatatatatatatatagtctgtcacccaggctggagtgcagtggcaccgtcttggctcactgcgacctccacctcccagtttcaagcgattctcccacctcacctcctgagtcgctgggattacaggcatgtgtcaccacgccaggtgaatttttgtattatcagtagagatggggtttcaccatattgaccaggctggtctcaaactcctgacctcaagtgatccccccgcctcggcctctgacagtgctgggcttacaggcatgagccaccatgcctggccctattcaataaatattgactatgcatggtgctaggtggtgagtttgaaaaggcaaaggccgggtgcagtggctcacgcctgtaatcccaacattttgggaggctgaggcaggcagattacttgaggtcagaagtttgagatgagcctgaccagcatggtgaaaccccgtctctactaaaatacaaaaattagctgggtgtggtggtgtgtgcctgtaatcccagctactcgggaggctgaggcaggagaatcgcttgaacccaggaggcagaggttgcggtgagccgagatcacgccactgcactccaggctgggggtcagagggagactcagtctcaaaataaaataaaataaaataaaaatggcaaataagacatacgcgtgcccctgccaaactcacagttggatggcacaacaattacatcctgtgtggtcagcagtgatggaggggccgcagagatttggaaacaggagggacacaggatacagatataggagggtagaaggcagacttcctggaggaggtgaaacctaacctgagtccctaaggtgataggaagcaggaaccagggaaggggagcctattctaacacagtagaagcagcaactgctgaggtctggatgaggggacctcaactgtggcccaaaaccccaagttcccattgtggctctgccaacaactggctgtgcgacccaggacaagtcctatctttgcactgtgtctgggtttccccgtgtgtaagatgaggcggttgctaggtgcttattggatgcattcctcaagtcccgccctccatctcctattcccctctcttctggtttagtgctttaggaaatgtggcagaaatctttttctgcctgtgtctaggaaatcataattcatgctggcgtaccctggttgttgaggtccctgaatccttgtgcccacactgctgaagactccttgtgtgayacaagtcaggggacatctgggtcttgactccccagatgctccasctggaccctgctgccctcccttgcccaccctcttccattgtagatgccaaggggctgagcgatccagggaagatcaagcggctgcgttcccaggtgcaggtgagcttggaggactacatcaacgaccgccagtatgactcgcgtggccrctttggagagctgctgctgctgctgcccaccttgcagagcatcacctggcagatgatcgagcagatccagttcatcaagctcttcggcatggccaagattgacaacctgttgcaggagatgctgctgggaggtccgtgccaagcccaggaggggcggggttggagtggggactccccaggagacaggcctcacacagtgagctcacccctcagctccttggcttccccactgtgccgctttgggcaagttgcttaacctgtctgtgcctcagtttcctcaccagaaaaatgggaacaaggcaatggtctatttgttcaggcaccgagaacctagcacgtgccagtcactgttctaagtgctggcaattcagcaaagaacaagatctttgccctcggggaggctgtgtgtgtgtgagtatgtatggatgcgtggatatctgtgtatatgcccgtatgtgcgtgcatgtgtatataaagcctcacattttatgattttgaaataaacaggtaatatgatagagtttaactgaaaaggaatcctctttagataggggaggccacaggagacctctctgaagtggtgactcttgtgctaagaccctaacggctgaaaggaaatggaaggcttaaaagacaagagaggaatattccaagaagaagaaactacttcaagggctgcggataggagagagtgttgtgtttgagaaagaagggcaaggttgtgagatggaggacgtgtaggaggtgaagatggagattgggcagaaaccaaatcataaacatatggctttgtcagccttttcagaaatttggattttattctcwttgcaactattgtaaggagagtgaaaaccagactaagtatttttattctttgagacaaagtctccctcaatcatccaggctggagtgcagtggcacaatcttggctgactgcaacctccacctcccgagttcaagcaattctcctgccacagcctcctgagtagttgggattacaggcgcccgccaccacgccctgctcatttttttatatttttagtaaagacagggtttcaccctattggccaagatggtctcaaactcctgacctcaagtgatcacccacctcagtctcccaaagtgctggaatgacaggtgtgagccgccacacccatcccagactaatgcttcaaacaaaccactctgttgggtagagagtgaattgcagattcctgagaatgtcactgtctccaatcatgtgatggatgatggaggcttggaccctggcaatggagcagtgaagataaacctgatcatctatttggaggaagagcccacacccacaggatttgctgattgatcagacatagggagtgagagaaagaggaagagtcaaggacaaagtctacatttttgctttgagtagcagaaatgacgatggagtaatttactgaaatgaggaggacagaataaacaacaagacactgggtctgggggtggtagtgaggggtgacctcagagatccattgtggaccctcttttcttttttcctttttttttttttttttgagacgagatctctctctgccacccaggctggagtgcagtggcgcaatcatagttcactgtagcctcaaccttccaggctcaagagatcctcctaccccagcctttcaagtagctgggactacaggtgygtgccaccacacccagctaattcttcattcttattttttrtrgagacaaggtctcactatgttgcccaggctggtcttgaactcctagccttaagcaatccttccgacttggcctctcaaagtgctgggattacaggtgtgagccaccatgcccagcctcattgtggactttcattaagcatgagatgactattacaaatccaagttatcaaggaggctgttgaatgtatgagtctgttgctcaagcacaagattaaaggcagctctgtggaatcagggggaagatggagccatggagggaagggaagaagactggccagaggggtaggagaaaaccagggcaattccagaatccaagagaagagcgtgtttgaaggacagagtgtttaatggtgttaaactctacagagaaacagaaagaagcggggargaaaggagaggtgaagagaggaggggaagagagaggaaagggtccattggattgacagctggaggctcttggcaattgtgttgaaagcagcatcagagagctgggagagtggaaaccagattggagagtgctccaaagagagtgagtgggaaggtggagatagagtagataaccctttgaaatggtttgactatgaaggggagtatgaaggagttaggatgactgcaagggagtgattagaatgataggtcatggagtctgggctgcactcaaaaagaaataaagatagaggccgggcacggtggctcacacctgtaatcctagcactttgggaggccgaggcgggtggatcacttgaggctaggagttcaagaccaacctggcaacacagcaaaacaccatctctactaaaaatacaaaaaaaaattagccagacatggtggcatgcacctgtaatcccagctactcgggaggctgaggcaggacaatcacttgaacccgggagatggaggttgaagtgagctgagatcatgacattgcactccagcgtgggcgacagaacaaggctctgtctcaacaacaacaacaaaaggatggggtgatagtgaaaagagagtgtcagtgaattgacagtctcagtagggctgaagaatttttgcagcgatggtattagattacgggagctggaaggacatgaggtgaagtcaaagtggggatgttgaattcgagattttggaggtgtttcagtgactgaagatgacaaggcgagggtgaggtttctcaacattggtactattgatacttggaactggacaattctttgttgtgtggggctgtcctgtacattgttcagctgcatctctgtcctgtacccataaggtgccagtagcacttctccagtggtgacaaccaaaaatgtctttggatattgtcaaatgtctcctgatgggccaaaatcatccccagttgggaatcgctgttatgtgatagctcatttcattctcactttgaccctgtgaacatggggttattatgaatcaggtgtcattgagatcaggatcaggagcctgtggtctgttgccaaataattaagagctctctgggctcagttgtctcatctgtagaatgggctaataatagtatccatcctataggattgctgtgaggattaaattatgtgaaacatgggaagtgctatacaacagtacctggcacgtgataattgttaattatcaacaattgttatttatcactgaaatagatgtactgtagagatckcttgcaagcgttgaaattccatcatcgtcatattactcaccataggctattattaaaccatatcccatgtggtatttttactccctgacatatgtttgaagcggttactgtgttccagacaatctgctaggccctcaaagaaagaagaaaaatacctctgaaattgtaatgctcatagacagaagaagtggttgttcctaaaagttgtgttacagacaaattactatgagaaatccaaggaaggagaatcaggagaggcttctaaagagaggaaatatatgagctgggatttgggcttatggacatggaacaggtttggggtggaaaaacatctctgacagaagcaacaacgtgagcagaagcatagagatagaaaaacacaggggacacatagatgctataagtaggtcagytggctgcagcagagatgtgggggatgaggctgaaaggtgaggcgggaccaaatggttgaaggacttgcactccaaggagctttgagagccattgattacatccattatgttactatgtgaccaatacactactcattagaacatttacgtgatctcagagcttccttatatgcaccttgttcctttcaactcacttttgttctcttggttttttggggtcctcttaacaccctcatgaagtctatagatgggaatggyacaccctagtttactaacccaggaataggtacccaacaggcactgccaatattggatgggctggttgattggccacgcctgaggaagatggcgtcccaaggcctgaggtctgcatcccagactctccatcctgatcgaccttctctacctgcagggtcccccagcgatgcaccccatgcccaccaccccctgcaccctcacctgatgcaggaacatatgggaaccaayrtcatcgttgccaacacaatgcccactcacctcagcaacggacagatgtgtgagtggccccgacccaggggacaggcaggtgggcaaactctgggattttaccttgcaaagggtgaggatggggcttaagacaggaggcaggagaaagtggagtctagaaggtagaaccaggatgcaacagttttctgggttccagggtagggaataaagggcaagattgtccatttgttgaggctgtttattcagtaaggtgactgacagcctttactgaatgaagccattgttgggatgaggcaatccactggatgaggtaacccattgggtgaagatgttcttgggtgagaattccattagttgacattgtccattaagtaaaagtggtcattgaagtaaggctgcacagttgggtaaggctatccattagacaattakatgagactacccattgggtcaggatgtctgctgggctagaccatcctctgaaacctccaaagtataaacttgtcattgggcaaagctcttcaaaggataagattatcaatgggatgaagtgatccactgagataagatgatattttactgacattgttctcagggaaagttttccattgaacaaagatggccaattgggtcaaatttgctctccaaacctgccatgagagtgaggccaattagtttctattactcatctcctaaatatccaagaaatggtattttttgagccagctggtccggggtttcatcaactgctgctccttctcccaggaaagamtatccctgtcacccatcccattgccgctggggacagccaggcctgggccttggtttgggagaagcagtccaagtctgcatatcaaataaatgatggaggagatgggtggtaggaccttccagacctcataaaacttaggctttatgatctgggactcacagaaggttgagcaataaaagaccttagggattmtctggyttaattaattctctcattttatagaggaagaaattaagtcaaggtggggcagggtgggaggggagaactttcccgggsctcttcatttactcccacaaaggctggaattttgagcagcccctgtctgtctgtttgtccttccagccacccctgagaccccacagccctcacckccaggtggctcagggtctgagycctataagctcctgccgggagccgtcgccacaatcgtcaagcccctctctgccrtcccccagccgaccatcaccaagcaggaagttatctagcaagccgctggggcttgggggctccactggctccccccagccccctaagagagcacctggtgatcacgtggtcacggcaaaggaagacgtgatgccaggaccagtcccagagcaggaatgggaaggatgaagggcccgagaacatggcctaagggccacatcccactgccacccttgacgccctgctctggataacaagactttgacttggggagacctctactgccttggacaacttttctcatgttgaagccactgccttcaccttcaccttcatccatgtccaacccccgacttcatcccaaaggacagccgcctggagatgacttgaggccttacttaaacccagctcccttcttccctagcctggtgcttctcctctcctagcccckgtcatggtgtccagacagagccctgtgaggctgggtccaattgtggcacttggggcaccttgctcctccttctgctgctgcccccacctctgctgcctccctctgctgtcaccttgctcagccatcccgtcttctccaacaccacctctccagaggccaaggaggccttggaaacgattcccccagtcattctgggaacatgttgtaagcactgactgggaccaggcaccaggcagggtctagaaggctgtggtgagggaagacrcctttctcctccaacccaacctcatcctccttcttcagggacttgggtgggtacttgggtgaggatccctgaaggccttcaacccgagaaaacaaacccaggttggcgactgcaacaggaacttggagtggagaggaaaagcatcagaaagaggcagaccatccaccaggcctttgagaaagggtagaattctggctggtagagcaggtgagatgggacattccaaagaacagcctgagccaaggcctcgtggtagtaagaatctagcaagaattgaggaagaatggtgtgggagagggatgatgaagagagagagggcctgctggagagcatagggtctggaacaccaggctgaggtcctgatcagcttcaaggagtatgcagggagctgggcttccagaaaatgaacacagcagttctgcagaggacgggaggctggaagctgggaggtcaggtggggtggatgatataatgygggtgagagtaatgaggcttggggctggagaggacaagatgggtaaaccctcacatcagagtgacatccaggaggaataagctcccagggcctgtctcaagctcttccttactcccaggcactgtcttaaggcatctgacatgcatcatctcatttaatcctcccttcctccctattaacctagagattgtttttgttttttattctcctcctccctccccgccctcacccgccccactccctcctaacctagagattgttacagaagctgaaattgcgttctaagaggtgaagtgattttttttctgaaactcacacaactaggaagtggctgagtcaggacttgaacccaggtctccctggatcagaacaggagctcttaactacagtggctgaatagcttctccaaaggctccctgtgttctcaccgtgatcaagttgaggggcttccggctcccttctacagcctcagaaaccagactcgttcttctgggaaccctgcccactcccaggaccaagattggcctgaggctgcactaaaattcacttagggtcgagcatcctgtttgctgataaatattaaggagaattcatgactcttgacagcttttctctcttcactccccaagtcaaggggaggggtggcaggggtctgtttcctggaagtcaggctcatctggcctgttggcatgggggtgggacagtgtgcacagtgtgggggcaggggagggctaagcaggcctgggtttgagggctgctccggagaccgtcactccaggtgcattctggaagcattagaccccaggatggagcgaccagcatgtcatccatgtggaatcttggtggctttgaggacattctggaaaatgccactgaccagtgtgaacaaaagggatgtgttatggggctggaggtgtgattaggtaggagggaaactgttggaccgactcctgccccctgctcaacactgacccctctgagtggttggaggcagtgccccagtgcccagaaatcccaccattagtgattgttttttatgagaaagaggcgtggagaagtattggggcaatgtgtcagggaggaatcaccacatccctacggcagtcccagccaagcccccaatcccagcggagactgtgccctgctcagagctcccaagccttcccccaccacctcactcaagtgcccctgaaatccctgccagacggctcagcctggtctgcggtaaggcagggaggctggaaccatttctgggcattgtggtcattcccactgtgttcctccacctcctccctccagcgttgctcagacctctgtcttgggagaaaggttgagataagaatgtcccatggagtgccgtgggcaacagtggcccttcatgggaacaatctgttggagcagggggtcagttctctgctgggaatctacccctttctggaggagaaacccattccaccttaataactttattgtaatgtgagaaacacaaaacaaagtttacttttttgactctaagctgacatgatattagaaaatctctcgctctctttttttttttttttttttttttttggctacttgagttgtggtcctaaaacataaaatctgatggacaaacagagggttgctggggggacaagcgtgggcacaatttccccaccaagacaccctgatcttcaggcgggtctcaggagcttctaaaaatccgcatggctctcctgagagtggacagaggagaggagagggtcagaaatgaacgctcttctatttcttgtcattaccaagccaattacttttgccaaatttttctgtgatctgccctgattaagatgaattgtgaaatttacatcaagcaattatcaaagcgggctgggtcccatcagaacgacccacatctttctgtgggtgtgaatgtcattaggtcttgcgctgacccctgagcccccatcactgccgcctgatggggcaaagaaacaaaaaacatttcttactcttctgtgttttaacaaaagtttataaaacaaaataaatggcgcatatgttttctaagtccttggataagtatcttttctttcaggtatcagaaataagactgaatcttctggttctacttgggggttaaaaaattttttttaaaggaagaatgagaatagttttatagttctttgtgatgtgcagaatgtttttgtgtccattataatttttcagtcttcacatcaagaggtaagcagttagacatgattactcccactttccagatgaggagactgaggcttgggggaagtgacttctcttggaaggcagaggtggacatctaaccctggtctcttgattccaagtacttagtatatcgagagagtgaaagttgatcccccttcttgaagaggggagtgatgaggggagagtgcaatggcaagatctggaagaatggcaagagggtccaagggtctgtcatcctccaccaaggttcaagacagaaccttttgctgggtcacctcaatctgccagcaatggaagatgagtagctgtggggacatttcataaaagcaagtggkttttttgttttgttttgttttgttttttgtttttttttctagaacaaggctgtgcacagtggctcacctctgtaatcccagcactttgggaggctgaggcgggaggatcacttgagctcaggagttcgagaccagccagagcaatataaggagaccccatctctacaaaaaatttaaaaattagccaggtatagtggtgtgtgcctatagtaccagctactctgaaggctgaggtgggaagattgcttcagcccaggagttcgaggatgcagtgagctatgaatgcaacactgcactacagcctggatgaaagaacaagactctgtctcaaaacataaataataagtaaaaagaataaaagcaagagatgcacttgagaatctccagccagatctgtagccactgggcttctctccaaggctaaactattacaggagggtggccttgtgtctcggtcaccacagaccacagcgttccattcactcggggttgtgctggagctggcttgtgagaactgactgttagcttctcttcccaactccatgtttgccagtgccacactgatagcttgaaattggttattgccggagtgtttacaccacaaggactagcaaactctacaaatccgggcttttgttcctggagagcccgttgttaacattcaccagcacaccacagcattcggcaatggctggaccatgggatgcctacatatggggacatcctccttggggatgagggtagagcagggcgatcctttcacctcttccttaagggaggggacaaaagttctggtctgggaagcacacgttttgctgatcagcgtaaccttgggcaggtcactccaccactccgagcctcatctgtaaagtgggaatgatatctccctccagggcagatgtcaggattcaatggaatgagatcacagtaactgtgagagctcccgttacatgaggagtacaagtgaactcttcatgcgcccctttttagcgagaagttaaccattaaactctccaggcttcagagcacccattcgctgtctacctgatccctagggccgctcccgccttcccctgtgccttccctccactagtcagcaccaggaaatgttttcgataacgttgcaacggaggccttgttcatgctgccgccatcggggacaagcgcggggggcggsgggtggaggccagaggagactatttcagtcctaaattgtgcttaataaacccatatcaaaaccataaacccttggctgccataaattcctctacccttggatcctccacctcatcagscctttgccctggttaatctcaaatctcagcgcaggcagccggagctttaggtttggtttctacttcagttgctaaacagcatcagctcaggtggcagacagtaaaattcccattttagagatgatgaaactgaggttcagaaaggtgaagaaacttgtccaaggtcacacagctagagaccccagccaagacctgagcccatgcttccaccacccaggtagcctgattaagaaatgggaattcttggctgagcacagtggttcacccctgtaatcccagcactttgggaggccaaggtgggcggatcacctgagattaggagttcaagactagcctggccaacatggtgaaaccccatctctactaaaaatacaaaaattagccgggcacagtggtgcacacctgtaatcccagctactcaggaggctgagccaggagagttgcttgaacccaggaggcggaggctgcagtgagccgagatcatgccactgcactccagcctgggtgacagagcgagactccatctccaaaaaaaaaaaaaaaaaaaaaaaggaattctcaattctcaagcttctcggggagacagatttgaggtttcctcttacatctttgtttggtggccctacaattaaacctctttctctgctacaaaacaatggaaaaaaactggaatttctaaggctcctcatttttttttttttttttgagtcagggtctcactctgtcacccaggctggagtgtagtggtgccatcatagctctctgcaacctctgcctccagagttcaagcaatcctcctgcctcagccttttgagtagctggggtacagtgtgccagcacacctggctatttttttcttttatttttagtaaagatgaggtcttgctatgttgcccaggctgacttctttttagcacctctgaaaagttgtttccccaagccatgctactagaagcttcttattccatcattccatcattgctcagagtggggaccagaagtagaagggaccctgggtgacaggctgcttgaagatccaaagaaagtttcatgcagtgtgaatggcctgtcatcccaaattggtgaaatcgtcctacttcctcatttgtggaacccagataacctttgagctacacttctcaaatccacgtatcatatgtaaattccaggatgtgatctcagaggcctgaatcacaggatcccaggcagctgtttgacaatggtggagttagacaccaaatcatgatgccaaggacatttactgggctcttcctctttgccaaacatggctggacataatttaattcccacaacaacctctgaggctgtcattcttgtggttctgtttcacaaatgaggaaacaagrccggtcatggtggatcacgcctgtaatctcagcactttgggaggctgaggcaggtggatcacctgaggtcaagagtttgagaccagcctggccaacgtggtgaaacctcatctccattaaaaatacaaaaaaaaaaaaaaaccagccaggcgtggtggcatgtgccagtagtcccgactactcgggaggctgaggcagcagaatcgcttgaacccgggagacagaggttccagtgagccgagatcatgccactgcactccagcgtgggcaaaagcttgagaccctgccacaacaacaacaacaacaaagaggaaacaggctcaggag

SEQ ID NO: 17774 - DNA, 68123 bp, Homo sapiens
aagtaatacaactcagaagatagttcaggaaccggtggggttcctgcaggccccgagggcagagcctctgagggccaaagagcagcgcactgaaccacagaggattattctcaggcctgaaacatgatggaatttggcctgctctgttttgaacttgcttggaacaartgacccttgtccacttatgtattccttccattttctccatttcagaatgaaactgtttatactatgccattgtatttggggagaggtaactggttttctagtttcatagatgaggaatcaggataaatcataccaagaaactcacatacacctgatttagatgatttagatgatgatatttaggactttttgactcgatggtatttaaatgagatttggaatttagagttaatgccggaataggttcagaaatttgaaatgggttaagaatgggatggatgtattctgcgtgtggaaaagacatgaattttgggggaccagagaatggactataatgtgttgaattgctccccaaaaaggtatgttcaagtcttcatccttcatacctgtgagtgtgagcttatttgaaaatagggtctttgcagatgtaatcaagttaagatgaggtcacattggattacggtaaaccctaaatccaatgactggtgtcctcacaagaagagggcacacagagattcacaggagacccacagggaaagaaggtcatgagaagagggaagcagagactggtgtgatgcggctatgagccaagaaataccaggtgtttctggaagccacccagtggaagtcaggaagaggcaagaaagtattcttccctatggcattgggatgcagcaggtgcctgctgacaccttaatttcagacctttagcctctagaacttcaagaaaatacatttctgttgttttaagccacccagcttgtggtaatttgttatgacagcccaggaaactaatgcaaacctcttatggctctatagraccacgtgattgtacggcactaagataatctaaccctttatatttctgttatcccagttgtctcaattatttgtgtctttatagggctgcctcttatttttgccctaattttctctcccttcccccctttatgtcttacatctgccccgccgtgcttttcttaaaactttgctctgcctcttctatcttcttttcttcctttttcctaatactttttttctcaacagggtctccttccattcctgatgaaaatctattttctggttctcttgcctatacagggtccatcctctggatgggaggaatatactccccatcccactgaagtcagctgtggtcaaatgacttatgttgatcaatgaaatgtaggcagaaatgataagtattacacccaggcagaagcttcacaaaccaagcatattttgctgtatctgtttttcttctgccaagggaattggtccatcagcctacactccagaataaagacatgtaacagaattgcagcagacctgcaataaacatgtggcaagaatagaaaaaaaaaaaaatttgttgttgtaagcatctgatatttggggattacttgttactacagcataacatgttcttcttacactccctaacattcaatgagaaaactttccagatctcccttttatctaatgaataaagatcaaactgcttagcctgatatctaaaatccactagtcctggctgggcaccgtggctcatgcctgtaatcccagcactttgggaggccgaggcagatcacctgaggtcaggagttcaagaccagcctggccaacatggtgaaaaaatacaaaaattagccaggcgtrgtggcacacgcctgtaatcccagctacttgggaggttaaggcaggagaatcgctggaacccaggaggcagaggttacagtgagctgagattgggccactgcaatccagcctgggtgacagagtgagactctgtctcaaaaaataaaaaataaaaaactaaaataaaataaaatccactagttctaacctatctttctccttttagtttcacttattttgcttcaaaatttattactaaaaaaagcaattaattacattacacattatatttaattttgttaaatatataatgtgtagtgtaattttgtgaaatataatgtgtaatgtataaacataatgtgtaatgtgtaacataataatgtccacattatatttaacaaaatattgtgcacattttgctactgtcttactcgttaattgctctctgtgtatcaagcctatgcctaagaccaaatagagggtatgactaaacccatagaagggctggcctgggaaaggatagctagaataaactcctgcaagagtccatagtcagaaaatgacccagagggttaataatcaacacagaactgagagatctgaaattgttcagtgtcaagttatgatggtactgtgggggtaaggaaattccacaggcagagatcagtaactcacctggaattgagacctcaagatgggtcccagaagcaagacccacagagaactaaatatcaaggtattaaaaacataatgggaaaaatattttaagtgtaatggggtgttatgggctgaattatttcccccaaaattcataaattgaagttctaacccccattgtcactatatttagagacagagcctttaaagaggtaaattaaggttaaatgaagacgtaaacgtgaggatctaatccaacagcactggcgtccttataaaaagaggcagagacaccagaagcacacatgcccaggggaaggactgtgtgaggacacagtgagaaagtgaccatccacaagccaaggagagaggcctcaggagaaaccaaccctgctggcaccttgatcttggacttccagcctccagaactgtgagaaaattaatttctgctgtttaagccacccaatttgtggtattttgttacgccagccctaggaaactaatacattgggtaatcaaggaagagggtcctacaggccaggtcctggccaagatcaatacagacactctgtttttactgcagctttttcactcacccatacttacctccttcctggggatctccactattccaaaagaatcatgtgacctctgacaatgagcatatgccttggctcttggactcctaataggcaggaagtacatctttgatatcacccagaggcttctgctatatgtaacaaagaagttctgtatatgcttgaggattaattaacgtgttctctgctccttcccctgaattaggggtttttaacttcatagaatccctgagaggatactgggggggagtttcatagatgggttttaggagcttgcccacagctttcatcagattctcaaagggaatcctaacactaaaaggtaaaaaaaaagaaaaaagaaaatccatttagatgttgacatctgtcacatcctctgaccaacagtgatgttacgtctcttcatgtacagtaacataatgagctttttgtcaaacttttcccaacccatttggacgtctcatacgttttctaaatctgatctgtagctccatctgttaggtgagtattgttgcaggtttattgtcctcagctttctgaactrtaaactattttagaaaaaacagcttcagaaacaatgagagtttgaatatctgccaacaaacatttccaaataaagctatactgaaaagacaccgcraattcaaaggcctttttttattcatttttctctcttgttttgttgtaagaaatacagtgggtctttattaatcatgttataaattaataagacctccaataaaactgaaagtcaaaattctcaagctttgccacctacaaatgaactctctaggtacctatttacatttaagagatgaatccagtttgctttaagtaattactttttaggttaacacagttacataagaaaatttattttgatcattttacagaagcataaaatatcaattttagcagaaaaaaattttagtcgggtaactttttttccagagccctttaaatgaaatttttttctacattctcgttgaattgatgtaatcacctgaaatcaatcttacaaagccatcttaaataaatggggaatgctagttagaataagaagttaatattttgggtccccaagaaaattttctttagccaactaaggccaaatcctcagaaatgcttttcttacttattctgcaatagtctcactgctcccaagccccttgggagacttggaaaaatggtctgtgtcttccacacttctcagagcagatgtgcacagaggatgtgcacaccagggagaagcatggtcaaacactgcccacccctttatccttcctccgaggagattgctcaacccctagaccttggctaaggaaaaacatcctattgtctgaggcaaaaagacatcaagtcctttcatgctgtcctgggaaaggcggtttggaacaagttatcctgattctagagacgtgagtgttcccagctgcaccgtgacttgtttttggctcctaggcaaagtgcccagtttcctctgctcccaaatttctccaactgcaaagtagagataatccttgttacctttttcttgcagtgttctgaaaataaatagggcaaataattctaaagtgttttgagagatttggctgagggcatatttgcctagaaatgtaggtgggggtttttggtttattttggttttattttgtttttgtcagtgtttttgcttttggccagacgttggcatgcatttagaaaatctaaattaaattaaattaaattataattattcatctgatgataatggaacatttacaggatgcaaagcactgtgctaggcaccaggagaatgcagaaagggcacatccccttccttcaaggagtttacagctttctcagaagcaggtatgatatatatatgtgtctatatcacataatagagggattatagataagttacacaagtgtggctgtcagccatggtagctgatttggaatcccatcctgtaagttacagttggataccctagaaaaaacacccttactaagctttggtttcctcttatgtaaatgataatagctaacatttattgagtgtctgctacgtggcaggggtgttctatgcagtttatcatgttaactaacttaaaactcagaacaattgcagagatagatattatcatcatttccatatgtatatccctgtcttatagataaaagcactgatgctttagagaggttatataacttgtcccgggtcatagttaggaagtggtgaagataggatgcaaatccaagctggctggcctcaaattctgccaatccaaccactgtatgacactacccctcaaatgggaacacagtaaaacttaccatgcgtagtgaggatcaactgataataacgcataaaaagctgttagcacagtgtctgacacataataaatgtgtgataaatgtagaagtagcagtagaagagattagacacatacaaacaaccagaatcccgggccaaaaataagtgcacacctccattctttttatgggaaacctccttcttagataccaaccattataaccatggagttacagtggagagctgtgttgaggggagaactgcaacatttctgaatcagcatacaagtgatctataatataaggagcaatcatttttatatatgtccatttccaaatctcattcaaagaaggttaaggtatctgaagtacccttctattaaaattcagactgtatttgctagaacaatttccaattgagcaacgtaaaaatgcatctgctgccatttctcttcttccctcctttaatccctactccccaatttcctttagaaagaaacaacagcatggagtttcttttcaaggtcttaaaataaaaatctccaaaaaagggatgctgcttataaaacctttcagagttgtttgaaaaagaaaaaaaatgcataaagagccaagtgcttatattctggccaagttatgaggctctgagaacaagagcttgaggggaagactgttaaccccatccacgccaccagaattagctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatwtcaactccagtagacttgaatrtgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaaggtaagttgtaataaatttacggcattatctaattgcatttgttaagctgatttgcgtgatctgataaagctgtcaaatatttttgcctaaataatacaaagccatttatttaccaaaaaaagttttgtgtgatttacagaaaagatacttcatagagaattttaccatttgtattcatgttttcttgtttcctgcgaaattaaatagcaagtactaataaatgatggtgattttagtgaagaccaagaatagaaatgtggaactgttgatcgcctcagtagcattcagatcttagtgaagcctgaatcctgaaatgtgttttgtagaagtactttattacatatatgaaataaactataaagaaggtagtttttaaaaaaaatttcaaatcaaataatttgtatgttttccatgtttaaattatctaaagttattcaatctcctgagcctaacagcaatgtagaaacggaactttttgcttttccaaaaggtaggaaaatttctccttttatactatattcttgtttgattatttttaagttattgcgattattttccctttcttggttcccttttacagctttayaactaattattttttgcctcctactatcatttgttaagatgctcacacatagacctaaaatttctctaattcttgatratgtcttatttacaaaagcaaaaatgggagargagaattaaagagctaaagagattatggtaactcatattataatgtactaccatttctggctctcttttctaaaataaagcaataatgtaggttgtgcttattcatccttcccaggtattaaaggtcactctgcaagagaaaaaaagaaaagaaaggaaaagaaaagaaaaaaaaacatgcttttaactgcagatcaatactgttgaaacagtacaccaagaggtactgcagaaagagtatctcttttgcactgcctttaatctgcaaagaggttaaatatgtcaccttggcattgtatctgagctctcctctggcccagggcctaagcacattgaatagaaatgttcactcagtccaagtcagcagaaatcttttttttttttattctcccctttctcgtagacaccagcttttttcagttcacagcttactcagtcaaacctgatggttgtgactattgttaactatgattttttttttattcaaaacaccctctttggaaagatttaagttaatatttctgttcatttaataagatctagcaaagcagagcagtttatttcatctacttatcgtccaatcaactagtgccactttccacattttggagaagaatattcacatgttatttatgaaccttgcctttttctttcagagaatttttcacacagccattgagcaattagagtgctggcatttccttcctaggtcttttgagatttaatccccartagctyctcatggcacagattcacatatcaactaagtaaaaataatagtgatgacagaaataaaatgaatagtgatgcatctggacaacttgaaaacattatttatttcatttcctcttgactgttctttttactcagttgacttaaacactgctattttacttaagtttagcaccatatccagaactggttgggaacatttttctaccgagaagggcataaacaacttgttagaagatctgaagtgcacatagtcctcacttatccctctagaatgatcttcagtggagaaggagacccccataaataaatccagtagaacttcccagtaggcctggcttcctgagagatgtccaaccaggccagggtctgtttcttacggggctcacagggcatcttctgccaaaggctgagttagcgatgatagcattacctagggctagcctggcttttgtcttagtcatcaaaagatggatagaactttgaaaaacagagtgcatggtcttgatgattgttccaaaggtggggaggcaatctaataaagtgaataaggccatgacctgtggtttatatctgaccatatggaccctgtttatataagaccgtggtttatatccaagctttaccacaaaatagctctgtgactttgggcaaacaacttcatctctttgtgcctcagtctcttcattcatggaaatgggattataaaatcagtagctacctcagagatttgttgtaagaaktaagtgaagaaaagagccatgtttggtacattaaagcaatcaatcaatcgtagataatatgaaagtactggactaactatatgtccctattgaaactccgtagaacgggaactgactctagatattttctcagggtttcttccttgtacttatacgttttgctctataataaaatatgaatgccaggtgtatgcctctgaggcagcacagcagagtggacagagcatgggcttcagagtccaatgcatctgggctagaatcctgactctgcttcttacaatcagtgtaagctttggcagttacttcccacctgcatgactcagtttactcatctgtttagcaaaatggggataataatacacacaaatgaggtcgttgtaggaatgaaatgtgatgtttattaaatgccaagtatagcacctggcagagaagtaaacacataggaaagttgactggttgctcataaggaatctcgtatatcagtgaggcctctgttacatacttgcaatgatttctctggtagtaacaatggagatcaagaaggaaatattctttgaattgccttttttatccaaagaaatgtaaaagtaaatcggacactactattttcccctggtggggggcctcaacacgaggtatttattactatgagacttcactgctgcatcagttagtagcttcttaatggccaagtcaaaggaaaccaaagaaagtgttctatgccagcttgccattacacagagtgagaagaaatgctgctttgctgtcaattctgttttattggcccacttggacaagagggaaagcccccaacatttcttctttcttatctcttctaaaggcaagaatagggcttttgacttgctccaggggatattttttcctctctaactgaaattcaagtgaaagagtcttttttttgtttttttgtctttgtttggtgtttttgtaaacctctcccctatgttcctagcattgaaatgtaagctgctttttctggctgcatgtagcaggagcaggctgtcgtcatagcaatgaaagggtgtagagagactcctgcttcatgacctgctctgggaaataactcttagtctgctttaaaatccttctttagaaatgaagtctccagtcctggcttgtttccttcctattacacaaccaacttatgtacacccattgcagtagctaaatgtttcctttaaagatttagtgaataggtattttaaaaatcaacaagagagctgctaaaacagtggctagtttactgtggcatacaggggaaaaacaactgggaaggcaaagaaagagaaatagaaatggcctcacatgatacacatactgcagcaaaccctgcaataawtccatttttcaagttcccactgcttcctcccatcttcacgatgtgctatggtgtagtggttatagaggggaattctggggcagactgcctggacttgaatcctggcactcataccttctagttgttttaatctaatccattctgtgcctctgtcttctcatctgtgaaatagatataataacagtcataaaattgtcatgggaattgaatgagattgagcatgtaaggcatttattacagtatctaacccatggtaaaggttggctgctaagctcaggagcctcagtttcccccacttgtgaaatgtggataacagctaattcataagatcattgtattttttttttttttgagacagagtcttgctctattgcccaggctagagtgcagtgacatgacctcagctcactgcaacctccaccwcctgagttcaagtgattcttgtgcctcagcctcctgagtagctgggactacaggcatgtactaccatgcctggctgatttttgttgttttagtagagatggggttttgtcatgttggccaggctggtctcaaactccaggcctcaagtgatctgcttgcctcaggctcccaaggtgctgggattacaggtgtgagccaccatgccaagatgatcattgtatgattaactaaaataatgaatgtacatgctcaataagtagtagttattacaattctttttcatggttttgttattgaaacagcaaggttccagtctaggtcctgctgctcacttcrtagaaagccaatcactgagacaacaagtattgccaatgaagaaggctttaatcaggtgctgcagctgaggagatgggagcacagtctcaaatccatctcactaactgactwaaactaggggtttacatagcaagggaaaaatgtaacaatgtgtaagaaaataagaactaggtaggggtaaggaaacaatcatggtgaataagcggtcaggcatctgctgcagtgatctggtgagtttccattcttttmtacttttttagaagcctgaaggtcctgtcctgaggaaggaacttagataaaacaaatataagtttcacactttaagaccaggagggtcaacttctatgtttttcaaaaagatctgtctgtgggactattgggtaagtttcagtttgatctaactctgacatgaatggcctttttgaacttagaattcccagtgagtcaaatataatgaatagaggcctcagaattatcattgcataaatgtgaaccatttgatttctacagggggaaaaaaaagaattgtgactttttacatttataaagactcatctcatcttgattaacaccagggtaaaaagtattaaaacatcttatctttcattaactttttattacgtttctgtttcagttcctccagtgttttctaggtcatgcaattatgaaaataagttagcatktttatcttacatctcaaacaactaatgtattcagtgttctatcccatgcaaaattccagaaatgcagcaaggagcaaaactagagaggggctgagctcttgtggtgcttactatgtagttatgaaaatggtcattaatcaaaccatcacaataatgaaaactgcataggaccaaacataaggtgcccccaaatacaatgccatcttcatctttctagtgagaacatcctcaaccaaagtgtttrgccaaacagcatgtacaaatgggtaatatattgtaatgtacacttgggatatttaatctatggttcacatacatatttaatatgttaytttaatttaaatattttatacttattaacatgactttttcctttctcacatwtcatgaaacaattttgttaaaactcttcatacgcatctttaacaccaatgtgtatgttcactggatccacgctgtaattatctaatacagagcacatcatcaatccttctgcaagttgctaaacatctgctgatgctgcaaatttaatccccaggcattagtcctcactcgtggtcatgttctccacactttcattactgactagattgtttttccagtgctttttaaagggcgtatttaaaaaccacttgaaactgtaagtgtggctttctaaaactatgtgattccaacttgcaataatgaagtcatacctcaggaataatgactaaacctgctttaaatatctttatctattttttcatccattttgtcaaggtgaccttcctaagaataaaaataagcattgcttgagattttttttttttttgagacagagtctcattctgtcacccaggctggagtgcagtggtgtgaccttgggtccctgcaacctctacctcctgggctggagcaattcttctgcctcagcctcctgagtggctaggattacaggtgtgcaccaccacgcctggctaattttttgtacttttagtagagacagggttttgccatgttggctaggctggtcttgaactcctgacctcaggtgatcacccacctcggcctcccagagtgctgggattacaggcatgagccactgtgcccagctcttgagatgatttctaattgtttttttgaatagtactttgctgctcaaaatgaagaaactttggaagcacttgaatataagtcaaatccctcttttttacggcaggatttggtggcgtgagaaaaaacacattttatttgaacacatgccatatataatgatacactgaaataagtgttatgaaggcaaaacacctttgttccaagagagtatataaggatcctgacctccactcaggatcaataatggctttccttgatctgaagtctgaatagaggttaactctgtgtgtgtgcgtgtgtgtgtgtgtgtgtgtgtgtgtgtgtgtgtgtgtgtktttggtggtggtggctgggaggagcgggtgctggagagagaattctgacagcgtgaacacttgtgcaaagaccctggagcaagagggatcgtggcctatttgaggcactgagaggcagccagctcccgagagcaagggcagagcagtggaagatgtaaatctccataatactcccttccctgagcactaaatgtatgtgccctttgcttgattcaggtttaatgtatacttttaacgtctggatggatttctggttagtctcaaagccccaacaggcatgaccatgtctatccctagctcagactcttatggtggtaggttcaattaggaaggatgatgggcagttgaaggtcagatgcccagaaaagtcttaagtcattgactctgagtatatcatatacactcacagggctgggacaccttgatgtcagatggtgactcagcagagarctcaaaatagaagaacgtctttttcacccttcagatgactttagggccaaaccatagagctctccccagagactcattaatactttaaaagctctaaagcatcagtgttaacactggatcaggtaacagcacgtatatgttagccaaaatatgactaagagatttgctctctgataacaaggcctttgactattatgtaaaaacaaggtgaacaggaacgttctgagtctgtttataaagtacctataataattgttttgtttactacatttcccagaaaggaaatttttccatagttgtaataattgctaaaaatagcagtctacaggcttcctctgatataaacaaattcaacmgaagatacctggccttatttggatgcatggatgtacatactccaggaaatgataggccaagagtaataagaaaaagaaagtaacaagacaaacctctcctttttctagtacacatggtatgtctttcttagttcattaaactttagacaaagtgataaacagatcaagttgtcatcatctgccttgaaacccaaaaatattgaaacaagttccctaggcccagaagggaaggaagaggacttgtaaattttgctgaggctgccacagaaggagctaaccactggagggttcagactggagggttcagaaaccaggggaatgctaggcaacacaaggaaaattcaattagaaagacttgaagcaataactaccagcactaaaatttccagggagtcactgatgtggccaatatgaaagaggaatcctgttcctcctttcagaggtatggatgactgcgtttacagtctggttcagtgttcagacagcttattaatgcttaagagaaaaggaaagagaaggaagatagaaagaagaagtacarcaaggcaagaagtgcccaggggagcaggtrtgctaagttgatttaagtggcatggcaatatacagaacttcaaaaataaaatttatcttttaaaatttaaatgtaaattaatgttctaaaaaactataggaactgaaaataaatcaaatacaaatatctacttcgacctaatcttactgtaatttaagtttctaggaaatatcatagaaactgaagtggaaccaattacagaaaaagaatgcaaaataaaccatagtaccgaaaataaaaacatattctggtcgtttgtgtaggttccctaataaatctagacggagaatgatgtttttgtgttttagtgtatgccaaactttagacaccctcctcttttctaggagatacaaatttcaggagcgatatttagctattacacacatagcttttcatcagagatgggggtagctgacacacacatggcccattctgcccatacctttcaggtcaatctctgatggcttggctgggctgtttccagctagcagaaaggatattcaggccccttttccttgcttttccagggacagagcttgtagagtgctgagaaatccaattacaacttcctttcatggtgaaatccaattacaacctctcccatggtgaaagccaatctttttgatacaaaaggaaactaaacaaaagggcttcaggcaggggatatgcttgtgctctgccttctcactttgacaattatgcaggaaggttgcaatgaccttggcttgccttgcttaggaacaaaagtcataatcttctaccccctactcccacaaaaaggaaaaacgttttcatatctgattccaggagtttggggagtttcctcaaggatccattagtcaggcaaagcaaattttgagccaacacttgctccctcccacacacttttttttccggcaagatgacttttcttattgaacttggaatgccatgttaaatgataaataaattagtgaattatttaggccaatatcctcccataatctgttcccaacaacttttttttttttttttttttgagacagtgtctggctctgtcacccaggctagagtacagtgtgcagtggtgcaatctcggctcactgcaacctccgcctacccagctcaagtgattctcctgcctcagcctcctgagtagctgggactacaggcacctgtcaccacgcctggctagtttttgtatttttagtagagatgaggtttcaccatgttggctgggctggtcttgaacttctggcctcaagtgatccacccacctcggcctcccaaagtgctgggattacaggtgtgagccaccgtgcctggcctgtttctgmtacctttgtgatatccaatgctgtgtgtcaccctttcagccaacctgtttgcttgaggttagtgagactgtagtactgcttggagaggggtcatcctaaattcctaaaacctggttgagataaacggaaacagttctcaaaacagtaatttatgaaaatagatattttatgagtacttgacacaagtctataattgctgagatatttaawaataaaattactaaccacattctattcaaatctctgtcacttctgtataatcactgtactccactgaatgtgtgtaaaatatgtatttgcagcttatagggaaaaaaatttgcaaattttcagaagaatcatgcagtcaactaataggttcttagttgaagattagtggagtggggagtggtaaatggttatctttttcaaaacttaggacaaactttacactaggttcaaataaaagtgctatggctacagagttaatgaacccaccattcaaagtggccctaaatagctctgaaagcaaagcatttttacattatttgattcaacttgagttatctaattgcctatataatatgatagggacccaggccggacacaatggctcatgcctgtaatcccagcactttgggaggctgagtcaggtggatcacttgaggtcaggagttcaagaccagcctgaccaacatggtgaaaacccgtctctactaaaaaatataaaaattagccgggcgtggttgtgtgcacctgtagtctcagctactcaggaggttgaggcagaagaattgcttgaacccgggaggcggaggttgcagtgagtagagatcagccactgtactccagcctgggcaacagagcaagactccatctcagaaaaaaaaaaaaagatagggacttgataggaaggtaccctgagatatacaaaaatcagaagaattgacctttatgataggtaaataaaacatgtaaatggtttcatgacgtgtttggtcagatgttcatgctgtcttagctcattgaaatcatttttaactttcaagccattagttcagtggatcctcccaaccttttactggggaccaaacaattttgagctaattctctctaaatcaagggagtattctattagaattcagaagaaacaaagcacaaattcttaaccctaagtgtcttctttttctctctttttcttccctgttgcccaactccagctaatgggttttaaggactttataatgagaagcaggttaatgtcttactagaaaaacttttcaataatttcctaaaatatggggagaagaaaatagtggaagatgttgttataaaatagaaaaatgcttggttgaaaccttggtactcgtattgatcttgtactcattagctttttggataggcataggcggggaagagaagtatcagcatcatctcactgataaaaacagctgatgtcttcttacagtctgaaaatgaagccattgatttcaaaagcaaatgttttattatactttgaaaaacactctggattggatcattcaaggttatgatagcctgagataactgcagcctcaaactcccgggctcaagcaatcctcctgcctcagcctcctcagtagctgggactacaggcacgagccattaagcctggcttgaggggaaaagtcttttcccatggtgggaggagaagaattaacagctgtggaccagctgtgggcaagctgtgtcttttccttgcttgaaggcatcttyttaacattttctctctgaaggcataaataagcttccaggttttcaccctattttcaaagaacttttcaaactctagccttaaaatccattagggtttattacatctgcttctttcagaaaaggtagataataagtaactttgcaccactgaggtaagcaagcaattgtttcccatattaaatgtgttggccctcaccaaggtacatgagaagcttggaccacgatctgaatcctaaagggacttctgctgggactgaatgyttgcattagcggttcacacaagaactaaatgctcatcaaagtacaccattattccccagaaggtcccaacaccatgagaatgaggctacttggaactgttctttggtattatttgttgtttttcttaatcctagaagagaactaccccccaataaataattcttggtccattcacagagctgaaagcacttgaaattcctctcccaactagcagaatttaacaactgacttactctgttagcaaaagagaggcaatttccactgaatccaaaggagttttatattatactggtagagtttaactaataagggaaattcaaataagagcagtcagaggataaagccaagaactaggcattcaggggaaagaaattacaggggtagtagagaaacaaataaattaaggggtagggagaagagttaaaggcagaaaaagcagaggattaatctatctgataattacaggggctaggytttaaaaggtgtattgtcttactattaacaacatgaagccaatcattcagatattattaagttactgcaacgtcacaaacgccaggactttaggtgagccatcctaagagcagattcagggtttgtgaagccaagagtttatacatatgtttggaaccttcttttttaaaaatataaaagtcaaaatcaagtctagaactttgtatggaggctgcacaagtgaggggccttgaaactcaagcttcctagttttatggcacgtctatcctggccatattcaaatgtctataccccaaatacarcaaaaagttcagaaaaataaataaatgtaaatatgagaaaatcctgtgttctctttctctgagaaagagaaaatagtarcacagataccatagtaggacttgagcaaagaaaaataaatatggccaaaataatgtctcccactataacacaggrcagggtgtggtggaccctttctgaaggattggcaaatgtctgagaaaaagaacaggcaactgyctccctggatggatccatcccatctggagctctggaatgagacacagtgagattagtgagtggtatgataagacgagaaactctgaaaggcatgattaagakatggtgaaaggtggctattgcacaagcttgggtaagataagcctgggggatcctctaaatataattaaagtaatccctcaattacacattatagaaaaggaggaatggactagtttcgcctgagcaagaaagaaacagacctttaagaatgtgtctgaaaagctgtgcctccgggtgccctttggcttccatgctcctcactgctgaccaggcacagtggcaaagagggatggtcaggaagcactcactgaatggtagttctgtgaaatggaggtgagggtcacagatgggagtgcatggrtggtacacaggtgaagtgcttagcataraacctggcatatagtaaaatctcaggaatgtatatgccattgaatgagctactattaaatggtctaagacaaaaatgtactttttcaataaaataatactttgatgaccataagtgattctactactgagtacatttgagtgctattccacacaaaaatatttaatgtttacagccaattatatatggcttcttacaaactcagtgactcaaagcaactgtttcataatgtctcgagatctggtgggtcagaaatttgggcaggcctctcagaggtactcagctaggagatgagctgatctggagtggcacaggatctctccactcacgtgtcctgcgcatttgcaaggacagatgcaaagctgggattggtagaactgttgaagtgtcttctgtgacatgacagactcagaaaatggctcaaggctcccaaaatgagttttccaggagattaggtaaaagttccaaggtttcttatgacctagcctcagaagtcccagaacatcatttctatctcaatcaattggccaagtaagtcactaaacccagtccagattcaagggaaggagaattagactccacctctcaacaggagaaatagcaaagaatttatagcaatctctaccataatatttatacctattaaataagaaatgtaagaaattgtctcaaggcagttactcatgtgagttagaatagagttgacatttgtgggtgtttggctcttaatgggagacctatttctgccatgacaaatgattcctctggagatttgttttaatggtacatgggtcagccaatagaaaaactctaggcatttgaaattcaaatgctggatgttctctataaaatgctgtctagctatcatcttttaaaattccagctgaggttctcctgaaagtttggtaatgagacaccctgttcctaacagaaggaaagggctctccttccagttacctatcatccctcatctttaacctctctaaatccataaaaagaaacagtgggatgaagaaaagaaagaaataacctaaggactctagtaaagggatgaattaaagtgtctgaattattcattattggggttattaagccattttctgccttatgcatgtttcaaagatatgataacatctttcatttcatttttacagttggtgaaattaccaaataactataggatcacatttgaatctcaaaacaactccagaagatagataagaaaatgtaatattacctttcctgttttgtagatgaagaaaccagtgacttgatcaaagtctcttagctggtaaaaggcagttcaagtctggaacttagatcttccagttccgtaccaactgtcctttaaactatgcagctgcctttgaataagctcacgcatttgagcaaaataatattgatttagtttcacatcaatactgcatatttaagtctttgagaataataattctgtgaattccaaaatttgtctcatttttgcatttttcatctggagttttattttctatttctgcaaaaataatctgtattttgtagtcagtgcacaccaaactcgaatgtctcaaaataaatgactttttactcatccaagaataaatggtattcatcatacttagcaaggacatcatggttttgatttttcaaagtactttgcaagcatcagctaattaagcctccctgagtcttcagtatgacagttgttttcaaaatatctctcatttcccaggaaagttctccattctgtcttatttatacaatcagcacatttgctcagttcttaaaataagaagctaaaggccatgaaattatttttgatcaatatgtggcaaatacaattagctcagtgagacaaaaatgyccagtgactagtctaaaggacaacgtggaacayaatggaagaacacaaggcgttttaaagtctagatactggattgtcccacaaggtccttcaaaaataaaacacaggcatcttctttataattgaaacttgaaggggtttcctgcttggatcattctaaatgacatgaccatactctgcgtttaaattttgttttcaattacaggatggaaaaaaactcttaaaaaatagttccatctttggactcagtaaaaatcagggaccattcagtaaatgttggctctcaaaaagcctgcacaagtggccatctgaggttatatgacaatccctagacttgttctatgccttaaaatatcttccatacagctacgccaggattctcagcattcgatagctctttttgggttaagaacaatgtgaacatacctcttacctgagaatagaaatacattaattcaggaataatcttttttcttttttttgagatggagtctcactctattgctggagtgcagtggctcaatcttggctcactgcaacctccacctcctgggttcaagaaattctcctgcctcagcctcccaagtagctgggattacaggctcatgccaccacgcccagctagtttttgtgttttcagtagagacggggtttcaccatgttggacaggctggtctcgaactcctgacctcaagtgatctgcctgcctcagcctcccaaagtggtgggattacaggcatgagccacaatgcccagccctaattcaggaatattcctatttcctcggtatggtttagatgcatgcaaaaaacaaagatttaaaagtatagaatataggataggtgagtttgtgtttaatgagtgaactaaaagtaaatatgttctggaactagctcctgggaagcttgaaatcccctaggggaggaagatacggaaaaggggaggagaaacactaaggttcttttcccttatatcacacttaatacaagacatatgtagttaatacaagatataaatgactctaatgatattactgatgacaggcagcaggcagaacaatgaaaataataatcatttgcatgtgtaaggtacttcagagtttgcaaagagcttcctcacctcaccttgcaaggagctacctttgacatyggaaggaactggtattcccatcctatatatgaagtttggagagagaaagtaatttgttcaaggtagtatttagtacttggcaaagccagggcccaaagccagaacttctggcttctagtctgtagcctgttcactagtctgtttggggagaatattggatactgagtccaaagctcagcgtttctaattcttgcccacctcttaagccttgtacatttggccaaataatttagactcttcaaatttctgtttctttacatttaaaaattctgtccctcctttcttcattgaatcaaatgagacagtatataagaaaacactttataaactgtgaaatgctaaataaatacaaggaatgtataactaaatccatcttaataagttaatattccttggaaccctgcctcaagacatccttacagttaaactttcctcccttttgtgttaaagaataaagagttcctccttctctttggagttaaacctttcacatgtgctttaatagtagaccagtaaatatgtatccaggatttaccaagatggtattgtctcacttaatcttcatactattttatagacaatgagctgaagcccccaaaagctacacaatttgcttatttacgcaaattaagtattacagcctatgacatcctgtttcagaacttatgcctttaattgttatgaaatattgtcttgctaatggttttggcaactggtctgttttgccttattttggttttcggttgctgtaaaacagtatgctctcacattaaatggcttaaaatcacatccytgtatttgctcataattctccaatctggattgggctccactgcatgattcttctgctgattttgtctggagttaattcatctggcttcagtgagctaggaacacatctggggctgaatcatccaggagggtctgttatcctgcaaggttccagccacatggtctctcatcattcaatagtctgggtcaagcttttgtacagcatggctgatagcttccaccaagaggaaaaactccaatgtgcaaaggtttaccaagtttctgctggcatcatgcttgctaatgtcacattggtcaaagcaaatcacaaggttaaggcccacatcatagggaaatgaagcccagaagttgtggtttactgggggtcatcattgtttaccattatctcctctcttaccctttatcttcaatttttccttatttacctgtcttttcccttcagcacagaagggaaatctggggccgggcatggtggctcatgcctgtaatcccagtacttccagggggctgaggcaggtggatcacctgaggtcaggagtttgagaccagcctgaccaacatggtgaaacccccatctctactaaaaatacaaaaaaattagctgggtttggtggcgcatgcctataatcccagctactcaggaggctgaggcacgagaattgcttgaaccctggaggtggaggttgcagtgagcctagatcacgccactgcactccagcctggaaaacagagtgagactctgtctcaaaaaaaaaaaaaaagagaaagaaagaggaaaggaaaggaaaggaatctgaatgatcacattcaaatacaaatataaatttcctgtaactgcatattccctttaagctaccacgttactctcctttgcacagccaatcatttttagagtggtctacactcactgccctcacttcatcactgcctgttcattctccaatcactgcaggctggcatccaccgacaccacagcaacaaaactgctctccctgagatcctcaataacctctgcacttccagaggcaatggataatttcctgaccttgtttgctttgaactctctgtgacatttaacacttcccttttctcatgtgactcttctttctctcactgtttgtatctttagctcttcccatcctctgatggtgcctaatgatcttcactccccagggttctggctccagctctctgctcaactggttgaataactgctcatgctacagcatgcaagctacatctgtaaccccaaactccatgcttacctccagacctatctacccaagtatctactagatatctctactcaaattcaacaagcccaaaactaatccaccgtctgtcttctaaaaccaaaccttcctcctataatccttcaccttggtaattaataccaccatttactaagttgttcatatgagaaatgtgactcaagacttttccttctcatattcctacaatatctaattcgtcattaagttttatctgttctttttttaattatttcttagaactatccagttgtgttttggtaaatgagcaacccattctctgagagagggagaggtgggtgacacttgatggttttcatggtgtgactgatcctcccaccacaactgattttgatgcaggatattttcttgaccccttcacggaactcgcggcaggggtgccttgtttactcagcccgccctgctcaatcccttgcaggagggagtgcgcaagcgaatgactgcaggaacctgagcgagcgaaggcaggaactggccactttggcaccagcaggagcaaactccatgtgggcccctcaccagcgtccaggtgtgggcaccagccacgccaagccccagagggcgtgtaaccatactcttagctccaccgtccgcagacagcagtgtgttatcagctcagtgagccctttgcctcatcacgtagggcaactgccttccgccagcaagggcaaagggccagtgcgaccgcctttttggatacctgcacgtagtgtgtccgagttcttgtccagtgcccaagaggaatgaggtcacacagatgaattgaaggatggcgaatgtggagaattttttttttcagtgacgaaagcggctctcagtggagaggtgagctggaaagggaatgggaagggaagatccctctcctctgaagtcaagccacctctctcctatgtccaggcgcttcttctcgacatcaggctgcttcttccctctgctggctgagttctggggtctttatgggcacaggatggggacggggcaggccgtaggtagttttggaaaaggcaatattcaattggtaaaaagacagtattcagaaakaaccaatcgggagagaatggaagttctcactttgggctgtgggtttcaggcttttcggcttgaaggtgggattttgccagcgacccgcccctgtatgcctacagtttctctgcctcctgttgctatcaattttaagctaccaacatgacgccactgaacagaatcgggaagagacatgcggaacacatattatatagtatttccaccaacagatataatagatgtaaataacctcaaaagagtagataatagtaaaataattatgaagtgatgagtttctactattttctttgcttttaacataattaaattatacatgtatgtaatttaatttttaattgatgactttaacaaccaactcaaaaaagtcttgaaatgtaacaaacagctctcacaaaccagtacaggttggatctatccctcttttctccactcctaagaccacagcccaaatgtaaggctctgaccacctcaccttgatgttacaattgtctctcacaggtcatgctactggtctgtcctccacacagctgtcacacatacaaatctggttatatcatcacccctgtccacacatgtgtgyacacacacagacatacacacatgcgtgcacacacagacacttacaataattctttgggtccctatagctctatggctggaatttttaattccttgtttaatgcactatgacttttacaatatggctatctgcttacttttgagccttatctaccccagcccacttcccctattgacagcctagagacccaaatattaacatcctagagactcgatgcttctgcaacttcacccatgctgctgcctgccaccctctagagtacatctagctgtgtgagaacatccttcatacagctaactactgtttattagttttcaaacctcagatcaagaattaccttctctggaggtcatctctatacagtagttaagaacactgtagttaagaacacagacagacctgatatcaaacagaagtgttaaatatctgctgtgccacttcctagctgtgtaaccctgaacaagttacttaatctttatgcccgagtttccttactagtgaaatgattacaataatgtgcttacctgatagaactgttcagaaggtttaaagaatatgtgtgtgcaaagctcttagaatagtgcctagaacttaagtactttggatgtagtaaagttagctattatcaactacctaatttaaaaatgcctcctatctctctttccattgcattatgtacataatcatcacattacactatatgattttatataaatatattatatatttatagatacattattagtatatacatatatagatacgtgtatataatacatatatagatacatgtatataagtatatagattayatatgtacacatatagtatacatttagccctcaacctgtgggatctgacactatctccaggtgcacatacatagtatatacacatatgtatactatatatatatatatatacttatatacatgtatctatatatgtatatatttatctatatacgtatctacattacatacatatatgtatctatacacacacacacacacacacacacacacacacmcatatgtttcatccacggttcctgtctcataattcccatagacctttttataatgttataatgttggtgcattttaggcctcataagcggacctcagaataacaggatttctctctctctaatcttctatttttttacctgctactttttctccccaaggcaggactctaatcttccyctgcctttacctaccttgtgtgattgtaggtcataagacccccatttcagaaggggttctgccccatattctggaggaaggaatgttgcatggagaggccaagaagaggcccagcacagtgatccatgtctgtaatctcagcacttttggaggccaagatgggacaatcgtttgagcccaggagttcaagaccatcctgggcaacataggaagatcctgtctctacagaaaaaaaaaaaattaattacccaagtgtggtggcaatcacctgtaacctcaactacttgggaggttgaggtgggagcatgcttgggcccaggaggtcaaaatcacgccactgcactccagcctcacagtcagagtgagacccacctcaaaggaaaaaaaaaagaggccaaaaagaatctgaacagatgggccttaccgggtttccccactcagcctttgagtactaaagcataccctttttgtctaaacacatttctatgtggttgtcaatggtgcctatcctttcatgaagtctccataaaaggcccaaggggacgaggtttgaagaaattacaagataactgaacctatggaggttcctagagggtgtgttccggggagggcttggcagctctgtgccccttcccccatacctcaccctttgcatctcttcacttgtatctttttgtaatatcctttattataaaccagtaaatctaagtaggtgtttccctgagttctgtgatgcactctagcaaattaatcgaaccccaagagggagtcatggaagcccaacttgaaaccagtcagccagaagttctggaggcctgatcttgtgactggtatctgggaaagggaagatgtcttgtgagactgagccctcaacctatgggatctgacgctatctccaggtacacagtgtcagaattcatttggaggacactcagctggtgcctgctgcagagttgattgcttgcatgttgatgacaaaaaatctcccacatttggtcacagaagtcttctgtgttgattgtagcgtggtgtgagaccacaggaaaagcagttagagattttccacacccagaaactcttaagagagaaactatgtgtccttgtgcttaggcagtgtctagtaagtactcaatgaatgaatttaaaaaaaatggattagtgatgcaagttctggccaactggacattctttccttttgattcattcagctacatttagatttagggaaatgaagggaacttgtgagatcatgtgagatcatgcggacagattaaaagggaaatattttctcaaatttaattagttatgcatgttgctgcaacaaacaaaaagaaatgagccttatgatgcaaaacacgtttgataattcttactccccttttaagttgtaccatttgtaagaaaatagggtagcattccatgtgcctaattccactgttatgtgtgatgaatgtcggaaayactcctggcattaaaaggagcctaaatgtgtggccagaatggactttaatgttccactggacaatttttctgacctcacagcaaaacttaaattacattattttctgagaatctaagttgtttattcaagaatcacaacttaacttatcaggaagatgagagaaaaaagaattaaaatttattgagcatctcctaggtatcaggcatttttaccagtaccatttcttctaactctcacaaaactgaattagatgttttattagtcaaggttctccagagaaacagaacmaataggagataggtaggtaggtaggtaggtagatagatagatagatagatagatagatagatagatagatgatagatagatagagatatagataatgaggacttagtttacattaatggagccagtcccaagatctgcagtcagcaaattggaaagccaagagagccaattgtatagttcccgttcaagtctgaagacctgagaaccaatgatgttgagttctagtccaagtctgaaggcctaagaattggagggctgatggtgttaagtcccaatccaacagcagaatatcaatgtcccaactcaaacagataggcagagagagagagggaattctcccttcccctgcctttttgttctattcaggtccccagtggattgaattatgcccactcacattgggtagagcaatctgctttattctgtctacsaattcaaatgttaatttcttcagaacacaccctcagagacacacccaggaataatgtctaagtagatatctgggcatcccatggtctagtcaagttgacatataaaattaaccatcacagatgttatccccatttttagatggggaatctgaggcttagagggctaagtaacttgccaaagatcatatagatggcaaatgttgctccagagttcaaatgcatgtctctctaatctgaaagcaccagtctgcttccgctaaaccaatggttctcaatcagggcgattttgccccccatggaacatttggcaatgtctggagacatttttgtttgtccctagctggtgggggatgggggctcgctactgacatctaatgggcagaggacaggaatgctgctaagcatcctacaaggcacaggacagccccccacaacaaagaatcatcaagccaaaatgttaacagtgccaagataaagaaacccttcactaaaccatactattttgtatttctatagttttcaaaaccagtagaatagtaataacatactgatctaaaatataaggctaggcacagtggctcatccctgtaatcccagtactttaggaggctgaggtaggaggaatgcttgaagccagaagtttgagaccagcctgggcaacatggaaagaccccatctctacaaaaaaaaaaaaaaacaattagctgagcataatagtttgcacctatatccccagctacttgagagtctgaggcaggaggatcacctgagcccaggaactggaggctgcagtgagctatgattgcaattacactccagcctgagcaacagagcaagaccctgtctcaaaaataaaaataaataaataaaataaaatataagtgactatagttccataactctaataaatatttgtggaataaatgaataaataagtaaacattgaatttaaaatgtagaggaaagaaactgcgtttttcaatgattctttacaattagcattcactargaggatagaatgttttaaattatcatcgctaatagagtccacatatttactttaagcatgaattacyatatataaaatattttattttaatacaataaaaatcatggaatatattttagtgggtttagtagtttaaggggaaaagatagcagcaatttaggrttcatacaattaatggaattattttcaattttagaatcctaaaatattagggttagaggatcatctaggtctcactcttcattgttcatcacttgagaaaactgtatctaagaaagggcaagtgactttcccaaggtctcctggcagtcagggacactgctagagccagaatccagctctcctgacagtttaatgcttttcttgttttaaggtgtttttcaatgtattagagttttggggcagcggggggaggttgctccatgtttttacttaaatacatttttctttcatggaaaattgaattcctatgctttttgccttgtttaggccataagatgttttattgaaagaaactttcaatatcaagtaatccaaccaaccttctaagataagccttttccttcaacacaaagaagtgcattttgccaagtacgtaccatcttactccttaaaatgtttggaactttttgtttaaaaactcaaactcaaagtgaaatctcaatttgtcacaatggtggtttttttgtttgttttgggatttttttagtttttgtcccccttccttacacctttgtgtaagaggtaaaatggagaatttgcaaaataactagaaaaaagctggagtgggagccaggaaatctagcttcaatcccagctccccttctacagagctcagtgatctccagcatgtcacactgtaggctttctaggcctgttcttcatctgccacatcctggggttgttgtaaagatcaaataaggtaatatcccatttgtaaatttatttggtaaacccaaagcactatggcaatagaaatgtcaagtatattttatatgccattacccgttctaaataaagtaaacacccattccattgttaatattctaaatttctccttgttatatgtagtcattttcagaaggatcacttagaagaattatacttgagtctccaagtacatgtccttttcattaaaactgggaattgattagtccagactagtaaggttataaatgatttaagtttctccccacacccctgattcaaccctcccacccccaccccaccacacacacacacacacacacacacacacacacacacacacacacacacacaataccaaatcactttctatgtgcagctttactctctattcttccaactgactgttccctggtccaggtggcccaccctggaccacctggatttgaatagtgagataggtaaaaatgtgttcttgttcccaatatgatgaggaagtctatgctatagccctgttttcttcaataaaaacttcatttgctgctagtttgagaggccgaggcaggtggaccagttgaggccaggagttcgagaccagcctgggcaacatggcgaaacccctgtctctactaaaaatacaaaaattagccaggcatggtggcacatgtctgttattccagctacttgggaggctgaggcatgagaatcacttgagcctaggaggcagaggttatagtgaaccaagattgcgccattgcactccagcctgggcaacagagcaagactctgtattaaaaaaaaaaaaaggaaaaaaaaaaacttyatttgctgagttagaaccaaagacccacaaagacccacaggaattcctatgtgtcacactaaaaatgatgatgataatgacagaggaaaatatgaagaaaatatgaaatggaagtcatctgttgtgaaatggagatgaaacatatacatatgttgccactccctgctaaaattccagaataatgataggaaaagaatagtaataatatagactcacagtgactgagataaaagaagaggagacaaagaagacaagtgtcaacacatctttagaagatggaagactgacttagaacagggaaagcttaaacctaagagtctgcagagaaggatgccatagacaaagaaggaagccattcacactgaagaacccatgcaagtttccagaattggaggcaccaggtgatttggaaggcagggtgaggatagaggctgaaatctggagtattggttgaaagcctatcagattaactcttagattcaagatccttcctcctgcctgcacagccaggggacttccatgtttcaacacaaacaggaaaaagcttattctctggctctgcactcagaataaacacaatgtcaggtgggaggtggagccatacagaaacctagggactaagtgaaaaatcagtgtgtgcactgagagaactccagtctcttcaytgatttcacagaatgctagcaaccaggtttatatttgcttctcaaggtaagaggtatgaatttctcctctagagaaaagaaaatctccctgtaatatctgtcaatgacatttggggtgccccatcaagactgtcaggttactgctccttggaagccctccaatgctccatggaactattctttggaagccctccaagccctgtccataaagttctaattggctttctagtgactcactgcraagtattaatggacagccaaatacatcagacattagagaaaagctttcaacaggaaaaacaaagatcaaaacaaactaactggggaaaaaaggaacaagaaggaaacagaaactgcagggtgcagaggaaattttcaaaatatttgattaatatcctcaaggagacaagaacatatgtcacactaataaagaacaggacaatattaaaaagaagccttcgggaaataaaaaattaacagtatataagcatattctcactcatatggaagcgaaaaagttgatctcatagaagtaagaagtagaacagaggatacttgaggctgggaagggtgaggagaagaaaggaatagggagctatttgttaaaggacrtaaaactatagctaataggaagaataagttctagtgctctataccactgtaggatattatatatttcaaatagctagaaagaagacactgttcccaatacaaagaaataataactgtttgaggtgatggatatgcaaattatccttatctgatcactatacattatatgtagtgaagcatcactatgtaccccatgaatatgtataattgttatttgtcaatttaaaaataaaattaaaaaagaaaatgaagtataarggtataattttttttaatcaataaracaggccaggcacagtggctcatccctgtaatcctagcactttagggggctgaggcrggcagatcactttgagctcaggagtttgataccagcctgggtatcatggcgaaaccctatctcyaggaaaaaaaaaaaaatcaataggagagatgtaaggtaaaagtgagaaagtttcccagaatgatagacacactgttgaagagaagagcaaaaatgattagcaaatcggagaatcaaccccagaattctgatatttaactaatataaattctagaaagaaaagacaaaaaatagaagggcaaaaatcattaaggaactaacacataaaatgctccccagaactgaaatatataaatttccaaattcaaagggmctaatgagttcctaaactaaatgtaaaagtatccaaactaaggcagagatggtaatatttcagaagactagggccaaatgtaaaaacataaaagcatccataaagaagaaaaaaatactatgttcataaaaacattggggaaaaactcacatcagagttcttactagcaacactggaaattataagaaaatagaccaatgttttaaaaaaaattctgagaaaaaaatactccaatctagaattctatatctattcaaactatgtatcaagtaaagggtaaaatacagatatttttctaatatgcaataccttaaaaattctgtctcctgtgtgtggtttctcaagaaacttatggagtatgtgcttcatcaaaatgagggagaaaactaagaaagaaaaatatatgggacttaggaagcaagaaatcaaacagaagaaaaaagacaaaggggattaccagggcgtggtgaccccaggtatggaccccaggagaaaagctgcccagcagccggrgatacaccagtccaaargaagcaagaactccgaggctctgggagtgccacttccaaggggcgaaatggacacgagggatttccttacggggttgttgatgtagctctgttgttgttattgttgttaccatattaagaggaaattttaaattttgttggaaaattcaggaagaataagtgatgggtgcacaaaaaagtacgtaaaaagctttaaaaggaaggcaatttttaaatcaaaaccaaagcaaaatatcgttcaagaaaataaatgtcagtgtggttcaacacatgaaatgactacttggttcagctgtgaagaatatttacattgtcatgaatgttaaataaaaatttaaacaagaattatgataaaattattttaggaagagaaaggaggaagagaagtgtgtgcgtgcgcgcgtatgtgcgtgcgcgcgtacgtgtgtgtgaagtgatagttgttgcaatattaaatccctagagtaatatttaatatattttaaaatatccatttaagcacattgtttagaaatattggaataagtagcagaagaaactgctcagtttctttataaacctcaaagtcttacttaaaactctgtgaatgtgtttatgtttgcaaaaaataatttaaaggagtcatctagtatttctgggcgatccataaaacctctattaaatactaaaagctgcagccctaatcccagttacaggtcagactaccagacttagggatatcctgcaaaaaaatgtaggctgcccactactttcaagaaccacaataatataactggtgtgtgggaaaagccttagacccagagttcatctggagacaacttacttaacctctctgagcctcacttgtctcgtttctaaacttaaagagttcgttcggaactaactaaactcaaatgaaaggcaaataccaaaagtgagacagatcaagcacaaacgccagcatcccttacagaggacagtctcaactcagatgcagccaactgctgtcatgaagacctgttgttgctaagaggtcagatggttcaagagaaactggaaatttggattttgacatgaaacctctggaatttaaaatactrgtttaaaatgcacagtgcctaccaaaccaaacctatctgcaggccacccctaactcacagattgccagtaaagacctctaaatcagatgaacattaataccctctaggtctattactctgtggcagtgcagtgctgcatgactaaaaatcttcactgaatgaatgtgtttctttaccactaaacaggcagcgtgtttttactcaaccttgacatatgacttttttttttcattatgaatactcatgaatcttaagacctgagatctgcacagagtctttactcgaagaagtactgtcataaacagagataggttctgccgaacatggccggaccgaaaaatcagggagcaattttcacaggtacacaatcgagtaagaactgccatcaatctgtcttttcagacatattaatccacaaagatagaaatcacttttatatgccaaggacaatatcaagctcagtatttgctaagactatctttcagtttttcatgaggaaacttttccctgccactgataattatcttcttggttcacagatctggaaagcatgaagactgggctttttttcctatgtctcttgggaactgcagctgcaatcccggtaaatttcctttcttctgttattacatctctttctcctgacatttaatgcagaaatcctccatttaaaagaaaatgttcttatataatggtttgaaattctctttttattttaattatattctttattgcccaagtaacaaacaaataactggaaaactcaagataaggtacttaaaaaaaaattttagaactatcaggttctacaggacacaataaatatgcagcagaaagtttgggctatcagtttattagccatagaatcagcccaaatacacaagagacaggaagaaataaattctcccagggaagctcatcacattgttattataaacccaagattttaggccaggtgcggtggctcacgcctgtaatcccagcacttcrggaggctgagatgggcggatcacctgaggtcaggagctcaagaccagcctggccaacatggcaaaaccccgtctctactaaaaaatacaaaaattagccgggcatggtggcgggcacctgtaatcccagctactcgggaggctgaggcaaggagaatcaattgaacccaggaggcagagattgcagtgagctgagatcactccactgcactccagcctgggcaacagagtgagactccgtctgaaaaaaaaaaaatacttagggtgcatatccacggtctccagcagcattttcttcaagatcaaatagatgctggctgagaaattttgagagtctataatgaaaacagaaaccaatggtttaggcaggaaacgatatggtaatcataaatcagctcctaattcacccttgggaggctgtccaagcaagtatgctgaaagtaggcagggctagaatattctcttcttcatggtcagatatattggccccatttgcacagcaataaagcagctgtacacaaatcagatcatttgaaaccgtgtcagtggcctcaaaacaaactgaaagttaaaaaacaaatgaaaccatagcatgaatgaccactggagatgttctgcaaatgattcatgtaatccttcattaaaccaaaggattcgtgccatattttttttctttttcaccaaatggaggaatcagcctcctttaaagagacaaaacaatttctcaatcgtccctttcctcccttcttctctaggtctaaaattctgtccttgctttttggataagttgttagctagcttctggttgacaaatgtgtcagcaaaaacaaactccatggcacccagaccaagctgttcttggaagacagagtttatacccaccatcaggaatcatgcttaagtagtatggagctactctagctgaaattatacattacaccctgaaatcacaaaagcgggacaagttaatgttcaacactgaaaggagttcccacaaaaccgttgttttctcctgaaaatgtgctttgtccttgtggctgttgctgttatgtaaataaacattaaaaagtgtctttgggccacgcacagtggctcctacctataatcccagcactttgggaggtcaaggccagaggatcgcttgagcccaagagttcaagaccggcctgggtaacatagtgaggccacgtctctacaaaaaaataaataaaaaattagccagctgccatggcatgtgcctgtagtcccagctacttgggaggcacaggagggaggatcccttaagccagggtagttgaggctgcagtgagccaagatcgcacacagcactccagcctgggtgacagagcaagactgcctcaaaaaacaaaaaaagtgtttgaaccaaatgtttgaatgacacacttgcatttagacacattccagatgtttcctttctgggacaatttgatatcatgtaaacctagccaaactgctagaaagctaagtatcttctcatagaaatgacctattaaaaatttgtataattttccctgcctgcctgaattctccagatgaaaatggattctgtgtagttgggagattccaaatagatttccagagttaaataaatagaaatatgcccatagtgataaaacataatttcaattgcagaatatttctgaaagtaaaagagctgccattttttgtgtgcatttcttcctgcttgggcagtaggcggatggagggggagagagagtgaccagttctccactaataagcctaaaatctcccccatccattgccttctatgatgccccctgctggcagcttaccaaagtggccaccattctttctccttttcccccttctttaaggcttctttataaactttttcaaattcattacccatcttaggtgaaaaggagataagaagcaaaggagcaaaccaaacctaatatgaatcctgtactttggccagaagccgtggctcacatctgtaatcccagcactttgggaggccaaggtgggcagatcacttgaggccaggagtttgagaccagcctggccaacatggtgaaatcctgtctctactagaaaaataaataaatacaaaaattagcagggcatggtggcaggcacctgcaatcccagctactcaggaggctgaggcatgagaattgcttgaacccagcaggtggaggttacagtgagccaagatcaccactgtatttcagcctgggcaacagagtgagactctgtctcaaaaaaaagtttaaaaataaaaaataaatcctgtactccatgactattacacagtcagcactacaggacctgctaatggaataaaaataagttaatccaaatagaatctcagtttcatacttacacctggataggccatctgagtgtccagagtatctctctaataaagatccatggtgaatatctgcctcagatactgggcagtttatattattgacacagtgtgacattagtactagaaatagtaattttcagttgggcaactccttaaaatttataacatattttttatacataatcttattttgatatttctgctcacttgatatttcttgccaccttgagagatggcagggtagaaattaatgaccttggccggtcatggtggctcacacctgtaatcccagcactttgggaggccaagacaggaagattgcttgagttcagaagttcgaggccagactgggcaacatggtgaaactccatctctacaaaaaatacaaaaattacccaggcatggtggtgcctatagtcccagttactggggaggctgaagtggaagggtggcttgagcctgggaggcagaggttgcagtgagccgagacttcatcactgaactccaccctgggcaagaggctggagttaattaattaaaaattaatataatgaattaattttattaatgttttttaattaataaaaaatattaacgacctgtcaaaccacagatagaaagtaaatagcagaggcaagacttgaatggaggcctcttacctccaagttcagttgttcaacttccccatcatgcatcactgcccagctctttatccaagtctccaatcttgctagaaataggaccatccctctaatagaaattaatactccagacatgcccttttctacttaggcttagtgccctgtctcacacagtctgaattaattctaattttttttgtttttgagatggagtttcactcttgttgaccaggctggagtgcaatggcacaatctcagctcactgcaacctccgcctccagggttcaagtgattctcctgcctcagcctcccgagtagctgcgattacaggcacccaccaccacacccagctaattttttgtatttttagtagagacggggtttcaccatgttgtccaggctagtcttgaactcctgcccttgacctcaggtgatccacccacctcggcatcccaaagacctgggattacaggcgtgagccaccatgcccagccccattaagatttcctgaccaacgttaaggccaatggcgttaagaaatcaaataaatattgataaaaagtttataaatttttctgctaattatcggtgggtacttaaattaggcaaatgtacaatactatatcctatggttaattttatttgacttcaactttctgctaaacaacactttccaaaattgtaaagtacaaatgctttgcaaaagtttaaaaaacacagaaaataatttcaaaactcaaagttaccattatttaaatgcattttgttttattttcacccagtctctgcataaataactttttcttaaacacaattgagattctgcttccacttaacattctgttctaggcatctgcttatatcctcaaaaactctagagaatatttttaaattgttggtataaatgaagtatattsctactaataatgatgacaacaagagtaactagcaaatttgtaaattagcatccagacatgaataacaaaaaccagtttttaattttttcagacaaatgcaagattattatctgatcattccaaaccaactgctgaaacggtagcaccygacaacactgcaatccccagtttaagggctgaagmtgragaaaatgaaaaagaaacagcagtatccacagaagacgattcccaccataaggtaaaagtaacatcatttatattaatacaattttttaattctccaaaggtcttagtttcaaagcatggtaaaagagattatgttatttatgtctcagtttaatttttttaaaacatgatgatcacctcaactgcctccaatcactagaagaatgatgaggattaatgagttttactacttgggctgagctgctgtatacttgtttcattttataaaatccaaattcagtttaaacctgtggctacagaktgtgaggaatattataaacatgtttacatgatagtgtgtgaagaaraagaataatgaatattaaatgttaccttaggcataaatatggttacattatcatttgtttgaagaatgaacttttttttcttttaaggctgaaaaatcatcagtactaaagtcaaaagaggaaagccatgaacagtcagcagaacagggcaagagttctagccaagagctgggattgaaggatcaagaggacagtgatggtsacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagwaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggtaaaattattttaaatggtccttgtccaataaagccagcattatcaataaacagtcatgacctttctctgtgctctcacagtgtcctgtatggatgtctactagtacattactaaaatatattacagttatttctttttaggtctatctctatcattaggctgagaatgcctgttttatttgagttcccgtagatgcagatcttggatttgagtgttgtttatttaagaagcacagggaacaaagaggagtgcagaagtaacacaagaaggaaaggaagctaataaaaggaacatcattcaagccatgtaaagacattttctcagaagtattccatttggcgactgaaggagctagggtacttcttttggctgaggattgctagaggggtattaatttcccagcatttccagcctgtcccttgagtgagccaggtcaatttccatgatttttcaggcacggaaatgcagatattggccattgaaagtccctggaactagctggaatgataaattatgacagatctgaaggataggagatactggcaactgctgctctaatgccttgaaagcagatgccatattgttttcgagttgaatcaccagtgtccaacaaaatgtctctgacataacaaaagagccaacaatgtttgttgaattagttataaagattaaggtcctactttattaagcaaacacataccaaaatgataatctggaaactacagcaggatcggggcagggaggaagcatatttggagctttcattcaaaatcctggcagccacaaagtcctgtgccagcaggacttggcacagattttggtacacaaggtcaatggtaacctcagttactgagaactctgctgccactctaacgtaggagttttcttataccttaaaagcctggtatgaaagctttaccaacaaattcagagagatttccaatgtaactctggcttaactacaaaatcacaagataatactacatttctagtgttttctcaaatccaaagaggagactccaagtcttattgagtaatccccagagataacgcactaaatctcactgataaagatagaaatgggtcctgttctccaagggttactgtctacctccacagttgtgactgatttccctttcttttttcttttttttttttttttgagacggagtctcactccttcacccaggttggagtgcagtggcgcaatctcggctcactgcaacctctgcctcccaggttcaagcaattctcctgtctcagccactcaagtaggtgggactataggcgcctgccaccatgcccagctaatttttgtatttttagtagagacagggtttcaccttgttggtcaggctggtctcgaattcctgacctcaggtgatccacccacctcagcctcccaaagtgctgggattacaggctccatttcttcttttttttctgttttgttttgtttttagagatggagtcttgctctgtctcctaggctggagtgtagtgatgcaatcacagcttactgcaacctcaacctcctgggctctagcagtcctcccaccttagcttcctgagtaaccgggaccacaggcatgcaccatcatgcccagctaatttttttttttttgggggggggggtgggtagagatggagtttccctatgttgcccaggttggtcttaaactcctgggctcaagtgatcctcccaccttggcctcccaaagtgctgggattacacatgtgagccaccacacccagcctggtttccctttctgagatttgaaatgatttgagcatgaaaaatactcgtgaaagtatgcacagtggaaatataaattaagtaatggctctcctcttagtagattttaacttttgctcttgttattctaaaggccaagaaagcagagaactcatcaaatgaggaggaarcgtcaagtgaaggcaacatgagggtgcatgctgtgggtgagtatgcatgaagcaagctgtttgtgactatatcaaggaagaaatggaatctgccactttgggcttgtccctccatcctttgtgaatgctgcacagaattttttctctccccagtcctccccaaggaaatgctcccataaattgttgacattttcttgtgcatacttgatatacaacaatgggtaaatgtgtttgcaaactggaagccctgttgagatattagtgaaagggctagagttcttccttaaatccttttgcttctgaaaagacttaattctatcttatttattctcaaatctgtaacttgctgatgaatttatatcccatacttgataaaggaccttattcctccccctatcacaaacattttgaatttcagccttatttcacttctgaccagcttgcacaacgttgcactaaggacttcagactatgaccatctcaggcatagaagagctgtctgttctttgcacatctccaatccaaactgctgcaagaggaaatctagattatcatgtaaaataatcagtaaaattatcatgtaaaatagaaggttccatctgacattaacacatcaattaaagaggattccaatgtcttcccacttccaaatttgcaaatttcaaggacttcaaaatttccccttcattagtgaaaatgaaactagttgagtgaatttgtatttacatactcaatttaactttgtccatgcttcctgcccaatcttttctgttagattcttgcatgagcttccagtgtaaaagaggccacatctgtaaggcagaccaacagggaaaacctcactgtgtctgccaggatccagtgacttgtcctccaacaaaaccccttgatcaagtaagtattcygcaaaatagtctttaagtggctccaaaaggttagtgactgaaataaaaatatttgccattgaaatttttgcttaaaaaaggtagatacctaggttatcatttggttatttgggatatttggaacatctgcagttttcattctactgagcttatctagagctaaattgtcatcaccgttggtacagtttagttgatttttttgatgccaaatggaacaattacgattttaatagtctcacctacctgaccacatctttggcacagcgctgttatcagcatatgagctttaaggagcagagtgtcttccagtgagcatttggctctatcagctttttcttctacttatcttccataggtttgtggcactgacaatcagacctatgctagttcctgtcatctattcgctactaaatgcagactggaggggaccaaaaaggggcatcaactccagctggattattttggagcctgcaaatgtaagattatgtccctcctgtcaaccatcatctctgagagggcttggggtgaatctggacatgcctgaattatctatatgcaaacagggaaaagctgatgtagttctgaacacaaaaattatcaactggagaaacttaaaaaataagaactctcaggccttaaccgtaggagattctgatttaactgaactaggttggaatcctgacattgttttttttatttgtttttgaagtaacctagacaattctaatgtgcagccagggctcagaaccactatgataatgctatccacttaatcacagagttgaatcactggaattttgctacattatttgccctcttcccaatttaagttaagcctttgccaagaagtctctgacaacacatttttccagaagtgttttaaggctgtcttccttccccaggatattctcaattgtgtttggctccccttaccactaagtgattctccacattagcagtgctcactaatgtttccgggtctcctccccttccagacacaggagaggatgaaacatgtcagcctcctggacgttaggtatgaccatatatcttgctttgtccagggaaatgtgaaaaaagtcatctatgtgagttctgggcagaagcattcaagagctggggtatggttctccatcctctgctcctttgccaccacaaactctctttgagatagtggcctcaaaaaatggcaacgtcattggtggctggcaagatggccaaataaggaccactctggtttgcagctcccagtgagatcaacgcagaaagagggtgatttctgcatttccagctgaggtacccagctcattgggactggttagacagtgggtgcagctcacagagggggagccaaagtagggtggggtgttgcctcacccagtaactgcaagggatcgggaaactctctcccctagcgaagggaagctgtgagggactgtgctgcgaaagacagtgcattctggcccagatactacgcttttcccacagtcttcgcaatccacagaccaggagattccttcgggtgcctacaccaccaggaccctgggtttcaagcacaaaactgggccaccatttgggcagacaccgagctagctacaggagtttttttccatatcccagtggcacctggaatgccagcaagacagaactgttcacttccctggaaatgtggctgaagccagtgagccaaatggtctagctcagtggatcccacccccacagagcccagcaagctaagatccactggcttgaaattcttgctgccagcacagcagtctgaagttgacctgggatgcttgagtttggtgggggggaggggcatccaccattactgaggcttgagttggcggttttcccttcacagtgtaaacaaagctgctaggaagttcggactgggtggagcccacggcagcaccagaaagccactgtagctagactgcctctctagattcttcctctctgggaaaggcatctctgaaagtaaggcagcagccccagtcaggggtttatagataaagctcccatctccttgggacagagcacctgggggaaggggcrgctgtgggcagagcagacttaaatgttcctgcctgccagctctgaagagagcagcagatctcccagcacagcactcaagctctgctaaggaacagactgcctcctcaagtgggtccctgacccccatgcctcctgactgggagaaacctcccagcaggggtcgacagacatctcatacaggagagctctggctggcatctagcaggtacccctctgggacgaagcttccagaggaaggaacaggcagcaatgtttgctgttctgaagcctctgctggtgacacccaggcaaacaaggtctagaatggaccttgagtgaactccagcagacctgcagcagaggggcctcttagaaggaaaactaatgaacagaaaggaatagcatcaacatcaacaaaaaagatatccacacaaaaaccccatccaaaggccactaacatcaaagaccaaaggcagaaaatccatgaagatgaggaaaaaccaacacaaaaagcctgaaaattccaaaaatgggaatgcctcttctcctccaaaggatcacaactccttgccagcaagggaacaaaagtggatggagaatgagtttgaggaagtgacagaagtaggcttcagaacatgggtaataacaaactcttctgagttaaaggaacatgttataacccaatacaaggaagctaagaaccttgaaaaaaggttagaggaattgctaaccagaataaccagtttagagaagaacataaatgacctgatggagctgaaaaacacagcacgagaacttcgtgaagcatacacaagtatcaatatccaaatcgattaagtggaagaaaggatatcagagattgaagatcaacttaatgaaataaagcatgaagacaagattagagaaaaaagaatgaaaaggaataaacaaagcctccaagaaatgtgagactctgtgaaaagaccaaacctacatctgattggtgtacctggaagtaatgaggagaatggaaccaagttggaaaacactcttcaggatattatccaggagaacttcctcaacctagcaagacagaccaacactgaaattcagcaaatacggagaacaccacaaagataatcctcacgaagagcaactccaagacacataattgtcagattcaccaaggttgaaatgaaggaaaaaatgttaagggcagccagacagaaaggtcggaatacccacaaagggaagcccatcagactaacagtgggactctctgcagaaaccctacaagcaagaaaagagtgggggccaatattcaacatgcttaaagaaaagaattttcaaactagaatttcataaccagtcaaactaagcttcataagtgaaggagaaataaaatattttacagataagcaaatgctgagagattttttcaccaccaggcctgctttacaagagcttctgaaggaagcactaaatgtggaaaggaaaaaccagtaccagtcactgcaaaaacataccaaattgtaaagaccatcgacactatgaagaaactgcatcaactaataggcaaaataaccagctagcatcataatgacaggatcaaattcacacataacaatattaattttaaatgtaaacgggctaaatgccccaattaaaagacacagactggcaaattggataaaaagtcaagacccatcagcatactgtattcaggagacccagctcacatgcaaaaacatacataggctcaaaataaagggatggaggactatttaccaagaattggaaagccaaaaaaaaaaaaaaaaaaaaaaaaaaaaaaaaaaaaaagcaggaattgcaatactagcctcagataaaacaggctttaaaccaacaaagatcaaaaaacacaaagaagggcatcacataatggtaaagagataaatgcaacaagaagagctaactatcctaaacatatatgcacccaatataggagcacccagatatataaagcaagttcttagagacctacaaagagacttagactcccacacaataatagtgggagactttaaaaccccactgtcaaaattagacagatcaccaagacagaaattaacaagtatattcaggacttgaactcagctctggaccaagcagacctaatagacatctacagaactctccaccccaaattgacagaatatacattcttctcagcaccacattgtacttattctaaaattcaccaaataattgaaagtaaaaactcctcagcagatgtgaaagaatggaaatcataacagtctctcagaccacactgcaatcaaattagaactcaggattaagaaactcactcaaaactgcacaaatacatggaaactgaacaacctgctcctgaatgactactgggtaaataacgaaattaaggcagaaataaggaagttctttgaaaccaatgagaatgaagacaaaatgggccagaatctctgggacacagctaaaacactgtttagagggaaatatataccaccaaatgcccataagagaaagcaggaaagatctaaaattgacaccctagcaccacaattaaaagaactagagaagcaagagcaaacacattcaaaagctagcagaagacaagaaataactaagatcagagcataactgaaggagatagagacacgaaaaacccttcaaaaaatcaatgaacctaggagctggtttttttaaaagattaacaaaatagatagacagctagccagactaatagagaaggaaagagagaagaatcaaatagatacaataaaaaatgataaaggggatatcaccactgatcccacagaaatacaaactaccatcagagaatactataaacacctctatacaaataaactagaaaatctagaagaaatagataaattcctggacacatataccctcccaagactaaatcaggaagaagttgaatccctgaatagaccaataacaagttctgaaattgaggcagtaattaatagcctaccaaccaaaaaaagctggggaccagacagattcacagctgaattctaccagaggtacaaagaggagctggtactattccttcagaaagtattccaaacaatagaaaaagagggactcctccctagctcattttatgaggccagcatcatcctgataccaaaacctgaaggatatacaaaaaaaaaaaaaaattcaggccaatatcactgatgaacatggatgcgaaaatcctcaataaaatactggcaaaccaaatccaggagcacatcaaaaagcttatctaccacaatcaagtcaccttcatccctgggatgcaaggatggttcaacatacgcaaatcaatgcgtgtaagccatcacataaacagaactaatgacaaaaaccacatgattatctcaatagatgcagaaaaggtcttcaacaaaattcagtatcccttcatgctaaaaactctcaataaactaggtattgatggaacatatctcaaaataataacagctatttatgacaaacccatagcaaatatcatactgaatgggcagaagctggaaacattccctttgaaaaccagcacaagacaaggatgccctctctcaccactcctattcaacatagtattggaagttctggccagggcagtcaggcaagagaaagaaataaagcgtattcaaataggaagacaggaagtcaaattgtccctgtttgcagatgacatgattgcatatttagaaaaccccatcatctcagtccaaaatctccttaagctgataagcaacttcagcaaagtctcaggatacaaaatcaatgtacgaaaatcacaagcattcctatataccaataacagacaagcagagagccaaatcataagtgaatgcccatttgcaattgctacaaagagaataaaatacctaggaatacaacttacaatggatgtgaaggacctcttcaaggagaactacaaaccattgctgaaggaaataagagaggacacaaacaaatgctcatggataggaagaatcaatatcgtgaaaatggttgtactgcccaaagtaatttatagattcaatcctatccccatcaagctaccactgactttcttcacagaattagaaaaaaactactttaaagttgggaaccaaaaaagagcccatatatccaagacaatcctaagcaaaaacaacaaagctggaggcatcacgctaactaacttcaaactatactacaaggctacagtaactaaaacagcattgtactggtatcaaaacagatatatagaccaatggaacagagcagatggctcagaaataatgccacacatatacagccatctgatatttgacaaacctgacaaaaataagcaatggggaaaggattccttatttaataaatggtgctgggaaaactggctagccatatgcagaaaactgaaactggatcccttccttacacttcatacaaaaattaactcaagatggattaaagacttaaacataagacctaaaaccataaaaaccctagaagaaaacttaggcaataccattcaggacataggcatgggcaaaggcttcatgactaaaacaccaaaagcaatggcaacaaaagccaaaattgattaatgggatctaattaaactaaagagcttctgcacagcaaaagaaactatcatcagagtaaacaggcaacctacagaatgggagaaaatttttgcaatctgtcaatctaactaagggcttatacccagaatctacaaggaacagatacaaatttacaagaaaaaaacaaccccatcaaaaagtgggtgaaggatatgaacagacacttctcaaaaagaagacatttatgcagccaaaaaacatatgaaaaaaagctcataatcactcgtcattagagaaatgcaaatcaaaaccacaatgagataccatctctcaccagttagaatggcgatcattaaaaagtcaggaaacaacagatactggagaggatgtgaagaaataggaacgctttcatattgttggtgggagtaaattagttcaatcattgtggaagacagtgtggcaattcctcaaggatctagaactayaaataccatttgatacagcaatcccattactgggtatatacccaaagggttacaaatcattctactataaagatgcattcacacatatgtttattacagcactgttcacaatagtaaagacttggaaccaaccaaaatgcccatcagtgatagactggataaagaaaatatgacacatatacaccatggaatactatgcagccataaaaaaggataagttcatgtcctttgcagagacatggatgaagctggaaaccatcattctcagcaaactaacacaggaacagaaaaccaaacactgcatgttctcactcataagtgggagttgaacagtgaaaacacatggacacagggaggggaacatcatataccagggcctgtcaggggctgggggactaggagagggatagcattaggagaaatacctaatgtagatgatgggttgatgggtgcagcaaaccactatggcatgtgtatacctatgtaacaaacctgcacattctgcacatgtatctcagaacttaaagtataattaaaaaaaaaaaaaacggcagtgatcctgagctctggggagactgcaatgagcagagccctcctgccaacttgtattggacttgtagcaggattgcaaaattgacttctgtttctttaagccactgagatttagcattatttcttactgtagtatcagctaatagctacctttttctctattcaatagcacttgtgccctccacctacaaatttcaactctgattctacagcagtgattctggggcctagctgcacatccaaatagatcttggagctttaaaaacatcctgatgcccagacttcacgccagaccaatcacatcagaatttacttgattggaagctggcatttggtatgttttttaaaaccccaggcaattttgttgtgctgctgccagggctgaggaccactgtcataataatggggacctgagaaagctctgtcagttgccagaagtcgttaagcttcctattatgaggacttgccataggacacaaataagcccaaagattacagtacattttctgcttgtaacagctattcctacttgtacggactttgaagtgattcagtttcctctacggatgagagactggctcaagaatatcctcatgcagctttatgaagccaactctgaacacgctggttatctaaatgagaagcagagaaataaagtaagttatccacaggttagcttcttcaatgtctgtctacagggcatgaggaagaaagacgtggtgggggggctacctacctctgcatactggcaaaagcccactatgcttccccatgcccggttagcccatgtggcttaacagaataatagatgtcaccattcacgccacaaggtttcagacaccaccaaaccgccccattcttcccaatggtcagtggcctgaattagggctcttcaattcctacctagagcaagctctggttgagcaaagttaatataaatttagcattgatctagtcagtccaaacatcttatttaaatctaagcatttgttttgttctcataggccagacatagatgtatgatataaagtaaatccattactcaaaatatcagtaatmtattaagattaaaaagcacagaacattgattccaaaagcttccagagaaaattcattcaccagatagttattgagtgtatcctgggtgccagaaattgacctaaatactggagatacagcaacgaaaagaaaatctctgccttcatgagtttacattctgggtgaagagacagactctaaacaaataagtatatatgtgtgtgygtatgtaatgtttgtatatgcatatatttgtacatacatatatatgcatatatgcaattatatatagtaaaatgagcatttatgtaaatataaccaaatcagcaaatatatgtataagtatgtcagttgggattaaacatggtgtgaagacaaataaaacaagaaggagggtgtgcattaactgtgtcagatgctgtttataggttatgagttgaagactgagaattggccagggatttagcatgtcaaagtcatagctgaccttgataggaactgttcctggggtgggagcatgtttcaggagggaagctccagtggacagagttcaacagagactaggaggaatggatgcagcaagtatagacaatcctttcaaggagttttgctatgaagagataaagagaaatggggtggcagctggagtggaaagtgagtacaagagtcccacctagcagtgggagatggtagaggatgtttgcacgcttctggaaataacccagtcaagaaggaaatgttagtggggagcagagaatgcgcacaactgccagagggcgttcttcgatacatgtcccacccagaggagagggattggacttaggttaggagcacaggaaggtcgcagggagcaaagttgtggttctgggagcaggtggaggtcctgtttgcttccaattactcagtgaaataagaggcaacatcacaagctgagagtttcacaggcactgctcaagaataatttctagcccccgtcttgaataccttgtcacagagagccttgagggtattagctatgaaacagggaaatttcaatggggctggccaagcaataacacaccagggtgaaagcaagactgagtgggcactggatggatgacctagaagactaagagtggactctgtcatcgggggaaggagcagcacttttcactaactaatcaccttagtcaattcagcccttttcattaaaacctcatagtttaaaaaaaaaaaaaaaaagcagcgaacattacttggttaaaagaaagaggcaaaacatacttaaaatatttaaaagtttaaaaaagaatttaaatttcttctaaaaaccagaggtttcttacatcaggtgctattctgtgtagacatgagaaaggcctgtagtattgattggaaggaatttcatttagttgcacatgatgtcctgagcttgttttcccctatcgtgttactgtcactcttcaagtaaagtttatagcaagtgacaagtccattacatttgtctgattctctgacagtcttctgccttcctaatcccaggtcaagaaaatttacctggatgaaaagaggcttttggctggggaccatcccattgaycttctcttaagggactttaagaaaaactaccacatgtatgtgtatcctgtgcactggcagtttagtgaacttgaccaacaccctatggataggtaagaactctttacctttccatttctagatttatctctctgataaaatatctacatatctatgcaaaaggaaaatctaaacagatttaggacatttcccagttccattttagaatactgaaatgcctggttaggagtctaaacacaaagctgctgtgtatgatgtactctagaacttaaggtataataataataataaaaaagtctgaaacttgatagagcttatgttgataaagtttatgttttataattttatcttttaattccatttctcaatgaactttttgaagtccccttatcacaattatcaaagctatgtaatattcattaaaaaaaaaaagctgctgtgaagatagcagaatatggctacaccacagctcccaagtttacatgttaaggtccagcttcccacagatactcctccaactttctcattcttgatcgtaaattcccaagattggcccaatgtgggtcaagtgactacatctaaaacaatcaggtatggccagtagatgagaaccaggttgtaccaacatgactgctgggtacacccctatagatttagggtggsggaaggacagttcctgtgaagacagaaamcttgtgaatcaacatcccaaaagctgtcaaccttacccacaaatactttatttcgttggcagtttttatctgtattctatttatatcacatatacarcaaccttatgggagaaaaatgtccttggtgagcctgagagttaaatcttcatgcacaagctactcaattaataggatgccatgtatttcattgcagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaaggtaaattcatcaccagccaaagaagagggatgtcttcttcctcagacaagccctaagccctgcatgcttcatagagaggtcctgccacatgttcgaattggaagctagaaaaaaaaaggtggcagcttcccagataggactcccttggtgcacatgctgtcattgcgaagtcacttcttactacctttatggcactgttttcaaagggtagcaagggtgaacatgcattgaggtctcaacagtcagctaagcctagaaagacgtgtgaatccagaattgggccaaatctcagcaggctttgtgtccttccttatttcatatcctaccttaacctgggccttgggccaaacttttcaaaattacacataaagaataaaaaagcaagcccatttctgacaatgggagatgtcagaacatctcagaatccattaccaacacactaaagactggattttacatcacaattagtgcygggataatcctttaacccaaaactcacccatggcttcaccctcaatgaatgggagctgtgggagggtagatcagagtattctttctttaytcctgcagtggaggaaattaaatttagatgcttgttttgctgggttatgtcttaatatgtttccttttctttccttaagttaggcttgaattttatgagcaagtatgttttcaataattaagatatgaaaggctgggcacggtggctcatgcctgtaatcccagcactttgggaagccgaggtgggtggatcacgtgaggtcaggagttagagactagcctggccaacatggtgaaaccccgcctctaccaaaaatacaaaaattaggcgggcttggtggcacacgcctgtaatcccagctactcgggaggctgaggcaggagaattgcttgaacccgggaggcagagtttgcagtaagccaagatcccaacactgcactccagcctgggtgatagagtgagactcggtctcaaaaaaaaaaaaaaaatgaaagatgttcaaacaatgagcattcaaatctactcgcaattctcaccacacacacacacacaaaaatgatagtatgtgaggtaatgcattcgttaatcagatcaatttaaccattccacaaggtatatatattttaaaaggtcatgttttacatgataaatacataccatttttatttgtcaattaaaataaataaataagaaaaataccactcacagaacataaattaacagtgaacatcaaatctctgaaacagagatttcattcatgtttacaatatacccttgggataaacatgcagctaagccgttaaagaaagtcagttcatcaaatgtcagaagttcccaaaaagaaataacttgtgcatacttcatttttaaaatatcccccatgcatatgtagaatgccttgaaattagagaggaagaggtgaaagtatgaggatttacttattaataaataggtaagcagagagggtcagtccttttccttgcaatatcattctgtgaaataaacattctgtgaaaggatgtatatttttgtaagtacctagttctgtgtattagttgtctatgctgcatagtgaatcaccccacaacttaacaggttaaattctttctcacggtttccaagggtcaggaatctcacagtaactaacctggatggctctggattaggatctctcattaggttgtggtcaaggggtcatgcagtgcggcagttatctgatggcttgactgcagctaagggtctacttctaagcccactcccatggctctttgcaggagccttcagtatcccatcgtgtaggcctctggtctacagggctgcccacagcatgrtatctggattcctccagagcgagtgaccaggcagaaagagagaaaaagccaagactgaggccccaatgtcttttataacctaacctcagaagttatatatcatgatttctgcctcattctattggtcacactgaccaatcctgctacagcaggaggaggagaaggagaccacagggggttggatgtcaattgtctttctaacatctatgatacaagcagagtacttataaaaattcaaatatatccttctgtcctgccctgcccaccattatctagaggggaaaactcagctgggataggatgtatttatggatgcctgtttatatgacatgtgattttaaaggactgataaaaaggcaaatttaaacagaggccattttacttaagaaaaccagttgcatctcattcttccttttgcaaagcttctggcagctcttcagtgtgtaagctcacccaggctccgctgggcggttgtctgggaggagcaggaagggcttaaaatccagtcatttacaaagctgctaatgatcttgtttgtgcactgtggtttggccatcattgccttattttgaagaaaggaaaaaattatcacataataaaccaataaagcagatattaaatattcagtcagaacacgtaaacaacttactgctttggaatgtagctaaagaaaaacaaatttatttgtaagtatacccttctttccttcaaggctgagaaatctacaggagaagataaagtttagccaatgttttcctgaattttaactgcctgtgatagacgtgctcatatattcctcacatagctgttattaactagctgtgtgaattagggcatgttgcttagcctcagtgagtctcattttccttatctgtaaaaatggggttcaggtaacaggtgcaggaatcctcatttattttgtgcccatgcataccatgcattgacacatacccatgctaatcgtcagaaaaccctccaagtgagactaacagggtaaacaactcagatgacgcaagttcccctaagccatttaaagacattatcctaagagtactggggggccaccaaagtgtttcaaacaagccagtgatttccctgggtttgtatttaagatggattctcctggttacattgtggtggggccaaagaattgttgagagaatactgtggtaaacccaggcaagagctgatgagaacttgaactaggggagtgaccaaaggggaaaaaaagagagaagtaaacatattcaagatatattttaagatataagcatactcaaatatatagcatgtggaaataagacaatatttgataggaaatatgtgggagycgagagcagacaggtgagagactgaaaagagaagtgcaatgcctaggtccctggctcagagcaggcagggtaaatagaggtaaatagaggcatcttccactgagaaaacacaagaacagaagtggatttggagtaaatgacaaattccattttagatacgttgaattgtaaagtattaggttgcctcctaagtgttagtttcatgcaaaagtaattatggtttggccattatctctaccactccatcaaaactaccattatccctaccatgcccaccactgatgggcacctacattgattttatatctttgctattgtgaatagtgctgcaacgagcatatgagtgcatgtgtctttttagtaaaatgatttttttataaatatacccagtatgggattgctgggttgaatagtagatctgttttaagttctttgagaaatcttcaaactgctttccacagtggctcaactaatttacattaccagtgtctaagcattctttttctctgcagcttcaccagcatgttgtttttagactttttaattacagccattctgactggtgtgaaatggcatcttattgtgagatggttttgatttaaattttcctgatgattagtaaygtggaactttatatatatttgttggccgcttatatatcaagacagggttttggaactgaaatgcatatttgaggattataagcatacagagaataattgacaccagggaagggaattaattctcccaaggaaaacgcattgagttacatgaaaaggggtctaggattgaacactgcactgagaaacaacaacatctagatgatggataggggaggaagaaagaattcagtaaggagaatgaagtttctcctgaaatgaaggaagaaaaccaggatagtgccatgcaaaggaggtgtttcaaagaggaggaagagattaacagtgccaaatgcgactgagatgtcaaagaagttgaaagaaataaggatatcctgggtagccttggttagagtagttctggtggaatggtagacatggaagtcacattctatgggttgagaagaaaagggagattagaaagggtaaggagtggatgtttgagtgcaggaaagacctagaaaagctacagagcattttctaaaaaaggggagcattttttagaataaaagagatttgagcactcctttcatttactcattcatttgctcaagaaatctttacaggccrggcgcggtggctcacgcctgtaatcccagcactttgggaggctgaggcrggcggatcacgagttcaagagatcgagaccatcttggctaacacggtgaaaccccgtctctactaaaaatacaaaaaattagccgggcgyggtggcgggcgcctgtagtcccagccactcgggaggctgaggcaggagaatggcgtgaacccgggaggcggagcttgcagtgagccgagactgcgccacttcagtctggcctgggtgaaagagcgagactccgtctcaaaaaaaaaaaaaaaaagagagagagagaaatctttacagatggtctacataaatgcaggcactgttctagaggctaaatatgaaacatatttaaatgctaatggaagggtctagtaaaaaaggaaaggtggaagaaggatgtaagaaaaaaagaggaaagtaaaaggagaatcttgtgaaggtcagaagagatcttgagcataggtagaggaattagccttaacgtcaagaaaaaggacaatctcttatctgagcaacagaaagaagacaaaggctatgggtgcaaatataagtaaacgtataactaatgaagctattatctccattttacatatgaagccagtactcaaaawaaaaaaatcaaagtccataatctttcccattctctgggctagataaagattattagcaggaaaattacctagtgcccacacagagtagtataatagtttgttagggtgggccatgttggtaaggagtgatcttatatttgctagaggatgctgtcttcttccacaggtatggcracaatttctttcacaagctactcaattaaaaactggaataacctagcactacacttctatttatttccattatttttcagctcaccttctagattagtatactgggcacttcttggctggacctcccgttaacctgctcttcctctatcagtggttctcaaccctgcagccaaattacctgcagagttttctaaacgtctacatgccattagtccacccctagggattctgattctagagtccagaggtgaggcctaaaaatacatatttgtaaaagttcatgagtgatgttgctgtcctaccaaagttgaggatcaccattatactgccttattagatggtttctctaatcccccaactctaatattgtttgtgctactactctggctactttctaaaagtgtcattttgcttcttgtttttttatagaggacatagatgaaaatctcttgttttgaacgaagattwtaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatccaaatgcttatgcaagtgtatttccagttattatttagacaatcaaatgtaaaagatcaacccaagactcacacttcatgtcaaattataattgtgcttcctaaaccctactaccttaagtgtgtgtgtgtgtgtgtgtggttgagaaaaaagtgtgagacatctcttacaggaaacaaatactcagtggcaagataagaggtgctcattaatgtccttcatcattatgtaagtttaaacagaaaaaaactaatatcaagtgcttttttaccaaatttgatataaaatgtagaacaagctgggtgcagaggctcacacctgtaatctcaacactttgggaagccaagtcgggaggattccttgagctcaagatttcaagaccagcctaggcaacatggagagaccctgtctctatgaaaacttaaaaaaatagccaggggtggtggcatgtacctgtgatcccagctacttggtggacttaggtaggagaattactcgagcccagcaggtcgaggctgcagtgagctattgtgccactgcactccagcctgggtgacagggcaaggccctgtctcaaaaaataaataaatgaaaataaaatgtgaaagattatgcactgcttgatccaattaattctaactttttgtgcagttgagcatgtgtgctggggaagagggcggccctgcaaaaatttcacataatcattgcctcacaataaagaaaatgtaatggtaaaacaggtagagggccataaagcgtcttgatgtccaatgtagaaagagattaaatattattaatgtaaattgatagcgaaaaacctgtcataagcaaaaatttgtctttttatttgcgctcttctttggtaactattacagtaaaagctagatcacaaaaatatgacattataatatagttttccaagttctgaagtaaggcaataaaaggacatgtcactcactttatttgactatttgaaagaaaatggttttttacatatttttctagctgaaatgaaagatatcaatacaattatcttttactattttttcaaataatcaaaaatgtgttgttgttgttgttgttgttacaaaccttatctgtgatagtcactgagagaacatgcccctaggaattttatctgaaagatatttacagaatagtttatttttttatcagaataatcttctctgagtatttcaaaatttcattcgttatctctttcatagctcaataaattacttattctttttttttttttttttgagatggagtcttgctctgtcacccaggctggagtgcagtggcacaatctcagctcactgcaacctctgcctcctgggttcaagcgattctcctgcctcaacctcctcagtagctgggattacaggcgtgcgccaccacgcccagctaatttttgtatttttagtagagacgaggtttcaccatgttggtcaggctggtctcgaactcctgacctcgtgatccgcccacctcggcctcccaaagtgctgggattacaggcgtgagccaccacacctggccaattaccttaactagaaccatatcatactatgtcctttctaaaaaattaagttcaatttgattaatcaaaatcgaattaagtattatttgtaactttttccaactacagaaataattttaggaactattccaaatttcagaacgtttttatatgaagctgaaaaggtcttagctaattacaaactaggttgctggtaacagtgaagttgtattcagaggtattaattaggcctaaattatcttttaccctcagacaactttcaaaaatattttagaatagtgaaaagtgattttaacaccaaggtaaggaaaccacctcaatatctactaaaaaattttgtttgaaaataatattcattttgaaaygaaaaatatttaataagagaaaatctcaaaccttaaatttctgtatcatttaaggctcttacatgtacagctagctcatctattatagaggcacgttaatattcttggtggtcacaatttttaattgtgggttgtttgtgataaagacatactctaatcccaacctaagagatkaagttattttctcagtaatcagtctgtaagtctacctctgtgtaattgagatattttggaagttggagctcctggtgtgaaagcaattattcagtttagctttgaattttgtgactcatattgcccataaccataaaggcattagtaacatggcttaaatactagatgggcatagagattctaggtgatcacactgctccttgaatttgttgctccaagggccactgaagcaaaggtaattgaagagatatatagtataatttggactgattctaatgcactagataaaagaatgtaacatattcttgtattgggtaatttaatgatttctaataggtccacttctaataagaagaaagaaattagtgtttgaatccagaaagaagaaaaatacaaagaaaaaacatgaaaaaggaaaagggaaataagttgcctaaattcaggcaaagtagcactaagattgaaatcagagttgggttttagatatatataacagatgaagtgtgatttatagatataacttgcctcaaatgctggagataagtcttaataataacatgataaagttgtttttctttcaaaatccaattccagaatacagtgatttggtttgaaactcacaaggtaagttaatttgaattaagtrcgatttttaaaacataaaaatgtctcctttcagaaccaatggaccaataaaaggccagttgatttcctttattgaatctgaatttactcatattgtgctgattttctaccaacccattacatcttacaaaatttttcccatacaatttccttcccgagaactataactggcaataacagcaaccagactatatgaaggcctggtaagtctcacagaggtacaagcttcaggtggatttatttgtgtattacataaaaactttcctctcattttagccagtagtgatcaattactaataataagcatgatgtaacactggtgtttaaagatttgtgagtagaattgagcacagtggctcacacctgtaatcccagcactttggaaggctgtggtgggaaggttgattgaggccagaagttcaagaccatccttgcaacaggggggcaacatagcaagaccccatctctaagaaaatttttttaaaattagccaagtgtggtggtgcacacctgtagtcctagctccttgggagactgaggcagaaggatcacttgagcccagcagttcgagggtacaggaggctatgattgtgccactgcactccagcctgagtgacagagcaagaccctgtctcaaaaaaaaaaaaaaaaaaaaaaaggatttgtgtgtagagatcacaaacgcaacttcagggaccaaacatgtacagtgtataggccgaactgtaactttataagaaagtagaaagtaatgggctatgttgggagctaaacagtgcatgtcttgtctaaggaattcaaagcttttaaaaacactcttgtaggcttacaaaacctatgtttggaggcaggatttatcttgaccactatttcaacacctctaaataggaataggacttacatagaaaaaaactcgaaatgatctcctaccccttcaattccaggctcgacctttagaatgaaatttctcatcttggctggccttttgagcactgccactgctctgcccatccccgtgagtacaccctcctcagctgctgactcaatttcagatttagagtcatcgcatttctcggctagaaagcaggtcttatcttttcatttcacaaaagaggaaagcggaacccaggaaagtcatagaactaggagttcaccactctttgtcagtccaagactctgcccagtacaaatctcagctccatatgccatgtgctagctgtgtgactttgaactaacccatggtttccttgtctataaaatgagtcctaggaacacctcagagttgcacggagatgatttttttaatgcatctaaggcagagaagggtcctatttgaaagataggatgttctcaataaactcagtgatatagaacaaatattctgcagtgacccaggtctaaattaagcagtttgaattgagtttcatttgtaatgcccttgccccaaaccatctcatgttttcttaaaaggctgttacatggaaatgctctgacaccaaaggactatctacctcattgtagatttgattttaaagaaggaaatatttaagataacttacattgattactaaattatgaatataaaaacaacttatgcctgaattatatttgagtgatcatacagacacacctttaaagtccaatttttgaaaaccagatttggataaaaagctacattcatctatagtgcccttgataacaaacctaatttgtttctttagaccacaatcctttttgccaaagctggcaagtatcgtggtctaaaattccaaacaatttgtattgcctgtttctttaggctgatgggaatgctgcagtatacatatttcattaattctaatatgtactttttgatatttcagcagctctgaaattgagctgtgtcttaaaaacacaatttgataaagtgtcacggcagcttaacagcagcgcttttcttttttggtaatttatgaaataatggtgcttttgacaatgatagcatctaagaatatatgaaatactgtaatcccagaacatcattaacttcacctatatagacattttgtcatcaactgactatatacaaatgagatccactgagtctaatctgggtttactagtctgaatatgagggcaccaagtaggcaagaaactctctcccctgcacactttgtatcaaaggagcttttgaagaagtgagggagctttcaaaatttgtgtttggggtgcagaacttaagtgtacatttccacactcccttcactttgagtttataactactgagaactaaatcaagaacaccattcaaagatttacaaaaggaaatattcatgtaatatggaattaatcttaagaaatgtaaataaaagcattctttggatataaatttaaaagcaaaaagccttggtcttccaaatcattgcacaaaattaattaaacttttccctattagatatccaactgctttttatttcagaagtgaagttacattactgatgggtataatgctccatagtggcttattacttattctcctttagaacaaaacctctctttagtggataatgtatttccatatgctgctttaccttgttgctgttattgttttgcaagctcgaacaatatgctgaaagttccagtgaacaggtgaacttctaattgtatttttaaataatgcattcatcattttaaaagtttgccattgtctgaaatgactgacatcatgtttctttttacagagatttatcttttacccaccacaagtaccaccatttttccctcaggtcctctttcccctacctccgcaaccgcccctggtaagcatgggtttggggaatctgaaatagctaaaaggatttatttgttggatggtggttatgaaactttccaaattttgatactgaaatatgaggctttaggcagtccccaggaatcagctattcaaacttctctcccatatagcttatagtggaacgtgacaaggggctagcaaatttccctccaaatcttcagtgccctctcgcagtgtttctctgcacttactattaaaaaggtgtttgtgctgaattactttgaccgttacgagcttactctttatgaagagaatacttctttctataatatccattcttttgctttttcaaattcaccttgttgctttctttctctaagaagattttttttccccagctttmtataactttttcccaagttcaagcaaaatagttattttgcttttctgtttggactctctccaggctctcctaatatctggattcttaaaacattttttcaar

SEQ ID NO: 17775 - DNA, 72069 bp, Homo sapiens
agagatctagaaagccttggtgtaactggatccagccattcaaaggatggcatcaggaacctcttgttctagccctgagctctgctttgctctgtgtggcctcattttcagrccagcattgcccaaatggctaccagcagtgccagtctcatgtcctactgcttgctccatagtgccagcaaaagtcccagagctgaccttcaagggctcaggtggggtcacatgccatcaagaaccaaccgtggaagctgcagggctgaaaactgttggcgaaggttggctcctgtgctcacccaggcgtagtcaacctgtggaaccatgtggaatgggggctctgcgagggcctcccaagggaatatccagagacaggacctctggatacacccagccaccacttccctccagctcctttccatggctcaccttgttctgagaggcagcagcctcctgctcccccagccctgccttgtcccctgaaccctgggccagaggccctgacccttctccctatccccagctatgagatcatgcagaagtgctgggaagagaagtttgagattcggccccccttctcccagctggtgctgcttctcgagagactgttgggcgaaggttacaaaaaggtatgttgaggcagggtaggggtggagcacggagagctctggtgcagaagtcagacaccgagtacaaggctctgcgtgatgggctggcatttaggggaccaccctttgtcctctctgggcctcagtttccctgctggttctaggaggggatgggctggcgctgtgagtttattttagcagcagagagctttatgaaatggaatcctacatggaagctgatcgattagatgcagggagggggcctagagcactgtctgtcctgctgcctccctcaggcctttacctccataccgaaccgtggggctccttcagaagtgtgaataaccccaggttacatgaccatgaaccgcctgaccacttggatcctgtcacaggattgtccaaggcccaaagagccagtagggccctgaaaccctgccccgtccaacaacacgggtccaagtgaggaggaaatacacatggcctttgacacagaggcagctccttctttgggtccatttctcacccccactgccccccggggatggtcccagggacctgggagatggagtaaggtcatcaccacttcacagcaaaggaaactgaggccctgaagaaggacgctgaggcagcatgagagcctgtgcctgtctgctctgaagtgggggaagagttagagtcctgggtgctggtctgataactgcccctccctgggtggtcctgagctcaccatgccttgtaagattctatgtgaggtaggagggcagctcaaccatgtggcttgggcaaatccctttcccctctgagcagcgggggtcttatttatacaaagggggatgggctcggttagaagatccctgaaggcatttctggcctgaccatccctgtttctttggttctccctgccccgggagcagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccaggtarccaccctggcctggggccaaggaaattgtgcacagtgtgtgtgtgtgtgtgtgtgtgtgtgtgtgtgtgtgcgcgcgcgcgcgcgcgctgccaggtttgcctcagaggtaagttacgtagggtaagtacttatccctaccaatgaatagaagacagaatggaactcatttgaactttgatgccctgaggtggaaagggcaggctagtaaaaacaaaagtatgggctgggacttacttgcaaggtagctatttcctttaagggagcccccagaggttatctatactctcttatctctaggtcctgtcctagccccaaaaagaagaagcaaacctacttagcatccccagcaccccagctgttactcatggccagcctgaggcctatgttctgttcttcagcaccacgccctggggccagagggagcctgcttggttgtaggagtcagaggtgcctaaaggaattcaggacagaattcagactgggaaggagattcgtggttttcttttgccttgggaagtggtgaagttacagcccagagggggctttataggaggaccctgctgttgtgtggacttgatgtccacgcaggatctccccttaactggagagaagggctccccatgaggccacgcccacctccaaagcgagatccagcccaaggtgaagtggctggagccccaggctggggtactgtcccaactctgccactagccgctgagacctgggaaggcttctcctctgcgagcctcagtttctccatatgtgccaggagtgcacaccggccttagaaggctccgaaggccctcattgctctaactgttgaagaggccaaccatccaagagtcccagtggatggtgcagaggagtgaagtgcagcgctcacacagcttgaggtgtgaatgctcaccctgttttgtgccctcagacaagctgcttcactgtctaaacattggtgtcctcttctttttttttttattatttttattcatttatttatttatttttgagatggagtttcgctcttgttgcccaggctggagtgcaatggcgcgatctcggctcactgcaacctccacctcccaggttcaagcaattctcctgcctcagcctcccgagtagctggaattacaggcatgcagcaccacgcctggctaattttgtatttttagtagagatggggtttctccatgttgagactggtctcaacctcctgacctcaggtgatccgcctgcctcggcctcccaaagtgctgggattacagatgtgagccaccacgcccggccagtgtcttcttctgtaaaatacaaacagtaaaagtacttctattaggcggtcattgcaaggattaaatgagatagcatacacctttaggagtgcagaggagggagatgctggtgggtgagaaatgagctttggagccagctgaccctgctccgaagttccagctcctgcacttccctgctgtgtgaagtggggcagtgatataacctctctgagccacactttcctcacggtgcaggccttgcatagttttcacaagagttaaatgagccggagtgtgtgaagcctacggtgcaggggtggacacaccgaaggctcttcatgactgctgctggaatcctcctgggctccttcctagcccctcactcactgcctctttcctctagctccaccctgaatgaagtcaacacctcctcaaccatctcctgtgacagccccctggagccccaggacgaaccagagccagagccccagcttgagctccaggtggagccggagccrgagctggaacagttgccggattcggggtgccctgcgcctcgggcggaagcagaggatagcttcctgtagggggctggcccctaccctgccctgcctgaagctccccccctgccagcacccagcatctcctggcctggcctgrccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaagatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagcccccagcagctgccccagggacatgggaagaccacgggacctctttcactacccacgatgacctccgggggtatcctgggcaaaagggacaaagagggcaaatgagatcacctcctgcagcccaccactccagcacctgtgccgaggtctgcgtcgaagacagaatggacagtgaggacagttatgtcttgtaaaagacaagaagcttcagatgggtaccccaagaaggatgtgagaggtgggcgctttggaggtttgcccctcacccaccagctgccccatccctgaggcagcgctccatgggggtatggttttgtcactgcccagacctagcagtgacatctcattgtccccagcccagtgggcattggaggtgccaggggagtcagggttgtagccaagacgcccccgcacggggagggttgggaagggggtgcaggaagctcaacccctctgggcaccaaccctgcattgcaggttggcaccttacttccctgggatccccagagttggtccaaggagggagagtgggttctcaatacggtaccaaagatataatcacctaggtttacaratatttttaggactcacgttaactcacatttatacagcagaaatgctattttgtatgctgttragtttttctatctgtgtacttttttttaagggaaagattttaatattaaacctggtgcttctcactcacagactttgtggtctctctcgggtttgggttcctgcccatagggagtgtggagtggggcacatgaggctcacccagacgcagacccccagacaggtcccttcagctctgagtctcatttcattcatctgtaaagtggggattttcgctctcccacccctcgctggaagctggggggcctagaccttgggcttggtttcccaaggtgggaagcgagcaggcttttctggctccacagagcctggccttgagtcgggcaggagggtgtggggctgcagggctgctccaaggctctggtgctgaggcgtctcactgcctccaccatgtgctttggctttggctatcagctgggacaccctcccctccactccgcccacaggcccggattgaggccggcgtgctctgtgacaggcagctgctagagcccagattccaggtccaggtgagtcatgatcaggccccaggtaggagaagggcagacagagtgtccaaaagcgtgagagcacgaagtgaggagaaggtggagaagagagaagaggaagaggaagaggaagagaggaagcggagggaactgcggccagggtaaggacaggggagggaatagggtggcgaccaggctgtggctttgagggcagagaggtgtagacctggcaggacccagacccctcacggctgcagcatctcaggggttgtggggccggcatgagtcataggctctcctgccgagcccaggcctgtgggaccccggcagcaacacagggccaggggcaatagggttgctgggggcaggggacagagtgctagggccctcccacctgggcccagagtcctgtacttggctcacttgaggtggaccagrtgtcagcctcagatccatcactgtgtgtccttagcccctcccttgctctctctgagctggggaaacggcatcttcatttgagtgggtgcgggaaggacctcattttggaaccacaggcctccctggactgcctccaggagtctggggctgtggcttcaagtggggaaaagaatggagccatgggacagctctgactcacaggcccagccgccaactcaggggcagctgagccacaccagggaaaatacccgacggctataaggcctggccatacaaagcccaccatcccagggatcctggcttcagaaaacacccagagcctgtgacttctcttctagctgtggcaggagttgaatgaggtgatacccggatctgccttgtaaagaaaataactagcccacattccagacagggattatctttgctgrtgcaaaagcctctgtctggaggtcagaagatctcagctccctgtgtctcaggcctgctccttwtgggaacttgagtggattacaccacatcaggcctcagtttccccagggrtaaatggagctagatgccacactaagacaaargttgataaaaatctgactaccactatccaacagttactatgccccagggctgtctggttgcttcacacacattagctcattttaccctcccaaaagcccagtgacctgagtcctactattatcccatgttacagatgagacaccagtccaagctgttgttgttttgtttgtttttgtttttctagttaaagaagtttattcaagggcaaagtgtgagggtagtcgtcaggaaacaggaaaaccagagaatggtgatcagtgcttccctgtgtggggcaaggtgaggatggtttatatagccagaaacgggtgggtaacacaattacattttccatacaaaggttaacgtagagctacaagatttgattggctactattgactacactttaagggggctgcttaacactcatttgtaaagaggtaatgatcaccagcgtgtcatttagtccaggtttgaataaagaatggggagcccggttaaagtataacattctcaacacaaaaatcaagaggcaatggtcagagagcagtcctgtgatgtgactcagtttccagggcttaacttttcccattggcataatgaattggggagctcctgaaattttattttattttcacaattttgatttgcattcaaaccaaatcaaatgtgcattcagggaggttttgaagtgacttgcccaagatcatctggtcagtgtggcagggatgggagaggagcccaggtcagactgactcccaagtcagcactcagggaggtaaagcacccacccaaatttgcagagctagggactggggaagcctgcgacaaaactcctatcttctgtctccagaccttctggtactgtgtttccccaagagaaaggataggaaaggactggatgagaaaggaaagctaacatcatctgagagctagagaaaaataataaaaactcatttgtgggagggcttgggcctctcaggcccctgtgcagagggcaggcagggtctggggtaaccacaggtcagcccctgctgggctcctgcctcccagtctctcccctcaggcgggcccagggaagacgggtgagctgggattttcctcccagacagatgagccacttggactgcacaattcttccgccaccccactcacggccggggttcttgttcctggaaaaagagggaaagactgaaaggagctatttctgccggggccctgacctgcagctgatgagggtctcacagctcccattcacgtcccttcttctttgaatcagggcaccgtctctaacaggccccttttattttagttataatgttcggttttgcaattaaaaattatttttaatgggcatcaggatatttccttctgtctttgaatatgccttttgtttctaatttgtgcaactataacttcacgtgaacctcatggattctggcttaggcaagtggcttctatgtaattagcagtgattccatcttaataaggtcctgtgatctgacaaaaaaaaaaaaactacttgatacaagtatttatgtcatatatgcctgtatttaaaaatccattaccaaaatacataatatagaaagagaaggtcttctttgagtatttttatatgttaaatgcagtaacattttaaatctttattctctttattcagcaactctgtggtacaaatttatcttgttgaaattctgcctctcactataaatagtttagttatatttttcaaagttgttttctttatatccatactaatatttgtatctgtacctatctacatagaatatagctataatcttcaacaaaactcccatttgtcattgtgcaactttttgtttttcacttaacaatatatcatgggcatactcataggtccatgggaaatacagatattaatgcattcattttgagagatgcacatagtttaaaagcaagcctgtgccagacattatttaaccaatgtcagaaatgcaaaatgcttgttccccagtgccacaaagaaatagcactcgaacataaatttaatttcctcagcaaggcaatttttactttctgcagagagggtgctcctggcagatggaacaatggcgagagcacaccttgacaggggaggggaagaggttcttattcctgacacaggcagcctctactgctgcattgttcccctattggctagggttggaccgcatagtctaagctaattccaattggctatttgaaaaaaaagagcaggagcatgagctggagtgccggggtgagtagtttggtgggaaaggtggatacgaacaggtggctcaggatgagtcaggatggagcaggtgactcaggtcaaagcaggtgaccaggggaacagatgtgaactgattaggactggtgggaaagttgtttactgaaaccagaagcaagggggcgaagagatccaggaagttaaactttaaaatggagaatcaaagaataagagagctgaacatattgacatactgattctttgaagagaaacttggggttcactatatttaacaccaatctcctactgaggggcatttggactatttcccattttttagagttataagttatgctacaatggccattatttataaaatatgtttgtttttgcatatttaagtatttgtttccatagcataaattcctagacattgagttgttgagtaaagagaataaacatttaaaatgtcactgaagtctaaaaattcccttttaagtacatatagtgccctgggcggctgagaaaatcaaacatacaaacaacagaaacaacgttatttaattctagctaagtactcyggactggtygaggaagtatggaccctctttggtttattgagaaaagtcataagtgggtgacagagaagarttgaagacagaaatgcgccaagctgaaacattctccttggcataaccagaaacacccagaggacttggcaaggcaggaagcttcccacagtgccattcagtgctgctgcagctctactaatccatcatcccacatctagacagggcatcccacccgtcgggaaacccagccttccctcaccgccctgctctgccccagtccctcatggtgtagggtgtgctcctaccagtggtcccatcggatcctcacgattagcctgtgagaggagcctccagatgaggaggttgaggctcagagccatcaagtggcttggctacagtcactgcagggaggctcttgccttccagcctccctgctcctaccttccccgggggtgtctaggtccagttccagatctcagagtggccagcaggctgagccctggggtcaggggccagctgcctacacagaatgtggctcctggaatttcttgggtggtggggggggggcgggcttctccttgggatggggttctggggccgctctgggccatgaaagtttcccacagcttggaagaaaatctgccaccactgtgtaggggtctggcgagggaccattggcctggggcagggacctggggacatcacagaagccgaactgtctccctgtaccaccccctcccagctggctcttccctcacccacatgttcttggcatacaggtctgccctctccagcagctcccaccccccacctgctcagggctcctcgccttctcctgcagggcttcacagcaggctgcccttgcccagctcccctttgcagatccacagtctctggttttagattttgtgggtcttcactgcaggaactagaaaagtcacaaacatggggaagtaacacagtttctggaaaatcacagaattctaagtcccttttttcccctctgaagagacaagagggaagcttccacatctgaaaatttttctttttcattcttgatcttcctgaagcatagtgatggtcttggtgttcccttgctcaaacatcttcagtggctccccgtggcccagcaaagtcgagactccttcatggaatctttaaggccctccctgatctgattccaacctctcctactgcctctcccacatctgccctccaaggtccatccaccttgtgtgggccactagyttcctgacctctgcccctttttttggtgctrccgtcaccacctagaatgcccagtcttttatagctgaaggtcaaagtcttgctcaagcttccagcccagcaaaagctactttctccaagaagctttcctcattcttcagctgaaaatgatttctcttcgcattcctttgtctgtgcctcttatgggccctcayatctgttcagcattcttagcctcccataccctgtgcactcttacgcctccaggcctttactgtgctgtttctccttcttggaacattccttcctcctccctgtatctctcccccaactcctcacccttctcacttcctctcaactcagatagggccttccttgactcttctctccggtgatcccaggacatcttgcaactcccccagtggcctggttcctctcctggctctgacaataggctgtgagttgcagaagggagggaccacagcygacctgttcaccaccatgtccccagggccagggacagtgattgagaaatatctgttgcatgcccttcacctgcattattgtctcactggatctgagtcaatagccccttccccattttacataatgaagaaacaaggccttgaaaggccggggacctggctgtggttaggagtggggaatgaattcctggtctatctggctccaaagcctaggctgttcccctttaccctcgatcctcctgagagcccctgccattgatgaaagacagtggttgaacatgtgggctctggctctgggttccagggtttaaaacccagctctgccacttagctgtttaactccaggcaggttacttaccatctttgagcctgtctttcttcatctgtaacatggagtaattacagctttcccctaaggtggctgggagaatcaatgagatgatctgtgcaaatagctcagtccagagactggcatgaagagtgtgcccaatggatcaaccagaacagtccttcttcatgcccctgtgttaatgcaattattaatagcaccccttccagtctcaaaggttccaaattggatgacaaatcatgttaatgtccatagatgtcagatattatcagctgcactgtataacaccacttagctacttgccttacctcccaccaggcggtgaggtccctgcatgcaggaaagtgctctgagccttggccttcctgggcccagaacaaggcctgacacatgaagcatttgctgaataaattgcttttggagggtggagagcttctccttgctcttcatttattcattcattcattggattgtttatacatttcttcatgcatctggcattgactgagcactcatctgccaggcagggccaggtgtagagggtataaagaagaccggaagggagactggccctaccaggaaactcctgctgcagaacaaaggggtcagaatgacatcacaccaataaccactctcataactgtgcttctgttgacagcgagaagtgccaggaaactcagggagccacgagagactataagacagggactcagtcaggcaaagggaggcttatgggccaggtggaagcagaagtatgtggaacaggaagaaggagtgtgggggtgtatgcaggagctgcaagtgttcagtacagcagggagggtggatggagagagaagaggcagagatcagattgcaaaggcccctgtaagccctgctacagggtatggccttgatctgctctatggagctgsaatagtaatgggagcaaataccccatagtactccaattcagacactagagctcaatcctcaggcctagagataggtgtggtcgaacctttgtggtccagggtcaaagaggaaccagttgccaaattgccattattctgtctgggtccctggctcctagcttgggcccactccactctctggtggggaacctcctgggtcccagggcatgggctgcagttggggttaactgggcaggagggtgggggctaagctgtccttgacctggggtctggaggttccagggtccaggagtcaggcagggagatgaaaactaggctctcagtatgtgaagtgtgacatggcccacacatttcttcagagtttcctaatccttgggctgtcatgcaaactcctctcaaagttcctctgccacaggaaggggtaatgtcaatctgggattcctgtttgtcaccttcccggcagcatcaccaaggcttcctcagtcagggcttaccccactgagtcccatggcacttccccactctgtgtccactagcggtcagcacacccactgctgggggaggtcaggatcgccctgtgcagtgtgctggtcattagcgtaggctctgcagccaggctgcctgcttccagtctcagctctgtcattccctggctctgggactttgggcaagtgaactaacctctctgagccttggtttcctcatcggcaaaatggcgtaattaatagaatcagcctcatgtgttaaaagcactaaattagataaatatggaaagagcctgctgtggtgcctggcacataaacagcactcagaaaatattagggagtccagtgtggtggctcacacatgtaatctcagccctttgggaagccaaggcaggaggatcgcttgatgccaggaggagtttgagaccagctggagcaacacagtgagaccctgtctcaacaaaaagaaatagaaaattagtcaagtgggcggtgtgtgcctgtagtcctaactactcaggaggctgaggcaggaggattgcttgagcccaggagtttgaggcttcagtgagctgtaactctgacactgtactctagcctggcaacagaatgagacttgcctataaaaaaagggaaaaagaaaaaaaagaggccaggtgtagtggctcacgcctgtaaccccagcattttgggaagccaaaacgggcagatcacttgaggtcaggagttcgagatcagcctcgccaacatggtaaccccgcctctattaaaaaaaaaaaaatatatatatatatatatatatttttttttttttttttgagacagagtctctctctgtcacccaggctggagtgcagtggcacaatgttggctcactgcaacctccgcctcctgggttcaagtgattctcctgcctcagcctcctgagcagctgggactacagccacgtgccaccacgcctggctgatgttttgtatttttaggagagacagggtttcactgtgttagccaggctggtctccatctcctgatctcgtgatccacctgcctgggcctcccaaagtgctgggattataggtgtgagccactgcacccagcctctgtcaaaaatattaaaaaattagctgggcgtggtggtgggtgcctatagtcccagctactcaggaggctgaggcaagagaatcacttgaacccaggaggtggaggttgcagtgagctgagatcacgccactgcactccagcctgggtgacagaatgaaactccatctcaaaaaaaaaaagaacaaatgaacaaaagagwaaggattaggcctctaaatgccattttttccaggaggacagagtaccttcctactcacggggctttggcatacagcattcattcattaattcattcactcttcatacatctaaaatcagtggatcagaatggtcaggtatacctgtaccataggaggcagaaatgccctcaccagctgtgtgatcttgggaaagtgacttaacttctctgagccttggtttgctcttcagtaaaacaaggataataaccacacctacctctagagttgaggattcaatgagaaaattccaaagagcactgggcgtgctgcctttcacatagtgagcacctgataaacctttgaagcctgccatgcaaggaaaatgctgggatgcggttgagcccaaaaggcctgggatgcataataaggatacctgcccatctggcaggaacagggaggcttccaggaggcagcgagtctgaaggagctataggaattagctggatggatagaaatgacaggacaagcagcatcctttgatcrtggggacagagacaggtcctgccaaggtggcctaggccatccctcaggactactgtagcctccacccctcttgctggttatacccctcctccacctaaacatgttccaccagagaggggtctctgccagcctgggtcagggactyggtgagaattgcatgaaagctgggcaagatcacacacaaactttgcatccgtgttaggggtgcccaggtttcctcaaggccatccagggactytcaaaggcagtggcctcagccagagggagcatgagaatccgctagagagcttgttacctgtgcaggtacccccctcccacccctaagtcagcaggcctgggatggtcctggagtcttcattttaacagttacccctgtgattctgaggctggggtccctgaactgcacttggaggtgcacccctctagaggcctccaggccattaaggacccatggcctataggatcaagccctggcaccstgccaggttgtcaggtactcttagtacttggacctcaccccctttctactcccatctccactccattccttcacactctggttggccccagagagtcctgatttttcaccctctctgcccctatgctattccctctcctgggatttcctttctgcytgaagggttgctgctcctccttcaaggcccagctccaatgccactgctctggaaggcctcacagactctccatcttctgttccccagcgccatctgattgtgcttatgttacaacacttaggggcttgcytccaaatgtgttggactttaagaagttaatgtcacattgatgaccttgcatgttgttgatctgatgagagtaagggaggccagatgtgcttggagaccatgtcccaggaaagactactaagaaaccagagtgctcaccctggagaagtagtacctccggggaccacaagtgctgtctgcatcactggaggcctgtcgagggacagggaacagagctgcctgagggtccagagcaacaggtgggtgtcacagrgaggcagatctgggccagatagggaagcatgggctaactgcttcccacaacagatggatgcaggtgacctgtcagaaatgcgccaaggggcacagggaatggtattggccagacaatccaagtagtggggagtggcgcccagctacctaggccttcgactcagaaaattcggattctggctctgagtcttccccaaagtagctgtgtgagctgagataagtcacaaaccctccttgaccttcctttttcttatctatgcaatagagctatgcacttcactgattgcctgtgacccaggcctgtatgagaaaatggaaatgaaagtgcctcgtaaacaataaatggctcagccttcctaaacaaaacatgaaacccagaagtcagaaatgaaaagacaacagatttgactacacacagtaaaaacttctgtgtgaatacacaaaccaaaagaacattagcagagaagtggcaaactgatggaaaatattttcagcatttctgataattgggttagcagacataatacagataacgaatagttcaataagctgggtgcagtggctcatgcctataatcccagcactttgggagaccaaggcatgcagatcacttgaggtctggagttcgagaccagcctggtcaacatggtgaaaccccacttctagtaaaaatacaaaaattaattggccgtggtggtgggcgcctgtaatcccagctactcgggaggctgaggcaggagaatcgcttgaacctgggagtcagaggttgcagtgagccaagactgcgccactgcactccagcctgcgtgatagagcgagactcggtctcaaaaataaagaaataaatagtccaatgaatcaataaagacaaaaaaacggacaaaggatatctgtagaagaaataccaatagccaatacacacatggaaaaaatgtttatttcatcactcatacagaaaatgcacatgaaacctcaacgaattaacattttttcctaccagactgcgaataattttaaagatcagtgatatcccatgtcagcaagtgtacggtgatgctgcatttctcacacactgttggtgagaatgcacatcctcacggccttcttagggraacaatttaacaatatctccatgttttaacgtacctaccctttgacccggcgatcccacttctatgaatggatcctgctccaatgagagtgtatttacacaacgattcatgtgcaaggatgtccactgagcattgtttgcaatggagaaaaattagaaggaactagagtgtccatttgttagaggaatggtgagataaattatggtacatccatacgatgagatacagtgaagcaattttaaraatatggtaaatctctatgaactaatatggaaagatttctaagatgtgttgaatgattaaatagcataggatactatttttaaaactataaagtagggatgggatggatgggtggacagatggatgagctcgtctgtgcccaggcaaatgctaggaagagtatacacacactcttacaagcagttgaggcggggagagaggctgtgattaggwgaataagggtttggggggccttccatttatggggacagtgtatctctttatggatgaatatcttacagtgaccactagtattaaaaaaaaaaaaaaaagaaggcaaggaaagcaagcaaggagtgggaggggattgccagcaccgccactctctgcctgggtcccgtgacggctggtggcagactggtggacctgctgattgcctttgctgttcatttcttttcagatgcccttctttctcttccctgcctctgcctggcaaaatccaaccttcccaggcctacctcttcccttagctcactctatcagttagctgttgttgcatagcaaacaaccctacaaagctgcagtgacatataccaataaacacgtatttctctctcatctacagtattcagctgatctggctggattgctagggttttctcatgcatctggggcagctggggactctgctttaatctagccttggctaggataccttagccatgccagctgaggcgcgtctttctcatagtgatgttagcagcatccgcaggcaaggagaaacatgcaatgcctcttgtggcctaggcttgaaactggaacaccctcacttccatctcattctataggccaaagcagcacctgcacgaccaagcccagattcaaggggtggagaaataggtatcaccttttttttttttttctgagagcaactgctaagtcacatggcaaagagatcgggtactgaaaggaatgaagaattgggaccattcatgcgatctcctttggataccataaagaggggagagacaaaccacagaatgggagaaggcatttgccaccatgtaaccaagcatgcgtataattgtgcgtagctgtatttcacttgtttatttggtttatattatactattatataaatactactttttactattctattattgatggatatttcatttttttttccagtttgagctattatgacaaatgctgctatgtatcttagtacacttgtgcacacatttctattgcacgtatgcctgccagggagtagaatttgttggatggtaagatattgcattttcgtcaatctaagtaaataatgctaaactgttttcccaagtggttgtatcaatttatacccttaccagcagtgtatgagatttcctgttgctccaaatcttagccaacacttggtaagggagttcatttctgtatatgttgtatagccggaaatgaacagtacttttaaaaaataatggttagccacacggtgaaagcccgtctccactaaaaatacaagaaattagctgggcgtggtggcgggtgcctttagtcccagctactcgggaggctgaggcaggagaatggcgtgaacccgggaggcggaggttgcagtgagccgagattgggccactgtactccaacctgggtgacagagcaagactccgtctcaraaaaaaaaaaaaaaaaaaaaaaagkttagccaatgatcttaggttcacttaaaactgtctttccctcccccatccccactggttctatcatctgtcaagtgtccatatgatccatatctaggaatttttttttaagagatgggctctcactatgttgtccaggctggactcgaacttctgggctcaagggatcctcctgcctcagcctcctggataactggcacgggtgygtcccacagtgcccagatactacgatctttattttgtaccaccagtctatttgtctatctgtgagccaacatcaaactgtcttaactatctttataatatttcttgatatctattatagaaagacttcccttttttcattttctttaagactgtcttggttattcctggccctttacatttttttcccattgttttatgaaaatttaatttacacacaataaaatggaccctttttagtctacaattctgctacttttgacaaatgtatatagtcatgtttatcattgtcacaatgaagctatatttccatcaccaaaaaattccccaaccccccacccccctgccggttctttgaagccctccctccatctccagcccctggcagccaatgatctattttctatctgtttacaagagtgtcatatgagtaagatcaaagagtatgaagccttttgaatctggcttctttcacttagcataaagaatttgagagtcatccacatcgttgtgtacatcagaagtttgttccacttaattgctgagtagcgttctattgtatggatataccacagtttatttatccatttaacagctaagggacatttgagttgtttccagtttgagctgattacaaataaagccactaaaacatttgcttagagggccttttgtgaacatcaatttccattttacttggaatgcctaggagtaggattactcaattatggtaggagttttctttttaaagttatgaattatggtaaaagtttcctttttaactttataagatactgccagactgatttccaaagtggtggctcttttgcatcctgactaccaatacatatatgagagttctattaatagttgttcgtggccaggcacggtggctcacgcctgtaatcccagcactttgggaggccgaggtgggcagatcatctgaggtcaagagtttgagatcagcttggccaacatggtgaaacatgtttctcctaaaaatacaaaaaaaaaaaaaaaaaattagctgggtgtggtggcgggcacctgcaatcccagctacttgggaggttgaggcaggagaatcgcttgaacctgggaggtggaggttgcagtgagccaagatcatcccactgcactatagcctgggtgacaagagcaagactctatctcaaaaaaaaaaaaaaaaaaaagttgtttgtattctcatccttatcagcacttgaaactgtcaggttttctgatttttggttttagccatttaattaagtatgtagtggtatttcattgtggttttagtttgtattttcctaacaaatattgatattgagcatcttttatatggcaaattatcttatcatttatatatattatttgttcaatgttttccttgtttttactgaatcatttattttcatattgagtattgaaagttctttatatactcttgatataagtcctttataagatatgcaatgttgaatattctctcttggtctgtattttgtcttttaaccatctatttaaaagagtagaagttttaaatgttgatgaagtccaatttatagatttactttttaaggtaagccaagtgaaacagtgggagtggagaaggaacaaagaaacctgtaactggttgtgatcaatttgttgtaaacaccactgcactcagacagcctatttttttttcttttatggattatatggatctttttaaatgttgtgtttaagaaatctttccataaccctcaaggtcacaaagattttctctatttcttgtaatagttgtatggttttgcatttaggtctttgatccattttgagataattttgtataaggcttaagttagagatcaatgttttctatgtttgtttgatttttatttttttctttttgcatgtggatagccagttgttccagtaccactttttggaatgcctattctttattcatttaattacttttgcaactttgtcaaaaatcaattggccacatatgtgcagttctatttctggactctattctgttccattgatgtacatgtctatcctttcaccagtactatattatagctttatagagtctgtcaaccaggtagtatgagggcttcaactttgttcttttcctaaattattttggctaatctaattcctttatgcttccatataaattttagaatcagcttgtcaatttacacaaaacttcttgcagagattttgattggcactttgttgaatctgtaggttaacctggagaagaatcagcatgctcaaaaatattgagtcttcaaacccacaaacattgtatatctaaccatttatttaggtctcattcattttcttttctcagtgttttgtacacagtatgcagatcttgcacatatttagtaagatttatacctaagtgtttcatgtttttttcagtgctattgtaaatagtatttgtaaaaaataaatttcacttttaatctgatttttgatattgaccttgtattctgtgatcttgctaagtttacttacagttctagtaacttttttgtagattctttggcattttctatgaagacaatcatttcatctccaaacagagaccattatatttcttcttttgaactctttttctttcactttctttcttttttctttcttcttcttttctttctttcttttttctttctttcttcttctttcctttcttttccttctttccttctctttctctctcttcctccttccctacctcccttcctcccttctccttccccttccccttcccctttccctttcccttcccttctccttctccttccttccttccttccttctttccctttctttttttgagactgagtgtcactttgtcacccaggctagagtgcagtggcatagtccctgctcattgtaggctagacatcctgagctcaagtgatcagccttccaagtagctaggactataggtgtgcatcaccatgctaggttctttttaaatttttttgtagagacagggtctgcctatgttgcccaggctggtctcaaactcctggactcaggtgatcctcctacgttggccccccaaagtgctgagcttacattgtgagtcaccacacctggtctatttctttttttgccttactacagtgtctaggatctccagtacactgttgaatagttcagtataatgttgaacagacatccttgccttgtttctcatcttagagggaaaatatacaatctttcaccactaagtttaatgttagtggtagggtttttacagatgccctttaccatattgaagaaatttcctttagaaatgaacattgaattttgtcaaagcattattctgcagctattaagaagcctatgtgatttttaaaatcttgatatggtaaattatagtgcttgatttttgagtgttgaacgtttcaacctttaactcttataataaataccacttggacatgatgcattatcctttttatatatacttaaatttgatttgctaagattttcttcagaatttttgcatctattttcataagggatattggtctataattttattttcttgcaatatctttgtgtggtcatgatattgggatactgctggtatcatacaatgaattaaaaagtcatctctcctatgctatattcttaaacagtttttgtagaattggtattctctctttctttctttctttcttttgagatggagtttcagtcttgttgcccaggctggagtgcaatggcacgatctcagctcacagcaacctctgcctcccgggttcaagcaattctcctacctcagcctcccaagtagctgggattacaggtgcctgccaccatgcttggctaatttttgtatttttagtagagatggggtttcaccatgttggccaggctggtctcgaacttctgacctcacatgatccgcccgcctcggtctcccaaagtgctgggattacaggcatgagccactgggccaggtcagtattatttatttcttaattgtttggtagaatttgccagtaaaaccacttgaacctgaagagtttttttgtttgtttttggttagaaggtttttaactacaagtttagtttttaaaaatagatacaggactgttcatgttatctatttcttcttaagagaattttagcagtttgtacctttcaaataatttgtccattttatgcaacttagtgaatttgttggcatagagtagttcatagtattcccttattattcttttagtgttggtagggttggtattgatgtccactttccattcttgatatttgcaatttgtgtttttcttgttttttttttttttctcggtaaatgttattacttttttttccagtgaaaaagcttttggttttattaattttccctaactcttttgttctggattttattgatttctgctcgtgtctttatttccttcctacggtcaatttggatttaatttgttcttctttttctagtttcttaaggtggtagccttagaccattgttttcttatccaattcaaaatattttctaatttttcatgtgacttcttctttgactcttgggttgtttataagtgtgtttaatttccaaatattttcaatttcccagatacctttttgttaataatttcaagtttgattctgttgtgatgcaagaaatactttgcataacttatttaaacttttaaagatgtatcttaagtgatagaatatggtatatcttggtgaatgttctatatgcccttgagatgaatgtgtattctgcaattgttaggtggataaaaatcaattaggtcaatcatttacgattttattcaggttttctataaccttgctgatttgctctctacttgtaccacctacaactgggagaagggtgttacaagagatttttatatctctcctttcgggtctatcagttttgtttcatgtagtttgaagctctgttctttttttttttttttttttttccaatttgagagcaggtactgtttattaaccaaccagcttagaaaaataatcatggtagacaccttagttcattcttctaataagcctgttgatctggtcctccctgttgccagcatctccaccttctacaaaatgggtggtctttttcttcattccacctcgtggagaagacaatttgaagggccacaggaagttatttgcctctttgaagcgttttccaacagtatagatctcatgaatcaaatcctccatgcagatgatgccgtatttaccaagagatcgagcaatcaaagcgttatctgtcaaagcaattcgcttcttattgattttgccataaccacgcttgtagattagttcatttactgacttcagattggggtacccccatgcaatatatggctctacaatcctcagcatgttaatcgaagccttgttgagcttcacaaaggttccattgaagatttgacgaaggcgaagaagctgcaacacctttcgaacctttgggctcactccattgatacctctgattctgatgacaaacgccaatttgggttctgcaggtacatagaagttgccagcttttcttgccatcctcgccattcgaatttcagtcctgtacatctgcctatattccttgtgatagtgctttgctttttcatagataagcttcctccttgcctttcgaagcatcttttgggcaaacttctttctcaggcgcttcatcttcagctctgcgaaattccttcgctttttcttaagggtttctggcacagcaggaacctccttcttcttctcttctacaccctccatggttccagccggaaaaaaaaactgaagctctgttctaaagtgcatatacacccaggattgttatgtcttcttgtaaaattgattctgtcttcactatgtaatgtccctcattatgcctggaaatatttcttgttctgaagtctattttgtctgatattaatacagctactccaggtttcttcaagttttattttatttttgattgacacataataattgtacttttttttttttttttgagatggaatttcactcttgttgcccaggctaaagtgcaatggcttgatcttgggtcactgcaacctctgcctcccaggtttaagcacttctcctgcctcagcctcccaagtagmtgggattacaggcacctgccaccacacccagctaattttatacttttagtaaagacagggttttgccatgttggtcaggctagtctcgaactcctgacctcaggtgacctgcccaccttggcctcccaaagtgctgggattacaggcgtgagccactgtgcccggcctcaataattgtacatgtttatggagtacaatatgatgttttgatacatgtgtatattgtgtaatgatcacatcagggtaattagcatgtctattgccttaaacatttatgatttcttatggtgagaacattcaaaatcctctcttctaccatcttgttagatgttttctattcattctatctggtcttctttctttccatctttgtcttcctttggattgagtatgtattatgtctccatttcatttccactattggcttataatttatacctcttcaaaaatttttaagttattaaaaagagagaaaaatttttagggagtgtcctgggttttacaacttacatcgtaaattaatcaaagtctacctttaaatgataaaatgttactttaaatatagcatgagggccggtgctgtggctcacacckgtaatcccagcactttgggaggccgaagcaggcagatgacctgaagtcaggaattcgagaccagcttagccaacatggtgaaaccctgtctctactaaaaatgcaaaaattagccagacacggtggcaggtgtctgtaatcccagctacttgggaggctgacgcgtgagaatcgcttgaacctgggaggtggaagttgcagtgagccaagatcacgccactgccctccagcctgggtgacagagtgagactccatctcaaaaaacaaacaagaaaaataaatatagcatgaggacctgacaagagtagactgcacaccctttcttcccgtttttcatagtgcagtagttcccccttattggcaatttcagttacttgtgatcaatccatgtccaaaaatatgaaggtactttgagagagagagagagactacattcacgtggcttttatcacagtgtagtgttataattgtcttattgtattattagttattattgttgatctcttactttgcctaactgataaactttatcataggtatgtaggtgatatggtttggctgtgtccccacccaattctcaccttgaattgtaataattcccacatgtcaagggtggggccaggtggagataattgaatcatgggggcagttttccccatactgttctcgtggtagtgattaagtctcacgagatctgatggttttataaatgggagttcccctgcatatactcttttgcctgccatcatgttggatgtgattctgctcctcctttgccttccactatgattctgaggcctcctcagccatgctgaactgtgagtcaattaaacctcctttcctttagaaatcacccagtctcgggtatgtctttattagcagtatgagaacagactaatacagtaggtataggaaaaaaacatggcatatacagggtttagtactatctgcagtttcaggcatacaccagggttactggaatgtatcccctgtggagattgctgtaaatgcatatgtgaaagtgaaatgtatgacaacaatatgtttcacttttaatctgctataaatatacaatgcattgctactacttttgctttaaatcagagattggcaaactatagcctgtggaccaaatgtagcctgcctcctgtttttgtaaataaggtatgattggaacatagcgtgctcaatagtttatgtattggctatggctgcttttgcactgcaatggcagaattaagcagttgccccaaagaccgtatggccacaaaacctaaaatacttactatttggtccttgacaggaaaaaaatttttcaatgtctgttttaaatagttatcttttcaagcatttaaaaagcaatcatattttttatgcttacctttattccatttccagcactttttattttttaatgtatatccaactttctagctggtatcatactccttttacctaaagaacttcccttaggatttttttttttttttttttttttttggtagtatgggtctgctggcaatgaattctcttagtttttgtttgtcaaagataatctttatcccttctctttttttgagataaaattcacataacataaaattaaacattaaccattttaaggtgtacaayggcatttaggacaaatacaatgctgggcagccatcacctttatctagttccaagacatttcatcaccccaaaacaaaaccacctcctcataagcaatcactccccattctcccttgccacatcccctggtaaccactcgtcaaccgtctgcctctacaggtttacctgttctggatgtttcatatagatggagtcgtatgacattttgctactggcttcattgacttaacacagtgttttcaaggttcatccacagtgtagcaggtaccagtatttcattccctttatagctgaataatattcaattgtatggacacaccacattttgtttagctgtcaactgtttccaccttttggctactgtaaattgtgctgcgttgaatatttgcgtgcatgtatttatttgggtccctgttttccattcttttggttttacctagaagtgatatttctggatcatatgacaattctatgtttaactttttgaggaattgtcaaactgattaccatagcagctgcaccatttttcattttcaccaacattgtacaaaggttccaatttctccacatcctcaccaacacttgttatccgattttttttattatgatgatcctagtagatatgaagtggtatctcaaggtggttctgatttgcacttccctaatgactaatgatattgagtattttttcatgtgctctggagaaatatctattcaatgttttgcctgttttttaaaaaaattattttagactcgggagtagatgtgcatgtttattacatgggtacattgcataatggtgaatttggcttccagtgtacccagtacccaaatactgaacactgtacccaataggtaatttttcacttcctttttgccctttcccctttccttctatccttccacttttggagtctattctttccatctttatatccgtgtggaccctttgtttggcttccacttataagtgaggacatgcaatatttgaatttgcctatttttaaatttaattgtttttttgttgttgtaggcaacactacaactttcattcttttttaaaatttattttcccataaatatttattaattgtgagggacaatagagtggctttagctacatattgcgtgattctacatacattctttagctacacactgtatgattccatttatatgacattatcctgtaaagcacaaagacattgtggaaaaggcaaaactgcagggatggagaacagatccgtggttgtttggtgtaaggggtttggggagggctttactataaaggagcagcatgagaaacattttctagagtgatggagctgttctatatcttgactacagtggtggttacattgttatatatatttgtcaaaactcatagaactatgcaccaagagtgatttttgctgaggaaacactacaactttcattctgtatatattctggatatatttatttattgtggatataaatattcattctgtgtgtttttattctcttgacagtgtcctttgatgcacaaaaatgtttaatttttattatgtccaatttttctttggttgcttgtgcttttagaaacatatctgagaaatcatttccaattccaaggtcatgaatattacctttatggtttcttttaaggttttaataattttagcttttatatttaggtctttaattcattttgagttaatttttatatgtgatgtaaaataaggattcaacttcattcttctgcatgtgactatctagttcttttagcacctatgttgaaaaaactggtcattctccattggatggtcctgccacccttgttgaatatcagttgtccatgaatgtgagagtttacttcctgactctcaattttattctattgatccatatagttattcttatgctgataccacactattttgatttctgtagttttatagtaggttttgaaattgaaaagtgtgactcctccaagattgttttgcatattcaatgtccctcgagattccatatgaatttgagaatcagcttttccatttctgcagaaaaaggctgttgggattttgatagggattatattgaccctataaatcagtctcactttgagagtaccgctgtcttattaaatcctccaacttatgaaaacaaggtggtttttcatttattaaggtcttctaaatttctttcaacagtgttttgtagttttcattgtaaagtcatgcatctccttagtttattccaaaatattttatttttgatactattgcaaattaaattgttttcttaatttccttattggagtattatcagtactatagagttacgtatgttgatcttgtatcctgcaggtttgctgaatttgtatattaactctaatagttgctttttgtagatcttttaggatttatctatatataggatcatgtcatctgtgaacagagatagttttacttcttcttttttaatttggatgccttctgtttctttttcttcctgattgctctggctaggacttccagtactatgttgaacagaagtggcgagaacaggcatctttgtcttgttcctgatgtaaagggaccagctctcagtcttttaccattgaattagttgtgctttttcacatgtgcccttaatcacgttgaggctgttcccttttattgctagtttgttgggtgggttttgttttgttttgtttttaatgaaagcatgttgggttttacagttacatcaagtgacatgatcatatgaggatwtttttcattctattaatgtgatgtattaccctgattttcatgtgttaaaccactgttgtatttcttggacaaatcccacttcatcatggtatataatcattttaatatgctgttagatttggtttgctggtggctgggtgcagtggctcacgcctgtaatcccaacactttgggaggccaagatgggcagactgcttgaggtcaggagttcaagactagcctggccaacatggtgaaaccctgtctctactaaaaatacaaaaattagctgggcatggtggcgcatgcctgtaatcccagctactcgggagtttgaggcacgagaatagcttgaacgcgggaggcagaggttgcagtgagccgagattgctccactgcactccagcctgagtgacagagtgagaccctgtctcaaaaaagaaagaaagaaagaaaaaaaaaaaaagatttggtttgctagtacatttttgaaaatttttgctttctatattcatgcatttgtattggtctgtagttatcttttctggcaatgtcttggtctagctttggtaccagaaaaatgctggcttcatagaatgagttgaaaaggattggtattaattcttctttaaatgtttgggagaattcaccagtgaagccatctggtcctgggctttgctttgtcgggaggtttttgattactgattaaatttcttttcttgttataggtttatttggattttctttttcttcttgagtcagctttgattgacattcatgattgctaaaggttcaaaacacttttctgaaaaagaaagtacatatatacactcataaatatacatacaaacacacacatacacaccacacacacacctgagtacaygggaatgatcattttcctggatcaatgttatatcaggatttttcaatttcaagaaggaactttaggctgggtatagtggctcatacctataatcccagtactttgggaagccaaggtatgcgaatcacttgagctcaggggtttgagaccagcctggacaacatggtgaaaccccatgtctaccaaaaatacagaaatttgctaggaatggtggcacatgcccctgtagtcccaactactcaggaggatgaggtaggaggatggcttgagtccgggaggtggaggttgcagtgagccgagatcacactactgcactccagcctgggtgacagaaccaaaccctgtctcagaaaaaaaaaaagaaaaaaagaagaagaaatgaccatgttctttagagataagaagtaaaatactaagcgaatcaactaaaagaggtaaaagcaattgcctccaggaaaagagggagcaaaggaatgctatatattttaagaattatgcagaacaattagattctttgtaaaaataaataaacaatgtaagtaacgcacaaaagatagttttataaccagactgctgggatccaaatcctatctccaccatttggtagctgtttgactatggacaagcttaaggcayttgatctctctgagctttagttttcccatctgtgaaatgagaatgacaatagtacttacctacataaagttttgcagtactaaaggagacagtgaatgtaaaaggtttggctagtaaatgtcctgtaaaaggaagcttattgccaatattatcaggctctcccagaccaacctgtatacaggaagaaaacaaactccgtttctcctatagtctcacaacacaaaatacttctgaccccagatgtagaggatggggcatatttccccatacaccaagcaatcaaccaattgttcagattctgcagcagacacgaatctggtgccctccgattcaatttgaacactatatttacctagagataacgtcagatctcacagcttgaaggcttgagccaggagtttgaggctgcagtgagctatgatcgagccacagagctccagcctgggcaacagagtgaaactgcgtctctaaaataataataataaatttttaaaagatatgcattactttggagattccaaggattttaggagttgtaagccaggacatcagggtaaagaaaaaatatatatgtcacaatatcatgcaacctaacttctctttgggatctgccagagccacctgatcactctgaagaccctcatttgtgctactgactaacggtctggctgctcttggacatgtctcttctcccaagaccccttgaagatggctttagaagggccccaaacttagctagctccccccaagctcaggctggccctgccccagactgcgacccctccctcttggrttcaaggctttgttttcttcttaaagacccaagatttccaaactctgtggttgccttgcctagctaaaaggggaagaagaggatcagcccaaggaggaggaagaggaaaacaagacaaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtaagagcagaacggggggtgggggactttgttggggtgtgatggagaagacccctgtgaaaggattcagtccttgcccctcactgggtgtcctcaggctgttttagtctccccaacactggactgcaggcttgtgggtatctgctttggagaggtagtggggtgaaaagagatgggtgtggtggaactggtccacctggtgctgtggatctgtcccagctctgccagcgactcactgtgtgtcctgagcaagcctctgatactcttgaggcttcagtgtccacttctattcaattgcaggtgttgggggcagggggacagtgatagactagaccagagcagtgcttttcatactttcctgtgcatacaagttacctgaggattttgttacaatgcasattcagactcagtcggtctcaggtgcgacctgagattctgtatatccaacacmctcctgggagatgtgagatgccggcactgctggtccagacctacactgagttgggaggacctggagagctcctgatggctctggcagctctgccagcctgtgattcgatgattctatgcaagatctgatttggaagggcctgataggggtggtggttcttccttgggtggcttgtgtaaggggtcagaggggagagacaagaggttggcctctctggcccagggctcaggagaggggaattyggggtgaaataggtatagggctagaggagggattgggaagaggccagtgagggtctcctggaccagagccctcccagacacaggctgccaagtctcaggaggtccccaggctgtagcagttctgcagaatttccatctgggagggaacatgactagaggtgaggggctgctgtgcttggcttgttggcccaacaaacacatttctattgcctgcttattcaaagggaccttgggggaggatggggattgaaggggagaaaggacagcctcatactggcctcttcacagaaggaccctaaggccgtggcgcttctggtccctgatgaggaggagatggcccactgaccatccttctctggcccaggcaatcacactgagcttgagtatttgggktttttttttttttttcctgagacagagtctctctctgtcaccaggctggagtacagtggcacaatctcggctcactgcaacctccacctcccgggttcaagtgtttctcctgtctcagcctcccaagctgggattacaggcatacaccatcatgactggctaatttttgtatttttagtagagatgggatttcaccatgttggccaagctggtctcgaactcctgacctcaggtgatccacctgccttggcctcccaaagtgttgggattactggtgtgagtcacggcgcccggcctggacttcttattttgcaatgtaacttacatgcagtagaaagcacaggttcttaagttcaatgaggtctgacaaatgcacacacagtgtacccgccacccccttcatctcagagagtcccacaggtttgatttcactgccttgtcctatccttacacccacaacctgcctgtggggcaaaaacggaaaagtatctgagccaggtctcaatttaattttattttttttattgagatggagtcttgtggccaggcatggtggctcacacctgtaatcccagcactctgggaggccgaggcgggtggatcacaagatcaggagtttcagaccagcctcgccaatatggtgaagccccctctctactaaaaaatacaaaaattagccgggtgtggtggtgggttcctgtagttccagctactcaggaggctgaggtgggagaatcacttgaacccgggaggcagaggttgcagtgagctgagatcatgccactgcactccagcctaggcgacagagcaagactccatctccttcctttctttcttccttccttccttccttccttccttccttccttccttccttccttccttccttccttccttctttctttctttctttctttctttctttctttctttctttctttcttttttctatctttttgagaccgagtcttgctctgttgcccaggctggagtgcaatggcatggatctcggctcactgcaacctccgcctccggggttcaagcaattctgccactcctgagtagctgtgattactggtgcctgccaccacacccagctaatttttttatttttggtagagacagggttttatcatgctggccatgctggtctcgaactcctgaactcaagcgatccccctgccttggcstcccaaagtgctgggattacaggcatgagccactgtgcctggcttcaatcaatttagaagtttattttgccaaggttaaggacatgctggcgagaaaaaaacatggagtcacaaaaacattctgtggtctgtgccattctggatgaattcgagggctttaatatttaaaggggaaagtgggctggaggggaaaaggggaggttgtggtaatccacatgttgcaaaagaaaagcagcaggtaggggaacagtcaattatctcggttcagtaaattggctctttacatagggaaagtgaacatagaggagctgcctgtgggatattttaccttttatctgtcgctatctgcttaggaataaaaggcaaggcagcttcttgcatgactcagtttccagcttgatttttccttttggcagagtgaattagggtcccragtttttattttcccttcacaggggcatggtgtgtgggaggggggccagatggttttccagggtccagtcccaagagaaagaagagatggggaggctggaaacctaagttttcagcccaacagaccaatgatgagtggatgaggggccactgtgaggagactggggatggtattggaggaccctagagagagaggggggctctctcttcattactgcgatgagatcctgggctgaagaggggctgtgtccagccttagtgtgcaktgtgtgtgtgtgtgtgtgtgtgtgtgtgtgtgtgtgtgtgtgtgtgtgtgttgggagagaagagtagagattggggcacattctggaagtgatgagggaggggcttccaggcaagtgggagctagtggagaggtgtggggcatggggagaattggggagtggagatgagaggggggaagaatggacaggcacagaaggggacctcagttaatgttcataagcccatgcccccaccccgaggaggatgggggccaagccggcttccttccctgctagccaagccagcaggggaagttggctgcggaagttgcgggtatcagccttatcctgcgtgaatacctgggacaataggataggacaaaatagggcagacaccgctccctgaccacatttcctggaggccaaggcagggtctagagagacaggctgggggaagggatgggagaagcccactgtaaggtgtgaggcaggtgtaaaaaaggaacaaatggaatcacagaatccaaggttaaaatcttgagcgatcagagttggcccagaagggacattagaaatgtagcaattaaagcaggtgcccagggcaggagtagttctatacatcatctcactcaaccttcagctgaagtttttggggtgggagctgggattattcccatcagacagaagaatagcctgaggctcaaagaggttaagaaactaacccagctggtaagggaagaaccaagatccaaacccaagttggtgtgagcccacactccaagctgtttcctgctataaaaccccggcctgggggccctagattgctgcagcagtgatagggcagccccagctctgttgagatttgctaaaaaggctgctagaaatgacacttgtccctcttcctggcagttgcactgcataggagggctacaaccccaggtggcaggcttggcagtattcacaattcactcaatcycgtttgctgatcagagtcttggggagaagggatgcacattctgatgaatacaaaatcaaaacgtgaattaagccatcctgaaaggacttgagagaggaaacctttccaattctgggctctatggtggggcagggggaatttccatttcaagggggtttgcagagaacaatggagataccctgaattcaccgaaagccctcggggctggcctgtcattgtgcccccatcactgggaagaggaagggccagagctgaggagttggatggccagggtcagccagtgggtcagcgtcagagcccagcctcacagctgccccgcaagtggcactccctctccctgcctggagagaggagagtggctaggaggctggggaagcagaagtgagaacatccctgtagaagggccacaggctgagcggaaaccgggggctgagcctgacgccaacaatgtgtttccgcccacacaggctgggggkcgcctggcagcccctcggaggcttgaatcagctctcacttccctcctttgcccctattttaggccctggaaaaatgctgacgctgcagaggcaacgggccttcttcccggacagcctgataggggtttcaagttctcttttctccttcaagaaaattttccttaaaagagattggcttcccagtaaacacagatgtgtgggggtgccggggtgagctgctgggtgtagactaggtaataaacatagtgactaactcttactgagccatttatttggtgacaggtgatgttctaaagtcttcccatgcatttaaaatgcctaacataccaatgagtgggtacgatgattgtccctgttttataggtggggaaactgaggcatggcacctccccatcccactgtgctgcagaccagatgtccattggtgggagcgggcacaccaggagattcttgggacctctctaactctgctgggctaagatcctacatctctttttttttctttcccatatgaattaagctgaggacttggccgtgaacattccattcatttgtttcttcattcggtggtagaaatacrtccactttgtacacagggttaaaagagtcyattcctggggagtagaaagatggcatcacagcagggaagactgaggcaggaggctgaggaccccagggggacagaggcctgggtgagaggctgagcaagctgcaagccccctttctcagaggagggacctcctggacatcagagacatcagtctgtccctgagcaggttgagggttaggagctgagcaaatgaccagggggcaggggctcgttcaaggtggtcccttgatggcacagcaccatccctgccaagctaccacccatctcagagtcaggacggcccaaggggcgcatcytagacctcacttctgtctgctgtccctctctcccaccaggtcagggaatcccagtgatagagcccagtgtcccygagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccayctctatgtcaaaggtgaggagtctgagcctcctcccaagaggcctgacccggcaggccccactacaatgggccctaaaattaacaatcgtaacaattcagctctgcatttactgagtgctggctatgagcaaggacctggaagagctgctaatgtaatgcagtcctyacaacaaccctgcaagtcgggtctatgatgatgcattttctagaagtgcagggaggttatccraggtcacacagcctcacatagtgggactagactggagcccaggtgcgcctgactctggagccaccacgctgaagcatccrctgaactgtcctggcgtggtgtgacctcagatgaatgatcagcctctctgagcttccttgtcacctatgtccaggtactccttggcccagtggagggagggcagttgtaaccctgtgccctcctctactctagaccctgcccggccctggaacgtgctagcacaggaggtggtcgtgttcgaggaccaggacgcactactgccctgtctgctcacagacccggtgctggaagcaggcgtctcrctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaaggtgcgtggggcatggggaccggcagccaggcctgaagagtrgggacagagagccggcggccacatgggtggtgactggggactgggtgtgatggggggcagtgggatgtcctctttctttcacttcttcccctcaatggttccacgatcatctatggggcaggactgacaaggtgtcggggcagggagacaaaccacatgtgagcaaataactcagtgggcaaggtcatctcargtcattggacatgctacaaaaataaacattcaacatggtagctgaataaggagtgtgtagggcggggagcctcactgagaaggaaacactttattagagcggaaatctgaatgacatgaagaaggtggctgtgcaaagatctgcttcagcagggggacagtgagtaccaagtggtgaggtggggacaggctctgaatgttctaggtatggaaagaggacggaagctcagcctcagacatggatttcccactgggggcctgcctaaggccargtgctggrcatgtgtaggagggatgctgagccaagaggcagggaggagatggtgggtgcgtgtgatggctctcgcggtggccaggtaacagtggaggtggagtctcaccctgctgggatggcaggcaggattctggtttctgggaggactggtgagagcaagcaggaccccagcctgaggacctgggcttgagacagcaatcagtccctgtaacragggccagggtcagagtgaagcagctagcccaatgccactgggatctgaagccactaaacctgccyagggggtcaaaggaccccagctgtgtgggcagaggaggccattagggctctttcctggcatttcatcctgcagagccctgggctggccaagagccaaaggtcctgggccctagttctgccttgacmccccctcagggaccttgggtgagtcctttcatgtccctgggccttaggaatctggattagattatctttcaacagcagcaatgggcataaatatgaattcaaggcctactgtgcatcaggcatcttgctggctgctggaatattcctgtcacggatttgacattcgactagagtctaactattaaatagaaagtaaatacaaatgtgatgagcaagaaaccaagctggggagtggcgggcatggaggtgctggggaggctaattcatatcagctggtcacagargccttgctgaggaatttttgagctaaagatctgaaggatgagaacagcctcccatttgaagtgtgggaggaaaggcattccaggagggaaaggtgggtgcaaaggccctgtggtaggaaagaggtccagcgggctgcagtgcagtgaacaaggggtggggttatcagggcggtcagaaacaggttgggctgtggaaggactttgacttcttttctgagagtaatgggaagccccaaatgtttacagaggagagaggcatggtcccatttatatttgtaagaggtcactttrgtgaagaatctaggtgtggggggcttggagggaggcagggaggtctctgaggaggctggtgcagaagtccagagtggagaatggtgacgggactggggaggggtagaggtgatggagaaagtagactttccaaggtctctttaggacaggccttgcagtggggggactgggagcatcaaggctgcctcccaggatttgggatggggcagtgatggggaccctggcctgtgtgtcctggcccatggcagggaggagagcaatatctctatcatrttcagggagcctgggtgttcaggggtctctcccccggtctcagtcatcccagggcccccagccttgacactggtgcctgcagagctggtgcggattcgaggggaggctgcccagatcgtgtgctcagccagcagcgttgatgttaactttgatgtcttcctccaacacaacaacacyaaggtcagtccctgcagatcacaaggtgaagtctggccatcctcccagcacaccaggtttcccatggtggagtcctgggcccccaactccaaactggctgtcttagctgaaggcacagctcagactccagagaggggtgcagactcacccgagatctcactcccagtcagtagctgacacagaaycaggactcatgcttgtgccgctgaactttgtgggggtgggtggggggaggtggttctctgtcaccttgacacatggcctttgccccagcctttagacaaaagccagaggtgagctcacttctgatttagcaagggtttcctaggccaccattgaagcccaggaatataacagctatttcagaaagacattgggagagagggaggaggagggaggattccaggagggactcacgttgggctgcctctaagagccccctcccttcccactgcacctgccgtgttccagacacagccctaagccacttgcatgcatatctcatttactcctcactacagtcttggggcagggagccagtattagccccattttacaagtgaagcaacaggctcagaggaaaggcagatagtaatccttaaaggctgaggattggaacccagatctttctaatccctaaactaccttggtataacatctccattccttctggctgcagctckcaatccctcaacaatctgactttcataataaccgttaccaaaaagtcctgaccctcaacctcgatcaagtagatttccaacatgccggcaactactcctgcrtggccagcaacgtgcagggcaagcactccacctccatgttcttccgggtggtaggtaagcatcagggtggtggtggacagtyggtagggatcctgcaggagtgtgagcagaagggttttgwkgaggaagctgatgtcagggaaggagacctgctgaggatatctctgctggagtttgtttatccaaggcctggctaaggagccactctccaggagctttcccttaccctctcctgggatctctctcccatcttggagctcttacagtgcatggctgcattgggtgcaccttagtgccattttttgtttatttggggattggggtccagtagctccctactggacttcatttgttcattctttcatgcattcctttatggaaacaygaaaagacaatgatcacccagtgattatgggggaagcacaaggtgtcctgggaacactgaagagtccccccaacccaggcttcgagaaggtggcctctaaactgggatgggaagaatgaaggtgagttggccgggcagaagggtgggaaaggaaggggaacagcgcttctggcagagggaggaacatatgcaaggctcaaaggcaaagagaacatagatcatttggaacactgaaagaacttgacaacagctgggatgtggagtggtgtgaggagtggccacaggggagcagaggaggtggcagaagccggaggtaaaggtgtcttaaagtgagaaagaataactgcatcttaacctattgggaggtcattgtaaagaggagagtgatggggtcagattgtacagaggaggcacttcgtggtggtcaggagcacacactccagggcagtgttccaacctgagtctgccaaggactagcaggttgctaaccaccctgtgtctcagttttcctacctgtaaaatgaagatattaacagtaactgccttcatagatagaagatagatagattagatagatagatagatagatagatagatagatagatagatagataggaagtacttagaacagggtctgacacaggaaatgctgtccaagtgtgcaccaggagatagtatctgagaaggctcagtctggcaccatgtgggttgggtgggaacctggaggctggagaatgggctgaagatggccagtggtgtgtggaagagtctgagatgcagggatgaggaagagaaaggagataaggatgacctccaggtctctggctatggtgattgggtgcaggcagtggcagtcactggactcagaccctgaagcaaggcagcagctcatcggagtgkgagcaggctctgagacatttaggtctggccgtgcctcatgtgttgaatgttatgggagatggaggtggcgaggagcatgagaatcatgagcatcmctgcccctagagtatgtgcaaggcactggacttgcagcagattgtgagctctgctgtggaccccaatctgcactgggagctttggcagggtaaaggggaagaagagcaaaagcacaagaattcagttacggcttctaatcctgtctgctttctagtacaggcatacagtcatcactcaagaaatgtttatgttcattcacactttgggccagacactgttctagacatcgaggatacagctgcaagtgaaacagatacaacaacccccgactcatgaagtgtgtgctctagctgggagtgggcaagcaatgagccaagtaaattattaaaaaaacaaattatatagcatttgcagcttcagatagggtgttcaccaaggaagatctcactagaaagctgatatttgagcaaaggcttaaattgctgaaggagcaagccatgcggccattttggagaagggagctccatcctgcagygggactgtgcttgccatgttcaggggacaagtgggccagtgtggctgyggggagagagtgagaaaaaaagtggtctcagatgaggtcagagagctaaagtgggaaggtgagatgaaaggaggctaccgcagtggtccaggctggagctgatggtgggtggactagagtggtaatggtgaaggcagcaggaagttgttggtgtttggatggatgaatggactaatggatggatgaataatagatagatggattgttgagagagacagagaagagaaaagccttgcccccaaaagctcacagactacttggagagagaagaaagctacctggagggagaaccagatgcatgaagcagtgcagatgtggtgcctaatgagtgtgtagtctggaagggcagcaaaagtcgagtggagtgagaggttcctgtgtcctggagcactgagtagagactccctcatgggggtgaatcttaaaggataaaggggcctctataatgaaaaggaggaggatgggatttctggtagaggaaattgcttgagcaaaacctccaaggttggaatgactatggtgtgttcagggatgttagsagacccagatgggtggagcgttgagtgtgtgtgtgtaggaaggaagaggggaggtggctggatgagcacagtgagacctgatttgattgagagccttgaacgccacgctgaataatggaggcaatgggackccatagagggcttttgagtagacatatrtcagtgtagaagggtgaatttcagatttttagacagaatagagtaaggagaggagctcttagaaatcatctagtccagggcttgtggcagagccctgaggttttaagaaggcatgtcaggggctaccatgacaggcacggagaggctgagtgaattggggttcttgccacaattcccttgcctgagattcaacaagagcagctgtattacaatctgtgcaaaatgtcattaggagaaactagttagtagctgggcgtggtggcatgcaactgttgtcccagctactcgggaggctgaggccggagaatcgcttgaasctgggaggcggaggttgcagtgagcagagactgtgccactgcactccagcctggatgacagagcaagactctgtttcaaaaaaaaaaaaaaaaaaaactagtcaggactctttcagatacaagtaatagaaaccaactcaaactggcctaattaaaaggatttttttccttatagctaaaaagctcatggatatcagcttcaggaacacttggatccaggtgttcagctgatgctggaaagaatctatgactccccaactctcagccctgccaggaaggctttccccttgtaggactccgactatccgccttgtagtatctgatccagcaacaccagtaaaatgagggcttctcttttcccagagtcttaacaaaaatcatggaattgagtgttatggactcatggattcatggtaacccaaaccaatcaccgggccagaggggacagagtaccctcactggttggcctgggttacacacctactccagagctatatttggaagccgcattgactratttatgaccagaagaaagggaaatggatgaggacacgtgaaattgtgtgtgtatgtgtgtgtgtgttttcttgctgccaaaaatttttcaaaaacttggaaaatcacagatatattcaatctcttcattacacaaataaggagatggaggcacaaatggggatagggatttgcccaggttctcctagggcttcagtgagaaaagttttgatccagggattctgaagggggtggtgagaagaggggtgtcagaggacctgtcttgggtggtggggactatgtacctgtgacatagctgctcagggactggatcaatgggtggatgacaaaatggacaaataaacaaggacatcttcccactaatgccagatgcttgtgtgttctgctttccagagagtgcctacttgaacttgagctctgagcagaacctcatccaggaggtgaccgtgggggaggggctcaacctcaaagtcatggtggaggcctacccaggcctgcaaggttttaactggacctacctgggacccttttctgaccaccagcctgagcccaagcttgctaatgctaccaccaaggacacatacaggtaccacttatcagctcccgtctacacagcccgacaaccagatggggtatgcttcagcaagcatcaggacgcttggctcatgtcccaaccttggtgtatgaccttgagcaagtccctgcccctttctgggcttcgctttccctgacttcatggaatcccaatattggtcatctgtgtttgagatctagatgaaattgacctacctctccatcccacatccttgggatagtcaatgccccacccaaggattctaccatttcttgggagtgtgcattctcattggtccctcaagaaccctcagcctcattcattttcctctcttggggccaatccaaatgcagaaaacagccccactcatagacacactcctgataatgactgcacaagttatctgctacatacaaaagcttggagggaggggaagagggaattaagatcacacaatcacagatacatgaaatgttctttaaaggattgtgatcacccagccccaagaatttctcactggctgctcttctctgtaagctcaaaactcttcccatgaagtgcaatctataataactccacacccctcttcttccgtctctccactcccacaatcctgtgtattccacacacattttagaaatctttttcctgtctgcttgtgaactgtgttcttggggtcttgctttctcatccaaagtggcttaagcaggtaggttctaaataagaaagctttgtgcctaagaggaacactcataccaggtatatcaggtattaactcaggtattaaaatagttccttcttttctttctttttattattttttttagatggagttttgctcttgttgctggagtgcaatggcacaatctcggctcactgcaaactcggcctcccgggttcaagtgattctcctgcctcagcctcccgagtagctgggattacagatgcccaccaccacacccagctaatttttgtatttttagtagagacagagtttcaccatgttggycaggctgrtctcgaactcctgacctcaggtgatctgcctgcctcggcctcccaaggtgctaggattacaggtgtgagccatcgtgcctggcctgaaataatcattcataccctgccctttcagagggagacagtacagcttaagggcagcgaatacgtggtgtgcatgccacactcactctcattcttgtttctgcaactctgttctgcagagtgtagatgcggcctcagagtcctcctcaacacaggtcccaggcagtatttccagcatagttggctcatgagagatctgtttgtcatccctgtgtggatcccttagacaacttcaaaactctttgggattctcgttctagctctggaagcccaaacctcattgattcccacaatcttgcttgtcaattgtcagaagcaacaaggatgttttcttgtcctcatcttcctcctctcagttcccttctggtcctttctggccaggtctctgtcttcctctcatttaaagcagaagttctgaatctggaatgtgtaggccctttggagggggytggtccatggatcggtttaatgggtccataagccacagagacattgaggaaaggaacacgagatcccctaaaacacagtagtctgggcccattcagcacaaggcagacaagcctggacaccaaacagccacagaattttagttcatgtgatgggttgttcataatggtgactttcaattatccaaaaaagtcaaattatttttagttaaaggggttagttatctcaagaagtgacctgggcagaggccttgtatatgcccagggtctggctggatgagactgctctctgaataccatagattttagtctagtagtagctgcagacatttcccaagcaagaactggccatttgctataatttttaaaattttatttattttgacagtgaactgggggactttttaaaaaatgtatttattacytaaacaacacatgttcattatggacaaattgtaaaatagagattaaagaaagaataaaacaaaaaatttcccagaatcagccaaagatgatttttattgttagtttttgctccagggccttttctgtaataaagggtaccattgaattgagtgcccacaaagattcaacttctgtgtcaagcaccctaaaaaggtcctttaatcctcaagccaagcctgtgaattaataaccatcgatatcactctcacagcaaaggaagtgagggatcagagaggttaagtacttgtctaagatcacacagccaagaaacagcagcaccaggacttgaaccccagtctctgcagcaacatggctcagaacccagggccctacatcctgcctcttgtctctttctcagtccctcttggcaaggttggcacttcagggatttgtagcagggattgcagctttcatgaaagcttagtccagtgacagtggtcaacgtaggcgacctgtgataggcctcccagcaccttgaagacatcacctctattaaacctcgggaaaaaaacactttcagataagaaaaccaactaaggaaatgggattggtggtttttgcatgtctcaatggcaccctgtctgagtatctggcttacccaaggccgttgggccctgaatattttaccaaaaataaaataaacccctttaaggctgttatctgactgcaatcctggcaggggccatactaggctrgggctcaccaacaccacctgattctcycctgcaggcrcaccttcaccctctctctgccccgcctgaagccctctgaggctggccgctactccttcctggccagaaacccaggaggctggagagctctgacgtttgagctcacccttcgatgtgagtgctggggccgagcgccacctggggcggaggccctgggactgcctggagggatggggttgactggggcagggcacagggaagtaggtactgggagattgggaggtggcggggaaagtgtgacttggggcctcctcctttcttcctcagaccccccagaggtaagcgtcatatggacattcatcaacggctctggcacccttttgtgtgctgcctctgggtacccccagcccaacgtgacatggctgcagtgcagtggccacactgataggtaagtgggctccactcacctccctcacctgggctcaggggctgggcaccctgtgagtgggagggacatgctggcgctgggaaccctgaagctctgagccacattctgcttttgccaggtgtgatgaggcccaagtgctgcaggtctgggatgacccataccctgaggtcctgagccaggagcccttccacaaggtgacggtgcagagcctgctgactgttgagaccttagagcacaaccaaacctacgagtgcagggcccacaacagcgtggggagtggctcctgggccttcatacccatctctgcaggtgagagggagccttcgcacccgcaccgcccccccgcccgccccccgcccctgctcctttaggcggctcctcccccaccccccaccgagggagctggggttggctccacctttggagcagatcctagcagtaccaaggtccacctctctgggccagtccaagcccctcctgcctggcaggtcccccgaagcagtaggacggggtagtctctgagaaagcagagagaaagcagcctgaagaaactggcccccactcttgtccctgcactctaactcatgcatctattcacaagtatgtgcaggcattatgcaccgtgtgccagggacgtgccctatgcagggaagcagtgcctccccagagctcagaggctgatgagggaggcaggcaatgagcaaggaaacagtccatctccagctcggggccagctaaggacggccttctccaactctcccctcttgctccagacacagtctatccatttgaggttgctgtgcaagaggctgccccgggggatgatgcccggccctgtgcacaacacaggctgcctctctgctttacacaaaggctccttaccagctagttctgtgattctcagaggcccacagcatcctcaggcttttgacaaccaggctctggcacccactgtgtgccagaccctggcatctgcctggctcaggggtggtcactcacgtccccagctgctggccttggagcaactgctaccagggtccagctgcaagcaggagcctgcggccgcgctgggcctcactgctggaggttgtatattataataaagccaacattttgttgaaggcttctgctgcgccaggcactgtgttaagctctttgtggggattatctcgattaactcctacaaacctaggaaataaatagaattttccctaggctcaatgtcacacagctcccaagtggcacaggtgaaacttgactgcagatctaagttactgatctgagcaaggaagtggaaattatgttctccaaaacatcrctagaactagtagtatagattctgggaagaggagactcaggggccacaagcctggcttgctagaccctcagaagggctgtatgattccaaaggcatgtggagaagctgcaggggaaatgcaggagaggaaggttgcagtgtgacctccagaaggcctttctgaacgagcttcctggaggtgtagtgcatgcaagccrtggctgggcaccaggccaggccgctgcagagaggtttcttgcactggcagagggtgagactgcatgaccccagaggctccctacccccagccacaggaggctgtgactctggacagggtttggggctgggcatgagcagagctgaagaggccgtcctctctgcctttctyggggagggtgtgcaggagaggctccagaggcttccagtggaggatgcttcattcagtcaacaagcatttattgagcacccactgtgttccaggcagtgtgcaggcctgacctcagggggctcggaggcacccctgcctgctcactgctttgcttcatgccttccaggagcccacacgcatcccccggatgagttcctcttcacaccagtggtggtcgcctgcatgtccatcatggccttgctgctgctgctgctcctgctgctattgtacaagtataagcaggtgagcyggagcrgagtggggctgccaggtgcctgagtgagccagatttggatggtacccccaggctgcatggattcacccttcctcctcctcagtcagtccatcagctaacagctctttagtgggtgcctactgtatgccaacatgagycagctgctgggtggcctctgaggctctgccctaatagcgtttactgtctagtgcgagagacaggtgctaatcaaatagccattaaagcaagggcacacctgtaatcccagctacttgggaggttgaggcagggggattgcttgaggccaggagttagggaccagcctgggtgatacagccagatcccagctcaaaaaacaaacaaaaagccgtgaaagcaagagcatggattatagagtgagaggctatgaggagaggaatggcattctgaggcagcgcagccytgggatcctgtctcagcccaggggtgtcctggcacccagcacggggcagaggaaatggatatacaagcgtggtgtcccctgggccaggcctgagccctgccctaagaagcacatggtctagtgaagacgagggcctgtgaccatcatcctcttcattatttcatgttactgtcctattagccaaagccacaatttagtgcatgttgcgtatagtgtgcttcctgtcactgtctgctcagtatatgacagtgatttgaggggcatttttctatagcatgttacctacatcatctcatttaatgccctcagcaaccactgtatgcagctagcattagtctrttttacagagttgtaaactgaggttctgagaggttgggacagttgcccttgtctacagctggtcaaaggcagagtctggtttttaaccctgaaggaggactcactccaaagcatgtcccaatcattatgtgaaacattgactcatcttattttaccctcacaagaagctggaggcaggaagtatactagtcagtatcttacccatcaggaagctgaggctcagcaaggttaaaaaaaaaaccccaaggggctgagggatagggttggcactgggccccaggggcttctgtccctagagcccatggcctccactgcctgcctgcccacacaaagaccatgtgcaatgtgatcagaagctgagaggaccaggccagagggctgtgggagttcagaggtgkacggacttttcaggctggtgggtaagggagactgcctggaggaggtggcttggcattggtgggacgggctttggaggatgaggatgcagcaggggagatgacactaagggaaagggtayctctgggggagagggcagagtgtgcagaggtgcaggtgagggaaggaccagggtggggytgggggtctgaagggttggaccccaccctgtcggtccaaggccatcagtgggtttgaacaagggagtggtgtgatcaaggactgaatgacccatcttgtgtccccttggctaccttttcttccccacacccccttggggcttttgtgagaagagggcttgaagtgggcagggtgggaaggatgttgggggagccccaggggcacatggatcgggatctctactcctgccagcactcagcatgagaaggctgctctgagggcagycccggtcaatacctccggatctaggtccagctctgacactgtttkgccatgtaacctcagctgactcgctgtcctctctgggccttagtttcccctcttataccatgggtctgggtgttctctaacagcccctcctcctctgacatgccaagagcccactggtggtctagtttaagcaccagaaacttggacttcagtgaatctgggtccaaatcctgcctctgccaagctctggctatgggrtgatgagaaagttggtgtgtctgagtctcttctccatttgtaaaatgggatcattaacagcctgttgtgagggattccgtaccacaacgcacatagaggactgagcggggtgctggacgagacagtctctgtgatgggagctgcacactcttgtcccaggaggaagttcgttggggaaccagagttagctcatgcctcttgggatggtggaaggagggggaggtctgaggtcgggcatcatctccttgactacacacccaaagcggttgtttggcccagcccacccacctccagggacaggaccttactcactctcggggccaccygttccttctctgagcagctccaatgtttgcaaagttcttccttacatggaactgaaaactgcctcgcagtgcccacagagctgccaggacagtcatgcagagattccagagaagrgcctagggccccctgcggccctttctgccttgggctggccagcccccttggctgtggtttaggaactctgtatcccctctccacgggaccatttttggaacatgtcacctccacacttcctgtccaggaaattcwgctgcccctggagcccatgcaaggctgcgagaagacttgcagctaccctcctcccctacacccattcacagaccctttagctccaggccgaggtgtccacccatgggagcggagggggcaggatggtcatgcccgtgctaagtgcctgccctcccatcctcctctgccttgccccatgaggttcggagccttgccccttcactggggactcagcccagcctctcctcattgcccaggcctggggaaagaagtggcctgtctgtggggagtgtttgttctgcctcagggctgaatcatcacctttctgtcccccagagtgaccacaaggggggccgtgggggaagagaaaagggcaggagtcagcaggctcccctggaggaggaggcgcacagggaaatggctgaggcagcagggaagggagggtccagggaggctgctggaaagactacgattctgggggctggaactgagctctgaggagcaacaggagggtccccaaagattccactgggaattgttcagatctccaccttcctgggatggagaacatccactcacccagaaccagcaggcctagatggggaggggaccgggactttgtctccatgccccctttggtggggaggatgggaggaagggaagaagtcagggggtgggcctggggcttaggcccattgcaaggaatgaatggggtgatgtgcttcaagcatctagcccagcgccccactcccaggaagagctcaggaagaacccgctgccatcatgacaattacgtccacccttctcagggagcctcgcccatccccacctcttgatctctcactcatagttctttggaagagaggctgcctctgggtagacgcccatgagccctttccagggatggcacaggtgccctgggaggtttacatgcccagcaggggcaggggagggttcctgaggcaggcagaaggcagcttggtccgcttccagaaattaggagcctaggattcagaaatctgagaatccagccaaacctccatcctccttgatcccctccctttcaacagtgccccctgcccagctgggggcagggaggggctgactcagcccagctgcagagggacagaggaacaagaagtggtaagaaaaaacagtcttagccacagaggctcctagagatggaagtggccaggagaggctgaagaatcccctcctygccttgttgctgtcttttgggctgggaaggcacccacgggcaggatttggatcctcagaggcttgggaagytcttctccctgggtcccgtttcagactctctcccaagctataacgcagaggctctgaagttcacctgcagtccgcccttccraatcagagcctggaagttagttccttctcatttctaattgcagtcttttctctctaactaccagctagaagttcttcctgatggttagctggaagctttctccctgtctctctctttaaaaatgtccacattttatttttgattcaggggatagacgtacaggtttgttgcatgcgtatgtttcgtgatgctgagctttggaatatggatcccatcacctgctactgagcatagctcccatagtttttcaaccctcgcccgcttccaccctccctgctctagtagcccccagtgtctgttggtgccatctttatgcccatgcayactcaatatttagctcccacttataagtgagaacatgcggtatgtaggttttctgtttcggtgttaatttgcttaggataatggccttcagctgcaccacgttgctgcaaaggacatgactggaatcttctctctcaaccaggacttgcagctaaaggccagcctcctccctagcaccggtccacacttcctttaagtttctagctcgggtgcccagggaaggagcccagctgcaggcacagccaagcttgtcccatccccaaggcctggccggaaagagttgctctgctgacccagggcctcagtgtcctccaccgccccagcccagcttccactttccccctcaacttggtcttccatcagcatttcttrtgggcaacccttagcatggtactccccstcagcagctgacccctgggcaagaaacaggggcagccattcctcctccccacatcccagggcttgcctcccctggctgggtggtaacagcatggagagcctaaggaaggaaatcaggtctttccaaaggtgctggtcctccagaatctatctagtgggcagcgtctctctttctctctcaaaaaggtaaagtcaaggctgggtgcgatggctcacgcctataatcccagcactttgagaggccaaggcagaaggattgcttgagcccaggagtttgagcctagtgagctatgatcgtgccactgcactccggcatgagtgaaggagcaagactctgtctcaaaaaaaaaaagtcagatggcgactcacctgtgtcaaactctcagggtctctcactgcccggccaggcatggtagctcatgcctgtaatcccagcactttgagagaccgaggcaggcaaactgcttgagctcacgagttcaagaccagcckaggctgcgacaaagccccgtctctacaaaaattagccaggtgtggtgccacatgcttgtagtcccggctgcttgggagactgaggtgggaggattgcttgaacctcgggggtcgaggctgtagtgagccaagactgcccccactgcatgccagtctgggggacagagatcctgtcttggaaaaaaaaaaatcccaaaagggaacccactcaccttatcatagccctcaagrccttcctgtttctggaatctgccccccacttccctcaagccatgatggctgccttcctatagctcaaacttgcyaggatcattcccatgtcaagcatacagcatttccatgcactgttcctggaaaattcttcctctgatggtcacatggtgggctctttaggggccttccctgacttatcttactttattttcttcatagcaccacttgagaatctcctagatacatgtttatttgcgtttaatgcctctctcagccactagaatgcaaactccatggaggggcagggactttgtcctgttcaactctgaatcagcggtgcctgacacaaatagatgttcaagaaagtatgtggatgggctactattattcagccttaaaaaggaagggaattctgacctgtgctgcagcatgaatgaaccttgaagacattatgctgggtgaaatraggcaatctcaatagacacatgctgtgtgagtccactgaggtgcagtgcctagagcagtgcaattcacagagacagcagaatcatggttgccaggggctggaggagggaaaggggagttgctttttaacaggaacagaatttcagttttgcaagatgaaaagagctctggaaactggttgcacaaggtagaatgtaatttacttaatactactgaaccatacacttaaaaatggttgaaatggtaaatttcatgtatgttttatcacaattaaaatatatrtatatatttggatgggaggttgggtgggtggatggatgggtagatggatggacagatgaacggatggataagatctcaagttccaccctccctcctggctcaggaattaccagattatcagagatatcagggccctcagaggttgtcttgtccaaggtcttcaatacacaaatagtgaaacaggcttggagaagggaaggtcacacaayaaggcagagtcaagcaggaacatgctctcagtgctatgttcatgagacgacctctctcagcccagagcaggccttgccctgccttctcccactgggcgccttgggactgcccacacccctgctcttgggggtcagaaacaaggtccaggaactgcctgccagccccgactgccaygtgctcccttcctcttctgcagaagcccaagtaccaggtccgctggaagatcatcgagagctatgagggcaacagttatactttcatcgaccccacgcagctgccttacaacgagaagtgggagttcccccggaacaacctgcagtttggtgagatggcagctcatcactccacagcttcctatcacagggcctgtgggggttgcagggagcccatgggcccttggacagaggccctttggtgcccagggacttaagggacctgtgtgcgtggcaggtaagaccctcggagctggagcctttgggaaggtggtggaggccacggcctttggtctgggcaaggaggatgctgtcctgaaggtggctgtgaagatgctgaagtgtgagtgaggggaggggatgagggaagggatgggggtggtagatgctgggggtgggctggccctggtgtcacaagaggcatcacacacatttcaacctgttgaagcctgggggacagagctcaggggtgaggacttgggttttcttgtgagctccaggcaccctctgactcccggctccaagaaggtctaggtcaccctttagttgtgaaggggctcctgactgagctccaaaaagtctgggggtgcagaaaggccacctatggccatggcctggccacagtttggcttcctgtcacctgaagaccagctcagtgacaggctcatccctyctctctctctctctgccatctgtgtgtctgcatttttccttctccttcttttggcttctggtcactccgggtcttggrrtatgccctgctttctcccctgggtctctgcatttggtccccatgtatctgtgtggtgctctctgtcctgccctctccctgtctttgggactgtggttcttcctcccagccacggcccatgctgatgagaaggaggccctcatgtccgagctgaagatcatgagccacctgggccagcacgagaacatcgtcaaccttctgggagcctgtacccatggaggtaagggccttggggttcctggggccaaggtcttggggcctctggggaatctcagggccccagggctaccttgttccgtcttctccttctyaggatcctactgctccaagtgtcagggggatcccggtcacagcatcccttaaactcctgggcccatctcctggaatagtcaggagctgcacgggcagcttgaggtataaagagagactgatagggagcatcggagcccttggaggaggagatgaatgtgcaagctcctaggccctgcttccagggagccggatcctctgggtctggagtgaagccccccrcctacctcttatgaagcttccattcaaggatgcttggacactctccccagggcccccaaaggtgccccrggctttgctgggactccaagtgccccacatcctcttcactgatagcagstctgacctacagtgagccgccatagctttcctttgaagaaataattcttgggctacattttttttaaggttgtcttttttttttcattttttgttttttttttcttgagacggagcctcactctgtcacccaggctggagtgcagtggtgcgatctcggctcactgcaacctctgcctcccaggttcaagcaattctcctgcctcaacctcctgagtagttggaactacaggcacatgccaccatgcccggctgatttttttgtatttttgtagagatggggtttcaccatgttagccaggatggtctcgatctcctgacctcgtgatccacccaccttggcctcccaaagtgctgagattacaggcatgagccaccgtgccccgccaaagccatctgttttaaacaratggaactactgaggcacaaggaaacttgctcacagagccgaggttagaactcagctatgctgagtccaagtccagtggcctcactgcccccaktctcatgctcctgttcatggaggggagcactcagcmcctccctcaccccacacccttggctgctctaggccctgtactggtcatcacggagtactgttgctatggcgacctgctcaactttctgcgaaggaaggctgaggccatgctgggacccagcctgagccccggccaggaccccgagggaggcgtcgactataagaacatccacctcgaraagaaatatgtccgcaggtagyccctggcaaaggacaagaaaaaggccaggtctgggaggcaggatccgagtctgtcttcaaagccagctcagggttggatggctcatgaatgggtggctatgcagccctcacctgccacctgtgtcatgggaagtagccaccacaggttttatggccatctcttgtttctctactccttttccccttcmttcaacaaatatttgaacacctaccrtgttctgggagtgtggagggcaaagatgggcagctcataatctggtggagatatgcatcaatgaaatcaccacccagtgtgtgtaaaagatcaaccaagatctgtgcctggagccctagtaagagatgggcagatgtggccgggtgcagtggctcatgcctgtaatcccagcactttgggaggctgaggcgggcagatcacctgaggatgggagttcgagamcagccttaccaacaaggtgaaaccccgtctctattaaatatacaaaattagccgggcgtggtggcgcatgcctataatcccagctactcgggaggctgaggcgggagaattgcttgaacccaggaggcagaggttgctgtgagctgagatcacaccattgcactccagcctgggcaacaagaatgaaactccgtctcaaaaaaaaagagagatggctctgttgtcctgttgctgtgattcctggaagccatccagaacagagccatccaacagacagagccacatggggaaccaaagagaggaagtggggagattcatgtcacacatgagtcagggttagaggtggagcctggactagaatcctgctctcttgacttccagtccaggagtcacccaagccacactgctgtcctggaggtctctgtctcaggggcttgtggggtcrggacaggatcagaacaagaagggtgtacactgcgccctcatcctagatactgtcagctgccacgcctggggaggcaaaagagaaggaggccatctcttcacccagggccttaaaaatgggggcctggcagcatcacttcctcttctgattccctgacacttctatgagggtggcacacactaggcctctgaagatcagatcaaaatgagcaccaaaggaaagtattagcttccatcttcaaatacgcagatggggaaagtattcccagagtgggtaatttcgagggcaaatggcctgtaaaccaactctgtcaaaggattccaggctgttaacggaagcatagtttctacaagggagcggaaggttttttcggtttctccttctgggaacactagaatatggacattgtcaaggtacacatctctagcgcagaggggacaggagggagagagaaatcctatctggctggaacgttaggagcagtagtgcttcagtctacagtagtgcttctcaaattctctaccccaagtgtgctctcataggcatctcttgaggactgttggaagtgcaccacctcaggcccatccacccaggcctgctgattcaaaatctgcattgcagagattcccggggtgatttatctgcacatgagttgcagcgtaagcagcactgctctagaccagtgggcctcagcttaggctgtactttgtgatcacctggggagatttaaatctgtgaatgactgttttgtccctagagtttctgaagtattagtaattagcctgatcctaaaagctcccgaagtgattttaatgtgaagccaggggtgtgaggcactgtccagagaagagagggcacaaggggccctagaatatgccccaattctagtagggctgttatggggaagaggactccaacttctctgtggcccttgagggtagagcaggggctaggaggaaaatctcaggggtagattggcattaggaacagtgaagaactttctcacaggcagagctgcccaaaaccagaatgggttgtaagctccctcaccggggacagccragcagagaccaatgctcactcagatggagtgtggcaggagggtttcttatcagaaagggaggttccagttgaccatggggtggtgggtggtcaaggcctgagctgagcagtgcagtgatgatgastgacctctgccccccaaccctctctcctatgtagggacagtggcttctccagccagggtgtggacacctatgtggagatgaggcctgtctccacttcttcaaatgactccttctctgagcaaggtgaggaggtcccagggccaggccccatttgcttgataacaagggaaaaggagaaggggctgctggggtgaggggtggggagtgtggcagggctgccctgacgcctcttcccaccctagacctggacaaggaggatggacggcccctggagctccgggacctgcttcacttctccagccaagtagcccagggcatggccttcctcgcttccaagaatgtgagtaggaacctggccctggctcatagccacccaggtctgtgctccggggaggctggatgagtgacgatggggaggaggaaacgggagcctgtgagggggtaggggaggagacagagtatgagagagtcatttgggcagcagctgcaaggatgagtgggagmaagctgtgcccagggctggagctctggggctgggcacctgtgtccccagcgtgaagatgaggaagggtaccaggctttcttcattcgwttttactaaatagtgtatgagagacaacagttgtctctgctcataaagcacgyggtctggtggggatgataacggaagcttcctcagaattttggggatattagataacgtataaagtgcgctcggcctaggaagaagtgccagggaatgggagctcttgccatcttccttagaacagattcgggagtcagtggtttgattgttggctctgccacctgctccgtgactttaagcaactatttaaattctgtgcctcagtttctacacctataaaaatgggcataacgattgttgaaaagaaaaagggttcaatgtgtgcagagtttagggaagggcctggcagatagcagctgctatgatcagaagtaacggtagggtttggagactgctctctgcacggaagcccttcgcttctggggcctgagcagaccagtcagaggacaaagggtgagaagggccatggctgctcagggtaatgggggtttctaagcattaaatgatcagatcacgatacacattctcagatcctgggccctggtagaaggtatagacaagggtttgtggtaaaggaccaaaactgttgttcactccagcagggactccaaagccatgtggggccctccctgccatcctcctcacctcaggctcaggtaggagaaggcccaagactaaccctgcagtgctttccctcagtgcatccaccgggacgtggcagcgcgtaacgtgctgttgaccaatggtcatgtggccaagattggggacttcgggctggctagggacatcatgaatgactccaactacattgtcaagggcaatgtaagtgctgggagggcttgggycaggctggggagggggtgaagagtcggggcccaaaataactggggactgtcatcccaggcccgcctgcctgtgaagtggatggccccagagagcatctttgactgtgtctacacggttcagagcgacgtctggtcctatggcatcctcctctgggagatcttctcacttggtgagccactgggcccactccaggcagagcctggggctggctcctctggttgccccactggtggacaaagctgtttggtgcccaggacacagcgagggttggtgagagtgcaggaatgggcaagggctctcgaaacccagcatcgtggctcctgcgggactcggcagaccctctgcccctgacaggcgctcctttctggctcttccctcgtttgtctctgctcagttgctgttacctgttaccctcctttgtcactgtttccctcctttgtctgaaatctacagacccttgaagatgcagctctctactactaggctctagtagaaagaactgctatttcccgaggactaggcacaaggacttgtactcagttcttaaatacgctgctcctataccctsataaccacctgactgtccacactttaacgatacacagctgaagctttggtctgattccaaagcctgtgcaagaatgtttggtgtgataaggcctggatagaggctcacaccttcctaaagcctaagcctgccacacactggctggcacacaggaagcaccgggtaagagtagctgctgttgcagtgttgtcaagtgggaccctttaaacccagtctaagatgtgtgtgggtgtgcgggaatggggagaagacaatgggcatggcctcttacctgatcttggcctttgcagggctgaatccctaccctggcatcctggtgaacagcaagttctataaactggtgaaggatggataccaaatggcccagcctgcatttgccccaaagaatatgtaagcgaagggatcccagggagggaaaaggacaccccaggctttcgctggaaagggatggaaggccgtgtggccctgatctttccctgtccaaaatgttccagggtcagactttatctctcccatagtggacacaacaagccccttttgagttcaagctatgggggatgttctcagagaagcagctgttcactagggctggtcctaaccgaccacttttcctttttttttttttttttttttgagacagcatcttgctctgtagcccgggctggagcgcagtgatgtgtgcaatcatagctcactgcagcctcaatcttcagggctcaagcaatcctttggcctcagcctcccaaacagctgggactacaggtgtgcaccaccaagcccagctatttttaaaaaattttttagtagagatgggatctcactatgttgtccaggctggtctggaactcctggccttatgcaatcctcctgcatcaacctcccaaagtgttgggattacaggaatgagccactgcacctgtccctaaacagacttttaagagatcgttattacagttaccctgaggataccaaaatggcctcatctgtcagaatgagggtgatgagagtacccttctgcaagggttactgtgaggattaaatggtaaagcatgccaaggacttggcataggttttatactaaacttactttgactgggtttggggacctctgctgggtaggtctctctaggggtgtgtgttaatggcccctggaccctagggagctgcccatgggcatcctctgtcctatctcccagatacagcatcatgcaggcctgctgggccttggagcccacccacagacccaccttccagcagatctgctccttccttcaggagcaggcccaagaggacaggagagagcgggtgagtggggtgaggcttggggtgggtsgccggtaaagcacgttgggctgggcctgatggatctggactgacagtttctggtccctcccaccctcaggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactrtcagttctgctgaggagttgacgacagggagtaccactctcccctccymcaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcaccccccgcctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcasagagtgagatctccctctctgagaggagcagcagatgctcacagaccacactcagctcaggccccttggagcaggatggctcctctaagaatctcacaggacctctyagtctctgccctatacgccgccttcactccacagcctcacccctcccacccccatactggtactgctgtaatgasccaagtggcagctaaaagttgggggtgttctgcccagtcccgtcattytgggctagaaggcaggggaccttggcatgtggctggccacaccaagcaggaagcacaaactcccccaagctgactcatcctaactaacagtcacgcmgtgggatgtctctgtccacattaaactaacagcattratgcagtcagcctctggttctttgtgccacatgagtacctgcaaattccctggaacgtctttctttccttccctccttcacatgaagtgacgagctcacagctgtggagcttgaccacactgtgccccatacgatgtgcacggaattgactcctgctacaccaaaaccagataatttaataaactttattcttgttgggggaagagggagggaaaaaaagccacctactccactcaataaattaacacatggccaattcccaggccctaaacaaaccttgggcacttgagccagtcctgctgtttccttatggcccagtctgcttccccttcatagaagggagtttttcctactgctgctaggttatgtcatgaccagggaccacatcccctctgtggagagggtcccaggcccagagaggatattggctgcagcagcagtggccagggaaaggaggaaggggatgctcttcctcaaagcttggggtggagaggacagtgctggaagagagctgtggctgactgttcctccctcctcagcttcccccaaatgtgggtacaggaagagcaagagagaaatgcatccctccttcagggagaatcaagagcccaaagggacccctagagttaatgaggccacccaggcccctagtcaaaggcaacaggctaagcaattcatcagactgagggggctgaaaccagggctcctcaggggtgggagagacctcagcagccttcccacctagtgctggggctcacgccttagcccacccaggacctccaccctgacccacacagcaggccccacggaacccaccagctaccagcctttccctcagcctcccctccattaaacataccgtgtcccccaagtgctctctcggggccagaagaggtttcctggtaccactcctgacccctggagggttgagaactgaggaccctgggtcccaccatgctcagggaatggaagctctttggtcagtcccagcagtcagaggccctccccacaggagaccacttctgcaggtcccctggatagctctgcctcaggcaagggccttactatggcttgagagatggtgtagtccctgtacaacagcctggcttattctgccactgcggccacctcctcttcctcaccctcctcctctgtctctgtcttgatctgagcaaccccaaggcggtagagggtgtcacgaatgaccacctcaccaggctggcagctctgtacaatgtcatggatctgacgattgacaatttcgcggctggtgaggaagtccatgaggcggttgtagaggtaatagtgagtggcattgtcgaaggcaatgggccgctggcggacaccgtttggtttgctgtccacgatggaggccaggatggttgcgtaaggtgccaattcagggcacagggccaaggagtggtgcccagcactggggtcaccaggattgggctgtaggcctgcatggacgatgcgccgcgtggcagtcttggtgactgggtgctggatagagtgctcagtttctgtcatgtccacagtataatgctggtccaagagctctgggcaggacacactctagaagagaaatgagaatgcattttgacaagaaggaatgactaaggtggaacccatctggtgatgagaacactctaggctcagccagccctctttgaatcctaacatcaccatgtactgtgtctcctaggccaacccctgcccgccagtgcctccatttcctcatgtgagaacagggacagtaacagtggccaccttccagaacagatgttggattacttatgctattattgcccccggtccattcaggccagtggctgcaggggagcagaaagatcaggctctgactgaggttaagacacttttctggagtccccagcatgctcatggagccagtgagccccagggagtaatgacaataatgactcctccaaggcaaagccagaggccttcacttcctataatgcatcctggctggggcactcaacctttgttattcttcccttcttcctaattatcagttctgacatctatttcagcaaaggccaaaggctggcctgctggccttggagggtacatgactggtgagaaatactgtctggtacaatataccaagacacagagacaagggctctgccactaatctgctgtgggacccggaaaagtccatttcctcctctgggccttagcatccccttttaataaaaggagagggttggataagatgagtgttttctaaaccagtgtatcttcagatcacaacaggcatgccatacagtgttatccatggtcaactaaatgtaagacatggtgaattaaactaatccagggctggctggggcctttaatatgtcagtgtgcacaataactctcaaaggtggcaactttctaggcttctctggaaggcaacctcttttaacacaaggtttgggatatcctgggcacactaagtgatatactgtggcctcaaacagagggcttggtcagtaaaaacttacggagtaggctgggcgtggtggctcatgcctgtaatcccagcactttgacaggctgaggcatgtggattgcttgagcccaggagtttgagaacggcctgggcaaaatggccaaaccccatctctactaaaacacaaaaattagccaggtgtggtggtgtgtgcctgtaatcccagctactcgggaggctgaggcacgagaactgcttgaacctgggaggcagaggttgcagtgagccgagataacaccactgcactccagcctgggtgacagagcaagacatggtaggcttgaggagacatggcagttcctcaggaggtgactcaccacaggtggctctgtggggctagagaaacagccctggttcctcccccacatctggttagtcagctctgggtagcagaggtcagcacacagggccactgacgtggccatatctaccacatagacaggcggccagtggcgggaagaggcaagcaggtccacatggtcacgggcactctcacctcgcacaagatacttggagccgcagaccacctgggagatgaagggtggggggcgcagggttaattaggaagccagtctgcagagagtgtacagttctcactcgcttcttcccaggaagatgagcaatcagcttcagggccgaagccatggccatcctgccagagcccatggcatgctgctcccttcctacttctgtccttaaatgaagtcaccagctcatccttgcccttctgagagacagctgggagcatcctgtcctcaacttaggctgaaaggcacctcagaacatctttcaaaaccccactctctccacatcacctaccagttcactatgctagctacatagcagcagcagcagctaagagctggttaagaatggagatgcctgggcccgaggtcaaacctaagaaactaaggtctctgaagtagggtctaagcatctgtattttgagcaagctccccaccagaccccagtgggcttgttgcccagatgggaatccacaatgtagcctagtaaacacctccactgacagggccccccaagcaccattccacaactctgggtacacccacttggctgtcacctccaagtgatgccactcccatcacagcccccaagatctacagctctccccatgctgtcagctgcttctcatgagatgatcccctgtcgcatgaacacaattccctgagcaggctctgatctgcccagagtagaagcattaagcatctccttcagacacagcttctgttaaagtagttgggaactggattctctttttacagctagatccccctgctgactcatgtgcttcagtgaaggctctgataagccacctctctcccattcagtacctgttaaggggggggggtttccgttccaagatctacctgggcccactctgtcatctagtacataacctgtcctggagctaacccagtgccaccttgtccacacccttccacagatttcccattcaaaaccatccaaaaggtccctcatcagtcagaataaaatacgaactgttactctggcctagagagctctatgtgatctggccccccgggggagccctccaacaccccctcctctcagctcactctgtctccccactcacggccttggtggtcccttggctgtgacactccttccctggcttaccaatgggctcctccctatcctgcaggtctcagtcttctctgccacctcagacagcaggttcctccctgttactttctatcttaggcccttatctaatttcttcagagccaatgccacaagctgtggtgactttatttccccactaaaatatacggtcaactagggaggaacgacatctttgtcattctttatacaagctcgcccttataccctcaacagctgatgcccaggatgtggtagggtgcttaaaaaatactgagagaagacccagcctccctccctagcccacggggtagcacctgacccgtgggcagctatgccggaggttgcccagtgacctaagtctagccccccaaaactgagctggatcagtccctgtatgggaagttcaacattagcaaattcactccaagctccccctagttattttcttacctgatgggggcacaccttgtagattttaccacctgtgaagtgacgtgggggccgtatagctctagctccattctgtacagattcgtagagggccaacaaggagaagcagagctggtcctggagtagaaggacaagattaaaaacataagggcgaatgctaagggaccacggctggtgctcagcatcacacactcacccaacacccaaagcaaaagaataaactgcctgggtcagagcgggccttggagcctcatcagcccaacctcctctaggtacaggtaagcaatcggaggccctgaaaggattaggtcacagacaaagccagccagactgctgatcaagctgccagactctgaggcctgagtcctttcactttttacagggcaaagaaaccatcaaaggggagctaacatttgaatctgatcttgaaggaagcataacattttcaacagcacagaaatatgaaagggaaagtaaataatgtatgaataaaacacatagacacatacactatgtaacagtaggcattttctaagagcttgcataggtagtaaccagacactgtgtaaagtgcattccttacaacaatctcacaaggttagtattttggttatttccattttacaaacaaggaaaatgaagctcaaaatataaagcagcttatccaaggtcacacacagtaaggaggagagccaggattcctgaccccagagcctaggctcacaaccttcaacaggaggaactgttagaggccaggccccacatacatgtcacatctagctgttgaccatctcctaggcatccctgactgccagcaccttgtgtccaaggcagatgccatcacagatattcatatccctgccctaaaaagtggaccaatcagcctactccagaagccccgatatccaccactgcccttgacactcaccttggagtcttctgccccaaaggggattccacactgccttagcaggtgctgcagcttctcttcactgtaggagccaatctcatcaagcttgcaggtgccctcctggagcagcctcaccaaggcactgccactgcctgcaagagacaacagtgctggtgggagggtgctgccgccagtcaccagaggccaaggctaggcccacaaaacagcaaacagtggaagccagctctgcaccaagccctcccccagtgctggcagaggtggaactcaagtcaggtccacgctttctgcagatatttgaagtctattagaactggctttctgccctggaacatctgagtgagatatcctgcacaccgccactgaaaaaaaccctaaaataagtcagcttttaatccagtcttctaaggtttttcagaaccaagacctcagatgcttaccatgactgcatcaataagaaaag

SEQ ID NO: 17776 - DNA, 65300 bp, Homo sapiens
tattagtcaaattccattcaaagaagtttcctggctatttcagagtactggaatgttgtcacaataacattgctttacttaaattggctcaacaacctatctaaagaaatctttattcttgtaaactacattttctgaaataaattcctgcattattttgtttggaggaaatctgtaattttggaatcaataagggtttgtgtcactcttttcattaaatattcatctatgccatttaattgtccaaaaatggcatcaggaatgtctacacaagtggaaaggaactgtctaagtttctgtacacttgatatggcttctgtgatggtgacttttggttgctctggtaaagatacctccccttcatcttcacttcctgcttcactggtattttcgccagccaccatgtcctggatgatgtctgtgtcctgagagataatgagatcatcatctgcagtaacaaagtcctggaaatttacttcatttgggacacaggtggcaatagccactgtgtgccacaacttttcaatggcaatgtctggttcactggctgctgattctgtgtcacattctgcaaattccatagggacgatgcctgccttctgccaacatttcaccactgtggatggcttgactgaccaccacgctgcagcaatcatgtcgatggcctgcttgatgtccacctcttctgatcctcactgctgttgagcttgaggaggatctgttttagaaggtggctccggtacagtactttcatggtgtgaattatgccaagattcagtggctgcaggacagcagtacagttggagggcagatacccaacctgaatcctttccaagtgtggaagcatgttatgagcagagcagttgtctatgagcaagaggatccggcgttccgccctcttcatcctggcatccacttgcatcagccactcattaaacagatcccttgtcatccaagcccactggttggctcggtaatcacaagggagggaatgaatgttcttgaggcagtgtgggctggctgacctaccaacaatcaatggtctcattttttcagtccccgaggcattgcaacaaaagagtgctgtcaaccgctgctttgctttcttgccccctctacagtggtctcctttagcagcaagtgtgtgctggggaagcaactggaaaaacactcctgtctcatcagcattaaagatatcatctgggctgtagtcagcaatcagttttataatttcccctgcatgccactcattaatcttatctattcctagaccattcattaacctgtcactatcttctctacagactgctttcaaagcaattccgtggcgatctctaaatctgttcagccagcccacacttgcttgaaaattgtcatagccaagcatgttggccaagtttagtgcttttttccgaatgacagaaccagtcacaagaatgtttttggcatggatttcttgaaaccaagcaaaaacagccttatcaatgtcatcataaagagcgctcctcatccttttccgctggggtcccacggatgcctcccgcaccttttcttcaaatttggtgcgatcctttaagaatgtagataaagtagagggagtgataccaaattcttttgccacatcacctttcctcttgcctgagtctacagctcccacaactttcattttctcctccagagagaactgccgacgcttcttgttccccttgtttgccatttccagggaatgagggctggccacaactaacaggactgtctggttcctcctcgcggcttgctttgccccaagtgtggaaagctgagaagacaaaatggagtacctatcaggaaacaatggatttcccctaaaagatggttcaggatttttacaaattgtattaggaaaggacaatttacagtcaaagtaaagaaaagataggattcatgctactgactttttgtagaggctacttgtaaagactcagaatgtttgaaacagaagtgatcttatctagcttacttaaacattctgaacctccataaaaatgggaataacaatgtttgctctgcctaccatgagaacagattgaaataacaggcagtgaaagagcttggcaaatagcattgcactgtatacattccgagttattctccagcttctttgatggacacagaaactggggccctgggaaggggcctacccgggttcatgcagcttagatttcttaactcagattactatttctgccaggccatggtcctgcttgaaattccaccaaagtgagatcttcaaagctctaccaccatctggcctggaaagatttttactgtgggaagatgtttctggtagccatacattcattttatatttacaggtgccaagctttaagggtagagtaatgaacaaaagagtcaaggtccctgttcttatgaaatataaaatgtggtgggaaatataaaaagtaaacagataattacagagggtgatatgtgctataaaggaaataaagactatgacaaagaataaaagaggaagatctacttattatacaaagggtggtcagggatgtcctcactaagatggcactgaagctgagatctccaagaatatggggaaagggctgtccagcaaaagacatagcatcagcaaaacctcaaaagcaaaaataggccgggcgctgtggctcatgactgtaatcccagcactttgggaggccaaggcggccagaccagcctggccaacatggcgaaactccgattctactaaaaatacaaaaattagccgggcgtggtggcgggtgcctgtaatcccagctacttgggatgctaaggcaggagaatcacttgaacccaggaggcggaggttgcagtgagctgagatcgtacatttgcgttctagcctgggcaacaagagcaagactctgtctcaaaaacaacaacaacaacaaaaaacaaaaaaaacacacacaccgaaaatagcttgaggtattcagggaactgaaatatttgcatgaatccaagtatatgacaaaggtgggtggccagaccattcaaagatgccatggtaggctggatggggtggcttacgcctgtaatcccagcactttgggaggccgacgcgtgtggatcacgaggtcaggatatcgagaccatcctggccaacatggtgaaaccctgtctctactaaaaatacaaaaaaaattagccgggcgtggtggcgggcgcctgtagtcccagctactcgggaggctgaggcaggagaatggtgtgaacccgggaggcggagcttgcagtgagctgagatcgcgccactgcactccagtctgagtgacagagcaagactccgtctcaaaaataaataaataaataaataactgggtgtggtggcgcatgcctgtaatcccagctactcgggaggcagaggcacaagaatcgcttgaacccaggaggcggaggttgcagtgggccaagatcacaccactgcactccagcctggcgacagagcgagcctccatctcaaacaaacaaacaaacaaagatgccatggtaaagaattggtattttgagtgcaacagaaatccacggatgttttcaggcattttaaaaggatcactttggctgttctgtggaaaatggatcaaagaggcaaagagaccaattaggtgacagattatggcagaagtgatgggcaggttgtagtacagtccctctctgggcctattttctttttttccttttttttttaatacatatttttgaaaagtcccatggttgcaaaccacaagcccagatgatgcctaaggtccttccagatttaagtcttggaccctagataggtgcttcaaactcaaatgcctttaggggccaggatggtggcgtaagtgagtgaaacagggattgaagtatttggagaatggtgtggtgtatcctgtctagaagtattcagaatttaaaacaaacagtccccctgccctacgctggtccaacaaaacatgatccagcagtagcagttttgggtaattgccttcgtaggcattttatcatgagaatccttaaaggacaagagaacctgctgtgactttatgctatgactgtcccttctcaagggtagatttttactatcacctccatacatgtatccatccattcatgacatgtactatgtattaagcagtatgcttgatgccagccatacagagatgaatggagcatagtgcccacctttgaggagcctaccagggaagacaaacactagagcatgtgaaaactaaatcagaggttacggagtactactggaacataaatgtgcagataatcaactggaatggagcatggatgggcagtgcacttcaaagagggaataatatggtgggccttaaagaataaacaaataggaactcatgagatgaaaggaaatatttaacatgaaaggcaatgaaatactatataggaaatagaatgtcctggtcaggaacaaaaaattctttggagaagaaagcaaggaccaaatcacaggaagtcctagtcaggtttctagcttgctttgggggcattaagaggcttttgacggttttttggttttgtttttctggaatgacatgatcagatttacaatatagtcttttggttgcagggtagagaacctaatgggtaaagttgattttcctaagagatggccttaaatctgaagataaaagcaggctaaaccagtaggccatatacagtttggatgttaatttgagtgcaataggaagctattgaaggattttaaggaaggagagatgactgctgtgtaaagaatggaagggtatcagagaaaaaagcaggagtccacatgagataatggtggcttggattagagtagtaatagagagatggtgagtagtagtcagtctggggctatgtttttgcaagccctgtgctggaccggatgtgaggtgaaggaggagtcaaggataacgcccaggtttctggtttgagcactgaggaatccagcagatgatggtgccatttactgaggtgggaggatctactgcgtaaacctcatttgttaagcactttacttgcttaatattgcttacttgtggcagggctgggattcaaacccaggaggctcacaacaaagctagcactccaaacactacagagtgctatatagctggttctgggaactactaatattgagaggagacatagaaagagaatgaagcaagagccaaatcagacaagtcttggtcaagctaagacgtctgaattttattttaagtgaatgagacactggagggttttaagcagggagtgacttgatcagacttacagtgcaaaatgatcaatctgactgcttcgtggagaatggattgtagaggggatgtggggagaactacatcagtccaggcaggagatgatggtggctagaaggttggtgatggcggtagatgcagagaagtaggcagactggaatacagtgagggttgtgcgggaacttgtacaaatgtggacaacttgtgacactggagagaaaggacaatccaatccaatccctatttgatttacggaagctctccatacggtcattcagctcagcttgagtcactccaggaactcactaccatcactattcgtgggccagtgggagagacggattgagggcagatcactggagtgatgaaggcgctacttgatgcggcactacgtatgaacccgatcctgaatgagagggaaagactgagacaggctgaggtcaggccttgaacgtcgtgctgaggagagggtggtattgtaggcttcccagcgcccgacgtggctctgaaaggtgaggcggggcctagatccctcacgctcagcacagccccgcccctgttacctgaacgccccacagcagtgcccgggggctgagcggccggggcgtcccaccgccggcagccacagcttcctcctccgcccgggacctctggccggaagcagtccgttcgccttactagaccccctccaagcctttgagcagttcgtgtgggtccgctcccaagctagggctgggctgttgcgcttgcgccaggggtcgcatgcagtcacgcgctgccgaccgcttccggtgcgccgcgagggccgccgggacgggtctccctggcgatccgtggtgtgccgctactgccggtgcagccgccaaaccggtgcctcggtgacgaccgtgtccctgccgtcttcctcgagctccccggggcttgacccccggggccctcggcaggcatcggtgaggagcctgcggagcgaacctgtgctcctattcttgcccttcaggaccccatatcgcgactccgagraggggaagcgagaggggctgtcgcgactccgcgccgtgtgtcgccgggcggggccgcggggccggggctccttcagcccccgggatgcgcgcgcgagccctcgcctccacttccttgttgctgctgtcacgactggagccgcctctcgccgacagcggggagcgcgagtgcgccagccatccccctcgtccagccgccgggccaagcgcctccgggaatgtgagcggcgcagcttgcacgctcctccgggtaagtcccgccttcgagggccgcgccgagccgctgggcgacctcgagttggatgctgcggctctctgagcctctactgagtcttccacaaagtagggccactgagccttagtgtcctccttccgcaatccgtatgggacattcggatgtcccagacgtcttagcttgaccaagactttgtctggtttggctcttgcttcattcatgacccagaatgagggaaaggagctagcccagagtcaaactgtggcccatggctgagccctcaaaggcaatctcgtgagattccaaggaggatctgatgggacagagaaagtgtctcgcatatttcaggtattgaccttaactctgttttacagatgaaataacggagacttagggtaagtagattgcttaaggtcagaggtccccgtgctggtgcgactggtgtagtctgtactagaacccggattttctgtcctctagagcccttcgtttttaaccttaaattgtcctgcctttttttgcattgctatactgctgcctcgagtctgataacaaacttgtactcaggcttagaacagggtaataaaacaaacaaaaccgtagggtgttgtcttcctgccctcagcccaaggtggctgtaatgagtgtttcctaacccgttttgcgcagggtgcttagtaccctatatgccattcattacagatgctctcctgcagttactgcccttctccacaaggctttcagccgcccagaagtcaattcagggcaaaaaagcgcagtccccacgtagccttgatttgaactactgcttcccttatcctttactggcctattgcttacccagccaagttgtagactgtgttctcttcctgggttgcactatggcagttagaatgtaggtttttgttttgtttttctttgttagtttagtttttgtttttaataggaagaggaatcatttagagatgacagagaactaggaagaacctaaggaataatgtgtgctttacctggggtatatcctgaaaattataggtgaaatacagtgtgtctgcaatttctaggagaggttttttgttgttgtagttgtttgtttttttaagctttcgcaacattgtcaaaagaattcttgcctccaaaagactaggagccactgggttcatccttttctcacagtagaaacagttgaaatttaggatgtggaatagacttctctgagatcatcaggttagagtttaggtctcttgactccacatgcagtgctcattataccttatttgtggagtgaggtctaaatgagaggtgtgtgggctttgtactgcacgtatcagtcccatatttaccaccacaactgcctcttcccagaattctaaatttcctcctgacagattttcaggggcaactatgttatttcctcttgtaaaattcaagtggtttctgtgagcctttctccctccaaggattgagacttgtggtaaaagtccaatttagaacttggctacaaaaaaaactaactcttcttgaactggttattaagttttttatgcctcttttcctagacataaaagctgttagtagattctctgttttttagcccagcaccagagagctgatgttggttggtcagatgactgtttagatctgtgctgtctctagctcctagcatatgttgctatttcasttaattacaattggccaggtgtggtggtggctcatgcctgtaatcccagcactttgggaggccaaggcaggaggattgcttgagcctaggagtttgagaccagcttggataatataatgagatctcatctctacaaacaatttaaaaatttgccagacttggtggtgcacatgtgtagtcccagctacttgggaggccaaggtgggaagatcacttgagcctgggaggtggagactgcagtgagacaggatctcatcactgcactgcagcccaggggacagagtgagaccttgtcttaaaaataaataaatttaaaaataaaactaattcaattcttcagtcacactagccatatttcaagtgctcgatagccatatgtggctggtggctactatatttgacagcacagatgtagaacatttccatcatcagagtttattgaacagtgctggtttggagggttgccagtagagatggatagcagtgtagcataatgaaagaaggcccagggagttggatttttgagttaaaaatctatctctcaagtccctgcttgggcttggtggccttgggaaggttgttaagcatctcagacacagataatagtctttaacagaggctagatgtggtggctcacgcttgtaattacagcactttgggaggctgaggtaagaggatcgcttgagcccaggagttcaagaccagcctggacaacatagcgagatttcatctctattattattttttaaattatataaaattaaaaaaaaaacttaatgaactcttccattttttttttctgccaattacctgactttaggaatgaacccagcwgggcacagtgtaatcccactcatgcctgtaataccaacagtttgagaggccaaggtgggcagatcgcccgagtccaggattttgagaccagcctggccaacatggcaaaaccctatctctccaaaaaattagccaggcgtgatgacatcacctgtagtcccagctactcaggaggctgaggtggaaggattgctgagcccaggaggtcaagactgtagtgagcccagagtgtgccactgttctctagtgacagagtgagaccctgtctcaaaaaacaaaaacaaaaaacccaaaaacaaacccttttcatttgcatagcacttgactattttctttttttttttttaattaaaaaagatttttatttttttaatagagatggggtctcactatgttgaccaagctggctggcctcaaactcctggcctcaagcaaccctcccatctcagcctcccaaagtgctgagattataggcgtgagtcactgcgcccatccaattatttttaaatagagttgtgtctattgtatcctttgagtcttatcactataaatctgtgggaaggtagttgagacatgtctttttttatacatgagagagaaagctgaacaaaaagcagctaaaagacctgaccaaaattgcacaagctggcagagtataaagaaatcttttacatacaggcccttactacatgtttgagtgaatcaatgaaggsatttgcttaagttgatgaaacataggaggaatgggccagaacttctgattcctggccaagcatttttttttaacctgtttccatatagaattgttataatttggggctaataaatctttgtgttaaaggggtgggtgggtactgtatcccatgaatataagtgaaaagtatttctaaggcagtggtcacaaacttgcccggtctgaggaatcacctgaggcatttgttaagcatgtggatttccataccctcgggagattctgctccaggagggctgaagtggagctctggaatcttgtgtgttaaacaaccaagccaggtgcttcttaggatatattgggtttgggaaatgtctaagccttaaggcactggcagaggtaaggggttatttgatcaggaagctgctgcccctcttaggggagattctggaaactttattttgactttcctttcctttagccatggacgcatcatatgatggtactgaggtaactgtcgtgatggaggaaattgaggaagcctattgttacacctctcctgggccaccyaagaagaagaaaaagtataaaatacatggagaaaagacaaagaaacccaggttagccaacacattttggttgctgctagcatttataaacagaagttgcttggagagytgcattgaggaaaacttttaagactctttgaaaaagagtgttatgattgaagtcctgtgtcgagggatggggagtgggaagtggagggatttctgccagcattgccattactggccagactttgcttttgttttcaagttgtcacaggaaattgtaccatactgatggtagaagctaggtacaaaagagctacattatttattattatgccattgttgttatttaaacatttaaaacaaagcattaataaaattacaaaattagaaataaggctgggcgtgatgkctcatgcctgtaatcccagcagtttggaaggctgagacgggtggatcacctgaggtcaggagttcgagaccagcctgaccaacgtggagaaaccccgtctctactaaaaatacaaaattagccgggcgtggtggcgcacacctgtaatcccagctgcttgggaggctgaggcaagagaatcacttgaatctgggaggcggaggttgcggtgagccaagattgtgccattgcactacagcttggccaacaagaacgaaactcctctcaaaaaaaaaaaaaaaagaaaagaaaaagaaaaaaaccacacaaaaagaaataataccaattatatctgtacagaatatccaaattgtagctctaacttcactcttgactgtgaatacctcaaacttgtgaaactaccagcattggtcattttgattggtctgcttgcttccctctctcatccttggggaggtgccattgaccaggttggtgaccaaaggctgcgtagaggagcacggagtgtgagtgataaccagccccttgaggaagctttccctgagagtggaatgacaggacaggacacctgtatctatctttgctttaaaatcattcctgcacaaaaagcgatctttaggaaagccagtcaaatgagcctttgcttccaggtttctgaaggggaaacagccacttgctatctttaccattcattttcccctcctcccttggagccccttatcttcctgggtagttactcctgactgtaatatagtggctctaatgtagtaactttaatatggtagcttatataagcatttctcctataccatgagtttttatattacaaattgaatgtaatataatttgtgttgtactgacagctatcagttataatcaggaataagattataacttattataacaccatctgaggatgttatttaaatgtttgtttgcttgactttcagtccctatttagataaatgcttagaaakgagaagctaggttttatcaacctcttgactacccatatcttagcatagtagtacttactggttgaatgaagtcctgggtcgagggatggggagtgggaagtggagggatttctgccagcattgccattactgggaaagcctgaagaagtcattgcttcctcaggtctgcttaccttctgtactattacgacatctacctgaaagtgcagcaggagctcccccacctccctcagtctgagatcaataagaagattagtgagagttggaggcttctcagcgtggccgagaggagttactacttggagaaagccaaactagagaaggaaggtttggatcctgtaagtaatttttttttccagctattttttccactggttcagtgatgaaggccttgggaaaaccaagccccttgttctgtttccttttcttttyttgggaaaastttcatcgttttatccttcttgactctgggcttgcttgtttccattttgataatgccctgcactctcttgtcctcttcggttgcagcaatacgtggagctgacatttttttgtgttttctgcagtgagccttaggttccttttctaaattttagtgtaacttggagcccctcatagttactataaatagtagctttaatgtagtaaactttaatatagtagtttatataggcatttctcctacgccatgagttttcatattacagattgaatgtagtatattgtactaactgctatcagttataatcaggaataaggtttgcatgtttagaggtagatagagctgcttgtgtaatacagtaccacattattttgttagcactggtggttggaaactatgctraaagcaaaaatgcaagtaaagccaaagatggtggaggagaccaaggctttgggtgcttgggttaaaggactaacaaggaagcatttagaattatgtctgtcagcattttcttatttctagttcacagtaacaaaatacactgacagctatttaaactgctgggtttttgtttttttgagagtatccctgtcatggcataaactgctgtttttttaaactgaaattcctgcaggaagaataaccttgctgttgcaggctggaaccttttatccttaactccttatttcaatagaaacagttgtctgtaacttctattttggtaatgtagagcaacagcaacaactacgttatagcagaacaggttgtattttcccttattggagctcatcagctactgccatttaaattattttgtgcttattggcctggcattcttctttctgggagagctttgtcttacctacaggcttggagatgctactctctgctccctcctctaggtgatttgtttattaacagtgaatctgggaaataatccctatagtggagtggagatggagtctaagaaaagcttatctactccctttggtttccttattataataaaatcagctgtctaggctgggtgtggtagctcatgcccgtaatcccagcactttaggaggctgaggtgggaggatcacttgagcccaggagtttaagactagcctgggcaagttggcgaaactctatctctacaaaaaataggaaaagattagccaggcgtggtggcatacacctgtagtcccagccactcaggaagctgatgtgggaggatcacttgagccggggaagtggaggttgcagtgagccgtgattgtgccactgcactctagcctgggcaacagagtgagactctgtttcwcacacacacacacacacacacacacacacacacacacacaaatcagcaatctttttgtgcatgataaaatcctacgtaatcctggagtgatttgatttttaaaactacacactaatgtagatcattatcaagactttaaaaaaatttaaatcatctgcaatgattcttccttatttacatgcttatttctatctaccactatctctaccactgccaccaagaacatgagtaggttagttctgataatagctgagtgaccattttaacttttgagtcttggtttcctcatctgtaaaatggcagtagtctcttctcataatgtttaaaataggtaatgtaaatcacctagctgaattcttgataatactgacataataaatattaccctttagtagattaaacattcattgactatataataaggaaaagtggcatttattgagtacctggaatgtagtaagactgagtgaagctttatgtgctgtgtttgacctctcccagactgcctggtgtgatgggaagaccctcaatgcccacataccttgggagcctgtcagagccctgtggcaggctgtcctccttagcagcccttcaggtctcttgccaagtgcaggctccagtgatatgccttctagtctataaaatgagtatcattcaggccttccaggtttctttgtgcttggatttgttaagtccaggccatgctgtgtgtatttgycaccatttagtcttgttctcctaacatggctgcttcaaagggtggcttgagaatgccatttccccattacctctccaataaaggctccataaaagattcagtccatctgcttttatgtttcatctgagtgctgcttttaacttttcatttctgagtgcttcctttatgccttaagtagtctcatcgacttcttgcttttgatttattgaagaatccttttgtagttgactttagtgttcattttaaaagatacttctgaaatttttttttgttctgtttaattktaggtctcatttaactgttcactttgaacttttctgttttccttattgggtgcctttaagtttaaattgaaaaaataaaacataaatgactttttcttggtgccaattagccattcaggactgtgctttttagtacctggccttcttgatacttagaagacctggcctggagtcccagctttactgtttactaattttgtgtttagggaaagtttacctccctgagtttcatcctaaatyttctcatttgttaaatgggaataataatcttatctaacataatagtgttgtttttaagataaaatcagataatgtgtttgaaaacattttctaaacctgaaggtactgggtcattgttaatattcacatttttttccgtagtatattcaggaccttgtcacataaccccttctatatatactttctgtcacgaagccttctaatgaagacccttagctttgtgatctgttcatcctcttctttgtaagtctggggaaaaccagtgaggtcagaatgcttacttgctgccttgagtttcatcttagcctgttaacttgtattttatgctttttgggtttttattgagcgttatacattctaatgtttgaatcttatgctgctttggaatcctaaagtatcagagctcaaaaggaactcataaattgccagattcagctcccttgttttacagatggggcagctgaggcctcaggaggggaaaggatttgctcaaggctatgccagacctcaggttctagctcacagtttcatatggcaagaccagtgctctttccagagttcagtccatgctgtttcctgtgtgactgagtgaataagctayattggctaaagtgtgattcaaatgaagatgacactgctgttgacaggggctgaccttatctgaattaggtcaagagagtagagtttttccagtcccttttgcaggaaraaaaaagaacttacacatatatatatatctttctctctccatgtggtcttagtccatttatctctgcttgtctyccccttcctggcttcctcatcctcagaactctaagctctctgcactgactgctgtggttccggacatcccaggtttccgcaagatcctcccacgctcagattatatcatcatccccaagagcagcctgcaggaggaccggagctgccctcagctagagctatgtgtggctcagaaccagatgtcccygaaaggacctcctcttgtgtccaacactgccccggagacagtgcccagccatgcaggcatggcagagcagtgcctggctgtggaggccctggctgaggaggtgggagcccttacccagtcaggtgctgtacaggagattgccacctcagagatcctcagccaggatgtgctcctagaggacgcttccctagaagtaggggagagccaccaaccttaccagacaagcctggtaattgaagagaccttggtgaatggctcaccagacctccccactggaagcctggctgtgccccacccccaggttggggagagtrtatcagtggtaacagtcatgagggtaagtggctttggtactgaagtctttggctttgtctggagttacttaaagggcagctagcaccatacagtgtgattccagagcagtggtaatcaagagtactggtgtggcacttactgatactgcagttctcttgaatgtgtcttgcccctgggctcactccagagttccttgaaatttctcaggcactcttaccaactctttgcccagcttagccagaattttcttcacatgagatggttcataagctacattagcaagaaagctgcaaattgtatttgaattatccacgagtcaaagctaggatctgtcaggcaatttagtatcagtcaggattttatgttttctgaagactgcttccttttcttgaaatgggatttcactctgttgcccaagctggtcttgcattcctgggcttaagcagtcctcctgcctcagcctcccaagtagccaggattataggcttgtccatcacactggctccctgaagactatttcagcaaacaatggcaccttgagctgtgtacaagaattttcacacaagacctgtacccaggtcttcctggattcagatggggtaggaagaaaaaagttatcttcaaggccaggttgatgggacttacctctgagaaagaggaagcaagtttctacagtggcctaagtgtcattctcagttgaggggaaaacagcacttttagtgatcccaacaacctcatcccctagaagtggaagtggagagaaactgctaccatgccatagtataatatataacctgccctctataaccttggagaggatagcattctcagagatgggagtctttctgtgcaggctaagaggaccagcttgctgtagcccttatggcctgggcagaagagaacaagtacccctgcaatctgtcccagggctaaatccttatttgttgcctcagtgctgtttatgataatgaagcgtgcaactagccggttgttgttgttgttggttggttttttttggtttttttttttttttttgagacggagttttgctcttgtcacccaggctggagtgcagtggcacaatctcggctcactgcaacctccacctcccgggttcaagagattctcctgcctcagcctccaagtagctgggattacaagcatgcgccaccacgcctggctaatttttgtatttttttttttttagtagacatagggtttcaccacgttggccaggctggtcttgaactcctgacctcaggtgatccgcccgcctcggcctcccaaagtgctgggattacaggcgtgagccgccgtgcccggccgccactagcctgtttaaagcaggtaaatagggtgctgagaacacttgaaagggttagaattggattctctcactaactgcttatgtgatcttagaagtcctaaatgtcttagaacctcagttttctcatctataaaataaacatagcacacttcctgtggaaatagttttctctttgttcttaaactttttgagataatcataaattcattccttttgataagcacattgggatgagtacactgtctgttattaaacttaatccaggcttccagtgttgagtggcctgggtgttctttattactctgtttcagtgaaactgtcyttctcttcattgcccataggattccagtgagagtagctcctctgcaccagccacacagttcatcatgttgcctctgcctgcctactcggttgtggagaaccccacctccatcaaactggtcagtactgtatgtgggggattgatggcaattagggtgtcataagcattttttttctaagtagatttgtctttttttctttctgagctaccagttgtaggaccaagaagatttctaaaagtcttagaacctcaggatgcgaggactggcaaagatttcagggattatgtggtccatatgttcttaatgggggtgagggggttgtagatagatctccatgggatccatgaactcacctcaagttttatacaaacttttttcctggaatggattccatgacttttataaaattttcgtaagcatacatgatttaggaaaatgagcagccactgatctaattcaatactgtgatcgtacagattaggaaaagggccataggagagaaaggacttgttcaaggttacaagacaagtcagactggattcgtttcttgattcccagttgatatttttttcagcattggggctgagatttatccctgtttatctttttctcacactattataaatggcatttttagaaaattttcaatatctgattgcctacaactagtatatcgtaatacaattgattgctttgtatattgggcttgtattctacaactttgcttaactcacttattagttctggtaacttttgtagatgctgttgggtttcctacaaagttaatcatgctgtctacaagtaatgacagttttatatgtcctttctgatttgaattccttctttttcttgccttatgatattgtctaggacttctggtacaatgctgaatagaagtggtaagagcagacatctttgtcttgtcctcatgtaaggaggaaaggattcagtccttcttcattaagtatattaactataggtttttcctacatgccctttatcatgtttaggtagttccctctattcctaattttctgaaagcttttatcaggaatgcatgttggattttttcaaatgctttttctgtgtctattgagagtattataagaattttccggaagttggttaaggtggtgaatttcactattactcaaattttaaaccacccttgtattcctgggacaaaccccatttgacagtgatgtaktatccctctcatagattgttggatttcatttgctaaaaagtttgctcagaatttggctcagaatttccttatacagtctctgtccacttttcatatcagggtaatgcttgcctcttaaaatgacttgggaagtattttctccacctcagttcttttccttaaatggtagtattaccagtgaagtcatctgggcctggagttttctttgtgagaaggtttttaactgcaagcccaattttaaaaatatgtataggactattcagactgtctctttgagtgagcatttggtattttggctttcaaggaatttgtccatttcatttaggctgttaaatttattgacataaagttgttcataacattcccttattaccctgtaataaacaatgtacttatctacaaagataatttgaactgttgtttccctattgctgacagatgaaaaagtttagaccttaaaataatacctgattgttggccacttctggttaaggccactctctccagctttccagtgacaggtaatgctttacattacaaccaactaatattctaagattcttaraaatggacaaaccacttgttgcttattttgattgtttctggacagttactacctgtgtggaaaaattcagggtgctaaacaacagtgtcactttatggcctggtactacactagagcatgtcacaagttcgcaagggcggtggctgctccctctactaacggatactaccagagaccttcacacagtgcagacctcggttactaacacctaaatattaacacccatgggatttgcagtccctatgttcatgtctagtacttgggtaagctccacaccaggcacatattgttttatgcaatctttaaagacatctgcaatagacaatatgcagtttaaacaaactgtgaggtttataaacagagaattctttacgtttgctattatgtcataacaggcacaatctgaaatacaattttgtactagcagtgtataaaaatacttttaaacgatactttcgataggtacagtagcactttaaagaaaaccactgtgtagttattccttttgaggacctactaaaacagttcaacttactgcccccagctacatctaaagcacgaatgtggaaagcaagttctcttacccaggtacacaccacacacacccacatgctgaaacagtctccatttatgatgcatgctgatgaggcatcaatctcaaacagggtatgagatgacagtgtttggtgcctgtttccatttccaggtttggtatgaatgaacaagaggcaaaggcaaggtggagtctgtgtatgggccctctctaggagtttaatctggcatatcaatatttaacttgggaggtgggggaacatatttcccagggattaaaactacctggtcttcccaaacactggagcaattttcggagcttctggaaccaatgtttcttcagcaccttygctatcttcctgatggagatcatatgaaatsttcccatattctcttaaaaatgggaaaatttcaagcagaaactggcagaagtctctgcgaataccaaaccaccaatgattgcccctttttggcctaaatgttgtggtcattaaagttagtaacaaaagccaaagggggacagatatggagatacaggagaatgtattgcggccatccagtctgtgaaccagcaggacttcaaaggtgagcagggcacgatgacagtcgttatccagctgatggccatggtcacgtgtgttcttcactgccctggtagttctcatttgttctttttctagtttcttaaggtagaagctgatgtcattgattcaaaacctttcttttcttttcttttctttttttggtarataaggtttcactctgttgcccatgttagagtgcagtggcacaatcatggctcactgcatccttgacttcctgggatccacctacctgccccagtctctcaggtagctgggaccacaggtgcataccaccacacccagctaattgtttcaaattatttgcagagatgggggtctctctgtgttgcccaggctggtcttagaactcctgggctcaagcaatcctcctgccttggcctccaaaagtattggaattacaggcgtgagccaccgtgcccagctctttctttcttttctaatgtaggtgcttactgctatgaatttccctctaagcactgctttagtggcattccacaaattctgatatggtgtgttttcattttcattcaattcaaatactttctaatttacttctttgacctatgagatacttagaagcgtattatttactctgcaaatatttggggattttccagatatctttctgttattgattaataatttaattccactgtggcctgacctttttgatttatttaaactgaatccctttaaatttattgagacttgtcttacggcccagaatgtggtctgtcttgataaatgttatgtacacttgaagagaatgcatagtctgctattgggtggaatgttctatacatatctaattaggtcaagttgattgataacgttcaacccttttatatccttactgattttgtctacttgttctatcaattataagagaaggcatctggccgggcacggtgatatgtgcctgtaaccctagcactttgagagactgaggcagaaggattgcttgagcccaggagttcaagaccagcctggacaaggcagggagaccccgtctctacaaaaagcaaaaaatagttgggtgtggtggtacacacctatagtcccagctactcagggctgaggtgggaggattgcttgggcccagtagttggaggatacagtgagctgtgatcgtgccactgcactgtagcctgagcaacagagtgagactctgtctcaaaaaaaaaaaaaaaaaaaaggaggtgacatttaactatccttgtagatttgtctgtttcttacagttctcttaatttttgtgtcgcaaattttgactctcttgcgaagtatgtaaacatgtaggattgttgtgccctcttgataaattggcccctttgttattacaaaatgacctttatctctagtaatctttgctctgaaatctactttgtctaatatctagcttttaaaaattattgttacatcaagaaatatatttttccatccttttaactaatttatatctacataaagtgtttttgttttgttctgctttgtgtagatagcatatagtttcaatataaaagcaagaccctctgacagtctctgtctttaaaagaggtggtttaagccatttatatttaatgtgattattgatatggttacatttagatctattattatttgtctcatcaattttgttctgccttcttctgatataagtattttttatggatctgctttcttttattggcttattagctattgactttgttttggttattttagtagtttctttagggctaaagtacatatttttaacttataagtttatcttcagagatctctactgagataaacaatatgttgtagataataaagctgcaatattttaaaataggaacagcctgcagctttgactcatggagaaactggttatttctcctgagtctttattctcctggaaattactgttctttcatgctctaataaatgtcagccaagcacttctagaaaagtgttttatgattaatacttaggactgaaacgtcatccttgaacattagcactttttttcctaaagtcatttctctagcctacttaacaatgttaagaatttccaagtccatggtaatttacttatgaaactaacctatcttaaatttttactctgctttcttgaggtgttcagaatgagaattatacattggccataacctgagaaaggatcagagatgttttatattccactattaatagtctctcacaagcatgtagaatctaagtgaatgttttctcatttcttatctcactttctcagcaagacacgcctataaaataggaagaacaggcgattttacagaggaagaaactcagggcccaagagttaaggttccttaccaccaggtcactcagtgtattagtggcaaaattggaasccaaagcctggtcttcctctttttggtgccataccacttcacgctcatccttgacttaataccactgtcataattggaagccataattgaagccttttccttaggcttccttgcagaggtagctaatggtagtttggtgtttccccaaggaagctttttgcgttttggctgggctagggaagctgggattaatagctgagtaaacattcatatgtgacagaacaaatatgacagagaaatgggtttttttccagccttaatctagaagcggagcatgactaatgaatgagtcgtttttatttgtagctgaaatattataacccatagtaatacattttgctcaaagggagatcagtggagatgataagagccagtggctatatatattaatatgcaaataactacattctgttgagtatcaaaggatagggcctggcttatagtcctgaactgcccttattttttcagtgaccatggatctatttttattctgaatcccaggtccttggttgtctgaagaatgaagatgaagcaaattctttgaagtatttagagccagagggtgcagctggatgcatagaaggaatgttgggccaagaatagagaaatatgggttctaggtctagctctgcccttgattgatgatttgaggcaaagcatttaaacctcagtagtaataatacgtacttaatacgattgctgagagtattaaatgaaatattggtaaagtgtttagcattgtgtggtgcctagctcartgcatagcaactatcactttcttcattcttctggtacctaactgtaatgttgggcaattgtctttccccatttgaacttagtttctccatttctaaagagtgaatttgttgtattgtaggacctttccaacactgaccttttatgatatgattatgaattggttatctttccacaagcttgtgacctcctggtgttgctgtgattatagtggtcatcagtctgagagaggttgttctattgattctgatgtgctctttatttacagaccactacatatacccgccggggccatgggacatgcaccagcccagggtgctcctttacatatgtcaccaggcacaagccacctaagtgccctacctgtggtaacttcctaggagggaagtggatcccaaaggtaaggtccattggctgttgctgctttggaagcctcacagaatagactttctgtttgccattaggaacaggtgatttttaaaaagttaacatttgtttttactgtctgactatacaagtaaatcatttccattgtatatagtttgtttaaaaaatacaaaagaaaaatggaataaattgttatccaaactcatataccatccaaagaaaagccattattracattttggtgtacttctttccagtctttttttctgtgaataagttctgtatctgtttttttcttcttctttccyttcttttttttttccagtagagatggggtcttcctttgttgctctggcctcaaacagtctcctgtctcggcctcccaaagtgctgggattacagcactgtgagcactgttttcccttttatttttctttctgttttttcgtggatatctccaatactataatattttgctttttttaatttaacatatcatgcctttaaatagtcttcaaaatagtacctgtttcataatttccatgaactactacaccatgtttatttacttgtttctgtcatccccccgtctgtatatagagatgtctgtatctatatgtctttaacatttttatttaacactcatcatcagttaacaatgtttctgtttatgtcacattgtgagttccttaatgaccttggtatctcccacagcctttgcccatagaagacactcaataaataaatgagcatcactgctgtgcccttctgaagttccgtttaacatgttgtcacctgtgtatgcttggtgcgaactagataaaacatatatacttgccacattttttatatgaaactatacattttaagggctaaaatggatggaagaggcagtaaattctcacctagttcagagaggagagacatttataaggactgagacagacaggcaaggtattatagaagagagagagttgaagattcaacagaatttgggtgggtagaaaaggaaagagaggacattattttagtgaaaatggcttaggttaggttcgtgattatcacatgtttaactcagcatgrtccaaacttgtatgtgtagaaaaaccttgtatagcagcataccttaaacttctctggggcaattttcacatctctttgagaaatactgggatggtgacttttgccctctggatgagtgttttggcttctggctaagttcagggtagcactaattccaggagacaggataattaagaacacaattctggagttagctacctcagttcagacccctgcttcccaaggtttttaactatgtaatcttggtcaagacattctatatctgttcctggatttaagttttgtctcatctgtcaatggaagttagtacctacttcattagggatgttagcagggtcaaataagattatccatatagactaaatggcagtttctggtacatattaaatcctcagtgaatgtcctgctatcatcatgatagacatcaatgtaattattagccctactattgctcttcatgttgtcaggaagggcctagtgctaatgtctcacagggggttttgtctaaggctcttgtgccatcttctctgatgtgcctctctgaagccatcagtgtattcacaatgtattccccaaaaaggcagttctctaactgcagtggggagattgaactggatagtagtcagaatcttccttgrcctttcttgaccaatgcgaaacaggtctcaaatgaccatatttcctgtgcttatacatgaaagactgtcagtgatcactgtgggcttatccctccttcaggctatttttactttggctttttcatttcttgtatgtgtggctttctttttcatttcttgtatgtgtggttttttttccactttgaaataacttttttttttgggacagagtctcttgctatgttgcctaggcccatttcaaattcttggtctcaagtgatcctcctgcctcagcttcctgagtagctggtactataggcatatgacatcataccatcatacctggctttaactgaaacagctttttttttttttttttgaagatagagtcttgctctattgtccaggctggatagcacgatctcagctcactgcaacctctacctccctggttcaagtgatccttatgtctcagcctcccgagtagctgggattacaggcatgtgccaccacagccagctaggtttttttgtatttttagtagaaatgggatttcaccatgttggccaggctggtgtcgaactcctggcctcaagtgatccacctgcctcccaaagtgttgggattacatgtgtgagccatggtgcccagcctgaaaaactttagagccatggttctcttactaagatcaagctcatggcatgaaaacaatttttttcttagctaccttcccccatcttgacttgctaagtcagaatttaccaatgtgttctgcaaggattaccatgtcaagagtagatactgtgatttctaaagcttatagaaacagaatgagtgtgagaagacaggtaacattttaccatcagtgcacttagaattttagaaataaattgactttgattatcagctacttcaactcttttgagtttccagctaaggaaaaatagattttgaaaaagcgacttactaaattcacacagccaattatcccattgccttttccactaaaccacacttctcagkcattgctgtgctgtttagctgcagaatgtaagacaagcttgtccaacctatggcccaggatggctttgaatgaagcccaacacaaattcataaactatcttaaaacattgagattttttgttttttaacaactggtaatcaatgtattaaaatagttgacttaagcatctgcagtggtgacttgcacctcaactcctggctcagtactgatggaagtaatttgcttaacaatctcagaaggactgtgcaagtcaattagttgcttgtggattctcctatggaaacattcctatgtcttagaaccttgaccacaagtttttcttgtagtgattctcaaagtcttggtaggcattcgaactgatcctttcactgagattcttttcctttgctcctctgatcaagtcagcacacatcttctccagggattttatgttgcagctcgttagagtgatttgaattcggtgaattgccacctccagctccatgggtgtttttccggtgtctttaaaagccttggctgcagcgggcttcctgaccgacttgttccttggcgagagagaacagcggtgagtcaggagcaggagcgggcaggagcgggcggaccgcagctccgcaccacctatgacygtgtcttcctcaaagagcaaaacattatwtttttttgtgtgtgattattttatttttatttttttaggctcatcagctattgttagtgttagtgtattttatgtgtgactcaagacagttcttccaatgtggcccagggaagccaaaattggacaccccgatctattaataagatttcttgaattctgatttttgaggcagcaagtataatttgtctctaaaagctccaagtgtgtttgtgccagccaggaaatgactcaccttttgttgtattgttctagagttcatactggctaaaattagcccaagaaatatgtggcatagttcccaatgagttggataaaacaaaagatagtatataaggctgtttagctcaaggcttcattcttaaggctctctgatggcagcagttgaggtctctctgagcctgcagcctcagagaattttgaaagtaacatctaaaatgagtaggctgagttaatgaaatgtgagatcaccaggtagagttgttttgctcagattgcttaaattacccaatctttctgtggtgatttttgtctaaaatagcctacttagtaggcagtgtttgctcaaaaatcttatctcaaaaaatgagtttagtctcctgtttttctgctaaattttccctctcctgcagtaaataagctctgtgcacttgacttggaatttttctccatgttaactcactcttaggggctattatgtgttagaatctgagaatgctttaccaaagagctcttaagaggtcacctgttactggctcttttttttttttttttttttccagacagggacagggtctcgctctgtcacccaggcatgaatacagctmatgcagcctcagcctcctggggtcaagtgatcctgccacctcagcctctcgagtagctgggaacacaggcacacaggctgcataccaccatgcctggctaatttttttttttttttttttgtagagatgtggtcttgccatgtttcccaaactggtcttgaactcctgggcttaggtgagcctcttgcctcagtttcccaaagacttaggatcacgggcatgagccatgacgcctggctgttaccagttctgaactagaagtgcagtatgcagatggctttggaaatgttgaggggtttttgggtagtaagcgactgggagataaatcattgaaatttagtgacattggcacagacactaaactttctgtaatgtgcagggaggtcctacacactatagaattaggtcacccaaaatgctgtctggctcctgttgacaaatactgagagcccaaccctttgctatttcataaggggaaatgaggattcaattgaagcttgccttataccacataactaattaggagtggagctaagcttgatagaacccagcctttatgtttcctagtttacagtgccctttatgatatacatggtgggtagaaaacctttctgaagacaaccactatttaaaaacatttttaaaagcrtatgtgtgtatatataatactattatttccactgcagtgctaattggataaaagctaagacaccaaggactttttaaagccaggtctagctraaatagcagctgccatttttagtgagtttgaatatttgtagcacataataatgcatgagttaatttgatccagtgcaaagtatgtgacatatgtgcaagtcattcttaagactctccttaaagaatctgggacaaaaaacagaatttttcccaaaggagatgggaaaatttgaatctgtccacatgaggttgcggccacattgggattaactgaatctcataaaaggaccaccaaggtgaacaacttagggcttttaggccctgtatggcagtatgtcaccctctttctagacacacagaagtagcctttgaataatgtaaaactaaatgtaaamctaaaaaatgccaacatttggttgatgaaacctggagaagcttttcaataagaattcattagaagatgaacagttttattcaaacgaaggcatttaatgctrtagtgaaaggaacctgtagccagaaaacttagattcaggctagttttacacttgagatcttaagttaacttcttcctttcatggaccttagtttccttatttattgcccatatgttattaaaaatgagagaatgtttgtgaatgtcatcaactgtaaaatcccttatgtatacaaggtattcttatttttctaggaaaagccagccaaagtaaaagtggaattggcttctggcgtctcttccaaaggctctgtggtgaaaagaaatcagcaacctgtcaccactgagcaaaattcctctaaggaaaatgcctccaaactgactctggagaattcggaagctgtaagccagctcctgaacgtagctcctcccagagaagtaggtgaggagagtgagtgggaggaagtgatcatctccgatgcycatgttttggttaaggaagctcccgggaattgtggtacagcagtcactaagacgccagtcgtcaaaagtggtgtgcagcctgaggtcactctggggacaactgacaatgacagtcctggagcagacktaccaacaccatcygaggggacaagtacctccagtccactccctgctcctaaaaaacctacagggtaagtcagtgtgtttgtataatatagggctttggaaatgccccatgtttcttttatctcatgtctgtacagcatgcctgagagaggcagcagagaccaggcaatggttcctgttttagagatacagaaaccaaggcctagagatatataaagattgtcccttcccccggactctgctattcatgtactgctgtcagattacttacacatctcttcttgtcagtctccctaaagcattaattagagwcttgctggtataggctctgggcagtattaaaactatgagttaccagtcctggatactggatttggaaagagaatctttattaaagcatcctgtagaaagagttctggccttatagtcagagaactcagtactggttctgactgtttctggcttctgtttgactttgggcattgtcacttcatgtctcttcacctcagttctctcctctgaagaatcttgagttggatattagaaaatcttatcctcacaggctgactgtacaaactgaagattgtatataaaacatgcaaccaagtaccttgcaagtcggaggaagtcactatctttttctccccttttcctccttaaatgcttaattggattctgtgtatatcccttccctgaggaagttgtgttcttgtaactgaagacccttatttgtatcaatggttctcaactggtaacaattgtgcccgcaatgaacaccagaagccaattccacttttaactttgkctggcttttcctggaaaaataagaataccttgtataccttgtatgcaaatatgtatgtgtgtgtgtgtatatatatttttcccattttttttttaacacaaatcatagcacaacatacatacttctacatcttgttttttatttttatgtttatttttattgtttgagacaggatctctctttgtcattcagtctggagtgcagtggtgcgaacacagctccctgaagcctcatcctcccaggctcaatcgatcttcccacctcagcctctggagtagctgggactacaggcacgcactaccacacctggctaatttttgtatttttttttttgtagagatggggttttgccatgttgcccagactggtcttgaactcctgggctcaggtgatccgcccgccttggcctcccaaatacatcttgcttttttttgggatggaatctcgctctgtcgcccaggctggagtggcgccatctcgtctcactgcaagctccgcctcccgggtccatgccattctcctgcctcagcctcccgagtagctgggactgcaggcacctgccaccacgcctggctaattttttgtatttttagtagagacggagtttcaccgtgttagccaggatggtcttgatctcctgaccttgtgatccacccgccttggcctcccaaagtgctgggattacaggcgtgagctaccgcgcccggccccatcttgctttttttaaaaaaaatcatgtagcaatatactttggcgatggttttgtatatttaaaggatgaagctgtgcactttagaccttttgtttgagacacgtaaatcactctagcaaatgtttattgaggcctcctctgtggtataggccatgtgctcaacattggtgctgcaaagatgaagcaaacatggactctgttctctagggtctctaagctgctgtcataagtatatgctctaactagaggtagattagatgttacagctataatagcgattggcattacacgctgtagacatcgttttacacttctgtgtcttcgcaatgaccccatactgtataggtaattactgttccattttacatattagaaacttgaagttaacagaagaatgaaattacttgtccagggccacacagctatttagtggttgaatttgaactcaatctgtctaaagcttgacagtttaaccccaatactatcctctaagaaagcactatgtagagattgcgctttggttttcttccctttgttccagaatttccagatttctcttcttattcttttcagagytgacctgcttacccctgggtccagagctccagagcttaaaggcagagcacggggcaagccctcattactggctgcagcaagaccyatgagagcaattttgccagccccagttaacgtggggcgaggcagcagcatgggactgcccagggccaggcaggccttttccctgagtggtaagggctgggacatacctgggatggaggggctgtctgacaggaaagggacaggagtggggggttgagaacggacatagagacttggggagactctgaatgcacttaagtcaccagtttggctcctggttctctcagataagactccctctgtgaggacttgtggtctgaagccaagcacactgaagcagytgggccagcccattcaacagccatctggccctggtgaggtgaaggtaaggcccattttccagagtgggagctgtttgagggtctggctgcttccatktaatgtatcaaagctataggtaaaggcacatcccatttcttacacgttggcagacctctgggtggaggttaacatgaatgatttatctgttttttaagtaatttcttaaaacttaagtgaatacatgtttttaaaccttttacttagaaataatttataacttagaaaaaagtcacaaaaataaaaatagtacagagaacacccatatactctttacccatagtgacctattgttaatgtattagcccattttgctttatcttttatgttcatgtgtgtccccccaccatatgtgggtgtgtacacattgcatgtgtgtaaaatacacattatagggtaagttatgcctttatgcttgtttgtgtatttcataagaatagggattttttttttttttggtggcagtgtctcactctgtcacccaggctggagtgcagtggcacaatcttggctcactgcaacctccacctcctgggttcaagtggttctcctgcctcagcctttcctgagtagctgggattacaggagcacaccaccacgcccggctaacttttgtattgttggtagatatggggtttcaccatgttggccaggctggccttgaactcctgacctcaagtgatccacccacctcggcctcccaaagtgctgggattacaggggtgagccaccacgcctggcctagaataggaatattcttttactgaaacattgatgtatacctttactctcccattcatattccaaattgtgtcaattcgacctgtgaaccctgaaaatctgagacaggtctcagttaatttagaaagcttattttgccaaaattgaggacatgcacctgggacacagcctcaggaggtcctgatgacatgtgcccaaggtggtcagagcacagtttggttttatacattctagggggacatcagtcaacatacacaagatgaacattggttcagtctggaaaggcaggacaactggaagcaaaggcaggaagactcaaagcagggaggggacttataggttataggtagataagagacaagtggttgcatccttctgagtttctgattagcatttccaaaggaggcagtcagatatgcatttatctcagtgagcagagggtgactttgaatagaatgggaggcaggttggccctaagcagttcccagcttgacttttccatttagcatagagatttgggggccccaagatttattttcttttcacagacccgattttatatatatatatatgtatatatatatatgtatgtgtgtgtatatatatatgtatatatatgtgtgtttgatatatatatgtatatatatgtatgtatgtgtgtgtgtgtgtgtgtgtgtgtgtgtgtgtgtgtatatatatatatatatatttttttttttttttttttcctccagaaacaaggtcttgctttgttgcccaggccggagtgcagtggtgcaatcatagctcactgcagcctcgaactcctgggctcaaggaatcctcccaactcagcctcctgagtagctgggtacacaggcaggcaccaccataccaagctaatttttaaattttttttgtagaaacggggtctcttgctatgttgcccaggctgatctcaaactcctggccttaagcgatcctcttccctcctcggcctcccaaagtactgggattacaggcattagccacctccccagtgtcttctttattttattgtatatttttaaagcccctcctattctagcacagttcctttatatagcatatttttctccagtctgtgatccagtctaggatcagatattaacgtttagttgtcatgtctctttagcttccttttaaaaatgaatgcatggttgtagaaaatatagaaaattcaggtaaaggagaaagaaaagtccctcatgatcctgccacccagaatgaccatccgatgtgctttcaggtcttttcctgaatttgtgtgtgtttattttttaatacagttttttaaaaatcagaaacttggctcttactccatatactagtttgtggcttatatttttcacttcatttagtgatacagatattaaaaattttctgtgtgtccaaattccatggattagtggggttggttggttggttttttggctatatgtagctagaatagttatcaagttttttttttttttttcatgtcaaatgggtaatgtgctgacgttataatgaggtttgagggaggcacatctcacccatgtgcatgaataccagattgtcatacttgtgagctataaaaggatctctcaaaatttcctaagttagcatttttcaagcttttgatcatgaccttcagtaacaggcatattttttattactgcccagtaaacatatatactaaaggtttaatgaagctgtgcccttactatatgcagtcactttttttttctcattcctatttgcaaaatcctggtttcaacccattaaattaatgttatgacccctcattggattgtgacctgtagtttgaaaactgtgtcatggaccaggttggaataggaaaacgggtctgccatctcccytgtcatgtgttctttgtcagttaacttcctttctttaacagttttacatttgccctgacaggaatatcaactggcttttactttgagaactgttttgttttccacacagatgtggcagctctgggtgtatgtgtgatcttgcggtgtagaaggaaggtatctggttagcgtcggtagttttgtatatttccagcccctagattcccttcatgtacactctgttacttgggtaaaccccagtcttctctgtaaatagtttccttttgattggtgacattgggtatttgttaaaagccacaagctcttttactagtcttaaaccagtaaagaggtacatgagatattcagaaaatcaacttaaattcattattatagaataattttaattttgtatgctttatcttttctttcttttttttagctatataagtaaaatatacattccttataaaacatttgaggccaggcatggtggctcttgcctgtaatcccagcactttgggaggctgaggtgggagcattgcttgagtccagcagttcaagaccagcctgggcaacatagtgagacccacatcgctaccaaaaaaaaagcaaattttgtagatagtggtaaagagggagaaacaaccatgattgtcctcttaccctgtgacattttagtgaatagtctttcagacatctttctatgcaaagttgttcaaccatgtatttatatgtataaaagctattatgtgcttttataactcagtagtagttgtaaatctgattcatggtgtttctaatacatggtattagaaactgcacagaagcatgtggcaaggcctggacttgaacatgacactcagcctttggtgggctkgtgactgccaactggcagtccagagggctcatttggagaatagctctacaaattccccgggaaagcattccctcaagtcgtttcaggacatgggagctcaggagtttggctaaggttcaaaagcrctaaataatttgttctgatccacagctaccaagtggcccatccaacaggacttctcaggtgaaagttgtggaggtcaagcccgatatgtttcctccatataagtacagctgcactgtcacattggtaagtatgcagctaggtggtggtrggttgacatggaggttgttttgattttgtggttgaaggtcagtaggaggctgggggagagrgtggtggtagctgggagggagaacagggtcmggtatagattgttaatgatgaagatcccatccctgatgcaaataatagctactggatgaatctgctgggttgttttggtctctttccaggtgagatttataaagtgtaggacagctgagattagtgtatttttattgagagttgccagagatgagaatctagtccagatttaacatttagctgtcttggaaccttttagcttagaaagggtgttccacagttacatttaggcaacgttgcctttttctccctaaaacagagtccagttcaacacgagtatcttaaagtaaaatagagaagtactttagtaaagcagcttattttgtttagcctagtgtttcccacagggttttccctttatttttaacataacacatattaacgtcctaatgsacaaatgtgtgacattgggatcacccttttgtagggcaggcagcatagagcagggaaataaatgctagacagctgagagacctggtccaaaaggagttctggctctgctgctagcatgccatatgccactgggcaagattctttccttctgtggtcctcagtttcactatctgtaaagtgctgcattggtttagacatctttggggcatctgtcactctcaacattctctaattctgttgatgcttaaagtatcaaccagcaagatgtcttttggcagtttctctagctgatttgattaagatgaacagattttgagagaacagctagatttttaaaaagtcttgcctcataatggcagacaggttcagaaagggtcattcattccttcaaaaaatatttattgagcacatattctgtactaggatctgtactggggattcagtagcaaacaagacagcacaatgtgatgggttaatgtctggcctgacctgatccataaggagaatgtgtctcttatcctggagatctgctcaggtttctttctcttgtgacctaaatataatcactaccttttccatgccttcactcaccactccctttggctacaggaggcaactagatttaccatttagggggaactacccctgagtagaccctctcttctgctgattagatagtaacttgtcataggagcttagatgctagagctttgagctttaatagtctgtaagtcacagtttgtcttcaggcagggcttgaactctttagttcaccagtctcaagcactctttgtttaaacagacctgctttactccaccaactgcctggaccctgaaggcatttgagtttctgaccattgagagtcaactctcctgtttcacagatagggaaggactggactggatttgccaaaaatttacagcctgtattaaaagtaaaagagttaactgcagaaaaggttaaggctcttgaagttaggctgaatctggtttgcagttgccactctcttctctgatttactggcagctgctcattctggttctgggttctgcccaggtttaacttaatttttgtagaattgaacactggtcttacttttttaggatttgggcctggctacatcaagaggccggggaaagtgcaagaatccctcttgtagctatgtctacaccaacaggcacaaacctcgaatttgtcccagctgtggtgttaaccttgccaaagaccggactgagaaaaccaccaaggctatcgtgagttccttcccccaaacacatcccctggcctgttctgggctctgttagtgaacctgtcttagtagaaataagaagatttttaaagtacatggtggtagttagagcatccaaactgaaccagttggtgggttctgaacctgagcaagtgccgccttttctctgagcctccttgtccccattgccagggtgaaggggttgactaggtatcttgatctctgagaaccaagagttcactcactgcagagaatgatgtagcacaggccttaagtaggagtgaaaggagagggacgaaagggttgcatcctcttaccgctgaggcctgatacaagacctgtaagttgatttactgtttcggtaaatagagaatgccaacctragactttgcagattagaccaccgctgctttctcaggctccttggaaagcttttagttaatcaaagctttatttctagcagtctaggcagccctcctctctgaagttgggccaaactacttgggtagtaaaatacattccacttggctccttagggctgctattattattattactattaccaggaaaaatgggcattttcagaggtccccagaatttccatatgagttttttraagtgaacagaaaatggtggcacttgaggcagcaaatggaaggactaaaataaggatgagaagagaaatgtcactggtctgccttggggaaagaggggatggcacacagaacaggtcaggacytgagatggagcctggtcactccagatcaaggctggaccttgaaaggcaggcaggttttgaatggaaggggaaggcatgccatacttaagtctctcccactagactgtagtctggtgagtgaacatgaagtgtgagtatggataaggataagtgtgagtgataaggataagtgtgagtgaacatgaagagtgttccatttggctggaggagatggcgtgggggcatggggtgggagaaggggtgttacggaaaataagacgtgaaaagcatcttggaaccatgtcrtggaaggtcttgtcagtttgttctttagtcagtggggtcctactgaatgtccttgagccggggagaggcctagaggaaagttatttcaagaggggaatttatgggatgagagtttgggagtagacaggactacagaggtggggagaactgcttcaagcttagaggtttatttgtatatggagagaggcctttttgatgatgaatctcaccctggtctccagagtctgtttccgtgcttgaggtgatgttctgagkttattgtccttgtgagaaaggaaagtggaaccaaagtatgtgggcactaatggcttggtgggaaaaacactggggctgggagtgaccctgagttggaagcttccctctcccgagctttagtttctccattggtaaagtaaggtgggcaaggtagattagatctgggcaktttactcttaagagacaggagccttagagaagactgataattgagtttyaaggagtttataaatccctgaaattgcatgcaaaatgggtccgtagctttcatcagattctcttgctccactggatgcctgctgctggaagtaagctttcttcccggattttcagtgggtttcaaagtgctcttcttgccatagcattgatcacaccccatattgactgcttttcttaactccctatgagaccacaatctcttctagggcaggtatgtctgtttttcctgcaccttctaaccctggagcttacatatacaaagtgtgtctatctgtaattaggagatagaattgagttctgtgtaggtagaagctctgagcattcctttctccttccagttcattttagctatttgcrcggtttgcagtggaagtgggtgttactctctagatctaggatgatgaaggaacttaacttctcaggtgacataggaaattatctagggacctcttgccaatttcaaatcccactcttaaacttatatccatctgtatttggttaactgagaactgcccacccccaggaccctcatctgcagaccttccatcactttccaatctcctaaagtttggagaaatacagtgtaattactgctttccagaaaataaagcactggtcagaaccacagggatcttcttgtgtgttgtcatttggagccccctggtagccagatgttttcacatctctgagatggaatggtctttagtcctttctatccttcatctctggcgagagtcacgggacagtattcctgccaagtggtcttccagctgtggtttcatagtcatgactgagaacacacagcctctcggggcagctcattctagtgttagtcagctcttctgtagccactgattaattaattctctcagccagcctatattgaatgcctgctatgggccaggctttcagagatgaataggacgtggccctttcccttgaagagcttacagtctagtgggagagaaagataaccaagctattacaaatgaaagttgtcataggtatgcggagttaataaaaagctccttattaagtgtcctagtctgttttgtgttgctataaaagaatacctgaggctaggcaatttataaagcaaagaggtttatgtggctcataatttggcagtctgtacaagaaccatagtaccaacatcttttttggtgagggcctcagactgcctccactcatggtggaaggcaaggggagccagcatgcatagagatcacatacagaaaraggaagcgaaactcattcaccacctcccttgctcctgccccacgataatctactcatgagggatctgcccccctgacccaagtacctccctttaggacctgcctccaacgttggggatcacatttcaacatgagatttggagacggtaaacatccaaactatagcattaagcatttaacttctacagagccatgtataatatgtccatcacatatgaatcagtatcttatgtgtgtctcaggcatcatgctggttgggaatcagtaaataagcagaatcctacccttactgaagcggggagggtggtggtttagcagctrtcagatgatgaattctgcagtcaaggggtgcactcagagaacacaaagcggggagtgatttatgctgccttggcaaaaaggatcagggagaagctccattgaagagagacctgcttgagaaagacctatttttaatgagtatttcagaacattgttcctggaagcctctgactggtatacaraattaccttgtacccagaagccaccgagaattaaagacagataactttaagcagtgcagatacttgtttatgtatcaaaactatcattcatagagccttcattgcaccataggcattgtgctaagtgctttacttataatatcttacttaatctgtrtaatggctctaagagattactatttttatgccccatttcacagatgaggaaattgagactcagaaagattaagtaaattgccttgggtcccacatacacagctgttaagtggcatatccagaactgaaacctgggtctgttatcctctaaaccccatacctgatgaatgagagctaagtgttgaatccattaccaagagttgtatataatcctctcatttactgatacaggttgactatcctgtatctgaagtgcttgataccagaagtgttttggattatttcataatttgcaatatttgcagaatacatactgcttgagcatccctaatccagtgattcaaaatctgagatgtctaatgagcatatcccttgaatgttgtctcagtggtcaaaaaatttcagatttcagagcattttggattggggtgctcaacctgtagagaaactgagccccacagagaaaaataaccagcctttagtcacacagtgagttattagctgagctggttaggaacctaggtttgccacctatcagtcatgggccccatctgtctgctgctcccagacttttattattttagcctgaagctggctctttctgctctgagtgcttggtgatcaatccactctcttcccaggaggtgagctcaccactcccagatgtactgaatgccacagagcccctgagcacagcccagagggagatccagcgccagtccacactgcagctgctgcgcaaagtcctgcagattcctgagaatgagtcagagctggctgaggtcttcgccttgattcatgaactcaacagctctcgacttatcttgtccaacgtgagtgaggagacagtcaccatcgagcaaacctcttggtcgaattattatgagtctccgtccacgcagtgccttctctgtagcagcccattattcaaaggggracaaaagtaagcaccccttaactctgcccctagctaccccatcccatttggctcatactgctcttttcttcagaaaacattaaaactataactgtgaagatgttattctctgccgtttttaggcttcctttaactttctgattgctgaaagtaaagtaataattggtaattatcatttctgttgaaatgcctgaaagttatcaccagattaggatttagtttacatctggactgccccacacaatgtttaggtttgggagttcattgggattggttaaattatgtaataaattcagagttacattaattgtagggatgattccacagattccaacaaagtggaaatacctacctagaaaatcctaagctccagcaaatgagaatttgccattgatcactgagccctggaactccataaagaagtctctttcccttctttttttttgttggtgatgtttctggtactagctccctggctgggccccaggagtgctggctgctgacagccagccgtctgcagacagtgactgcccaggtgaagatgtgtctgaacccccattgtctggccctgcacagcttcatagacatctacacaggtgggtgccaaccttctcttccctcagagcatcccaaagcaggcttgggaactgcctctatggatgagacctctggccctttgaggactgggccttctcagatggggcttctgaggaagggggagtcttcttcctaaatgtcttagtcccacaagatgacttttacctctcaagtgttgaagctctcaactgggatctttaaaataacagatcttcattgtggaagggctggaaaatgcagacaaataaaaagaggaaacaaaaaatcaagagcattgctactgccatgagataaacacttatttaacagtgtgatcaatcttccagaaatgtttattcatctgtgcagaatataagaaattataggatgtataggtttatagtctttctttgaacaaaagtacggttgtgctagatgttgttttggaatgtgctttttaaacttaggggtacattgtgggyatcttcctgtgccagcaagtagagaagtacatgaccatttttatagggatgtatggtgctccagtttacacttttgtgattcagtctttgtgtacagccctaatttgtcttttggacaaatactcagaagtggaattgctgcacatttaccctttcctcccctattattcatcaacatcaggcatttgtggaacactcaccgtgtaccagccattttaagactttggttgaatcctaagttttgtttgtagaattgagtgctgaagatgaaagtgtatttttgatgtattctctttgtcttagaacttaatggtgctttattttgaattcatgtttttaatgtcttatattattagattgagtttgtactattttatgctcttgccaacagttaacaaaagtgcctattaccctgttgtctatccaggctagtactcaggattatatatttatttagtcaacatgtattttaaaatttacatgtagttaagtgtgttgctccaagttccataagttctgacagatgcactaagtggtgtaactaccttcacaatcaatatatagaacaggtctatcacccaaaacattctcttttactgttcctttgtatttaaacccatccctctcccccaacctctggtaactgtttgatctcatctttatccatatagtgttctctttcccagaatgtcatgtgaaagcaattatggcacgtagccttttgagtctggcttctttcagtaagttaatcctttgagagtcatccatattgtgtttatcagtgatttattcctttttattgtggagtagttttctgtggtgtggatgtaccacaggttgtttagctgttccccatgggrggatatttggtttgctaccggtgtttggcagttacaaatagagctgctacaaatatttgtgtaccagcttttgtgtgaacctaagttttcatttctcttgggtaaatacctaggagtcagattgctgggtcatgtggtaagtgtgtgtttaattttataagaaaactgcattaccaaagtggctgtaccattttgcattccttcccacaatgggtaaaagttacagtttgctctacatgccagtacttagcattatctgtttttgtttttcagccattctaataggtgtgtctccgtataaactgtagagtcagcttgtcaatatctacaaagtcctgcttgaattttaattggattgtgttcaatctgtacacatcaatttgggaaattttgacatgcctaacaatgttgaatcttccagtccatagtctttctctccattttaataggttgtcagtttttctagtttcagcatataggtcctgcccatattttggtagacttacatataagtattttacttttttttttcagtgctaaatgacatggttcaatttctagctattcattgctagtatagaagtataattaagtttgtctgttgactttgtttttgtaaatattataatttttttaagtttatcaattttataggtaaaaacttgtgtataatcaggtaatttgttgtatttctttgtagtaggtagagtatatgtcctttttatgatcctttatgggtttttttctatagtaaatttcttttgtgttttcattcttcttttggtcttttttgttgacagttttctcccagtttatcgctctatttattcagttttacctctagcctgtcagaatgtgatatcagttgtcttttacatttgtacctggtgatttctgggggcgtcatgacttttgctttttaaaaaatatttgtatgggaccagagctttgctctcccttgtggtttcagcctttgcacttctccttacccttcttcactgggaacacatactccaaaatttgcttttgtgcagattagtgcattatgttttgtgcacatataaaatcacccacttttatttgtcttaaattgactgcgcttaaattcctcagattcattcatttcaggatttggtgttggagtgatttcatagcctttgttgtaccccttacacattcatgagctaaaggatgctcctggcctttccccaggtgaagttgtgtgaggtgtaaaggaagagtgatacctttggtcctgaggactgagctgggtgggaagaaagtgttccttttttttattgggggaaaaagatctactatatgtactatttcattattttttgtttgtttgtttaatgatgtattataggcaactttgcgtcagaacagttagatctacttctttttaaaaaaaaatggattccatgttggaatactttattctttttaatgctttctattttatgaattcaccataaattaattaaccctttccctattgatgggcatttagttgtggggtttttgttttgcctttttcaagatatataacttgaataaaatagagatggggctttgytatgttgtccaggctggtcttgaactcctgggctcaagcgatcctcccaccttgggagactacaggtctcccaaagtgctgagactacaggcatgagattacaggccatacctggcctgttttgtttttttgagatggagtctctcactgtgttacccaagctagtcgacarctcctgggctcaagcgatcctcctgcctcatcctcccaagtgcctgcaactacaggcacgtgccaccgcacccagctggtgtgtattctattttttgccattgtgtatgatacattaatttccttgttgcctcttcttaacctgcaggtctctttaatgtggggaacaagctgctggtaagcctggacttgctttttgcaatcagaaatcagatcaagctcggagaggaccccagagtgtccatcaatgttgttctgaagtcggtgcaggagcagacaggtaaaagttgttttcttccctttcccaaggttagtcctaagctccctcggaattttcagtgatggcatttggttaaaagactcattttgaagaagagtctgattattttgaaaaggagacattcttgacttcctaatacactcttccttttgaattttacaaatgccaaactaattttggaaagcatgaatctttttgtgcatccagggacccttagcaagagattacgagtgacttgtagaagtaccttctttgktcatagggagacttggccccattgcatgttagactcattctgaccacacagctcctggatatctgcttccagtcccaaggctcatgccaagacctaagagtgaggaccatcctttctgtctagaatatttttcctccatgccctctttactcctatttgtgcttttcccatcccattcctataggctccaatccccctctaccttacctgctgtgagaacagatggagtagagcctactagagttacatgggcctgtgtttcagtcttggctctgccactgttgcagtgtgattttgagcaagttattcttgtgcctctgtttctccagttataaaatgaggataatagctcctcgttcataaagaattaaattgaggtgagattaatgacataacatatccaaagctttcagcacagcatctagtacttagtacaaggcagctatcactccagtgggaattgctctttgggttgccacctgagcacttgcaggccagatccctgaccctcagggtaggtagtacactggagtgttctttaaggtgaatcagtctggcagaattgctctacttactacccactggctcatccctagtggcttcagtgtctttttctgtgcccttctcagtgttcttgctcttctttcagagaagactctgacctcggaggagctgagccagctgcaggagctgctgtgcaatggctattgggcctttgagtgcctcactgtccgagactacaatgacatgatctgtggcatctgtggtgtggcccccaaagtggaaatggctcagaggagtgargagaatgtgctagcactgaagagcgtggaggtaagtgcctcttagccaccgtgagggacctgcggaattttctcattttggcacctcccttcctatatgatatccccagggggtggatagctccagtcctgtctaggtgaggcaagtgagtttttcctcccacagcccaagatttcatttagggaatgccagatggaaatggaggcatttgtttattcagttactcacttgaaaaatgtatttatccagtgaataagtatcaaaaaatatatatagtaaatatattgaacataaactaaatgcatgttttagacacctgggagatagtagttaaacaaagtttckgtcctcatggagctcactttctggtttggaggacacaggaaacaaatatctgtccaggagtagtgagtgctgtgaagcacagtaaagctgggtaagagagagagaacagtgtcatgggaaagggcatttgtattttatagagggcagtgaggggggaaggcccctctgatacagtagcatttgagtagagatctgaaacccatgtggctttgtggaggaatattccaggcagagggaacagctcgaacagggtctgaggaaggcttgctgggtatgattgaggaccagcaaggagaccagtggtgcagctcagagtgtgggagggagggagggagtggtggggtgtatgaggtccagacagtgcaggaggccgacgctatgtagggtaacatgggctattttaaggacttacacagagtgaaatggagagccactgaaggggttggaggaaaagagtgacctgagctaacttaggttctgaactgaaaaattttcacacaataataacatcaaactcagatggcttcatagattaattagaacaaatatccaagaaatattattccaaacataggcaagtaacaaaagtgggcatgtttccccaactcatcatataaggttgtataactttggaaaccaaatcagacatttgatgtaagagaagaaattggggctgaatatactcatgaatatagatgaaagtctgaataaaataatagcaaatcagatctaacacagtaatgcatcatgacaaacttaaacacaggaaagcaaggttgtttcagcagtaggaaatatgttaatgtaattcactacttaaccgattaaaggggaaaccctatatgataatttcattaaatgtatggggaaaaaaaagttgtccagtatgattctacacccatatttatgataaaacttttagcaaacagaacagtaggaaatcttccttaaccttctttagggtttaaaaaaaaatcccatagattacttttccctgtgatcatgctatgaggtctggtctacactcacaggcagggactgcgccttgaatatgccagtagttgcataggagtgtgaggtttccatctctgaactctaccatagtaaacaagagcctgggacatgagctgactttcaggtactggacttgcatctcatgtgttcactgatcaggcaggtgcagaacctgtagagaacagctttggtgtattctggcaggaccactagacatattaagggttgaatgcatagtcctgtcttttacttcccaagtaagaaaccaggcaactaaaccattttgtttgtgttatctcatctagaggctgtttccagattgattcaaatccgcttgyctagtagtagtgttaataataatgcagctaagatttattgagcattttattactatgccaagttcttaatctgtgctaagtgctttactatatgacttaattttccctacaaccccatgaggtttttatagacataggcactgaagcccaagggccttgcccaagctcacccagccagagaagggtggggctgagattgaccttgctctttctcagccgctgactgtggagtctgcaccctaagcactgccattctcaccagtacctcctacgactctgagttctgtttcttctgatcatatctggccacagcaagtttatggtttccaagaatagacagaggcccacctccctgcaaaggtgccatctcctagtcctgcctggcacccgtcctgtcccaatcaaggctcctctgtcccagaatggagtagcattcccttcactctcagtttgcttgtctctttccttcagtggtaccaggtacttctttcatagaggtacttctttgttttgtgtgtggagagtagtgtggtatgtgtggggagagagtatcctgaagtctgtgaactaaaacaggaagttattgaacaaaacttaaatatgctgttatccatgaagagacttgtcagcccctctctcggagttgtataaaggaggaccctgtggttagtttgtgtactgggttggcatttcctgttcccttgctccttgtggagaggatagactcagctggcctcattcccctaggtgtgccatttacacagagcatgcactaagcacccctgtgaggtggcaaacaaagaggaataaggtgaggagaggagcctttatggggagcagtggttcttggactttagtgggtataagaactacatagggcagtggttctcacaactttttacagtggagggcttgctgggtcccacccacaggatttctgactcaggagatctggagtggggccaggaatttgcatttctaacaagttgtcagatgatactcttgctgcttgtccaggaccaccctttgagaaccattcctctgaggaaacttttttaaatgcaaaattaggagtttagttcatacagctcaagatgtggccaaggtttttacatttctaataagtaagctatacaactgtgattgaggtattaggatccgggtcacgttttgagagccatataagagggcattgcaagaagaaaaattgagtagcacaagcgctattaatagatgtctataagagataagtaaatgctgccctgggtagaggagatagctgtgtgctgatgatgtgtgggaggatgtcggcaatccacagggccttggaaaatggctggaattttactcaataggattctgctcgttcttgccagcctggtatcagcagtaagggtttgggctttggaactagacctgtgttgacgtgattgttctgtctcttcgagtgcttgaatactcacctcagccatccccagacttgttttttagtagttcattacaaagtgtctggcacataacaggtactcaaatggtagctccactttctttgtaagacagggaaaatgacataaacaaaggtatagaaacagaagggatttaggaactattcatgtctgggagagtactatggtgtgagggaaagaaatgtgaccaaaaggcaggtgggtacagagctgtcaaattcaaggccctgtggcagtgcctggctgtctgacttcccttcaccaagccttggcttccctgtgtgtataatgacggggtagrctgttgtgttgctgatgttctgtgactcccacagtttgaccwtctttatcctgaccttctagttcacctggcctgaattcctgggctctaatgaggtaaatgtggaggacttttgggccacgatggagacagaggtgattgagcaggtggcatttcctgccagcatccctatcaccaaatttgatgcgtctgttattgcccccttcttcccaccactcatgagaggagctgtggtcgtcaacactgagaaagacaaaaacctggatgtgcagccagtacctggtaaggccacctggtggctgactggggtcaaaaaagggctcagtcaagagtctgggacattgtccatggcaagatagcacagtggtagcgagagggccaggccccgctgcaggactcctttcagaaagataataacagcccgtgtcaaaatcccctagagtttaaagttgtggtgcagagttttgaagagctgtcctccatcttacatagcaggggcgcacagctcattgtcagccttctgggatacacacactgagtagcagaactcctataaaaaatgctgataaggctccatccccaaaggttttcattgagcaagtgtaggggcaggccaaggaatctgccttcaaaacaggcctcccagagggttttgcagctagttttatggattagacattgagaaaccctggactagcgggtaagaggataggtttctaacagcttgagtttgattcccagctttgccacttagctgtgtgaccctctgtcaggtcccatcattgccctaagccactgttgcttcttttacaaagagggtgcgataatagctacccacttcctagatcactgaagataaagtgagctaatgcggttagagtgatagccgccttttttaactgtaacccatagtgagaaatacattttgtgtcatgaygcagaatgatattcgtacatatgcaagtgtgtataactgaaacaacattcccaaaacagtatttttctttattttctatcttatttcatttttgaatttttggatatgacccactcaattgatattgtaatcacttaatatgttgtgatccactggttctcaaacagtgcttcctaatattagatattgaggctgggcacggtggctcacgcctgtaatcccagcactttgggaggcccaggcgggcggatcacgaggtcaggagatcgagaccatcctggctaacacggtgaaacaccatctctactaaaaacacaaaaaattagccgggcatggtggcgggcgcctgtagtcccagctactcaggaggctgaggcaggagaatggcgtgaacccgggaggcggagattgcagtgagccgagatcgcgccactgcactccagcctgggcgacagagcgagactccgtctcaaaataaataaataaataaaaataaaaagatactgaggtccacctcatattcctgctaatattttaagggcccaggcatcttttttttttttgagacggagtcctgctctgttgcccaggctggagtgcagtgttgtgatctgggctcactgcaactctgccttccgggttcaagcagttctcctgtctcagcctcccaagttgctgagactataggcgcacgcaccacaccaccacacctggctaattttttgtatttttagaagagatggggtttcaccatattggtcaggctggtcttgaacttctgacctcagataatccacctgcctcggcctcctaaagtgctaggattacaggtgtgagccactgcacccggcccccagggattatttttttaaggtgcccccacatagttctcttgtgctagccaggttcaggaacgttgtgtagagggcacttttaaaccgagagctgctgttcttttcttattgatgcagtcatggtaagcatctgaggtcttggttctgaaaaaccttagaagactggattaaaagctgacttattttagggtttttttcagtggcggtrtgcaggatatctcactcagatgttccagggcagaaagccagttstaatagacttcaaatatctgcagaaagcgtggacctgacttgagttccacctctgccagcactgggggagggcttggtgcagagctggyttccactgtttgctgttttgtgggcctagccttggcctctggtgactggcggcagcaccctcccaccagcactgttgtctcttgcaggcagtggcagtgccttggtgaggctgctccaggagggcacctgcaagcttgatgagattggctcctacagtgaagagaagctgcagcacctgctaaggcagtgtggaatcccctttggggcagaagactccaaggtgagtgtcaagggcagtggtggatatcggggcttctggagtaggctgattggtccactttttaggkcagggatatgaatatctgtgatggcatctgccttggacacaaggtgctggcagtcagggatgcctaggagatggtcaacagctagatgtgacatgtatgtggggcctggcctctaacagttcctcctgttgaaggttgtgagcctaggctctggggtcaggaatcctggctctcctccttactgtgtgtgaccttggataagctgctttatattttgagcttcattttccttgtttgtaaaatggaaataaccaaaatactaaccttgtgagattgttgtaaggaatgcactttacacagtgtctggttactacctatgcaagctcttagaaaatgcctactgttacatagtgtatgtgtctatgtgttttattcatacattatttactttccctttcatatttctgtgctgttgaaaatgttatgcttccttcaagatcagattcaaatgttagctcccctttgatggtttctttgccctgtaaaaagtgaaaggactcaggcctcagagtctggcagcttgatcagcagtctggctggctttgtctgtgacctaatcctttcagggcctccgattgcttacctgtacctagaggaggttgggctgatgaggctccaaggcccgctctgacccaggcagtttattcttttgctttgggtgttgggtgagtgtgtgatgctgagcaccagccgtggtcccttagcattygcccttatgtttttaatcttgtccttctactccaggaccagctctgcttctccttgttggccctctacgaatctgtacagaatggagctagagctatacggcccccacgtcacttcacaggtggtaaaatctacaaggtgtgcccccatcaggtaagaaaataactagggggagcttggagtgaatttgctaatktygaacmwcccatacagggactgawccagctcagttttggggggctagacttaggtcactgggcaacctccggcatagctgcccacgggtcaggtgctaccccstgrgctagggagggaggctgggtcttctstcagtattttttaagcaccctaccacatcctgggcatcagctgttgagggtataagggcgagcttgtataaagaatgacaaagatgtcgttcctccctagttgaccgtatattttagtggggaaataaagtcaccacagcttgtggcattggctctgaagaaattagataagggcctaagatagaaagtaacagggaggaacctgctgtctgaggtggcagagaagactgagacctgcaggatagggaggagcccattggtaagccagggaaggagtgtcacagccaagggaccaccaaggccgtgagtggggagacagagtgagctgagaggagggggtgttggagggctcccccggggggccagatcacatagagctctctaggccagagtaacagttcgtattttattctgactgatgagggaccttttggatggttttgaatgggaaatctgtggaagggtrtggacaaggtggcactgggttagctccaggacaggttatgtactagatgacagagtgggcccaggtagatcttggaacggaaaccccccccccttaacaggtactgaatgggagagaggtggcttatcagagccttcactgaagcacatgagtcagcagggggatctagctgtaaaaagagaatccagttcccaactactttaacagaagctgtgtctgaaggagatgcttaatgcttctactctgggcagatcagagcctgctcagggaattgtgttcatgcgacaggggatcatctcatgagaagcagctgacagcayggggagagctgtagatcttgggggctgtgatgggagtggcatcacttggaggtgacagccaagtgggtgtacccagagttgtggaatggtgcttggggggccctgtcagtggaggtgtttactaggctacattgtggattcccatctgggcaacaagcccactggggtctggtggggagcttgctcaaaatacagatgcttagaccctacttcagagaccttagtttcttaggtttgacctcgggcccaggcatctccattcttaaccagctcttagctgctgctgctgctatgtagctagcatagtgaactggtaggtgatgtggagagagtggggttttgaaagatgttctgaggtgcctttcagcctaagttgaggacaggatgctcccagctgtctctcagaagggcaaggatgagctggtgacttcatttaaggacagaagtaggaagggagcagcatgccatgggctctggcaggatggccatggcttcggccctgaagctgattgctcatcttcctrggaagaagcgagtgagaactgtacactctctgcagactggcttcctaattaaccctgcgcccccsacccttcatctcccaggtggtctgcggctccaagtatcttgtgcgaggtgagagtgcccgtgaccatgtggacctgcttgcctcttcccgccactggccgcctgtctatgtggtagatatggccacgtcagtggccctgtgtgctgacctctgctacccagagctgactaaccagatgtgggggaggaaccagggctgtttctctagccccacagagccacctgtggtgagtcacctcctgaggaactgccatgtctcctcaagcctaccatgtcttgctctgtcacccaggctggagtgcagtggtgttatctcggctcactgcaacctctgcctcccaggttcaagcagttctcgtgcctcagcctcccgagtagctgggattacaggcacacaccaccacacctggctaatttttgtgttttagtagagatggggtttggccattttgcccaggccgttctcaaactcctgggctcaagcaatccacatgcctcagcctgtcaaagtgctgggattacaggcatgagccaccacgcccagcctactccgtaagtttttactgaccaagccctctgtttgaggccacagtatatcacttagtgtgcccaggatatcccaaaccttgtgttaaaagaggttgccttccagagaagcctagaaagttgccacctttgagagttattgtgcacactgacatattaaaggccccagccagccctggattagtttaattcaccatgtcttacatttagttgaccatggataacactgtatggcatgcctgttgtgatctgaagatacactggtttagaaaacactcatcttatccaaccctctccttttattaaaaggggawgctaaggcccagaggaggaaatggacttttccgggtcccacagcagattagtggcagagcccttgtctctgtgtcttggtatattgtaccagacagtatttctcaccagtcatgtaccctccaaggccagcaggccagcctttggcctttgctgaaatagatgtcagaactgataattaggaagaagggaagaataacaaaggttgagtgccccagccaggatgcattataggaagtgaaggcctctggctttgcctyggaggagtcattattgtcattactccctggggctcactggctccatgagcatgctggggactccagaaaagtgtcttaacctcagtcagagcmtgatctttctgctcccytgcagccactggcctgaatggaccgggggcaataatagcataagtaatccaacatctgttctggaaggtggccactgttactgtccctgttctcacatgaggaaatggaggcactggcgggcaggggttggcctaggagacacrgtacatggwgatgttaggattcaaagagggctggctgagcctagagtgttctcrtcaccagatgggttccaccttagtcattccttcttrtcaaaatgcattctcatttctcttctagagtgtgtcctgcccagagctcttggaccagcattatactgtggacatgacagaaactgagcactctatccagcacccagtcaccaagactgccacgcggcgcatcgtccaygcaggcctacagcccaatcctggtgaccccagtgctgggcaccactccttggccctgtgccctgaattggcaccttacgcaaccatcctggcctccatmgtggacagcaaaccaaacggtgtccgccagcggcccattgccttcgacaatgccactcactattacctctacaaccgcctcatggacttcctcaccagccgcgaaattgtcaatcgtcagatccatgacattgtacagagctgccagcctggtgaggtggtcattcgtgacaccctctaccrccttggggttgctcagatcaagacrgagacagaggaggagggtgaggaagaggaggtggccgcagtggcagaataagccaggctgttgtacagggactacaccatctctcaagccatagtaaggcccttgcctgaggcagagctatccaggggamctgcagaagkggtctcctgtggggagggcctctgactgctgggactgaccaaagagcttccattccctgagcatggtgggacccagggtcctcagttctcaaccctccaggggtcaggagtggtaccaggaaacctcttctggccccgagagagcacttgggggacacggtatgtttaatggaggggaggctgagggaaaggctsrtagctggtgggttccgtggggcctgckgtgtgggtcagggtggaggtcctgggtgggctaaggcgtgagccccagcactaggtgggaaggctgctgaggtctctcccacccctgaggagccctggtttcagccccctcagtctgatgaattgcttagcctgttgcctttgactaggggcctgggtggcctcattaactctaggggtccctttgggctcttgattctccctgaaggagggatgcatttctctcttgctcttcctgtacccacatttgggggaagctgaggagggaggaacagtcagccacagctctcttccagcactgtcctctccaccccaagctttgaggaagagcatccccttcctcctttccctggccactgctgctgcagccaatatcctctctgggcctgggaccctctccacagaggggatgtggtccctggtcatgacataacctagcagcagtaggaaaaactcccttctatgaaggggaagcagactgggccataaggaaacagcaggactggctcaagtgcccaaggtttgtttagggcctgggaattggccrtgtgttaatttattgagtggagtaggtggctttttttccctccctcttcccccaacaagaataaagtttattaaattatctggttttggtgtagcaggagtcaattccgtgcacatcgtatggggcacagtgtggtcaagctccacagctgtgagctcgtcacttcatgtgaaggagggaaggaaagaaagacgttccagggaatttgcaggtactcatgtggcacaaagaaccagaggctgactgcatyaatgctgttagtttaatgtggacagagacatcccackgcgtgactgttagttaggatgagtcagcttgggggagtttgtgcttcctgcttggtgtggccagccacatgccaaggtcccctgccttctagcccaraatgacgggactgggcagaacacccccaacttttagctgccacttggstcattacagcagtaccagtatgggggtgggaggggtgaggctgtggagtgaaggcggcgtatagggcagagactragaggtcctgtgagattcttagaggagccatcctgctccaaggggcctgagctgagtgtggtctgtgagcatctgctgctcctctcagagagggagatctcactctstgccagtctgtctagccccaaagagcctggttttctcagtatcagtgtagctcctggggacttcataggcataaagtcagtccatttccatgaagataaggggattaggaaagaaggttctactagttggcatagcaaacacgaggccaacaccatgagaacagtaggggaggcggggggtgagggctcagcccccagcccctgactggcagtgatggcccatgctcaggaagtgggatcctctgacctcccctgaatccctcaccttcccaagtttcagagctgggccgagctgttgagtgaaatgaccgaaggcagagtttgtatgttctccccgtgtcgccccatccatggaggagttgaagtttggaggaggggagagtggtactccctgtcgtcaactcctcagcagaactgayagttgttgggctgcagcaagggctgggcgatatccccttgctcgcagcaggtcaggtgctcactagagctctcctcctccagctcactgctgctgctgccgctgccaccgcttctgctgctgctcggcagattggtatagtcctgagggtgggagggaccagaaactgtcagtccagatccatcaggcccagcccaacgtgctttaccggccacccaccccaagcctcaccccactcacccgctctctcctgtcctcttgggcctgctcctgaaggaaggagcagatctgctggaaggtgggtctgtgggtgggctccaaggcccagcaggcctgcatgatgctgtatctgggagataggacagaggatgcccatgggcagctccctagggtccaggggccattaacacacacccctagagagacctacccagcagaggtccccaaacccagtcaaagtaagtttagtataaaacctatgccaagtccttggcatgctttaccatttaatcctcacagtaacccttgcagaagggtactctcatcaccctcattctgacagatgaggccattttggtatcctcagggtaactgtaataacgatctcttaaaagtctgtttagggacaggtgcagtggctcattcctgtaatcccaacactttgggaggttgatgcaggaggattgcataaggccaggagttccagaccagcctggacaacatagtgagatcccatctctactaaaaaattttttaaaaatagctgggcttggtggtgcacacctgtagtcccagctgtttgggaggctgaggccaaaggattgcttgagccctgaagattgaggctgcagtgagctatgattgcacacatcactgcgctccagcccgggctacagagcaagatgctgtctcaaaaaaaaaaaaaaaaaaaaaggaaaagtggtcggttaggaccagccctagtgaacagctgcttctctgagaacatcccccatagcttgaactcaaaaggggcttgttgtgtccactatgggagagataaagtctgaccctggaacattttggacagggaaagatcagggccacacggccttccatccctttccagcgaaagcctggggtgtccttttccctccctgggatcccttcgcttacatattctttggggcaaatgcaggctgggccatttggtatccatccttcaccagtttatagaacttgctgttcaccaggatgccagggtagggattcagccctgcaaaggccaagatcaggtaagaggccatgcccattgtcttctccccattcccgcacacccacacacatcttagactgggtttaaagggtcccacttgacaacactgcaacagcagctactcttacccggtgcttcctgtgtgccagccagtgtgtggcaggcttaggctttaggaaggtgtgagcctctatccaggccttatcacaccaaacattcttgcacaggctttggaatcagaccaaagcttcagctgtgtatcgttaaagtgtggacagtcaggtggttatgagggtataggagcagcgtatttaagaactgagtacaagtccttgtgcctagtcctcgggaaatagcagttctttctactagagcctagtagtagagagctgcatcttcaagggtctgtagatttcagacaaaggagggaaacagtgacaaaggagggtaacaggtaacagcaactgagcagagacaaacgagggaagagccagaaaggagcgcctgtcaggggcagagggtctgccgagtcccgcaggagccacgatgctgggtttcgagagcccttgcccattcctgcactctcaccaaccctcgctgtgtcctgggcaccaaacagctttgtccaccagtggggcaaccagaggagccagccccaggctctgcctggagtgggcccagtggctcaccaagtgagaagatctcccagaggaggatgccataggaccagacgtcgctctgaaccgtgtagacacagtcaaagatgctctctggggccatccacttcacaggcaggcgggcctgggatgacagtccccagttattttgggccccgactcttcaccccctccccagcctggcccaagccctcccagcacttacattgcccttgacaatgtagttggagtcattcatgatgtccctagccagcccgaagtccccaatcttggccacatgaccattggtcaacagcacgttacgcgctgccacgtcccggtggatgcactgagggaaagcactgcagggttagtcttgggccttctcctacctgagcctgaggtgaggaggatggcagggagggccccacatggctttggagtccctgctggagtgaacaacagttttggtcctttaccacaaacccttgtctataccttctaccagggcccaggatctgagaatgtgtatcgtgatctgatcatttaatgcttagaaacccccattaccctgagcagccatggcccttctcaccctttgtcctctgactggtctgctcaggccccagaagcgaagggcttccgtgcagagagcagtctccaaaccctaccgttacttctgatcatagcagctgctatctgccaggcccttccctaaactctgcacacattgaaccctttttcttttcaacaatcgttatgcccatttttataggtgtagaaactgaggcacagaatttaaatagttgcttaaagtcacggagcaggtggcagagccaacaatcaaaccactgactcccgaatctgttctaaggaagatggcaagagctcccattccctggcacttcttcctaggccgagcgcactttatacgttatctaatatccccaaaattctgaggaagcttccgttatcatccccaccagaccrcgtgctttatgagcagagacaactgttgtctctcatacactatttagtaaaaacgaatgaagaaagcctggtacccttcctcatcttcacgctggggacacaggtgcccagccccagagctccagccctgggcacagctttctcccactcatccttgcagctgctgcccaaatgactctctcatactctgtctcctcccctaccccctcacaggctcccgtttcctcctccccatcgtcactcatccagcctccccggagcacagacctgggtggctatgagccagggccaggttcctactcacattcttggaagcgaggaaggccatgccctgggctacttggctggagaagtgaagcaggtcccggagctccaggggccgtccatcctccttgtccaggtctagggtgggaagaggcgtcagggcagccctgccacactccccacccctcaccccagcagccccttctccttttcccttgttatcaagcaaatggggcctggccctgggacctcctcaccttgctcagagaaggagtcatttgaagaagtggagacaggcctcatctccacataggtgtccacaccctggctggagaagccactgtccctacataggagagagggttggggggcagaggtcastcatcatcactgcactgctcagctcaggccttgaccacccaccaccccatggtcaactggaacctccctttctgataagaaaccctcctgccacactccatctgagtgagcattggtctctgctyggctgtccccggtgagggagcttacaacccattctggttttgggcagctctgcctgtgagaaagttcttcactgttcctaatgccaatctacccctgagattttcctcctagcccctgctctaccctcaagggccacagagaagttggagtcctcttccccataacagccctactagaattggggcatattctagggccccttgtgccctctcttctctggacagtgcctcacacccctggcttcacattaaaatcacttcgggagcttttaggatcaggctaattactaatacttcagaaactctagggacaaaacagtcattcacagatttaaatctccccaggtgatcacaaagtacagcctaagctgaggcccactggtctagagcagtgctgcttacgctgcaactcatgtgcagataaatcaccccgggaatctctgcaatgcagattttgaatcagcaggcctgggtggatgggcctgaggtggtgcacttccaacagtcctcaagagatgcctatgagagcacacttggggtagagaatttgagaagcactactgtagactgaagcactactgctcctaacgttccagccagataggatttctctctccctcctgtcccctctgcgctagagatgtgtaccttgacaatgtccatattctagtgttcccagaaggagaaaccgaaaaaaccttccgctcccttgtagaaactatgcttccgttaacagcctggaatcctttgacagagttggtttacaggccatttgccctcgaaattacccactctgggaatactttccccatctgcgtatttgaagatggaagctaatactttcctttggtgctcattttgatctgatcttcagaggcctagtgtgtgccaccctcatagaagtgtcagggaatcagaagaggaagtgatgctgccaggcccccatttttaaggccctgggtgaagagatggcctccttctcttttgcctccccaggcgtggcagctgacagtatctaggatgagggcgcagtgtacacccttcttgttctgatcctgtcctgaccccacaagcccctgagacagagacctccaggacagcagtgtggcttgggtgactcctggactggaagtcaagagagcaggattctagtccaggctccacctctaaccctgactcatgtgtgacatgaatctccccacttcctctctttggttccccatgtggctctgtctgttggatggctctgttctggatggcttccaggaatcacagcaacaggacaacagagccatctctctttttttttgagacggagtttcattcttgttgcccaggctggagtgcaatggtgtgatctcagctcacagcaacctctgcctcctgggttcaagcaattctcccgcctcagcctcccgagtagctgggattataggcatgcgccaccacgcccggctaattttgtatatttaatagagacggggtttcaccttgttggtaaggctggtctcgaactcccatcctcaggtgatctgcccgcctcagcctcccaaagtgctgggattacaggcatgagccactgcacccggccacatctgcccatctcttactagggctccaggcacagatcttggttgatcttttacacacactgggtggtgatttcattgatgcatatctccaccagattatgagctgcccatctttgccctccacactcccagaacacggtaggtgttcaaatatttgttgaatgaaggggaaaaggagtagagaaacaagagatggccataaaacctgtggtggctacttcccatgacacaggtggcaggtgagggctgcatagccacccattcatgagccatccaaccctgagctggctttgaagacagactcggatcctgcctcccagacctggcctttttcttgtcctttgccagggrctacctgcggacatatttcttytcgaggtggatgttcttatagtcgacgcctccctcggggtcctggccggggctcaggctgggtcccagcatggcctcagccttccttcgcagaaagttgagcaggtcgccatagcaacagtactccgtgatgaccagtacagggcctagagcagccaagggtgtggggtgagggaggtgctgagtgctcccctccatgaacaggagcatgagactgk

SEQ ID NO: 17777 - DNA, 16914 bp, Homo sapiens
aatttaagactgaaagtttaacatgcttattttgttaccagccttctgtgagcccaagggctatttgctttatattgatcctatttggatccttctgcgaagcttaaaatggccatgagacacgggttaggtcatggtgaaaatggtaagaagccactttagtttcttcctgccaaccttccttcttgaatcagacactttaatttcaattgctatgagatcacatagtggaaacatgtattcccagagggtgatacagtgcaatactatccttaacaggcaaatccaaggcatagccagtcccaagttgatcactagtgcaaatcataaaatacctaagtaacttttaggtgactttctcataaacaccagaatgacatgggttttcttaacaaaatatcactggtttgagacctaggatgcttctaaaacattgttattgctcccagatttcctttctcagagaattaggagagaaacaaaggtttgttgaggacctgttatctataagttgtttcaggtgggtgctttatgtaatttgttcataaaatatacatatcaggtattattattgtcttcattttattgatgagaaaactgaggctcagagagattgagtaagtaatgtgaygaagattctgcagagtaatgtatgtttagtcagcactgaaacccaagtcaatgggtcttgtttctaaaacacatgttcttttcactctaccatacgtttatttcagtgaccagatacatgtagttttctgacctagaaataaagattggattcattatccataggcttctgagttcacaaatcaccacagccagtcaactacctgagagactgttgagtcctcagctttaaacaaagttttctacttccctccaagttgaaagtgtaatagagacataaaaaacccttcaaaaaatcaatgaattctggagctggttttttgaaaagatcaacaaaattgatggaccactagcaagactaataaagaagaaaagagagaagaatcaaatggatgcaataaaaaatgataaaggggataccaccaccaatcccacagaaatacaaactaccatcagagaatactataaacacctctacgcaaataaactagaaaatctagaagaaatggataaattcctcggcacatgcatcctcccaagactaaaccaggaagaagttgaatctctgaatagaccagtaacaggctcctaaattgaggcaataattaatagcttaccaaccaaaaaaagtccaggaccagatggattcacagccaaattctaccagaggtacaaggaggagctggtaccattccttctgaaactattccaaacaatagaaaaagagggaatcctccctaactcatttcatgaggccagcatcatcctgataccaaagcctgtcagagacacaacaaaaaaagagattttagaccaatatccctgatgaacatcgatgcaaaaatcctcaataaaatactggcaaaccaactccagcagcacatcaaaaagtttatccaccatgatcaagtgggcttcatccctgggatgcaaggctggttcaacatacacaaatcaataaatgtaatccagcatataaacagaaccaacaacaaaaaccacatgattatctcaatagatgcagaaaaggcctttgacaaaattcaacaaccttcatgctaaaaactctcaatatattaggtattgatgggacgtatctcaaaataataagagctatctatgataaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaaggacattcaattaggaaaagaggaagccaaattgtccctgtttgcagatgacatgattgtatatctagaaaaccccattgtctcagcccaaaatctccttaagctgataggcaacttcagcaaagtctcaggatacaaaatcaatgtgcaaaaatcacaaacattcttatacaccaataacagacaaacagagagccaaatcatgagtgaagtcccattcacaattgcttcaaagagaataaaatacccagaaatccaacttacatgggatatgaaggacgtcttcaaggagaactacaaaccactgctcaatgaaataaaagaggatacaaacaaatggaagaacattccatgctcatgggtaggaagaatcaatatcgtgaaaatggccatcctcccaaagtaatttatagattcaatgccatccccatcaagctaccaatgactttcttcacagaattggaaaaaactacttgaaagttcatatggaaccaaaaaagcccacattgccaagtcaatcctaagccaaaagaacaaagctggaggcatcacgctacctgacttcaaactatactacaaggctacagtaaccaaaacagcatagtactggtaccaaaatagagatatagaccaatggaacagaacagagccctcagaaataatgctgcttatctacaacgatctgatctttgacaaacctgacaaaaacaagaaatggagaaaggattccctgtttaataaatggtgctgggaaaactggctagccatatgtagaaagctgaaactggatcccttccttacaccttatacaaaaattaattcaagatagattaaagacttaaatgttagacctaaaaccacaaaaaccctagaagaaaacctaggcaataccattcaggacataggcatgggcaagtacttcatgactaaaaacaccaaaagcaatggcaacaaaagccaaaattgacaaatgagatctaattaaactaaagagcttctgcacagcaaaagaaactaccatcagggtgaacaggcaacctacagaatgggcgaaaatttttgcaatctactcatctgacaaagggctaatatccagaatctacaatgaactcaaacaaatttacaggaaaaaaataaacaaccacatcaacaagtgggcgaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttgaggggactgtaaactagttcaacccttgtggaagtcagtgtggcgattcctcagggatctagaactagaaataccatttgacccagccatcccattactgggtatataaccaaaggattataaaacatgctgctataaagacacatgcacacatatgtttataggggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaagccatcattctcagcaaactatcgcaaggacaaaaaaccaaagaccgcatgttctcacttataggtgggaattgaacaatgagaacacttagacacaggaaggggaacatcacacaccggggcctgttatggggtggggrgagggggtagggatagcattaggaggtatacctaatgttaaatgacgagttaatgggtgcagcacaccaacatggcacatgtgtacatatgtaacaaacctgcacgttgtgcacatgtgccctaaaacttaaagtgtaataaaaaaagaaagaaagtgtattaggttgatagctcccaagtgatacagttttaattctttgaaaaaagattaaaaaatcacaatgtacctaattttgaaagtaaagctaaattatgaatgtaaaggacttcccattatgacctttgtccccaactcatgagtgtgtatatgtgttttctttccttttttgacatttaaaaaattatttattttttagagatgggatctctctgttgcccaggctggagtgtactggcatgatcacaactcattgcaatctccaactcctgggatcaagagatcttcccgccttagcctcccaagtagctgggactacaggcatgtgccattacacctggctaatttattttattataattgttacagccaggctctccctatgttgcttaggctggcctcaaactgctggtttcgaactcctggcctgaagtgattctcctgcctcagcctctctaatagctgggattacaggcaagaaccactgcaccaggcaactctttttcttttttgtttttttttgttttttgtttttttgtttttttgtttttttgttttttgagacggagtctcgctctgtcgcccaggctggagtgcagtggcacgatctcggctcactgcaagctccgcctcccgggttcacgccattctcctgcctcagcctcccgagcagctgggactacaggcgcccaccaccacgcccggctaattttttttgcatttttagtagagacggggtttcaccgtgttagccaggatggtctcgatctcctgacctcgtgatccgcccgcctcggcctcccaaagtgctgggattacaggcgcgagccaccgcgcccggcctctttttcttttttaatgaaataatagagctagtagaaaatagtttgctttttaaagtgcttacttaataaaataaaaagtgggcaactcgaaataaaaaatcaaacaatatctaacatgtttaaaagatttttaaaaatcaaaatataaaataatatcaaaatttaaaaactgggattctgttccccaaagttctgttcaaatctgttagatttatcttcccttgaccctaagtaatatcttgggcaagccctagagcttctttcctgacccttagttaataagatgttatctggtcacattcagtcacaataatagactcattttagtaataaacatcttaagactagtaattaaaactctttacttcacaccaagtttcctccccaagcttggcctgttcctggctggcagcctgaagtagggaaaggagagatatggtgaccttttctttgtacctttctagctaccctctataccctgaccccacatacataattgagctgtggcttctgactctactgggtttggggatgagaggcattgagagtaaaatgaaggagtggttttaattaatggcacagctaaaactggattttgttctctctgcacatggcagatgtttaaagctcattctttcttttatgcaagtttttacaccatccagcctcatttgtacctcttgaatttttgctcagtggcctatcaccattcaggatcaagacaaaaatcaatgagcacttattgtgtgtcatgcaccctacaaagtgccaggatatttatccaaactcctggcaatgctaaacacaatgcaaaaagacatattagaaaacgaatcttattaactttaacttttcaactgtatttcatcataaagtcttactttacaagataattgctgttgtgaaaaagggaaaggtcatggtctcatttcccagatgttatttgatatatgctataaattatattacctccaacatagtctgcactttgaacttagaaaaacaatcttcagacggcatgcattctaattcttgaaataagtatgcccacaaactgtartttaagacagaataggtatgcttctcatgttttaattcagttgaatttcagaagatctcaggaatgtacagaacgagaattaagaattaataagaataagaattaattaattgcttgacatagagtagttaggtgatttcctgaactttaagcttccacatcacartatgaagttggttyaagataagaaatataataaattctcgcccaaggacagacctgaatctctagctgcctagaggctgactcaactgaaatcatggcgtttgacagcacttggaaggtagaccggagtgaaaactatgacaagttcatggaaaaaatgggtaaagactttatttctttgtggctcattctttgctttcttacaaacatttttctttctaactcctaaatctctaggagattacagatagcttacagatagctcctgatgtggtagagaggatccagaagatgttcagaggagggaaaccatattytcccttcttacattaggaagaatccactatctcactaatggaagaaaagattctttgagtgctgttctctgaaacacaccaaaaagatccagaaatgtttccttcmctctttaactgaaaaatgactttttttgttgtttacagtaagaaaatggcagcgtgtaatgataacttccagatctgaaaatgttaaattctaggagatggaaaaacaaagaccatataagaaagtaatggaaaaggttctcttaaaatttatagcgctgaataagttagatttaattctgatttcttctaacttaaaaaagttttggaataatcttgagaagctgtgtagttttctccagggcgtttaatttaactgatttataatttgataccaatactctggcagcccatatactatacaagataggcaaacaaatttgtgtcattcccctaaaagaaaaatctgcatcaattatagcttacagtttaggaactctaagtttaaatttataaaagttgtagattcttatagtgattttggcttaatatttgctaattttctcatttttgtgtcagaaagaaatgccacaagaagcaaatagaactataaagttcaaaatgttaaagccactaagaaaaacaaaggggcatttaagaaaaaagaatactgtatatgtggaattaaagatgtgcttccttataaatatatgaatatacattttaatccttcatttratatttctagaatttgatttacttaacactgaaatgaacagtttgttaatcttattaaggttgctcagctctaagattctataattctgtactctacttaatttttctcaagttatggaaaaacaactttaatcagttctcttgatcggattgaacctgaacttctrtagaagcaatctgaatgttcttgtgcaaaggcaatgctaccgagttttcttcccaccctcaaaataaacaaacaaaacataacttggaaaaataaacacttcctatgggatttgactttattttctccattgtcttaccttttacaggtgttaatatagtgaaaaggaagcttgcagctcatgacaatttgaagctgacaattacacaagaaggaaataaattcacagtcaaagaatcaagcrcttttcgaaacattgaagttgtttttgaacttggtgtcacctttaattacaayctagcagacggaactgaactcagggtaagaatttttttttttatgagcaatgcattcttgatttttctacccaatattaaaatgatttctgctctatttcattggatggtttaattaatgcagktctccttcactaactgaagaagccaatgaagtttgtctacattatatattrcacaaattggcaggrtatttaaatatgyttttatttttatacgcatctgtgaagaatctgaattgaacagtaagaattagaaaactatcttttgaatgactgaatatagacctattcataaagaaatttaaaactgtgtttttaaacagtacagcaaaagaagcctttagagttaatatgtaacttaactgtaatgtttaacatgttgaaataataaaagaaatgaatagatgaacaaatgagtgagttaccaaatggaaagatttgatgtattgtaggtcattgggagtgtaccttttcatgtttaagataacacattttaggaagtcatcattttcaacaaattttttaaaaactttttttagcctcaacatttttctatttaaattacatgtttgtaatgacaatttaactactgaatgttttatcrtaagttatgtctttcyttaattagtaccacaatcacacaaattaaaacaagcacagagttrttaacatctccrtgaaactaattttaaccatgactatatttctggacacgtaacatgaaagattcagaaagaagtgctgctcatctgccttaaaattcagcgtatggaaattattgaagagaacaagcataatggttatcaacacatactctgtagcccaatggcctaggttcaatcctcactctgtgactttaggtgaatcactgtgccattttacagtctcctcttctgcaaagtagagatartagtatcagtttcatagggtcaccatgaagattaaatgaaaaagtgtgtctacagaactcagaacagtgcctgacatgtgtaagaccctaataaatgccattattattattattattattattattattattatgtaggggacctggagccttgagggaaataaacttattggaaaattcaaacggacagacaatggaaacgaactgaatactgtccgagaaattataggtgatgaactagtccaggtgagttgtcaaatttatagctattttcaaaaggcaaaaattactacaaaacaataatttttgtcactgctgagccagatcttcagtaaactgactacttcttttctcataaatcttactgattttaaaaatattgtatagctattttctgatgcctatttactaaagacaacttatatatgtcaaataatcaatgcctattttaactgaaaatataaatgactacaaaccaacatgtgttttaaaatggctgtatcccatatctgtataaatcttgctatcaagtacaagaaaaaattgtataaactcatactcatataatatatatgaatatataatataaaaatagtataaactcatatagtataaaactataatactactttttcttaacttagatgtaaaccttaaagataaattcttctgtttgttaacacctttcagacttatgtrtatgaaggagtagaagccaaaaggatctttaaaaaggattgagcattattcttggcrcacagtccaaaatacaaattggacagaagatctatattgtaccagaactrtttatttcaccccatcaagtataaggttactgattgattggtccttttataaacattggtatatttccattcatgccaaagcaaaagaagtaaaagctaattaggatttaatttgttttatattctctaagatatatatttactaaaagaatttgtgacattttaaaaaacaaaaataaatattgcgtccatgttgctttatatgtagccttgccttttaaaagaaaaagtatgtgaatatgaattgacagactgttttcgtagagagagggtcttactctttcactcaggctggaatgtagtggagagatcatagctcactgtaacctcaaactcctggactcatgcaatcttcctgcctcaggcttctgagtagctaggactatgggtacattccacagtgcccagctaatttttgttttgttttctttttattttttttagagatggggtcttgctatattgcccaggctggtcttgaacccctggcctcaagcaatcctcctgcctcagcctctcaagttgttttttttctttacatttgataaactaaaagcataggctgcatatgagtctttaacatcttgaactggttgtgaataattttctggcactggttgtaagtaatatctattattataaaaataatatatgctcaaccagaaaacttagaaataagaaacacaaatgtaaaataagtatttccataactcataatccagagataattgccattctgattttgatagatatcctctcagctctcttccctgggggcagatatttcccaatacataccactttgaataggatgataggaaataaatgatgtactacattaaattaaattattgtattacatttttgtacacatcagtcattcccacgcttggctgaaaatcaggatcatctgagaaacttaaacaatttctgcattcttaatctccactgttattctattatatcagaatcgctaatagaaccaagaattctagaaaatttcctggtgattctgatgcagcctgtccactaacttgtctttgagaacaatggagatatcagttatcaatgttatttttaaccacccccttcttttttgttgttgtgggttttttcacataaacacatacattgccaattttccagggctcaaaaagtttccttttattcatattttcacatgacgtaaaattttatgtgcttcacataattgtattttagcagggtacatattaggggatggagagggggtacaatttttaagcatttgcagctgcaactctatagacttttgacaaattctttttcacactgatgtagataacagcttaacatttacatagttcttackacttgccacacactgttctaagtggtatatacatatgacatatatattaaaatgtaggaagaaaaatgtttgagtacctgatgaaaatgaatagagagtatgtaatctttgaaagstgaatactgygtgttctcacttataagtgggagctaaataatgtatacacatggacacaccagagtgtagaataatagacactggagacttggaagagttggagggttggcagggggcgatgataatttacttaatgggtacaatgtacattattcagggggtgatggttacagcccagactttaccactatgcaatatatcaatgtaacaaaactatacttgtactccttaaatttatataaaaataccttaaatctatgttcattttataatttcataaaaatcttcacataggaaatagtaattatttagattttcacatgcttctcttcataaaagctcaatgtatttttatccctctaatcttatgtgtctaccatatatgaatcaggaaaaggcaggtattaatctcaatacaaaaactgagagagacaaaggcacaaagaagtttattagcttgtctaatattgtacaaagtccatgatgaacagaagaattaaatgtaggtcttgactttcagcctagatcattatgatctatgctattactcagcctgttataaacaaaaatatattaagaaaaaaaatgtccttaattcctcagtggcacccaagaatagcactctaaatgagtcaggtcagactgtaaaataatggtgttgagtgattagacacttatctatttctagtctcattgcaggctgacttttttcaccatttatatcctttctagaattaaatttccactatttattagtattggagaacagcctattatttgttaagtgacttccatttcaacaaccgtttttygggaaaaccaaccttgtcattacaccaccctgcttggccaaaagagggtccctgacccaagagcagccaatctaccacaatttggccagatcatgagctctgtgtagaaggaaaaatgacaactaactgaacctgcaagaacctctttctagggagtttgaatttgagaagtacacagttagtagttgatagcaaggaaaaaggcttaaagaggacaaatagagcagacaataagtagaagtcatgagtacctgaaactatgaacaagcagtaaccatagggtagatagcagaatgtcggggcagtcagaagcagttggagtagtagaagctgaaatatttacacatgcaatatggtatctgggatttgcttcaaattgctttctccccaatctagggttggggaggaagattgatacaagttggcaattcttgcagctgttgcaaagtgcctgacacataataacatatgataggttcactgaataggaacacaggaattcattatattcatctctgtacttctgtatgtatttgagattttccataacaagaagttaaaaatatagtacttacatacacatataactccagaatccaaccacttcccatcacttccactgctatcaccttagtatgagccaccattatctttttcctggattactgttacaactctctaaaaagcccaagaacttctaccttccctactccacccctttagtctctttttctacacagcagccagaaggatcctttaaaaatctaaatctgatcacatcgcttatctgctcaaactgctgcaatggcttccattttcactcagaggaaaaagccaatgttcttacaatgacctgtaagaccctatatgatcagatgccctgttacctctccaacacgtggtcctgtttttcatgaaatatctgggggaagagtgtttcaagcagaggaaacaccctggagcaaagacaccaaggcagtagcaaacctggtaaatttgaagaacatagcctggaaagagtccccaaatcacccagagctgaccaaaaacaagaccaatgttcaggaaacacaggctgactcagctttcctaaaatttaggaatgatgtggtgaaaaagaatgggttttagaatcacagacttgcccaaattcttgtctgcccatttactgactaaaattcaagttctgattctctatttttctcatttgaaaaatggggaaaatgtaatgattttctgagcttgttgcaattgaggtattatgtataaaacatcgagtgtaatgcctggcatatacctggtactcaaatgtaacataaacatgtacccttctcctctagagaaaatggggcaaagtatatcctgagtagatgggaaaactattttcttaaaatacctctcatggagtctgcgtgagagagtgagccttggcctggtagatgagaatacttagttccagtccagtctgtgacataactagctggggactttgggagagtctcttcatctctttggaatgtagtttaatcatctttaaaatgagaggattgaactagatctccaaattttctttcagtgctaagattctatgatgtctgaatgacatttagtgattccttcctttcttaagcagcctttttggtgtgggtcacaggggacaggacattagaacaatggaaggtaggatgggaagagggaaatatttacattataaagtatggctggtttcatgggtgtatggcttgtgcaggctcagagggccctgtgcttggtttaatgctcttttcttactgtcctaaaattctcaatactttttgaacaacttctgcattttcattttacacagggccctgaaaattatgtggcttgtcctatttctatggattgactattaataagtacaaaagatattttcctatgagcaactagagagaatggtagcaagacatctctaggcacctaaagaagggtgaatggatggatggaaaagatagttgcctgggataaaatggaagtgagataaggttatgtggtgatggggaagggaaaaaggaggtagatggtcacttcatcattaagaagtgcttctttaccttttgctacttgctttctctaaactatagtataagaatgccatctgctggccaaggatacagactctttcggaggtttccaatgcagtgtctttgccgcatttcagtgtctagggagtgttccagaaaggtctgatataccgtagtctacactttaaaatgttaattattaaatgcttcttcagttccaaactccacactaaacaaagctaatacaaagactcctcttgaaccgatccactaaaactgctttcatttattgaacaaaaaataattttaaaaaagcactatgtgccagacagcaagtatttaatgatgaacactattggtagagatatttaggtgattaagaatttcctcaaatggatacaaactctcaggctcatcttgggtctgaatcgaaataccaagaatagcatcatcatcttcagcattggatggtcatctagagtagggttatactctcactcagtgggtgctaatatgcagggtggtgtatattgccttcaggcccgatgaccaaccttcaagctattgtctggaacagattttactggagaattgactggaaaagaagagtatgcaagacagtggcagaagatgaaagtttgaagcaaatggtggaaatcaatagtcatggataaagcatagtgttccagagggcttctctcatccatatatatcctcattgaagattccattagaatgatggattgcgagaagtcctccctgccatgtaatcaagatttccaggaatgaaagagggagcttaaacaattagtagttaggactgctgtgaaatgaaggagtagtagaactctgaaggaggacaggcaaggaagtgctccctaaatgtcagcccagtttcaaagccacatctctcagattacaggtagtgtaactgttcttatcaaatgattctggcacactcactatattcactggagaaaacacctgaaagtcaaagaacagtactcttcctaaacttgaaaacaaaatgtcttttaggtaaaggagtatatgctcaatgccttcactgggttttaatttagaaacttttaaacaagattttttttaaaaaaaggatactgaagggcatcattgtgacacagaacttcctctctttaacatatacttggaacagagaaacctcagtaaagatggaggttatttcacaatcccagtccagactgagtgtttgtcctgcatgttcccatggcacaaagtgttcaactccagcaataccattactctatattcaatctgcttgcctgcctcctctagtttgtgagctatatgagggcaaggatagggtcttatatctataccccacactgtatccctctaacacatagcaaatattaatgattgtaatttggggcatgctgggcagccccagcctcagaaagccagctttccccattctttcttaaacccagaagatctactgagggaataagtccttgttgttctttacaaacagataaacttattctgaaccagatcaccctagccatatctgattaggtcaaaaatggccacctgacccaagggcagtcaatttctatacttgagagcagccaatgataggagaactctgtccaagaccaataattctcattaattaaaaccaggtagggtctctgttgagaatttgacttcaatacacagagaaagtcattagctagtaatgatgggcaaaagttaagatacagatggaaaagcaaacaacagatgccatgaggtaaaagcagtcatgatgagttctagtaaacaaaaaccggatagaagaaaagaggggtgagataacatttttagatgtggaagtaatgaattcttgcttctggtggataaaaagataacttgttcagtataggctcctcgtattctgagtagccaagaatacatattcctttaaccaaatatgaaccaagcacctaccatgtgctaaatatgacatgagttttagtggtgaacaagacaaatctattttgttcccatggaactttgaatctgcttagcttagaatctagacatagaagacatattgaataagtaaaaattattgtgataagtattataaaggagtaacggtaggctttcatagaaatatatgcgatcttgaattatactttccattgaactatttttcataagatgcttaattgtacagactttcttgaattattaaagggcctaactcacacatcagactcctgtcatccttattttcatacaaattggctcctacacacaagggggatatcataaaatctaaataaatgctttatttataaaacatagcactaactcagatacagttaaatgcaactccttctaccactacaagttaacatttattaatacatggtgtttccaatgtgccaggtatttttcaaagtgctttataataccaattcatgttcatcatcacaacaaagtctatataataagaacaattattattagtctcattttacacatgagaaaactgaggcagagagaggttatataacttgcccaaggtcaacagccataagtcgctgaaccaggatttggacccaagcagttgtcctagagtccaaattcaattttacttgatgtggttatgtaggtaaattttcattcgaaatatcgtccatcaaaatatatattaagcatgtcttatatgcaggcactatgtgccaggtgctgatctaggtgttacagctacaacaaagaacaagacagacaaaaatccctgtcatcatggaagggatacagataataaacaagagaatgaagtaaaatatatagtacattagatgatataagcgctattgagaaaaataaaaccagaaagagggatgtggagtgtcagaggtgagatcatgggtgcagttttaaatagggagtaagatagcactgaataggtaacatttgagcaacacttgaagggagtgagagaatgagccattctaagtatgttttagtcagaggcctggatttggatccttgagccagtgacagtcttaaagagccttggaattacactgagtgtttctgggctctgtaatatagtgagcctagggctggatacagtagctcacacctgcaatcccagctactcaggaggttgaggcaggaggatcccttgagcccaggaggtcaaggctgcagtgagccatgatcacgccactgcactccaggctggaagagactgtgtctcaaaaaaataaataaagagcctaattagcatagcctatgggggctcaaagttgctagctaaggaagaacagagtaatgtaacaaaataagcaatatgaaacaaacaatagactccttctatgttttgaattggaatttctgaagga

SEQ ID NO: 17778 - DNA, 19832 bp, Homo sapiens
taccattccttctgaaactattccaatcaatagaaaaagagggaatcctccctaactcattttatgaggtcagcatcatcctgataccaaagctgggaagagacacaaccaaaaaagagaattttagaccaatatccttgatgaacattaatgcaaaaatcctcaataaaatactggcaaaccgaatccagcagcacataaaaaagcttacccaccatgatcaagtgggcttcatccctgagatgcaaggctggttcaacatacgctaaatcaataaatgtaatccaacgtataaaaagaaccaaagacaaaaaccaaatgattatctcaatagatgcagaaaaggcctttgacaaaattcaacaactcttcatgctaaaaactctcaataaattaggtattgatgggacgtatctcaaaataataagagttatctatgacaaacccacagccaatatcatactgaatgggcaaaaactggaagcattccctttgaaaactggcacaggacagggatgccctctctcaccactcctattcaacatagtgttggaagtgctggccagggcaattaagcaggagaaggaaataaagggtattcaaatagaaaaagaggaggtctaattgtccctttttgcaggtgacatgattgtatatctagaaaaccccatcgtctcagcccaaaatctccttaagctgataagcaacttcagcaaagtctcaggatacaaaatcaatgtgcaaaaatcacaagcattcctaaacaccaataacagacaaacagagagccaaatcatgagtgaactcccattcacaatttcttcaaagagaataaaatacctaggaatccaacttacaagggatgtgaaggacctcctcaaggagaactacaaaccactgctcaatgaaataaaagaggatacaaacaaatggaataacattccatgctcatgggtaggaagaatcaatgtcttgaaaatggccatactgcccaaggtaatttatagattcaatgccatccccatcaagctaccaatgacttttttcacagaattggaaaaaactactttaaagttcatatggaaacaaaaaagagcctgcatcgccaagtcaatcctaagccaaaagaacacagccagaggcaacacgctacctgacttcaaactatactaaaaggctacagtaaccaaaacagcatggtactggtaccaaaacagagatatagatcaatggaacagaacagagacctcagaaataatgccacatatctacaactatctgatctttgacaaacctgacaaaaacaagaaatggggaaaggattccctatttaataaatggtgctgggaaaactggctagccatgtgtagaaagctgaaactggattccttccttacaccttatatgaaaattaattcaagatgggttaaagacttacatgttagacctaaaaccataaaaaccctagaagaaaacttaggcaataccattcaggacataggcatgggcaaggacttcatgtctaaaacaccaaaagcaatggcaacaaaagccagaattgacaaatgggatctactgaaactaaagagcttctgcacagcaggagaaactaccatcagagtgaacaggcaacctacaaaatgggagaaaattttcacaacctcctcatctgacaaagggctaatatccagaatctacaatgaacccagacaaatttacaagaaaaaaacaaacaaccccataaaaaagtgggcaaaggatatgaacagacacttctcaaaagaagacatttatgcagccaaaaaacacatgaaaaaatgctcatcatcactggccatcagagaaatgcaaatcaaaagcacaatgagacaccatctcacaccagttagaatggcaatcattaaaaagtcaggaaacaacaagtgctggagaggatgtggagaaataggaacaattttacaatgttggtgggactgtaaactagttcaaccattgtggaagtcagtgtggtgatttctcagggatctagaactggaaataccatttgacccagccatcccattactgggtatatacccaaaggattataaatcatgctgctataaagacacatgcacacgtatgtttattgtggcactattcacaatagcaaagacttggaaccaacccaaatgtccaacaatgatagactggattaagaaaatgtggcacatatacgccatggaatactatgcagccataaaaaatgatgagttcatgtcctttgtagggacgtggatgaagctggaaaccatcattctcagcaaactattgcaaggacaaaaaaccaaacaccgcatgttctcactcataggtgggaattgaacaatgagaacacatggacacaggaaggggaacatcacactccggggacagttgtggggtggggggaggggggagggatagcatttggagatatacctaatgctaaatgccgaattaatgggtgtagcacatcaacatggcacatgtacctgcacattgtgtacatgtaccctaaaacttaaagtataataataataaaataaataaataaataaataaataaacaattgaaagaagtgaaaaacaatgatgtgaaaaattgaactactcatgcagtgttgatgggacatgcagccacattggaaaacagattgccagttccttaaaatgttaaatatacatttaccttatgatctagcactttcactcctagctgtctaccccaaagaaacagaaacctatgtccacacaacacatgaatgtgaatattcatagcagctttatccataatagtccataaagtggaaacacatcaaatatcgatcaattgatgaatgaataaacaaatgggagccatccatacaatttaatagggtttggcacctaaaaggagtaaaatattgatacgtgctacaacatagatgaaccacaaaagaacattaagctggccaggtgtggtgactcacacctgtaatcccagcactttgggaggccaaggtgggtggatcatttggggtcaaaagtttagatcagcctggccaacatgatgaaatcccgcctctactaaaaatacaaaaattacccaggcatggtggcaggtgcctggaggctgaggcaggagaatcacttgaacccggaagtggaggttgaagtgagccaacatcgcaccactgcactccagcctgggcaacagagcaagactctgtctcaaaaaaaaaaaaaagtatattaagctaagtgaaagaatagaaatacaaagaccaaatattctatgattccatttatataatgtctagaaaaggcaaatctgtaaagtcagtgagtcaattaaaggttgccttgagctgtgagtaagagtaaggaatggtgactgatgagcacgagggatttcttaggaatgatagaaatgttggaaaacaggattacagtgatggtccacacaagtataaaattttactaaaaataattgaactgtacacttaaaacaagcaaatgtgatgtcaattatacctcagtaaacctatttaaaaataaaagaaagttggtagtatggttcccaatcactctggacctttgttttatttctccctttctttagggcttatatttattgcttccactcagagactccaagacacatgagctgaaatctacgagcctccagaacgttcaacagctgaaagaaagtccagccccacactgaaggcgatgggggatctttaaggtgctctccagcactgctacagcaggcaaaggcatgcgatgcacctgggtagtttcagatagtactccacaagtctcagcaagacccagggcctgtaaatagttctgatagtttcagagaacaagctgctacatcttgtagcacaaggccaacctttcctaggcaagtggttttgaagcattggtagtgaggtccaaagtagaagatgaatgtctacaacatggaggagggcaagacccagagtggggtgtcaaactaaatcatttgtagagtattactttcaacaactgcagaaagcattcttttcaagtgcttatggcatgttcaccaatgtagaccatatgctggaccataaaacaaatctcactaaatattcaagaatcaaaatcatacagtgcatatgctctggccacagtagtatttaattagaaatccataacaatgagatatctagaaaatcctcacttttagaaaacaagcaacacacttctgaataacacttgggtcagagaagaaaccacaagacaaaactttaaatattattaactgaatgatgataacccaatacatcaaaatgttgggtacagctcacacagtgcttaaagagaaatttacaacttttaatgcctatagtggaaataggaaaggagtaaagaaaaacaattttctatgcttttattatcaggatcctgaaaaacggggctgggtgcagtggctcacgcctgtaatcccagcactttgggaggctgaggcgtgcagatcacaaagtcaggagtttgataccagctggtcaacatgatgaaaccccacctctactgaaaatacaaaaattagcccggtgcagtggcgggcacctgtaatcccagctacttcggaggctgaggtgggagaattgcttgaacccgggaggcagaggttgcagtgagctgagatggtgcccctgcacttcagcctgggtgacagagcaagactccatctcaaaaaaaaaaaaaaaaaatgtgaaaaacgagtgaaaaaaaaaaacaaaattaataaatgtaagccaataataaaaataatgaaaatcatgaaatagaaaaataaacaacagagacaatcaacggtcaatttttctgtactccctgcacaaaacttcatttcaaaataattttatatttaaatatatatccagaaccacagagatcttagaagaaaaaattagagaaatatagaaataaaatgagaactgtgggaataaaaatcaggaagtagttgcctatgaggtagattgggggaaggtcagggaattaacagggaacaggcagaaaacaactttctggagtgacggaaatggtctatatcttttttggggtgctacttacatgggcatatataactgtcaagttccactgaactgaacactgaagacctgggcattttaatgcatgtaaattatatttcaatttttttgagtaaagtgtcttgggaagcttatggcggtgatatttgggcagttctggggcataggcttcagaagcattcacagtatgtccagttcaagaatttgctgagaatcgttttgcagccaaaaatatggataagttcgaacacctatgataagagtcattggggcatacaaccacaaatccccactcttgtgatacaggccatatcattaagtggttatcaccagatagctttccttcaatgatgttgttcatctaggaacccagggctctccaggggcaaatgaccattgaggtttcagatatattgggtaggaaagaaagtcacctcacataaaactaagtgattggagctgtcaccattgcaaatttctaaattttgtaagacagcagcaacatttcaaatgatagtctgagagaggagataatgggcttacatggatttccctccagatggatttactgaacaagggcacaattcaaattgcacttgcagatttctcctggtctagtttaagttcacagattgtggatcccagacagctggtatcaactgactagtgtcctgttaaggctaaacccaagactctttgccacactgcagcattaggatgggacttctcttcctgttcctgggaagaattagagatgtaacccaaaggtcactatttttctgagataaggatcccataggaggagagagcaatgagtacatggccagagatcaaagtgataagggttgggccagaagccacagtgcataaagcttcagacttgccacaggaaatgaggtgagaagtacgtccactcttctgtccagcttttaacaatctaactaatggttagagatttttcattttctttcagctactcctgcagtggtggggacacagaatgtttgcaaaaaaaatggggtggaggaaaatgaggcatctgtgtgagtatataaccatttgacatctctttttagccctctccagggtcaccctagaatcagatcygctccccagcatcttctgtttcctggtgagtgattcctgctactttggatggccatgacgggctggagctgccttgtgacaggagcaggagggtttctgggacagaggatcatccgcctcttggtgaaggagaaggagctgaaggagatcagggtcttggacaaggccttcggaccagaattgagagaggaattttctagtaagtaaacttgggtcatgggtgtgtggttccatcttaaacactgcatgtatgtggggggagatggaccttgtctagcaagttattgaaatttgtagccaaatctaagccaatctcacatccaaagtcatcaagaaataaatattaaatagtataaaatggcatagtatgaaagatactgggtgggatttccagagactagattctggccctgacccrgaacttgagaagcagccacctcagcctccaggcctcttttcttctcatctagaaaatcccacatcagttctttgtcttgtctgcaactcttttatgttctgaagcttttgtcttggcaattgctgtacaacattcataaaggacactattaccctggagacctcaccaatgggtcattgtctctctagaacgtgccaggctgtgttttgttttgcagcttccttagtatcctttgtgagggcaaaataaaaggaagttaaggtaaagatgagtgtataagtgggtgtgtgtgacagagagagaggaaaacaataaggggragagagagtcggggagagagagtcggggagagagactcagagagagagacaatgagaaagacagagaaataatgaaaaatatatagtgagagagagagcatcagtgagagaatgtgtgtgcacagtgcacagcacagagcagagacagagtaagaggcagtataaggccagacatgcctcatttagattttgcatatatggcttttttttaaaaaaaaaaaaacaaaacatttacctctgttgctcatcatcaaaaagaaattgactgcagaattttctgtggcaactccttgtacaaatggccccaagaggcaggtagaaaaggcatcacatccaacaggacaatgaacgcatcaaggtccggaatcacaaagcaacatgctaaggccatctgattgatgcgtagcagagctcagaccagagctttatccataggctatttcacctggccccagagctgatgcttggcaaagtggatcttcagtctctccctttgctccttggtgtgccccaaaacaattccctgtcctcctccccaacccaggggatttgggggactgtgtgtctacatgtgggctctggctgcccagagggtcctgccctgcccacagagaatcccccacttgacagcactcagggaccacacccaacactctacttttrctcttctctgacctcttgaaatgttcgatttcttccaccctctgttttaatgttgtctttgataaacaaatatgaaatgcttataatccttgcctgtgtctcagcaatatttgcaatttaacatctgaagccagaaaaaagcaatgctcagcctagaggtattgttcccctatggtaaaaatgcagatcatataatagacaggcagggatctgtatgaagataaaaacagagaaagcattcagtgttctttttgtgccaggcacttggccaaaggtttgccaactcatttgctcctcataacaaccctatgagatcggtaatattatcctccttttttaaagatgaggagatagaaacagagaggttagttaactttttgaaggtcccacagttagcatatggcaaagctagatttgaacccagacagactagtgcagcatctgtgctcttaagcagtagtttgtcttacagctcctttaggccttcctctagcccaacttacaccataaaagcaactccatttagtctacataaaacacttgccaagtctacagtgccttggagaagaagggagccatgacttcatcaacaaagtaccttttcctagtccctctagatccctgggaactcactggggaagagtccttttctctcagctttggacttcttccactttgacactcctttgagccagtctgtctgaagtggcagcaaagaagaagcagaggaaggcagcaggaagggcagaggtggaactagaaccagagaacatcccactctcaggctgttacccacatcaccaccagcagcctcttccctgactcccccactccaggaccttcttggagttgcctgacaaygggaagaggttgggagtagacaaaacatggcagaggcatcaggagagcaagtggtcctgcttgtaccccaggaaggaatttctccagcttcgaatttttcactctgaattttgctctcactggtctttggtctttgttgccaatttcagttaaactggcttattctttggaaaagaatgatattaaacaacagaaaagttgatattaaacagccagtcctgcacctggtgtacagggtacaagcttggaggcagggtgggcgtgtttaagccttcactagaaacgtgaccttagatctgtcccttaacctctctgagactcagtttcctcactgataaagtgggactcagaatacctacctcatgagatagctgtaaaaagaaataaatatcctgtaagttgcatacagatgataaagcacaaacaagtgtagagtatttatccaagctccatgtagcatggtgttcattttgtgggctaattccaggtgacaaccttactggcagcgtcacttcctgtggatttcagaggaacctgaagacattgatgttgtaaccactgcctccagctagacagctgcgatgttagttcattggtggttaactcattttcagcattgctacctgcttttgatgatatctgataatagttttccagggaaattcatcattgaagcccacccacaattcctgagtaatgactccactctcctcccagttgcccaagcaggaaactgtaggggtgattttatcttctccttttcctatcagctcagatccaataggtaccaggaccttcaaggtaaggtctgaaattcaaacctggtatatctctcccctcctctgcttccactgctggaccctgcttccagtcctcatcgaaactttggcacagacattctgattaatcacttgatcatcagtctttctcaaatcccctataccagtccattttatatcctcaagccaagattaacttcctacaccacaaccctgcttttgttcctttttttgttgttgcttgtgtggttttcttttttttttttttttttttttttttttttttttttttgagacaaggtggtcttgctctaccacccaggctagagtgcagaggtgtgatcttggctcactgccaggaaccagagaccccagcctccatttatcctcccacctcagtctgcagagtagctgggactgcaggcaggcacatgccaccatgcccagctatttcatgtattttaatagaaatgggatttccccatgttgtccaagctggtctcaacctcctgcgctccagtgatccatccatcacagcctcccaaagtgctggaataacaggcatgagccacggggcttggcctttttgtcattttattccaaatataaataaggggttttctttaacatgatgctggagtcccaaaattatgattctatacatgatttctcattacttacagaattaacttcaaacttttccctcatactctctacaatcacactactctccttagaaaatttgatgggcttcccatgactctagcaatgcttatattccaggcatacctgacagctcactgctcagattacttttctaaaatgagatgggagagaaacagatgtttgctctttccaagaaattgatacacatgctgatttctgtgccttttttacttgttctttccgtrgaatgtacaccctccactctaacaccctwctctaaccatccttgaacacctatgtaacatcacctttatcagaaaacttctcagccagatacagaaatcattccaatgacctracctgtgttcacacagaactccagaacaagaycaagytgacagtgctggaaggagacattctggatgagccattcctgaagagagcctgccaggacgtytcggtcrtcatccacaccgcctgtatcattgatgtcttcggwgtcactcacagagagtctatcatgaatgtcaatgtgaaaggtatggtaggctggggaggagatgcagcaaggtggggaattaaggatcacaaagaagggcaggaagggaagagaagtccctccactgaacacctgctgtgctctgggccaagtgcctttgctgatcactacgaataggagagttcaagactgctaactttagttttttagatgataaaactaggactgagagagggcaagtaacttgtccaaggtcccccaggtaagtaagcaggtaggagagttagactttaaactcatccctgtgtgactccaaaggctctttctactgtgactccaaaagctctttctactgtggttccaatcaaaagtcaactaatttctgacttcagactcttgatacccagacaccccttgcctcccaggccagaagcagaccttgcaggtgccactgtagtcaccattttgaaccttgtgtgtaggctgatgaraacattcagagccctcctgcccacctcaaacaaraagtcctctcgagagaactagcaaagctggttcacaaggtctgtcaggacagaattatccagcacatgccttcccacaatatttttttaacagtgagatttttccagtatcaagaatacagtctcttcagctcaccacagggcctactattccagagccgttttcagccaggtgcccaaagtgcaccctcatttaatcttcatcccttaaatgcttggcgtttcctttcaaagtatggctttccaactaccttaaattcagacacatttccttaaggaatcttctcagaaatctcaccctctgatctccagagtccagtctcttcagcaccatagcaccccaaaccccggcctggccctccgcatttagtctactctgactctttttccaaagcaaccaattgcttttgagtctccagcaccataaaagaaaaaaaaaacaacttccagtttctacttacccatacttctaagtacccctgctgtgcaaggagggtgctaagagtaaccagttttaattactacttcaacagctcccaaaaggaggggatatgaaatgacaggggaagtgttagaggcatctgtttgctaaaaccattataactcccaagcttagaaaatacttcacaatgttggtcatttcccccttgaaggtaaactaactccaaattttctctgccacaagattaatttttgaacacatgaggctgtctttccagaaactcaaattgcacagagacattaaaagggctaagaatacaaaaatttgtaaataaaaatgatcctttccctaggaaattccttccttcttcaagggaaggcactatgggtacctccatgagctttgcttctacacagctcaggggaggctgcaaggtcctcccactgcaggtgttaccagcagaggacacacttctctccccagccctccaccaggctccacaggaaatgccagggcagggtttaaaagaaggtttatcacctccactttacataaccaggtaaacagagtcacagccagaattggaagcagctttcccagggaatgcacaatcaggaagagtgtgggtttccagcatctccccacaacccactgcttgctcagtgactccaggatggtccttgtgacaaagttttattagagcccagcaaaatgagaaaagtaccawcaatttcatatatattgaagagtttatattgcctatatacaatggtgtatgtgtgtgtgtgatgtgaattcttcaactgcccattttgcctaaggactggaactgtccatattcacagagtatagcctcctgattttttagattttaaatgatctgactttaatggtactgattacaaatcataatttgtcaatacccttacttggcaaaataaaaagtgataaccctaggtccctttccaaaattaaagtacacacacacacacatccatgaaacccaaaagtctagaaattcttactctccagaacccacatgtcagtttctcttcattttggtatttttcttatggctgtagtacgaccaaatctcagacagaaccacagaagaatgtaccctgagtctgttacaaccaccatatttgggagtggsgggtggggcacatagatctgtgttygtrgttggcacctcttagggatatatcctgacagtgacaatatgctcttcatggacaggtacccagctcctgttagaggcctgtgtccaagctagtgtgccagtcttcatctacaccagtagcatagaggtagccgggcccaactcctacaaggaaatcatccagaatggccatgaagaagagcctctggaaaacacatggcccgctccatacccacacagcaaaaagcttgctgagaaggctgtactggcggctaacgggtggaatctgaaaaacggcggcaccctgtacacttgtgccttacgacccatgtatatctatggggaaggaagccgattcctttctgctagtataaacgaggccctgaacaacaatgggatcctgtcaagtgttggaaagttctccactgttaacccagtctatgttggcaatgtggcctgggcccacattctggccttgagggccctgcaggacccyaagaaggccccaagcatccgaggacagttctactatatctcagatgacacgcctcaccaaagctatgataaccttaattacaccctgagcaaagagttcggcctccgccttgattccagatggagcyttcctttatccctgatgtattggattggcttcctgctggaaatagtgagcttcctactcaggccaatttacacctatcgaccrcccttcaaccgccacatagtcacattgtcaaatagcgtattcaccttctcttataagaaggctcagcgagatytggcgtataagccactctacagctgggaggaagccaagcagaaaacggtggagtgggttggttcccttgtggaccggcacaaggagamcctgaagtccaagactcagtgatttaaggatgacagagatgtgcatgtgggtattgttagkagatgtcatcaagctccaccctcctggcctcatacagaaagtgacaagggcacaagctcaggtcctgctgcctccctttcatacaatggccaacttattgtattcctcatgtcatcaaaacctgcgcagtcattggcccaacaagaaggtttctgtcctaatcatataccagaggaaagaccatgtggtttgctgttaccaaatctcagtrgctgattctgaacaatttagggactcttttaacttgagggtcgttttgactactagagctccatttctactcttaaatgagaaaggatttcctttctttttaatcttccattccttcacatagtttgataaaaagatcaataaatgtttgaatgtttaatgtggagggaggtgtgagttatgttaatacatactttcctcctttctccttcttttccaggtattgccatctccaatttagaagagtagcataaaacctgggttggggagagggcagagtagtgggagggccaggaagggcggatgaagactgaataagctctactacctttcaggcatgtacaacatgacctacatatgacatatattatcttatttaatactcatcagaaacctatctggtgggggtgactaatcccattttaccactgaggaaacttgttcacagtcacactaactgattattggctatgcctgctaccagggagttggccttgaaagtccttatctttccacggaatcacgcagcctgaactggtcttgtcagtggtacagcagagcactggagcatgcagtgccgatacgtggaagagacccatctccgttgggttacctccttcttgcccagtcccatgcaggggactctctagaacccaggagaatccctggggagcatctggaagggtttgaatgccttaacaaatggccctgagcaggggtgagtgaagcaaaaatgcctccagcctccaccttcaatgccaatttccttgaaggtctctagaacacacctggctatatgtgtgttagtcattctgatcatacataaccctgcatttcaccctttcaaatcacacagtgaagccacaccatgggttcctgggcaagtaaagggaacaagtttaaacttcccccaaaatgtgccttctattcagcccaagaagtaagtctactgtcccacatccccagatttaactgcctctctcttcattctccttctcttcttgagatcatatcttttcctcctttattctttcatctccttagcctctttccttccctccaaatccccttaaatcactggctctctcattcttctcaatttccctgaggaaaggaggctaatcaagacaagcttggggacttcgatgatgacatagtcattaaccaaccaaaggagcaacagtcaaataaaaaatactctcaggggcatcagtgacagagttgaactgaagtgggtgaggaagttgctgtgggtccagagtgtggggaggggaaaattatctccctctggacctgggtgtatcacagccatgataggagtcacacccaacttcaagatggcttgcttcttacatggggaatttacagattattaatcagttgaatttgattactgcaaagaggtagtttcagtattcattctgaagggaaaaggtaagcacattctggtccagaagaacaggtttccaccaccatcaacaccccaagagacagatgatcagcaccagcatcagcatggagtggccccaggcagtagggtaacatggaaaatggaacacccatccttccctggcactgcacaaaatgcaagaaccagcatctgttcagctcttgaaaggcatgcacaccatgtatatgttaatgcaaaatagcagtgaaaggaaaggagggtggtggaatcttggaaaagggcccttcctccttgtttttctgcctagtgaaaccccacacctatgaatccaccagggcaattttcacaggcaagggaagaaaaaggatttatctccaacaggcagtgaggggtgtttgaagtaagagaatagaagactggattggccaatggtctcaactgaacaagcacgaaggcctcagagtcttgtggctaacaaaatgtgccatcccttattacacctgcaggtgccaggcgggcagagctcctgcaccaagccctgctgcacctcacctgatgcaccacatgggggactgaaaaggctccgagggaagaacaaggaagcctgacctggtagggaattttgggttccttttctccagctgggtggctctgcaaggtacctggcacaagaatgaatgaaagcgctagccagtacagcctgagcttttgctgaatgtaccatcttgccctagcataacatgcgaagccttcatatgaagacattccctctgtctacctcccaccccctgcagcccctggcccaaaattcctaaagtcatacttatagttggcaaaataattcaccacaagcagattgggcagacagggaacaaaaccaaccttcaccttcacccttaaatggtgttggaatgtgtaagcatctgtacctctctcatatatgtctccctagcgttgagcactatacccggcacttgcccactcagctgaggggtgaacttcccaggggctctgctctcaatgagacacagccttggggcccggggaaggccagccatacacagatggtatcagaacacccaggcagaaccactccctacttcagctatagtaggtccagaaaagcatctcagtggagtgtcttcagtgaataaaaagaatgcattgaactactttcaatgaatccctggtctccaggaactgaactctgtcagtccttttactagtgttgaacattcttcaaatatatgtatgggaatgccagcttgaacacagcatgtacacttatacctttttcaaatttcttaaacagagggaaacatgggatacagaacaacttgctgcccacctcattggcttccaaagctgagcattcctggctgctggaatgaggcagggcaccagctggatatagagagcactgagaacagtggcctggatctcaggggaacagctggcaattgaaatccattggaatgtgctttgggttagcagagatggcctggatctcaggggaacagctggcaattgaaatctattggaatgtgctttgggttagcagagatggcctggatctcaggggaacagctggcaattgaaatccattggaatgtgctttgggttagcagagatgaccttgacactgcagtctggcagcagaaaactgcaatctgcatggcacttgaggttgtgacagggagacaggggaataagcattaacagcaaagctagagatagctgggcactaaggctcatgtctataatcccagaattctgggaggccaaggcagaaggatcacttgagcctagaatttcaagatcaccctgggcaacatagggagactccatctttacaaaattaaaaatgtatcaaaagccaatcagggcttggtggtgtgcacctgtggtcccagccactcccaaggctaaggtagtagaatcacttggcctgggaagttgaggatcatgccactgcactccagtactctgagtgacagagcaagacgctgtcagaaaataagaaaacaataaaaaaggaaaaaaggttagagaaaaaaaagaatgtctaaatgaataatgtcagcactggaatccccatgatcttttgctacttgccacactctgttctccatacaacagcctgagacatgtttttaagtaaattcaaatcctatgccccacctatttaaaacctttctgtggcttcccgatccatttactatacgctctaaactgatctccagctctcctgggcactgcatgatctgctcatccttccaacgcatttcctcatcactctccctttcactcatgatgcctgagccagattgacctcccttatattccataaacaagcaaatctttcttgcctttggatcttcacatttatcattcccttaacataaaatggtattcctcatatctcatgattggctctctgttgacatgtagatctcagctgaactgttaaggatgaggtgagacatccctgaccatcctctcctgaatacgctctgcttcactcatcacatcaccctgtttctcccctcctagctgttaccacaacctgcaactaacttatcagttgtctattttgttgtttatctgtacctgcatagggaccttaaaccgtcttgctccctgctacattcccaagaatctagaatcatgcccaatgtcatagagagtcccataaatatttattaaataaattaatccatggaggcaaagctggaccagactacctcagcacatctggagaattatagcagtcagaggaggaaaacagtgagttaggatggaacccagcagaatgggtcactacctaagccaacagacctgaaaagtcttctatcattccttgactggacactttcctgcatgaacccatgccattgtgcaggtccacttttgcccagattaacccccagagccaagagctgggtcaaggaaacatttgcatagaaaacaccaaaagagaaagccgtcccacaggcagtcactctggtaataacttttaaggctatttgtttaacccaaatatatgtataggacgtataccatccacatattataaaggaaaaataaactaccattgtacagctctgctttcatataactgcaattcagaacacagaattcaggaaagtgaacaacaaactttcaaatcagcagtgacttaaaaaaattgttttccatagtgtctgactcaaagcagctcctttgattcttctcagaacaaaagatcttaaaagagcagctcagtaatgactgaaacagccagtggattatagtttttttcacatcctttatatcgctaggagataactatggaatgttgcactctggacagaagagcaatacttataaaatattccccaacaaaaatcacactctctattttttatgttattttattttttttattatactttaagttatgggatacatgtgcagaatgtgcaggtttgttacataggtatacacgtgccatggtggtttactgcacccatcaacccgtcatctacattaggtatttctcctaatgctatccctccccttgccccccaccccccgataggccctggtgtgtgatgctcccctccctgtgtccatgtgttctcattgtgcacttcccacttatgagtgacaacatgctgtgtttggttttctgttcctgtgttagtttgctgagaatgatggttttcagcttcatccatgtcccttcaaaggacatgaactcattgttttttatggctgcatagtattccatggtatatatatgccacattttctttatccagtctatcattgatgggcatttgggttggttccaagtctttgctattataaatagtgccgcaataaacatacatatgcatgggtctttataatctttcaggtatatacccagtaatgggattgctgcatcaaatggtatttctggttctagatccttgggaaatcaccacattgtcttccacaatgattgaactcatgtacactcacaccaacaatgtaaaagtgttcctgtttctccacaacctctccagcatctgttgtttcctgacttgttaatgatcaccattctaactggagtgagatggtctctcattgtggttttgatttgcatttctctaatggtcagtgatgatgagctttttttcatatgtttattggccacacaaatgtcttcttttgagagtgcgatgcctccagctttgttctttttgcttaggattgtcttggctatacaggctctcttttggttccatataaaatttaaagcagttttttataattctgtgaagaaaatcaatggtagcctgatgggaatagcattgaatctataaattactttgggtagtatcactattttcacgatattgattctttctatccatgagcatggactgtttttccttttgtttgtgccctctcttatttctgtgagcagtggtttgtagctctcattgaacaggtccttcacatctgttgtaagttggatccctaggtattttattctctttgtagcaattgtgaatgggagttcactcatgatttggctctctgtttgtctgttattggtgtataggaatgcttgtgatttttgcacattgattttgtatcctgacactttgctgaagttgcttatcagcttaaggagtttttgtactgagatgatggggttttctaaatatacaattatgtcatctacaaacagagacaatttgacttcctctcttcctatttgaa

SEQ ID NO: 17779 - DNA, 71711 bp, Homo sapiens
atcttggtgttttcttgatttttttagggtttctctcttgaccatgaattacattttcttattttttatttgtcttacaatttttattgtatgaggcattatgcttaaaagaataataaaggctatagtaaataatatttacctcagagaaggacattcttattctgttagccgtttagtgtaggagctgagttatcccaatttgtaattgagctaggtctaatataaaccaaaattgttgtagcattaagttttaactcaccacgctcttaaaatactttgaggacgtgataaggattttcctttcaactaattttgagatctgagcacaggcaaagctctggagagctctttatccttgacaatacagagaaaaagctctctgaactgtgtgtgatacgaggcctaaaattaagacacagaattatgtgccgtcttgacatctgaaaccagagggcgtcgagggccttaacccaaaagtttccttccccactctgctcttgtggataaggtccccagcccagtatccactgccttatcaaagggaccaggcatagttcctgcttatccctgagtagtaggtttcagttccctgccagcccacagaattattcgaacaagccagtcacatccgcctgtgggagccaggggacacctcatactcttgatattacaaagtccgccttctagcattgttgattgttcactgtattcccgagtgcagccctggtgtggccctgcgtgatgtgctgtgccctcttccccagggctttagtttatgtataaactgcttccaatctcatcaattcaacactagacatcatgtgttcacccattcttataaccttagggtgggaattcctccctcaccaatggggtgaagagaggatgattaaaacactactttacaatgaaaaatcttcttctacttgcaacgaaaaatcatttttaaaacaatctctagtacattctcatttctttccagacccacccctgcatttctataccttggaagacatctttccaacctcttgccttatctctagcctttggaggacctttcctccaaagtcactcagtgaagacctgccatgccttgaagctactgattttcattcttttcttttcactcagcttttggagagccatggcagtgtactcaggcgaggcttcttgatgaagaaatttctggctcctctgttggccttctctgagactaccccaacagaagaatgagggttgggacaccttgttataacctcatgaggtggaagtttaattctcccttcaggctttgctggcaagggtgggttcttttgtcttttattttgcttttttttttttttttcccctgtgctctatggtgggagtagagtggttattttctaaaaactttctcttctttccaggctgacaattctctagtccttggcctaaagagagcttttattggggcttttattgtttctgcccattggcgttcctagtttgccaaattctccagtacccagaaatgaggcaaaagtaaacttgggaactcagtgcttcattgttccttgggtcacctagccattctgccttcttttctccactcttcagagtcttattctattttttctatatataatgtccatattttcagatgtacttagcagaaggaatagggagatatgtctattccatatttccagaagtggaagtcactaatgataatcacttgataaccagatacagctttccattaagaaaatgaaaatatggttatttctaaaatgatcaaaagaaatgcgttttgaactctttcacttcaagggtactgttctgcgtaaatgggaaatataaaatcagcaatgacatggttttgtgaactattcttacattcattttctcatgaggggcatttggtcatctttatcagtatgttccttatgatcttataaagttaaaattttaatattaggacaaatatgttgtttttttttcctgataaactaatatgtttctctcacttaatattaagaattatataattcattaattgtccatcttccctttcctgccagcccactcaaacctaaattttcttacttccaatttatttgcttatcttaaatttttctagcatcactactgcttcattatcttttattctacaactcccagtctttggtttattattctaatgtggctgtgacggcttcaaaataaaccttctcatatttattttgagaatagataatatagaaacaatgggctttctgaattttctttaggagtaacttacaggaggcaatctgactgaatgggtatttcagaagacttttgaaggtgtgttcccggaacaagttcattatatttatttagattactttttttttcttttgtgtggctataataatgtgaaatagagccctcttcaacccatttgttatcactatacataggagtatggtcatagcttcatctattcgttcactgattcaacaaatatttaccgaatacctattgaatcaggattgggcataaatatctgttctaacaattactaatgtgttaccctaggaagttatttaacttctttaagtttaacttcccatgagtataacaagaatagaatacttacctaacatgtttgtaagaattaaataatatgccaaatttaacttacctagcacatcgactcatcaaaatcatgcagaaatcagtttctcttcttctccagcccttttgctgtatgttgataaccccctttgtccacatgtaaatttgacaggttttcaatatttttcaaacaccattaaattgaaaaagctctaaaatttgttttcttctattattttttgacagatatgtcttatggaggaaggtaataatgaaatcatattttggatgttttaaactattttaagaaaataggaatttctcatgtgaaaaatgaagaaaacagctgctgaaaaatcctattaatctggtggaagttagcccatacccccaacattttacaaagaataagtcttgcagctataaaaatgctttgaatagtacacagcaccatctacagtgaactcctcaatctaagattctcttttaactcacatttatattttcttttaacttaataatctttttttgtttttttttcttgtggttagaaaattaattcatatgcattataaggtggaaaagaaccaaacccattatctcatcacctacagacaacccatgttgcagtatatagtgaatcctatgtttatgatacaatgaaaaatgacataaaaatctcctgataactcataatataataaatttcatgatttttatcttataaaatattcatggtgaacaaatggcaagatggtaaaacataatttaatatgaacaaccaagtgggaaatgggaggtatagcaaaatgacagggtccagttatacaaaactgatgatatagtttaatccaacaatagtattttagtatctagtatctagtataatagtatctagaagaatgagtaaactgagtactcttcagccagtcatctcagcaatattatttttcttaattgttatttaatgagtattaattagtctcagaaagaagaatttgagacaaggtctctgacaatttctggagtattttatacctctaattaagggctgatccatatacccaaaatcactaaatgagcttgagattctctggggagttaaagtgcaagatggcttagtagatcaatagtgagatacagaacctttagccttttgatttcagggtcccttgtaagctaggataggggtgagcaaaagtcattattggtcaataccttataagtggttaaatgaattgcttagctttgttcagtttttattatcattggataactatttgttatcagttatagatccaatgggtgacattttaccactaaagttcacttgccagaccaggtttgaacagtctttcaaactgtagaagaaaacaaaaaatcagtgaatgtcattattttggcagttttgtaaatcttcaagacagtccattcatctatttttactaaagctaggaaaattggtgtaaaattgaatataaataggaacatttttcctaaattttatgaaattactgctcttccataagccaaagctagtttcttctgtgttttccagataaagacactgtaaagcctttttctttctactgaaaaccatgtttgtattgtgacagttgtgcagtttcattgctcttttgctctttttagtaactaatcgtttcctggattgtctctgctggacctttttgctcctttactaaggcaaggtttgtggattgttctgtggtatatctgagaaacggatgctttttactccatatcagagtcgattggggttgctgatgattgtcttagtttaaataaatactctctagtaggtcaacaatacacttacggaaataaatggcaaagattgagggaagaaaaaaatattaatcccaagtagttagtagctcaaggaagaattaggccttatttcaaatcctggtgcactgtgtccaggaataaggactagagaaaatatctacaataaaacataaccaagcaggcattagatttccaattctctaattttgaaagacggaacttaataatctaataacaaaaaataaaatctaataatagtttaacaatcaatgactgaatatttagcaagagcataatgcctggcacagaagttgacagaaaaatgggttacacatggatttagcttccaaataacataacagacatttagcaaattgacagcaaagaatatttttgttttccttataatcctagcacataagagagtgctttgcacagaatgaggggttatgtaactactgaattcatgaatacataaataaatgaatgagtgaatgaatgaatgaactattataacttagtttgtatatctatttaaacagactgatatgaaattttatagataagaggttaattgaaatctgaggatcagagatttgctggagaaattaaatgataaatctcatgaaacatctctaccagaaaaaaacccatagaaaactcagataaatctggttctctgctacctacaactggcataattttgtcctacagtaaatgtataaaagcattctatatgatcccattttaatttatttttatgtgactccattttttcttcatctatcccttactagtaaaatattggttacccccaaccatcagacaatcgtgattggaaaataaaggaagtaaaattctgattatttattccattagtgggtatctctggtagaagttccaggagcaaaatttaaagtgacttcctggtatacctgtctaattcaattacttatgctttccttttctgttattacttataatcattgagattaagtaatgatacagctgaagtgtatttataaaaatagaaagatatacatgtatgtagatagatgttttataattcagagtatatgtactatatgaaaggatagagacactgtaaacaagcttttgattatgtgtatgcatgtggatatacacttgaacaaaatgcagctttctggatagagcacagcagataagtatcataaaaacttttctcagtgtctttatgtagtagaacaaaatgttaaaactgtattcagcctatatcaacaaaattttgcactctctatcgtgaacctgaaatttctctttgaaatcagtgaaacgtgaaaccagggtgtgctcaggaaaagaaagttacttcatattttttcatgggttttcctgataataattgcctgtgctttcccatttacccttagctttgtcagagacccttcagcacttccatagagccatcccactagaggtcacagatcacaaaaaccctacagaaacaggaaaccgaacttcctgagtacgctacaaaacacagaaacctgtttcctctacacatctcaaactggcaaarctcagtcttagcagattcagtgtggaagcagctatcaaaaaggccataaggattttgtccccaaatttcacatgagctaccttgcttcaaactactgagatgaagggggcaagattatttgtccttctttctagtttatggagtgggggcattgggcttaacaacagtaagcattcttggactatacctgaggatgggaactctcagaagactatgccttctgcttcarttcctccaaataaaatacaaagtttgcaaatactgccaaccrctcgggtcatgtcggcggagatagctacaactccagaggcaagaacttctgaagacagtcttcttaaatcaacactgcctccctcagaaacaagtgcacctgctgagggtgtgagaaatcaaactctcacatccacagagaaagcagaaggagtggtcaagttacagaatcttaccctcccaaccaacgctagcatcaagttcaatcctggagcagaatcagtggtcctttccaattctacactgaaatttcttcagagctttgccagaaagtcaaatgaacaagcracttctctaaacacagttggaggcactggaggcattggaggcgttggaggcactggaggygtgggaaatcgagccccacgggaaacatacctcagccggggtgacagcagttccagccaaagaactgactaccaaaaatcaaatttcgaaacaactagaggaaagtaagaaatcttcttttctttttgttctttctctgtctatcaggwctagaagawtgcaagtgaaatttacctcactcccagaaaattatttcaaattcaagatgaaattggatcatatttataatttcaccatttcagttagataaagttattgttaatttatctaatagggaaaaatgaagaaataaaatgcagcaattttgttttaactgaaataatcattcacttttctactcacttatagaggtagttttacttagaatagtcattgccaagcaaactagcaccacggtggctgttagtttaattcaaggatatgttgattgtgttcccaaccatattcacaatatgaaagacaaaaataaacaaataaataaaattggggcttgaacagatgtgaaaattggaatagcagtattataaaaagtaacagttgtcaaagatcgaaacaagcacaccaggggtgcaatcctggcttcagtatggtctagttccatgattttgagcaactcarttgatgtctgtgaacctcagtttcttcatatggaaactacagatttaatacraggaatgtcaataaaaataaaactttgcagggttctcgttcagataaaaatgaatgaaaagtgcttagatgcatgctcctcacagaataggtgctcaacaactcaaattttgctagtaccatgattattttgagttgtgttgccatcatgaatatgatgaatcagaaaacttatttttcaaattaattttaatttaaagttagagcaatttgagtggttgaaataaaataaaacaaatttaaaggagtgttgttaaagagggttttcaaaagaagtgatagtcaaatcaaaataaacaaagaaaaaatatctgggtgggtcaatattttattcatttaatgctcagagtcatctgtatgtttggaatactagaagtttagtattgcaaaactaaacttacaaatagtttttacatgtaataatacaaagtcaagacaccagacatgtcttgggagcaaaatggggttaaatatcttactaataataaaataaaatccaagttaaaaatagaagttgacacacctgctatgtgaaagacatttagttaaagctgttgctgatataaaggtgagaagaagagagacactggtaagaattctagccaatgaatttacttatttctgtattatttattattcaagtctatttttcactatatttcaaaagttatagaatttttcgaaatatataagtaaatctgattgtaactaaaaaagtattcacttggtggactttggaacaatcccagcttactgtaaaacaaatagtacagattacaatatgttcactttgggacaagtagatttgccattaaaaaaacatttaacagacatgcattaatctttctcactttgggggacaacaggattttatctattaaataatcagaaatgtcatttattgacagctttttctaaatcacttgaatgcatcatttctgttaatcatattttattagaggctgtaattaaatttttaaaaactaattacagtaaaacccttggacattcatgggaaacgattgtgagcttttcagagatgctatagctaagaatttttttttttttgagacggagtctcgctctcttgccaggctggagtgcagtggcacaatctcggctcactgcaatcttcgactcccaggttcaagcgattctcttgcctcagccttctgagtagctgggactacaggtggtgtgccatcacacccagctaatttttgtatttttagtagagatggggtttcaccatgttggccagggtggtcttgatctcttgacctcatgatccacccacctcagcctcccaaagtgctgggattacaggcgtgagccaccgcacccagccagaattttttaatagaaagggaaatataataaacagaaaaaagagacaattcaagttaaaatagcatttaaattttacataccatatagaaagtggcatacagttgtgtcataattagaactagtaactaatagtttgataaatactagtttttaaataaatgctagttgtgttatccaaggtccttgctttcaaatgytgggaacaatttgatgaatatttataatttgcccatcatgtgctagcactgtgctaggctttgggttacacagaatttaaaaaaataataataattcctctgtctaaggaatattccctataaaaagtaaacactaacatacctatcagacttcaaaaaatgttaataygtgctatgagaaaacaagatactaaaggtataacttgctgaacagaactttatcctctggattttcyaacaaaaataatcttaaactccttctatagaaaagtactaactgcatgtagggattctctyatttgaggtcctggagagcctgaggttttcttttagtaatyctttccattaccaagattccttactcattaggccatgcaaatgacaatggcattagagaaaagcctaggtccttcacttttggacacagtgctgctgcaaacccttgatatggtcaaaagaagtccttcgtactttcatttgattggcaaataataataataatagtagcaaacacttatatggcatctgttactmgtactctactattgtcagtgaatatattcactcatttaatcattactataactccataaagaagaggaagatttttatcattatttctttacagagggattaagtagcttacctaaggtcacttggctaacaaagctcagggcaaagactcaaatccaagctggctggctttagagttgtagctctcagctcctacattacactcccttggcaggtacagtctcttatcacaagtgggaagataagcgtgaccagttcacttcccagctcgtgaggcttcacrggctattggttgcctccagaatacaatctagatttgttacccagttagtcacacgatgccatcctagatctgcctcctgcctacctccccaacctcatcttccgccacttcsggctattcaaataagtggttctctggtacaatatgtgctgtttgttaaacccacctttcttccctgtctgcccctgtgactaacaatgggccctcttttgccatcgttctctcttttcacacctaataataactccaggaagccttctcaggtgaagttaggtggcctttctaaycgctcctacaggtctctttgaattcccctgttcactgcacttacgacactacataataatcataatgaatttgtagtatctttgcatatagggacttattttcagagctagcaaagtctctggtttatagcaggtacacaatcaatatttaatcatactgaatgtgaaatatgaggattaatatgtgaatataaagaagaaagcttcccaaatatttgcatttgtttatgaaaaaaacctggttgatttagaataaactcatatttgttcttttttctaccattcttggaattttataataattcttagtaaaaggcgtatttatgtttattacaggttcttttctagattattcaggattattctggcatatttttgtttcatcttgtagtttttcttctttttttttttagccttgcaggaactcctggccaaaatagacctatggtttcctgtctggcagagtgggtgttagtcaatgaccaagcactttgaaataggaaggatggaaataagaaattaggattagtgtatttatatgttgaacaaatatttgctgaacaccttatctgtcccaagcactgtgcttgtgctgggagtaaaacaatgaacaagaactcctacatgtcctgccttatggaaccaacagcccagtggcagaggtgagaggaggaataacagtgaatcacaaatgctgattctgaatgaagcttaagaaattgtagtgtataatggggggaatggcctaccaattgtgaatggggtcagtaaaccttgcctgagaggataataggtgaaatgaggtaatgatacaatctaactgcctacttagcttttcccacaattcccaacccctgtacacatgtatcttaatttttaccaaatcagtgaatggctagttccataactagaaaccttggatagatctttggcatttttctctcccttctggtttttatctaatctatcaaaaagtcttgttacacctctaatacatcccaaatacctcaacttctctccatcttctacttgccgttattcaccactagtgttctaattggtccacttctttccactcttgtctaccataatccatgatccacaaaagggagggatcttttgaacatttaagtcagattaatgcatttcactggattaagtcttcattattgtaagtgacacattattttaggtactaatcagaaggaaaagtatgacatcatacttgcttaatttgaatttttagatttgtctttcagactttgagattttggtcacatatcacttttgcaaacttaagaaggaaatgtaaatgaaactggtaaagtatttcgaaggcaatggcaacaactgctatctgaccactagtgactgaaaaatgcctttgatttcaagacacattcttgatttcagagatgtrtgtcttaaaatgtgtgaaatttggtctttcattcattgtcacactccaagatcactgcacttcatttcctccagccacactggcttcctttctgtttattgaacatgtcaagttaatatctcaaaggaaactttttttgctcttgctggaatgctctttctgcaccttttataatgaaggactcctcttccacttgcacctccagctttaatgtcacctcttcaaagggaccttctcttaccacccaatgtaaagttaactatgctctcacttgccattccttattttgtcacctttatttttttctttgtaggaattatttgaaattattctacttatatagacaatggtgtattttatgtctttccgcaatacatcccatgaaaacagggaccttgcctgtcttattactactctatttgctgcctagaacagtgccaggtgcatagaaagagctcaataaaactctgtaaaatcatggattattagatgggtktggcatccagaggggagatcaaggctagagatataaatttggcaaagcattggtatatagaaatgtattaagtcatgaatgtggatgatactgaaagaaagaaggaccttgaattatgaacggagaatctctaatatttgatgaactgatagtggtggatgccaacaatacagtcttaaatggggtgaccagagaagttaggaaggaatctataaaagtgtggtgtcatagagcaaaggaagaaaatattttaagaaggaggtaagtgatcaacagtgtgaaatgctgctgaaaaagacaaaatgaggactgaaaaatagccactatttcagtttagtgagcaccatgctctggcctgagagaattgaggtatgaaggaaggcaaaagagagccattaaagccaactcaattaaggagggcttttatgaaaaaaaaaaaaaaaaaaggagaaagtggtcagaagccaaggctagtccagttatttatgttttgtgtttgtttcttataatatttcattttaaatacagagggctcatacatatgttaacatgttaatgagaagggtcagaggaaggtaaaatttgaatatgcagaaaaagagggattttttttctgagtttaatgacaaattagaaaattagaaattattatttctgagtttaatgacaaattagaaaattattctgagtttaatgacaaattagaaaattacaaaaattaaccattaaattctgctgtcatactttttttctgctcattttgtgtgaattatgaataggttttagaagtgaattatctgatcagctaaattcttgtgttgttttcaaagttattattaggcctaataacatccaaaatgggttattcttacatgctgttaaattctaaagagaaaccattatactaaagggtattttcttatatctttgtgaaatagatgtctctattacattactgccagtgaaataaacactacataaagtatattctctatcaacttttacccattaatcacattctttatttcattactttgctgtttctactctgttactataaatatatattgcatttcatatgctagaatttaatgagtgcttatatattcctaataattaagtgggaactttttgtattcgcacaacttctgcttttctgaatataaaactataattttaaatttattatttgggggtaaatgctaagagagtcagtttacaggaactggattaagcatagaattctgcatcacggcatccgttagcctgcctttgtggtctgcacgctgggaaagcctgacacctactggaatagaaacagtttacaacgcccggaatatgctcaagtcacagttttgcaaggaagggggaaacaaaaaataaaattaggtaaaaaarartatgttcaattcccacaggaaggggaatatcacactctggggactgtggtggggtagggggaggggggagggatagcattgggagatatatctaatgctagatgacaagttagtgggtgcagcgcaccagcatggcacatgtatacatatgtaactaacctgcacaatgtgcacatgtaccctaaaacttaaagtataataaaaaaaataaataaataagttatagaagagaaaaaaaacaaatttatggaaaaggttatattaaaggttgactttaagaatcattacttataaaatatatatgttatacatatttaattcgatgtaccactttaaaaatatactacttttcactttaaaattggaaaataggttggatccaaacagcaaactctatgtacatcctgtgatggccatacattcggctcgttctcataaaactttacactgacaatattgtgtatagacagtaatttgtggctgtgaggcactctacagtcatctatcattgaaaactcaattacattcaccacactgttcccactacagaaagcaaataaaattatgcctgacaaaaatattttaattgcaaaagttggtacataaaaaagggtttcttcttaaagtctaaattaaccataaatcaaagtatctaaaattccccataatctgagctttgcataattgcttttcaaaaaattattttaaatatcaatttatttatatgattcttttacaaaactgatatttttatctcagtttgaatactatataaaattttgtaaaaggattaagcatagaaagatacactacaataaaagaaccacaaacataaattattttgttgttaggaaataaaacaatgattttcttaaggaaataaatattgagatgaacttgtcttttggacttttagccaaagctaaatatcaaatgtctaatgctttatttaaatataatttacatatcaagaatcttttcactaagtgtaaattattgcttcccatttttattatcttttttcatgtatatatttcccttgaattattttctcatttatgactagtgaactacatgcaaattatagtctttcaaattaataatttgattaaaaacttctctttttagcttgattggaaaaaataaagatttcaataaatagattctataacactttggaagtatttatgttcatgacttcttaagactgtagagacattctgaaagtttttttttttttcctgagaggcaagcttcatctgaattgaacataaatgatgatgatggtcttctgtattggctttatggaaattattgacttgaaacatacaagcaattatggttaagatgaatttatcaggtcattaaagaagcaaaacaggagctgtgtttctttgtatctgaggcaaaaaaatattgaggccatattatatatatcctcttcaaaaaaaatcccgcttaactctgaatcatttaattattataagcagtgatagcagcaaatattttacttttcttaaaacatttagtctcacgacaatcgtgtgaggtagataatattattgtagatgcttcgtagatgaggtagtcacttttgccagacaaagtcatggctataaattgtggagtcaagatctaaaagcaggtagcctggctccagcgacgaactatgttatgggaaatttttcagggaaatttttctttattttcttttgcttatgcagatgtgcccactgcccccacccctcacccttgcctaattcaggattagaaaaaaaaaaaaaaaactctaggcacagaaatacactctcttctttattcacacctatgtgtgcagttaaaaggagaataaaaatcttgtccagcaggcagaacttcatcatcagaaatgaccttctaattctgatctacgaggtgaaaaaagcatgtattgatgacaactctgatgttgccagaaatgcctcattcccctcctcctctcttcttttcccctttcctgttattttgtcctattttttcatcctttgctctatttcttactttttcttcttcaactctctctgattttgacaagagatatgcaaaattattatttttcactttgtgtggcatttttttcagtatgtatgtatttatttatttttattgtggtaaaatatacattaaaaaatttaccattctatccrtctttaaatgtacagttctgtggctttaagtaggttcacattgttttgcagtcatcactgccatctatttctggaacgttttcatcttcccaaactgaagctctgtacccattaaataataacttcccattgcaccctccctaccatccctagcaatcaccattctattttctgtctctatgaatttaaccacttaagtacatcatataagtgaaactgtacaatatttgtccttttgtgtcttgtttatttcacttagcatagtattttcaaggttcttccttttcaaaggttgaataataccccattttgagtgtgcgtgtgtgtctgtgtgtgtttgtgtgtgtgattttctttttccattcatctgtcaatggacacttgagttgcctctacctttctgttattgtgatacatgatattttaatgacgttctcaaattagggtagtgtgctagggagaacatgtactctgactagtgttgctatctaaaatctgttctatttttattgacttaggacacatagttttcctcagggacttaataattgaaccgttaaaacaaatgagggtttagctgaattttttccctgattattgacaccaataaaaataggtttgttaagatatagttacctttaaaattctattttcctctttaaacaaattattttttactaagtgatattttttaaaaagagagggggggaattatccacatatgtcagacttatagagttgagaatgagatgagcaggttggatttgcaaaaagtagtaaacacttataaaaaaatataagactaacttttatatatttaggatatgttttcccacttatcactgaattgggtggggattttatcactatggacttcaggagtttagtgtaaaatgatgtacaacactattatttcataattttgccattagtaatggtcaaacagttaagttttgtttggttgtattttcatgcaataataatcttataattaagatgatagtatttttcatgaggtaaattaggaataatatgaataaattattctcttatgagggatcaatatttttctctctaaattaagtcccaccagagacttagttcttcccctgaagcatttatgaattcattaatgtattcatatgttgtcatttgcaaactgtagtcatttttaagtacaaggtaaagaaatggacatttgagatcttatactttctcaagtcagagacgcatgggtgggtattaggtgaggtgtgaggggttattactagagtcacctgataatcttatttcttcragagaatgttaattttcagaagcagctatgtctgtcttgtcctattttgttttcctcttgttcccttttaaatctctacgttaaagggcatgatgggaaacaaaggtcattcaatccataaagtctcccccagaaacaaaatcttctcccacttctcaaagaaaattatataccattggcttggtttatggtggcgattttattgtcttaccttgacttctaatgaacatcctcaggacttggtattttcatactattgtgtcaattaaagccacagtttattaatatgaaagtttaagtatttagcttcttttgaattagatgacaagcaatctattcatctgggttctaagaactagtataactgaataatgttagttcttagattatccctttatttcttgggaaaatattctgtgtggtcattatttaaagccatcttttttgcttcagtcctctctcactcagttcaggataagaattggtatgactgggccattatttagtcaattaatggaagttttttacattagtcttttcactagtttcctgaaagactgagtttctaaaatgtcaaaataaaaaatatagtaaactgtttatttatgatgccttctcttagttcattatccacaagtctttgagttttatgaatcatawtagaatcctttcccctctctattttatatgttcaacaagctaggcmtttgctcataaccaaagatgtctgcttttccctagaacaaaccttttacctattaacttggaaaatccaaagaatcaatacaagctttttttcagtacatgttgctgcacaaaagcaacagagttattaccctgaaagagaatcccaaatgtggtctgctggatggaaggttatgaccccatggaaaactaaacacttcaaagtaactgctctccatccaccataatcagtctagaaaggtacaaaggattactaggtttaagcaaaatgcttgtctgggatcattgcatttgcctttaaactgcccatcaccattttgccatgcttcattttctatttttaaacctacattttcagataatttggctttaaaattatatttacatttttaatatcccttaatgagcttatttcattggtagcataaacctaattatgagtcacaccaggggctcttttgctgtggatagttcttctaatttaccctggatcaaagattgctgggccatgagcagtctgctgatctgcttctttgtctcctcaactattttagtcatgagattgttttaatatttaggatttcaaaaggtctctgccaggtgacactatcattttgcctcacagagaatgaatatactttttttcttttcaaagccctgagcatgtagtgacggtgatacttgtgttgtttctgccccacactccctcctccacagtcattcagagaatgttcatgtgacaatttaattgtgcttctgttgaagtgagtcagtctcagtaattaggatcatcattgcatttgcatgaggaatctagttaattttttaaagatccctttattgtggtcctctcaattttaaatctttttatttttatttcttgctttttccagttctttgttttacattatttttgcctcaattgtcaccagtgatttaacaacatgtgccagcatgtcttcttacttctttaaggggcctgaaattttaaacatcacattcaaaagaacacaataagttctgtagagctcaatttctctgccttagatgaatgacaatgtggaatgattaaatcaagcaattaacatatctttttttctttttatgtgttgttttctggaatttgtgtatgatgtacttaagtgaggttttactttgtgtttatcctcttggaattcattaagcttcttagatatgagggttgatttttttaaaaaacaattttaggaaattttccctttttttcttctcatgtttattctgcccaatcttaggaccacttcagttttgctcatttatgtttttgaatttttttctctgtacttcagtttggctggtttctattccttatcttcgagtttattggtcttcctttctaaagtgtccaaatttctgttaagaacattcagtccatttttaattcacatattgtatacttctcgttctatttaatggttaattgttttaaagtcatgggttgctaattccaacttctatgtcatgcctgtttttttgttttttttttttctatttactggatttttactccatatactggtcctgttttgctgctttttctcatagttagttttgtctgcttttcatgctgggcattgtggatactatgttattagtgtctggattttgttgtttgcaagcacaaaatagtattcagtccaagattcaagggcacccctatattgacttttaaaatgatatttctgtctggccccctcattttattaatctttaacacattttttaaccatcctagtatccccaaactcagatctctattttctttacttggtgtcttttctggaatccatccttctgtgatgcagtttgraaattgttcccaggcacaaaactagattgaatgtggagctaacatcacatattttccctcaagaatcatatcactgcattgtctactgcccaacatctgaaaactgttgctttatacatcttgtccagatttataatttttgccataaaaggtaaatctgatagtttatatagccagggacaaaattctctgaaatttatgtttttagtttattatatgaaaaattatagaataagctcatttaactccttatatcaagctaagatttgttgtgaaaattcatagaatttgaagattaatttgaggaaaattgacatatttgcattgggtttcccattaattaacatgattcattggctttttctttaaarcttttcaataaagtttaaaatttttacttattaaatctaacacttcttttgctgaatttattcttaggtacattattcttgttgttattttttgctactgttaatagtgtcttttttaatttgttgttggtacagagaaatgtaactgatcttaattttgtgattgaattaatataaattagtattgtattaactcataaacatttatatttgattacattgctgaattgtctttttaattataataatcggcatctagaccattttgcattttgtttggttacaatcatatccactgcagctaataacagttctttctcttcttttttgattttgaaaccatttatttacttatttacttatgctttactgcacataatttaaagtaatggacccggatctgagttttttatctcagtactaatattaatatttgctacaagagcattcttgcattttgatttatcttatagctaaactctgcaggtttctcattttagctttgatttattcttttctttattttgatcttgttagtgtttccttatagtyccygagtacagcaatacagtaataagttattttctcttatatttaaatattttaaagctaaatagcaatmttacaaggtttctgatctatagtatggcaaaaataaatgtttgtctgtgaaaataattttgatgaaaagaattcttttttgacaacagttttttccctaacaattatgatcttctttaggaattggtgtgcttatgtacataccaggttatctcccacagtgayaytggacaaccaggtcacttatgtcccaggtgggaaaggaccttgtggctggaccggtggatcctgtcctcagaggtatgtaatatttcttgaaaatagccactgtttttgcaccataataaattatagccgggaatatataatgttattcatgcaaggtacataatacatagtagggtcaggggatggtagtcacattatgctttagtaagtgaaaatgcagacactaataatatttgcctcatatggtcatttttagaatcatttgagataatgcaatactatatttagcctagtgccttgtgccttatragcattcaataaatgttaattatcatgcttatttctatttttactatcactattacttttactctatatctggtcaacaatcctgtccttaattgcttatgaatttcatgcacagttttgaagatttattattttctcttcatgctaggtcagaaagaagtttataacttggttcatattctaaaattaggagagcttctagttacaattatgcatggaaaagcagctaggtgaagcttttcttcttgtgtctattgtaattagccatgtcatttgattatcattttttaaaaaagtctatgctgttgtcctaaaagatggggctgagtaattgataaattatctgaattcatgtagtcaccgtagctcagctgggggtgtttccaaagagcctgcaataaaaactccaattgttattcaggccatgatggctaatgttatgcaaatagtcatacaaataactcaggcaatgaatctgacacatggcaatctggaacagtgcacaataaggatacataaaatcaaggtgtttcttagtcccttgaggaatagctaaggttcatggtccagagacctaagcacatcttagggatttgggagagctgaactctagttctgttttcagccctcactctctttgtgacaatttccttgccaatacgagacacaaagaatgcattgctaattctttagtaataaaaamtttaccacagtagcccctagcatactgcccttctggattcaaggtgagctctttttatttttttcttttctttaaacaaaccataagtatttatctttattctcgaatcttatcttttttatgccttctgagtgggtgcattcattcgctatttttaatactcgtgtcataattgccactttttcttttattatgtctgagctacatgcaacagatattcagtttgccaaagcaggaacattgaccccaacaatagttcaactaactgcctgagctcatccttacaaactctatatacagtccctttccaaattgcttygcttcctacttagctttaactatgagagtgcagatagtatttcactagacagaatgatttagtgaaataaatgagggtaaatgattagcatgcttttcagatggaagggatcttgtagctcattttgcaactgacaaatagcctcagacatactcggttacctgtcatgttatagcagaaactgaaacgtaagtcyctaaaggccggtctgttataatgctattgctccacatgttcasggtttacccatgtaggtgactgttgtctccatatagtygtacgtggcaaactccaggataataacaagggaggctagcccacatgacatgggctaaaatcacagctctaccccttttagatatgggactttgagagagttatttcatctctctgttctttggattcctcgtcaggaaatgaggataataataatgccttcatcataaactaaaatgaaaattaagcaagatagtatgtacccattttacagacccatttgataaatagcaactaaatattaaagtcacatgggtaagactaatatggccaaattgtacttatgacttacatttacaaacacacagagctcacaatttagtagcagtcactatattgattgttgtgttgaactgctatagtttccatatttcttttctgctgttctatggtttcatcttaaaaataaaatttcctcatattacatcccttctctctctctgtccttctctctctctctcagagaaatactatatgacaaaaatagtaggtagcataatttcaaaactttgaagatgaaaaattcmatgggaaaatgatagtggttgtcataatttcaattagatcacgaatatccaatttgtttcaagttgtttgataytgatctggaggaaatacagatctttttaaatataacaatataggaaatcatatgaattgaagtagaataaattatctccatataactttaaaattggaatgaaaataaattttaacattgatttagcaagaagtattatcaagagaaaagctataatatctttagaaagtcaatggcaggtatcaatttaaaataccaaataccataactagtaatgctttttgtaatgtattgaaagaaacctaagttaggcaataatattgatgatgaatattatgattataacagccgatactaaataaatgcttgttatattgtaggcattgccccaaaaactttacatttattattccggctgatamtttaatgtgaaacaaataatcgatttccctccaattgctcaactctctagatctcagaagatatccaatcctgtctataggatgcaacataaaattgtcacctcattggattggaggtgctgtcctggatacagtgggcygaaatgtcaactaagaggtacactctaatattaataatcacaattctgaacaataagaaactgattctattgaagaaaagaatagcatttccccttttgaaccaaggtaaattaacatgtarccaaactcctaggactgttatactttctaagctttctaacttggtagcttttataacactctgaartctcataagctattctttaacttctccccccatttttatgttggatttrtatgatgagcaaatggaaatctgatgaaagatcttacttattcttaacaacaagctatagaggcatgccttattaaaatatcaggaatgstaattttcaatttttaaataaagtgttattagaagtgactcaatataaaaataagactaccatctagttttgttccagttcagttatttgaaataatgtgcatatgaatgaaatttagtattaaaggacatacaaggtatgtcatgaataattctctctttttcaaaattctaatggagctattttttttttttcagctgaggttttaaggactttctggtggcaaggctgatcaaacacatggtaacccgctgtggcctaatatccatgtgactattattttgcttttggctttaaacaggtttcctttgaaaaataagatacagcatcagcatacatattttaaatgaatgaatattacaagaaaggccattagcagtggtggggaattcaatcaacagtataagagactgtgattaaaaattaataaaactgtggagaaaccgttatggctcacattaagaaaaagaaaattataatacaaaagctctaggaatcctgcattttagttagggatattatttatggttttactagcctatacaatgagaatctacaggcaaatttcaccataatgctatttgttctgggtctggcctgaatttcaaagatgttataaaaattcaatttatattcagactacagaatgaatatgtacttcatttataaccaggtaaaataaacttttaaataaaatataatctatgctgaaaatatttggaaataaggaatttagcatattttaaaaagacccaaatatggccctgatttctgatttccatgaagtacacaaatatatactcacaatggtaaaacatatttgtgtctagaattggtgaattgttaaaagttctggataatatttagaattctgtttctgaaatctgtatttctcttcttctacaaagaaggatatcatgagattattaattccatcattatttcttgatgattcaagtttgtttgcagagcacatttctagaaatttaggttgttattacacatcttattagtagacatgtggcagggaaaaagtctactaatgaaatgtcatggactctagttgatcagagcgttgttgctccgtgcttcaaccttttatacttaggaatcaattctttatcactatggtggactacatacatgtaggaagaaaataccagaacatcactgtaaatatagacacaagaaacaaagactagctgacagtttcaaatatagactgtgtcctgccactctcatttttcaaagtatgatatgaaatatttatgaattcaagtagtttagggattgtctaatgacaccttatatcctaattagaagcaacctgtggataggttttatactagatttacaaatcattgtattaatttccagtggcaaaaatgtcccagaacagttctgattatgaccttctgtcataatagtgtaattggaaccactcataattcaggtatctgctgattaagctgttattgaaaggcctcttttctacggaaatctacaatgggaataatgttccaatggcagatatgcatattgtgtcatattgtcatacaaccaattctaatatagctttgattccaaaatagcctcctgttgctctctgctatactttgaccattctacttttcactttttagtgcagttgtattttcaatggctgaattttctattagtgcaattgatgcactggttgtattaggaactactgtgtcctttgtcccttgaaccttcattatatctctcctgggaggatatttgcacattttccccttctaatagctaaccaaattgcagtaggaagatcttctaaatatgcagggaatatcaccagctcaggaataaattggagctgtttgcaattgtacttttttacttcttctcccccacttttgtacccttctttccatttctttcttttatacccttctttctatttctttggggatgtggatccatctcgaaactgttagaaagagatgtggtgactcagaatacatggcgattctctctttattccacaatatgctaatctgctacgcacgtactttagctgcaactcagataatcaaaatactggtagccacagttctagattaccttataaaaatattcatcatattatcaaaaggaaaccaatttttaaaaatctaaatgaatagaactttattgggggaaaaaaggagyactaagtccaacatcaaagtaatagttctgatatgttttacatttgttatgtcattttctcttttcaaacatatatatttgtacataatgaggagtgagtcatcaaagacagtttgcacaagggttttgcctttagaaaggacctaattttgtgatatggtattcaagatacttttcaaaaagtcagcagtaacatacacttaaatctgttttataaaatttgcaataatgctcttttccagtagatgtctctaaaatattctgaagtggaacaaggaaagtgtgacttgctttaatgacacaaagggcaatgatttaaatacaaatagtgttagattacagaggatgaagaaaacttgtttgcaaatctgtttttaaaaatccagtggctttaatcatcagatcctttataggaaaaaggtatcttataacattctgttttgtactgcagatattatgaatgctgacaaaatgtgagcatgtacaagtgctgaaataaactggcccctaccatatgttatgaatatataaaaaatatttggttttacaaatgctgggaaatcatgcaataaattatataagagctactgtaactaacatttgaatatggggctcctccagcaggagtattttaaaatgcattccctgtagttttgcatatctagttcttcccagcagtagcaaatgctttcttctttgagaaagaacattacctcctctaagagtctttcacaataaaattatgatgcatttagtgaagaacactctgtaccataagtggttgttgcaccaaactgcctacttcaatttacctagtmaatctcagtaaagcttaacatgtacaccgaacattcaccatgcaagttttcacttgatattgagggatcagctggaaatctgtctcctcaagccacacaggaaggttttctggttctgagtgagagagagcaaacatcctcattactgagttgccattaatgacatcctccatatggctcaaaggtctggaaggaaaacaaaaaaaacttgcaaataaaatccatctaattaaaaaaaaaagcatctaataaggaagctgttgctcctactgtagacacttgctgaccttgcttctctaagtcgttgatctgtcaaggtcagggcttccattgcaaggggaaaaaaagagagtaactgtcctgggagaaaagcaaaaaggaatccaacttaaaaaatatattgcattttaaaaaaatctgaaatgcacaaacatctttaaaaatttagttgactgaaataaatgtccttctgtccctgtacctatcgcttagaagggaacaagaaaaagaaacttagaaatctgtcctgtatggaacaaagcaaaggtctgtgctcaagtgaaagacagattgcttggaaaacctagaatctgtggcagtccttgtgatagagaatacatttggggagacagaaagattgctaaatgaaaaaacaaaagagcatcaatcaacgaggctctttatcacaagagagtaactgactccactgtcagagatcctatcagctctttgctgtggctggttaaatcccgtgtaataaattgggatgaatgcaagtactgaactccagtcaacaaacaaaggtagggaaagataacataaactattgaatttgtaaaacaggcatttcaagttttcaacagccttggcagggactccatccaatgaattccggagcaaagagattcatgtgacaattggatctcaaggatctttgtgtgatgcttaatagttgtttcttttattcaggagtacagttttctcacttagattctgaaaaaaaaaaaacaaacaaacaaacaataaatttaacaatgctgctaaaagcaaatgggaaactttatgaacatgcatgtgcccacatgcaattacattaatttttgacatttaatactaaaaaakttaatcacattttctttcaaattagtgatgttgaaactataaaatatgaaaaaagcttaatttttctcattttatatatattattttcatatactgaggaatgaatcatcaaattttagtgtgcaggaaaactagattttcacttgatacttctatgtatgtttattttttatctttttcaattgcttgttttttttctttctgacagcttttcaatttactctctcctctccttcttctcactgattttaaagttttttcttacgtttttggttactattttcaatctattgattatctccygcatatcactgtctattcccttttttaatggaataacattttccaagatcacatgaatgatatatgtctcaaattcttttgaccctgaggtcaatagaaaattaaactttgatgctcttcatttgcttcctttctattcttgacactttacctctcacctaggtaaatttttacttcttgaacattcaggatctttcctagactgggtagcacrgagggaactatatcttgatgacatgctcctactgaagtctcaaataggatcctagaagagttaaaatccccccacacatcctcgtgtgtgtgtttgtgtgtgtgtgtatgtgtgaaagagacagagagagcccttgcccttgtttccccagtctttgaaggatgttaagtaaaacattgttataatcttcatattaaatatgcagcatgtaatactttgtaagaagtaaaattaagagacctgattacaattccattataaaatgcaacttaaaataacatgtcactatttataataaagctttaccaaagtattttgaacccctggaaataaatcctgtgtaaaatgcttttgtgatttgtattgaggtctctccacttcgggatcacgagcacccaaaccaatctgcctcttgattatgatgattggtgggaaggggcagcagccacagtcaatattgtatataaatcaaaaattaagaatgyattactttttattttcttaaattagagcattgtctataatacagtctaaaactacagaccaagtaatatacatcataccaaaaatcactcatatcattctaataatttctaagcaatttattgatttctacaaattatattgatgtcgtctttcttttgccatggatgataccagctaaatgatgtccttgtcagagaggtaatttaatataggsaaccctctcaacctcctttaatgatttacccatcagatttagagtcactgggtgacatgaggtctcaataagtttgtaattttattaacatcagttaaattatcctcctgctgaattatctattgggctttcctgaataaaaagtgattgcattcaatttttaycagcacttaaatactgtgtgtatttttgaatgtttactgtctttattattaactaaatcatgaaaattcttatctaaatatcctatttaattagtttatagagctttgttaacgtcattaggccaaattcatctggcagcataaatcaatgaatatttattgcatttttttagttttgtcatataaattttattttcaaacaattcattagaaaatctttttcttacataattggccttttactaatttttgtttcaaatagtatatatacatctatatatttcaattaatatatattcatttaaaatagaatatataagtttcaaatgtatatttatagaatacatgaaatttttatatctatactatctttgatcagttttttaactatctccagtttaataaggggaattttcttttctcgtaaagctgaaaaaggattggcatttctgttagagtgtcatctctgaaaatcagttattttttaaaaaagtctattttccaaatgttaaatttcacaatttatatgaaagtgaattcatagggcttgatataatttacaaaatgcctttttagctgtaacatcacaggctatctttgaagtccaaatattcttccaatttttattattttaatttttagcatgtgctcttgctttccatctctctttccatctttctctctccctctcgtctacttttattgtctcttctttatttgatatatagcagtaaatatgaaattcatctagaaaagatttcaagtgtttacttgataacacattatactttcagtcagaaatatttgaatacagtagcttatagtgccaaaatttttaaaaagcagaagtctatctaaaactttgcctggaactcctggtttactttttcactattattgcacaggcttcacctatgtaaaaaattaaattttcacatacacaaattttgtggaaaattcctttctcaagtgttcatatgtattactacattactaatgtagcattaaagatgtttttccttctaatttactgagatttaaaaaaattaactgctttaaaattcttgatttttacgttttaggaaaattatgaaaatacttgtatatgaaagagttcaagtttcattaataatacttttaaattttattaagttgacttttaagttttctaagaagttgtcttacaaaaagcagtatcataaaactcatttgcaatgatattcctagatcagaattattatattaggtaagttctgtaatacttttcttttctaaaatgctctattatttttaaatgctcttattattttaaaaaagaaataatttaaaattctgattttttctaaatattttattattttatgggcactttattaacattatcggataaagtattttttaagttttttacttcaattgatttcattgaacatttttattattaggaatacttattttgtgaggctaatttcataacattttttaatattttcttcatgattcatggttgcaaacgatctttaacatagtgggtgaatgccattatgatgaaaaatgagtctaataattttatttctatattatacaaatttgtaggattgtttgaatccaacgtttacctagcaagaaaaaataatctaccaatattgaaaatcaagttgattttcattccagaaatgtaacttatttattttatattgaatttattttttataattatttggtattatttagatgttgtacatattaaaagatgttccagactaactgagtttgcagagtatcattacctaatttaggactaggttcctaagtgatacaatttttgttttattctcagattcaaaaattcaaaaaattcatactcaagatacccgaaacaaatgcttttaaaatttggttaaacttttgtttctttttcagtgtctttgataatttactataaacttctggaccataattatcaaataactatgcatttagaacaattagcacatgctaataagtaaaataaattgagcatcaaactattcagaagttgtagcaaatacaaaaatcataagcaatgataaactgttcattctactaaaacactgactgtttcacaaaatctatgcactgcctgacatcagtccaacaaaatgctaattctgaaaaatagttttcagatgttgccacagtaggaattccattcatcacatatcctacaaaatacatcctttatcatgtatccatgattaacttgtaattagttaatattataatttgtataactcagcttgtcagttattggacttcagcattatatatttgccaacagttgtggctttattatatttcaatattttaacaattggccgaccacattgctacatactggcaaaacacaatcatggagttggggaatgtgcaatgttgctagatgggagtaaggagcaacagtctggcttttgagtggaaagtgattttatttctgagacattctaaaattgtcattgggctgtagatttgattgctgtgaaggcagcacaaacactcttcatatgtttccatgcttaacagtgcctctttagggatcttgtgttataacaatagaaagaatggtaatatctgcatgaggaaatcaggaagctgtgaaaggtaccttccacccccatcccacttcacttactctttaaggaattgtatgagactcaaggttttcatttcttaaactttattaaatctgtcttcaacacacacctttgttattaacaggaatgctrtttaaaagtctatgaagattgatttctggattgcaattttagtattaatatatctagtattttctgcattataacaatgaatttacctcttagaagtagaaagcttagcaatttgttcaaaattagtgttcctaaccagggccatatatagaaatcacctgtagagttttgttttttttgtttgtttgttttttttaaatacgcacctgccccattcctcaaaatagagctactgaatgagaatctcaggtgagggagtggaaagaacatggacacttaatgtttcaaagtatacaggaacttctcatttccatctacgaggaaaaaaatcagtattctaatgggatgtaaagaaatatgtgttataataaaagttaatgatagaaaaggaaattcgaatagtaatcttgtttgtattcaacaaaacaatattatctttgctttcactataattatgcttcccttcctaacaaagtatccacagcctactgagttatggtactaccttcaaatgcaccagctctttttttttcctatgatctagccaaaaaggtaagcagcaaataaatgaaaagatcattgttcatcctgttaaattcacctgttcttactgctataaatatttataagttagtatccttaacattcatatttaaattaatagatctaaggtgggactctagaagttctacctccaaaagtttccaggtgatgctcatactgctgattaaaggaccccagtctgagaaccattgctttactctctagttatactcttggatggatgtacatttaagctgccagaataaaatgccttagtacaccatttaaggaggaatcgtgataaaaatttatgcaatgattaaatggttgtatctgtatgaattaatttaaacttacactataataaccttattgctaggtcttagaagaagatttacacttttccccacgcaatccatcccctaaataattacactattccccaagctgcagattgcttttgtccatcagataagtcaacaattacacaggactttatagaatacagcagaggaaatgaaaatcaaaaagaaacagcatcaaaacaaaaatcttggacatgaatggaaattcattaatttagctcaatgccctgaagaaaaacaatgcaaaattcaatctaacaatatagactcacccamattaatgccaaatatacttcctgtggagtagagaagcttaagtattatagtcaaagccacatatggcttagggagcataattaacatgtgccagagatgcagagtttcattggttcataaactcacctgggaagaagcacggctagacacaaaacacttgtttcctcatgtctgtcatgcagactttaatggataaatttgtttgttagaagtctgcaaattaaagccatattatttgatgttctcaatattttattttatttatttttattttaattattgattgattgattgattgattgattggcagagtcctgctctatcccccagctggagtgcagtgatgccatctcggctcactgcaacctccgcctcccgggttcaatagactctcctgcctcagcctcccaagtagctggaattacaggcacctgagccaccacatctgactaatttttgtatttttagtagagacgggctttcactatgttggccaggctggtcttgagctccgacctcaagtgatccacctgcctcrgcctcccaaagtgctgggattacaggtgtgagccaccgcacctggcctgtactcaatattttaaatagatcatttctctaaattgttttccccaatgaaaaactatattgccatttaaaatattatttgattcatgggaattattacttgccatttaaaatattacttgattcatggtaaattcttcagtagagtagatttattttacaagaatttctattgaaatttcactgactttaccagttgatttgcttgaaatgtgcctgcaatagtttacttttatttttagtccagtttgagactatcaaaatctggaaacaatccatttaagtggcactattaatgaaatagctatttttattttagtaaggaacctgtagctctcccttttttccaagtagacaccagttgggaattgccttgttaaacaatcagcctttgtggcagtccacttataagaatgctatagcttttaacacagcggatttaaaaatcccctcaattatgcaggcaatttacatctgctagtttacacagctcctccaaactaccatcccttttcacggaaaggaggcctgaataattttatttttttttccaagcagaattagagtcctgcatttcccactccaatgtggtkttgcattgccctatggttgggggcggagcagcttactctgcaatcatccccgaccatcatgcttcagtacgcgggaaaatgaatgtcagccaaattattgttcaggactgraaaaaatgaggctgtcccagtgcttaactgtctctcttctctttctgcttccttctagcccaggaacagcaaagtttgatacacaccaaccaggctgaaagtcatacagctgttggcagaggagtagctgagcagcagcagcagcaaggctgtggtgacccaggtcatagattgtaattactatcatctctgacccaattattgtcaatgctatttattacaacttccaagcaagaaatctcttagttgtcaaatgattgatggtgacacattagcatacttctcagtccttttctactggtgctggatgttgggagaaattgtggataagctataataggtactgaaaagaccatgtataactacagaagctttgtgtgcaaacacagaaagaataaaaatgctgtgatactaggttgtaaggaaaccacagttttccaaaataagaccaaacttttgttctccaaagagtgtcattatggaagacccttgacatggaaggaacaacttattcttttaagggatctaagaaggctctcttcaattcattaataagaggttgcttaatgggtactgatccctaagaartgggattatgactaagaatcaacaagaacctcctgctgatccaaagttggcatgtcacatatttttccatctttctaatcagtttttgccatttcttttaggctaaactttagctyttacaaacataaggttggttactgctaaaaacatctattcactgtgtttggcatggatctagtcatacaaaacaaggcactcaattaagaaatgtgacttaaagggctgtctttaagaatgcagctgaatatcccttaacaatggtggtgtaattttttaagggattgaaattcagtatctttataaaagaccataatattcttgaattactgcaatacatgtgtaaagggatagacagtattattgctatataaagtgattcaaactaaattatgagtctctttatctttgattaacgaatacctcagtaaacaataaaattctcagaacatagctacaactacatrcatatatctagctgcatattttaaatgctgaggtattgaatttggaagcagaagatgagccatcagctctgtaactgcgagcaagttattttggatttctgcccctttgtttctttttgagagtgtaacagtaactctttgaaataatttttttaaaacactgaaaattctgggaaaagttaaaacattttagaaatctaagctattatactactctttacaaatttctacacttagtcttaacattcaagttgccatttcctgaatgaatatagtcttgtattttcaaatgtattcctgcaaatatagtttgtttgaattaccttcaaacctatcatgaaatttaagtgatttttaaatatatatatattaatttttaattaaaaatttaagtgattttaagctgggcacagtggcttatgcctataatcccagcaatttgggaggccgaggcgggtggatcatgaggtgagaagatcgaaaacatcctggcctatatggtgaaaccccgtctctactaaaataaaaaaaaattagtctaacgtggtggtgtgtgcctgtaatcctagctacttgggaggctgaggcaggagaatcgcttgaacccgggaggcagaggttgcagtgagccaagatcatgccgctgcactgcagcctggtgacagagcgagactgtctcaaaaataaaaaattaaaaattaagtgtttttaaatatatatatttaactttcagtttttgtgggtacatagtaggtgtatgtactgttttgatacaggtacacaatgtgtaataatcacataatggagaatgaggtatccatcccctcaagcatttatcctttcggttacaaacaatccaattatattctcttagttattttaaaatgtacaattaaattattattgactatagtcaccacattgtgctattaaatagtagatcttattcattctttcttttgctattcttttttattatttatttatttatttatttttagagacagggtctgcacccaggcaggagtgcagtggagtgatcatgcatcactacagcctccatctccagagctcaaccaatcctcctgcctcagtgcccaagcagctgggaatacaggcacgtsccaccatgcctggttaattttttttttttttttttttttttttgtagagacgaggtttagccatgttgcccaggctagtcttgaatctctgggccaaagcaatccacctgcctcagcctcccaaagtgctgggactacagccgtgagccactgtgacttagtctctaacaatttttttatacccaaataaaaaacaaatttttatttatatttttaatatatatatatatatttaatttttaattaaaaatttaagtggttttaggctgggtgtggtggctcacgcctgtaatcccaacactttgggaggccaaggcgggtggatcacgaggtcaggagatcaagaacatcctggccaacatggtgaaaccctgtctctactcaaataaaaaaaattagccacacgtggtggcatgcacctgtagtcccagctactgggaaggctgaggcaggggaatcgcttgaacctgggaggtgaaccatccccacctcactccaatcagccattatccttcccatcctctgataaccatccttgtactctctatctccttgagttcaattgttttgatgtttagatcccacaaatacatgagaacatgcgatgcttgtctttctgttcctggcttatttcccttagcataacgatctccagttccatccatgttgttgctttgttttttatggctgaataatactccattgtgtatatataccacattttctttatccattcatctgttgatggtcatgtatgtttcttccatatcttggctattgtgaatagtgctggcaatatacatgggagtgcagatacttcttggatatacagatttcctttcttttgtgtgtatacgtggaagtgggattgctagatcatatggtagctctatttttagtttttgaggaacctccaaactgttctccgtagtggttgtactaacttacattcctaccaacagggtatgggggggttccctttctccatatccttgccagcatttgttatttcctgtcctttggatataagccattttaactgaggtgagatgatatcgcatagtagttttggtttgagtttctctgatgatcagttatgttaagcacctttttatatgcctgtttgccatatgtatgtcttcttttgaaaaatgtatattcaaatcttttgccctgttttgattggattatcgggtgttttcctataggcttgtttgaccttcttttatattttgattattagtcccttgtcagatgggtggtttgcaaagatttttctctcattctgtgggttgtgtcttgactttgttggttgtttcttttgctgtgcagaagctttttaacttgatgtgatcccatctgtccatttttgctttgagtgcctgtggttgtggggtattactcaagaaatttttgcctagaccaaatgtcctagatactttctccaatgttttcttatagtagtttcatgttttgaggtcttagacttaaagagctaatccttttttatttgatttttgtgcatagtaagagacagaggtctagagtcattattctgcatatggacatccaatttccccagcaccatttattaaagagactgtcttttccctggtttttggcacctttgttgaaaatgagctcactgtagatacatggatttgtttctgggttctctattctattccattggtgtatttgtctatttttatgccagtaccatactgttttggttactacagctctgtgttataatttgaagtcaggtagtatgattcctccagttgttccttcagttgttctttttgcttaggtaagctttggttattctgggtcttttgttgttccatataaattttaggatttttttttttgtatttctgtgaagaatgtcattagtgttttgatagggattgcattgaatctgtaggttgctttggatagtatggacattttaacaatatttattcttccaattcatgaacacggcatatcttcaatttctttcattagtgttttatagttttcattatagtgaccttccacttctttggttaattgaatccttatgtatttaactttgtgtgtggctattgtaaatgagattacttttttttctttctcagattattcactgctggcatataaaaatgctactgagtttcatatgttggttttgtatcctgcaattttactgaattcatttatctattctaatagttttttggtggagtcttcaggtttttccaaatataaggtcatatcatctgcagagaaggataatttgaccccttcctttctaatttgaatgccctttattcctttgtcttgtctgatagctctagctagagcttctagtgctttgttgaaaaatagtggtgaaagtgagcatctttgttgtgctccagcttacagaagaaagggttttagtttttctccattcagtatgataccaactatgggtcaaaatatattttttaatggtctcaattttctcttctatatgcagaagtgatgcaaaaaatgactgatcaggtgaactaccaggcaatgaaactgactcttctgcagaagaagattgacaatatttctttgactgtgaatgatgtaaggaacacttactcctccctagaaggaaaagtcagcgaagataaaagcagagaatttcaatctcttctaaaaggtaaaaatgaaataaaataaaatattcattcagtaacacagaaagcaaatgattcatttttcttttcttacatcactttgggatctttgctttagtttgggtggtatggaaacctaagaaagattttttttaatgagatataaattcactaaaattctgaaataatttgaaatatctacattttattatatatactgaagtctttgactgaatattccatttggttgataaacatgatgtctctaactatagcctaacatattcatttttagttaaagtgagtcatattaatttacttccattgtgttatctacttcaagaataaaracgcagttaggggatcaagatagctagttgcatggttgtctcaatactattgatggagacattgaggataaatctgaagtgcattattatcccccaaattttctaggttatggtgtaaaatctattaaatatatcctaaaacattccagctattattaatattaaagaataataatttatatatgtgaataggctttgcctgaattttgtgctcttcaaacagtgggcttaaaagcaggctatgtttctttctggaggatcaacaggataatccatttcctgctaatccaagatgctggcagaattcattttcttgcagttgtaggactgaggtctctgttttcttgatgtctgtaaactgaggcccattcccagcttctagaagccactgcatttcttgactcatcatcctccatctttaaagccagctacattgtgttgagttctccctgcatctttctgactatgtaactccgttggacctacctggataatcagaaaaatctctctatctcaaggtgcttaactttaatcacagttgccaagtcccttttgccatgtaaggtacatattcatggatacagggaattagcatatggacaccttgggggaaaggggtgtgtattattctgcctaccacagagatttatgtatagtgagtaattgttatgatagtgttatacacaggatacaatgggaccacttgacacttgcaacaaatccaatctaaggggaccagggaaagcgtctagaaagagaaaccatctcaattgatgttaaccatgcagaaaggtttcgggtagggcaaggatgttctaggcatgcagttagtttgattcctgggagcgtcccagtcgggtttattgtatgaaacttgtctgtttgcaagtttcaggattactgttttttttccttttgctttattcattaaaaaactcagtgtacaacccaatttttatcattcacaagttatcttttctctattgatttaaaaaagataaataggtggatatttaatatatcatctaccagtatggatgcttacatagctcaacaacaattatgttttttaatcatataaataattgctgctactcaaccactaaaagaaagaccctgtcctacatatctggtatggcccaaccttaccaatgctgagcatgagaaggaaacatttttcccccctgaagtgacagcatgagaaagaagtcaaatagaaacagtatgtaattgactataaccatctgaatgagatttgtttagcaagatttggttctcatgacctaacagaattagcctgtcaactgtttttttgtgacctaccagcctactacaaagattctggcactgacacaggagaaaaatcacacactcacagcaacagcattaataatgaaactccctccgcaataggaggaattaattgtgtactgagcacagtcattaattataagaaccagagggcttgtagttaatgaatattcttacaggaaacaaaaactaaacccacctccaaggtgctgtgcttgcctagcgaaaccacagcttcctccctagtttactttacatccaaggtgaaaaacactgcgtaatctgacagtagccatagaaactgttgaaaatcaaatgtctcaactccgtaagaggaggtggataccttaagaggtacctaaatgttattaaaaggccatacattcacaattacagaaggtgaatgctaaggtatctgatatcaaatatatctggtaagtcaccaaatgtaatatgcttctaagaaagtggaagcatatgagtcacaggaaacagaaacaaacagaattaaaatgatgtgcccactcaactattaacataaagcactttgacatgttcttgggaaatcagattcttgtacagatgcttgtttagtaacaaattgtagaaatgttacctgaaaagcttctgatcccaaaacacatttttaagctaataatatgtttaatatcttttcagacattgctgtgattttgcactttcttcaaagtatttttccataaaagtgttaaagtgtaacagctaaagtaatttacattactcattttcattgttttttctcccaattatgttgatcaagattttgtgctgagtttttgcttattgtttttcttattaggacttttaggcatgtagttttttgtttgctgaagttaaacatttattgtcattgtccacaactaataaattcaataaagcctaaattttattgtacctttcaatcttgaaaaactgtaagattataaatttaaagaaggtcgaatctgaaccttaaatattttattatatttcatcaagcttttgatgtcatgagaattagagtcatttttaactaatgggaaatgactaaatgttcttatagaaagagtaatattaatattactattgaatagtaccttacactcaatgatacttacatattcttttttgtaagaccagaaatcgaattttctaaattttacttactctatatagcatatagaatgtatttcatcaatatttattgaataaatgggtgactggttaaatgctaagcaaaatgtagaagataaaaatgctttaaagcctttctggtgtgattatccatgttatttgatacaaaagctaggactatttctgtataatttatcttaattgtggctagttagtcttttctaattcatttagcctttccttagtactttaaggctgtgtgtcatattgattactattctatatttcatgttttgttttcttttttccattacatacaaattgatctttggacttttaaacttactttagtttccactaagtttataaaaagtaaaataaaatatctttcccattttattttcatctggcaacatggatctttagggtgcaggatttccagagaaatgtttatccatctaaattttcatatttacagcttcgtttttgtacaaaattgtcaatatcaagatgctcaaacaatacatcattctatttttaataatcactctttcacatatttttatgtaagtccctcatgtatgttaaaaacttacttacaaaatggagacatgtggagcctatttttttaatcctaggatgatctttctttaatagactacatagtagctataattgatggcaatatcccattgtacagactttcctgtctaaaatgctttgcattgtattgtgtgtattttacattatagtcattgattattgtgttagtccattttcatattgctattaaaaaaacctgagacagggtaatttatatagaaaaagaggtttgatggactcacagttccacatggctggggaggcctcacaatcaaggcagaagatgaagaaggagcaaagccacgtcttacatggtggcaggcaagagagcatgtgcaggggaactgccctttataaaaccatcagatcttgtgagacttattcactatcatgagaacagcatgggaaaaatccctccccatgattcaatttatctcccactgggtccctcccacaatgcatgggtattatggaagctacaattcaaaatgagatttgggtcaggacaatgccaaaccatattatttcaccccggccccttccaaatctcatgtcctcacatttcaaaaccaatcatgccttcccaacagtcccccaaagtcttcattcatttcagcattaactcaagagtccacagtctgaaatctcatctgagacaaggcaagtcccttctgtctatgaacctgtaaaatcaaaagcaaattagttacttcctagatataatgcaggcacaggaattgggtaaatacagccattccaaatgggagacattggccataacaaaggggctacgggcctcacgcaagtccgaaatccagtggagcagtcaaatattaaagctccgaagtgatctcctttgactccatatctcacatccaggtcacactgatgcaagaggtgggtccccatggtggtgggcagctccatccctgtggctttgcagggtacagcctctcttccagctgcttccatgggctgattttgaaggtctgtggctttttctcatgcacagtgcaagctgtcagtgaatctaccattctggggtctgcaggagagtagccctcttctcacagctccactaggcagtgcccaagtggagacactgtgtggggggtcccaccccacatttcccttctgcaccaccctagcagaggttctctatgaaggctgtgcccctgcctgcacatccatgtgttttcatacattctctgcaatctaggtggaggttcccaaacctcaatccttgacttctctgcaccttcaagcccaacaccacatgtaagccacaggcttggggcttgcaccctctgaaacaatggcctgaactatacattggtcccttttagccatggttgggacacagagcaccaagccttgaaacagcacaaagcagcaaggcccccatgaaactattttttcctcctaggcttcccagctggtgatgggaggcactgctgggaagacctctgacatgctctggaggcattttctccattgtcttggcagttaacatttggctgcttattacttatgcaaatttctgccaccagcttgaatttctcctcagaaaatgaggttttttttcttttctatttcatcatcagcctgcaaatttttgaacttttatgctctgcttcccttttaaacataagctccaattccaagccatatctttgtgaattaataaaactgaatgcttttaagagcacccaagtgatatcttgaactctctgctgcttagaaatttcttctgccaggtatcctaaatcatttctctcaagttcaaagttccacagatctctagggcggggcaaaatgccaccagtctctttgctaaagcatatcaagaatcacctttgctccagttcccaatatgttcctcatctccatctgagaccatctcagcctggactttttggtcaaaaccatttgacaagtctccaggaagctccaaattttctgacatattcccgtcttcttcagagccctccaaactgttcccacctctgcccgttacccagttccaaagtcgcttccacattttcaggtgtcttaatagcagtagcccactctattgataaccataccccactctgttggtaaaagctatattagtccatttttatgcagctatgaaatagctgggtaatttataaagaaaaagaggtttaatggactcacagttccacatggctgggggagcttcacaatcgtggcagaaggtgaagaaagagcaaagccacatcttacacggcgacaagcaagacagcatgtgcaggggaactgccctttataaaaccatcagatcttgtgagaactcacttactatcatgagaacagcatgggaaaaaacccacccccgtgattcaattaccttccactgggtctctctcacaacatgtggggattatgggaggtaccattcaagatgaggtttgggtggggacacagccaaaccatattaattatattttgaatttgaatggacatatcttccagttatgtgtacttcatcactagatattataaatatatctctagtatatgtatcttttctgttttctttgtatgcaagtttttttatattttaaatagtcattttctattctaaatagttatgaatattaatagttgtgaatagtccagtacacttttcctgttcctttttttcatgctacatttagagactaccacaattatggcttatgattaaccaatgttttctaatatttgagatagtactatgtgtttcattacttgcaagttttctcttctctttttgttaaaaattaatgtcatactataataatatgtcaggtgtatcttgaattcctattttcgttggaggaagacttaattttgaaatccccaaatctcattattattattttattgttattataaaacactattaaatcttatgaatattacttcatttttcctcatttgagaatatcattaaggtttttccctgcagtcaatttattagcttttataagcccaaagcataagctttgcaacttaattagtagaaacctaacaacacagtcatgagctaacaccaggtattatttactaaggcagaaagcccaaagccatttattttcacacaaaacgaaaactagacctagaattattgtacacaagggtgtattactgaagtcagtagtagttccgtcatgtctttcatccaaaggaccttagttttatggttttagtatgttctagtatgttctgcaagtgatatctcctctcagatttattattcaaggaattgatcaccttttataaattatagtaatttttaaaattctataagtaaatgtagttaagaggtatttttattattacgtgttattaatgtttaatttcaaactttttatcttttagagatgcttaaagtctcatataattaaaacyatgtattattaattatttctttctctaggtctaaaatccaaaagcattaatgtactgataagagacatagtaagagaacaatttaaaatttttcaaaatgacatgcaagagactgtagcacagctcttcaagactgtatcaagtctatcagaggacctcgaaagcaccaggcaaataattcaaaaagttaatgaatctgtggtttcaatagcagcccagcaaaagtttgttttggtgcaagagaatcggcccactttgactgatatagtggaactaaggaatcacattgtgaatgtaaggcaagaaatgactcttacatgtgagaagcctattaaagaactagaagtaaagcagactcatttagaaggtgctctagaacaggaacactcaagaagcattctgtattatgaatccctcaataaaactctttctaaattgaaggaagtacatgagcagcttttatcaactgaacaggtatcagaccagaagaatgctccagctgctgagtcagttagcaataatgtcactgagtacatgtctactttacatgaaaatataaagaagcagagtttgatgatgctgcaaatgtttgaagatttgcacattcaagaaagcaagattaacaatctcaccgtctctttggagatggagaaagagtctctcagaggtgaatgtgaagacatgttatccaaatgcagaaatgattttaaatttcaacttaaggacacagaagagaatttacatgtgttaaatcaaacattggctgaagttctctttccaatggacaataagatggacaaaatgagtgagcaactaaatgatttgacttatgatatggagatccttcaacccttgcttgagcagggagcatcactcagacagacaatgacatatgaacaaccaaaggaagcaatagtgataaggaaaaagatagaaaatctgactagtgctgtcaatagtctaaattttattatcaaagaacttacaaaaagayacaacttacttagaaatgaagtacagggtcgtgatgatgccttagaaagacgtatcaatgaatatgccttagaaatggaagatggcctcaataagacaatgactattataaataatgctattgatttcattcaagataactatgccctaaaagagactttaagtactattaaggataatagtgagatccatcataaatgtacctccgatatggaaactattttgacatttattcctcagttccaccgtctgaatgattctattcagactttggtcaatgacaatcagagatataactttgttttgcaagtcgccaagrcccttgcaggtattcccagagatgagaaactaaatcagtccaacttccaaaagatgtatcaaatgttcaatgaaaccacttcccaagtgagaaaataccagcaaaatatgagtcatttggaagaaaaactactcttaactaccaagatttccaaaaattttgagactcggttgcaagacattgagtctaaagttacccagacgctcataccttattayatttcagttaaaaaagrcagtgtagttacaaatgagagagatcaggctcttcaactgcaagtattaaattccagatttaaggcgttggaagcaaaatctatccatctttcaattaacttcttttcgcttaacaaaactctccacgaagttttaacaatgtgtcacaatgcttctacaagtgtgtcagaactgaatgctaccatccctaagtggataaaacattccctgccagatattcaacttcttcagaaaggtctaacagaatttgtggaaccaataattcaaataaaaactcaagctgccctatctaattyaacttgttrtatagatcgatcgttgcctggtagtctggcaaatgttgtcaagtctcagaagcaagtaaaatcattgccaaagaaaattaacgcacttaagaaaccaacggtaaatcttaccacagtcctgataggccggactcaaagaaacacggacaacataatatatcctggtaagctgttactgaaaagtaacttttaatctctctttttacttaaatgatatttaatagatctgtacagttgagcaagaccattaaacataaaactacatacttgaacttggatagatagtcaagttgtgaagatcactgacattatttaaatctgaatctatcttacagtatttcagayatcaatacaaaacaaatatttctagtgtatatttggctatgtgtttttaaaatttttctgactagacctctataaaataattaaatttgctcctatggaacaatttgctttgcacaagtaattaaacaaagctattaggcaaggagatctttaatagaccagatttacttattttggcattttaccatatctgatatgcaataggaactcagtaaatacctgttgaatgatcatctgacaatgaatgttcaggaaatagatttgggtaaatcatagaaggccatcaatgccaagctaagtacttagacatgattttgtaaagagtagggtgtctgaaaattggtatcagtggattggttgtgataagagctgcaactcagaagcatgaagctagcaatagtgtgtagtgtgattgcagaggtgatattagggatgttactgaatgaatattggcaagagccatagaggaagctctaaggctgatgtgagaaatgttggaaagttcccatcaacagaaacagagggagagtggcaagaaaaatgatttgaggaacatcaaatcttgattctggtcctagatgtattagtaagtttctgtgttagttaatagcactaggtaaaaagttcacctctctaggccttagtttcttccttttaagtgatgagattgcagtaggtgatttgctgaggtgcttagtagagatatgccgaagactgcttcactgtaaaaaaatccacgatctgttcacagccttaatgcatgacacttggagaagagagagatctagactttcccgatgttttgaatttgggaaatgacagaatagtggtaccattaacagatgttctaaacaccaaggaagaagcatgtatttgggaagaaagaggaattgtgtggtgcatataaattgcataatagtacctctgtatgaaggaagtgttttatgaatatggttgtcatataagtaatattgaataatcttttctaaatatgaatatctcttcattcttacaaaaagtaatggctgtgtttttctcatatgagtctgctgttaaattatagcccatttgtatgaattttgtactttatttctttttaattacaaaggatgatcattattctaacataatatgacttcatatttaatgtatgaatgttttgataatattaaaaataacagaataatagagttgaattatctctactatttaaattagtatatttatttatgactcccccagagtaatctgacctaatagaactaattttacttctgtaggaacatagaagaaactatttagacgtatatgtttcccagagaaaggtagtatctcaatataagatgttcttaaaataacaattttgggagatataaggagttgttttttccatactatttccattattggtcttcatgtggacacttcatcatgatcttcaattagctatacagcatgtgtgaccacacaccaggcaagctatgtcattttttaaacatatatatatatatatatatatatatatatatawwtttaaaatatatatatgctattttcatagtaagtataaaattgaaatagcctcaaataaattgaggaaaaacatttatagaacattaagaacttgcaaactttgataatataatgaatgcatgttaggacattataaaaattgtatctagatacttattgtgattgactcaatattgggcttaatagactaataataggaaataactcagttttgattcttattttccaataaggctttgataacattgcttcctgttcctttatttactgactgtagaactttttatgttcctgtctaccaaaaataactattaaagttctttattttatttaagcaaagataccaataatgatgccaaggtaataaagatatactgacctaattcccacgtgcaaggtagatattccttttatgccaggccgggccagcaacataatgtatgggacccttttaagtggttgcataggtttgcatgcccattaagccagccatacttccatgggccatagaacagatgtcaatcattgggcagctcagcaggcaaggtctatgaaagatgatgaaaccagtggactcaggctaagttctcctgtaagaatagaacaattgcagaataaactactacttttgataccctgttttataccaggggtgggacacactgtttaaatttggctgtttcatttcacctttgatattgtataagtattatacagccacattgctctcccacataactaaagccagaagataatttatcatcatcttatgaatctcagagtcatattattcagattctagctgccatcatttgcaaaataagtacagtatatagaaaaaagcatataaatatagtgttttaatcttaattttaataactgataacttactttgaagcctgataatatgaataccgtaataatacgacattggttagtattcattaacatttactatatctcaggcactgtgaaaattcccaatattcataacttcatttaacaatacctgtgaggtaagtattattatttattctgaagatgagtaaactgaccctcggagacattaactaaagtatcctgcctaaggtcattcaactagtaagtgatagagcttggcttctggccagctagactcagggctcagtcctcaaccacatgctcaaagaaattatagagtgtgttcacatgcctttctcttctttctgtttctgtttcatgcatcatatgttcttcagtctggccatatctgaatattccatatggctggagccgatatttttagggagtttcttttcttgaagatccaaatactgacaagttgtttctgcacatgaggaagtagaggtgctacttttcagtttggcttttttgggatatggccagtgggtacttattgaaagtcaccatcagatagtcacaagatcttcctttgactgacgaagaagagggacaaaattcattattctcatccctgccacttccttttgagccattcctacattcattcatgctatttctgattcctagtaggccactgatgataagatattctggttcaattgctaaatatttgatttgtttctaaacaatattctaatagacaccaagaggtttttatttcatctttgaagatttgtttgtacagcaattggcagacttatccctgcagagagcttttggctgcttgcccttccaaaagcagctgaatcctgacttaacacaatgtcagcagctcactgctgagcatgtgcacctcctgcttgtaaaaccattggctttttatttcaactttttctctaatgtttatcaatttagctccccttcataaacctctcttattaataattattcctgtactcccaagaaagattactttctataaaacatttggtagtgttttaaaatgtaattttaaaaattatcattgatgtgaatatatgctatttaaaagagaaaaaatgaggacctagtgaatatttaactgtcttatatcacattgaaaccatttctaaattttgtgactctgcatagaggcagctgtgatgactaatgagccctgaatttggaatcaggacaccagggttcaagtcctgcctggcaatatatttatttgtaataagtcatttatttttctaggcctttctttcctcatttataaaataagaataacatacaaaccttataagtttattttgagaatcaagaatataatctgcagatagtgtattaagttattactatatgatgcaattttcttagctatattcaatgtatatgcttttattttctcaacattttcacttaatatttgatatataattatttccatgcatcaacatagtttacaaacttatagcatctcattgttacttattattactttgataattcactgtgttttaaactccgcatatgcttataacttagcttatggtcatcatgcaatgataaatcaaaaagaataggatacaaaatataaagactgtgtaaaaacatgtgcattgataagcactgaaaataaatgtcaaagaatggttttctccaagcgattttctactatttatatgattttccatattataaaatattttcaaatatacctcaagataactaataggttatcttctgtacaaaatggctgaatataagcccgttaaattttgaaagctatctgcttcaatttagagtttagatgtgttttagaartcccccaaatacgtgtacgcatttggtaattcaatagaagtgctcacaggatctggcatatccatagtgttcacatctgtggcttattatggcaaaaagttcgtaacaggatcagctaaggaaaaagatacaagcagagtctggagaaatttaggcacaggattttttatgtttatccctcccatgaaggacaacatttctgtgtgctctttttttctagtcacacacacatacacaaaattagtaacgtgtacattaattctgcccatacaagcccatcagatactcagcacttagttttaytgggggctggtcacataagcatcctctgcctaggacataccaaaactccatactctcagaagggaagcagatattcagcataaatcatattgtttgtacaaagagtctgggcatggtgaatgacacttaccagttagggaatggagagaagtcaagttcccagatgctaaccaactgcaaaattttccaagtaggcctttctaaagatatcagtctctggcctactatgttcactcttctctgcagattatcttaaagatattcttcrtgtcagaactggttaggaggcctgtctgctggggatggcctccccaatttgtgtcaataaaacatatcagtgttgaaggaaatagtaaatgaactactttttgttcatggctctctgggagaagaacagactcccccagatttccatatgattcccttcatatggaagaatgatgacagctaaagagcaaatgctgacaaaattgacaaccttttctgtcaccttgtcctcaataaagtagccaggctatctaaggtgcatagtcagaaacccagacgtttaatgatcacattctctgaaccaaaatgtctaacatttgctctgacatgaaaaaggaaatgggatggaattccaggttccatttacacagtcactgcatatgcttgggttctttcccaagcaaaaatcacaggagctacttcccaacaatagacgatttctttgacaccaaggatttgaaacgaaatttgattcttaacttgtctgtaaattaaatgcaataaacatatatttttgtactggtcattaactatattatgaatttaaaattgtactcaatagtattattttgtaacttattgattatcaaacatgaaaaggaaggtggcaggattattaaattacagattgtaaatttgctatggaatgatctaagtgaacatgatattttcatcctgacaaaaatcacagcatagaaataacagctgtgtaatatactaactgcatatgaagtctgaaaaacatactttaagtttttaattgccagttttactatacatagcttaaaatgggctctccaaagaaataattattattttaggatataaacctaatttgaactttttaattccaattatgttgacagcattgttttaggggaaaatatcacatgaaactccattgatatcaatattaataaatctaaactcaagtgtctttaccctaaaatcaaattaccagtaaaattatgacacagtgtttggagaaataaagcaatcaatgaaaaaaaatgatcgcatgttgtgccagaatgataaaagttctaaactacacttatttttttactttttacaaaaaagtaaacaattgttttacagttaatgaaccttcctttcagaattcttttccagactttataatcttaaacgagtgttaagatttgaaatttgcgtggaaatttagatttgagaggtattggcatgaaaatggtgtttggaaactctgggtgtgggtgagcagagccaggggactcatgtaagagcagagtcagaggaagagcaacctctaaagcttaactggagagagagcagtctggagagaatatcaagaagaaacaaaagagacaggaggataagcacatctgatgtggacgttagcatatgattgcattttccaggcctgccaaaataaattggaagttataaaaaatacttactatcccaaatcatcatctgaataataatgagacatcaacactaccttttatatataacctaaattcggtgactttattgtcaactaagaaactgcttgtacacaatcatgtgtacgtgtatttagtcatttacttgaataggaaatttgtttgaaaatgtgaaattgcagatttacctcaagaggatctttgtaaaacactttcctagatggatgctacaataaagacaagataatttctattattcatggttatattagcttaaaatgttgtgctaaaacttcttaaagcagtttttgttttaggacccaaatgaattatttttagaattatgagtattattggaaagttataatgattcttaattttccaacttgattcaacaaatattacgtaagtcctaagtgggatcaagttagaaagcaaggctctggctcagaaagctttgtaattttttgttctagaagaatttgatagtgaggctgggagcggtggctcaccactgtaatcccaacactttgggaggctaaggtgtgcagatcacttaaggccaagagttcgagaccagcctggccaacctggcgaaaccccatctctaataaaaatacaaaaattagccaggtgtagtggcacgtgcccaactactagggaggctgaggcaggagaatatcttgaacccaggaggaggaggttgcagtgagccgagatcatgccactgcactccagcttgggcagcagagcgagactctgtctcaaaaaaaaaaaaatgatagtgaaagatatacctatagagcagtgcaatgttctgttatattttatactttttttgatattttggtatgtgcataagaataccatgttattatgaagctattttgaatgtgaaagaaaagaaacaacataccacagcatattctaactatttatctaacttgtattcaatttttgacttttgtacattttaatttttttctctattttaaatagtgccacactaattaatttttgtgaccatctctaatcttatttccttaagataacatccaagaagtaaaattactggtgcaaagcccatgcacattttgaaagaatttgataaatattgccaagtttctcttcagagagtatcaatttacgctcccttgagcaacttatgaaagggccaagtgttatacctgtgtgcacatatatacacatgggcaygttaactttgcccaaaaagtttgtccaaaaaattaaaaaatatttaaatatgagacttttaacagacaatgatgacactatggatatcttttatttttatcattttaataggcgtgcagttatatctcattgtaattagggaagcagatttcacagctatatggatgagggttgtttagaggcaggcaaarcgatgttaagacggctrtaatcatctagatatgagaaaatgagagcatcaattagaaaagttaatggggatggaatggaaatcaaagagcagggagattacttttgagaagttacatttggtaaaataataagttttatagacaacaaagaaggtgggatgatgaactacaatattcttagtgattttgaaatccaaggtaggaaattaagggacttgaaacaacgcgagtttatttgtttgtggtataacttacatttagttaaatgtactaatgttgatagatagcctatgagttttgacaaatacatagtcgtataaccttcaccataatcaagatagggatcagttccatcaccaccccaaatttcctcatgcacctttgtagtcaaacctgttcctactaccaagcactagcaaccagtgatctgttttcttcccagacaattctattttttccagaatatgtaagaaacaaactcatacaatatgtggaggctttggagtctggcttctttcacttcatgtaacatatctgagattcatccatgttcttgcatgtattcatttttattcataagtagtgtatagtataaatatacaatttctttatctatttaccagttgaaggatctttttttggttgtttccagtctggggttactgtggataaagctgctataaacattcacatacaggtttttgtatgaatgtcagtttttgtttctctcttataattatacagcagtagcatagtttggttataagatacatagttttaactttagaaggaatgactaaccacttggcatttccatgaataatatatgagaattctaattgctccaaatttttgccagcacttgacattgtcaatatctttcatgttattttagtaggtacatagttatatctcactgtggttttgttttgcattttcctagtgactaggaacactgaacatattttaatgtattggtcagacaatgtttttaattcttctcttgattgatggttataactctaaagaaaaaggataaatcagttcacgatatcaaacaaaaacatttaatttcctaggtcacagcttaagataacaaaataatagcaagggataaagtaaatcctttcggacaggtctaagatatttgctgaagattgctgatacaactaaatgtgccttaaagtaatatatgaagggttgaggaaaaaagatcccagaaaacaatataagaaacaattggtgtgatataaaaagaataccaaaaataaaaactgacagtttgaaggaaaagcagtaaacatggtttgaaacagtatttccatccatctatacaccaaagaacacaatgttagtaattagagcaatgcatttgaaaacttaataaaaacaaataaatgttagtattcctagaagttgctggcaatgggcatatgaaatatttctagagcaacaggaagataagccttatttgatataaacagttttgacaaatggggaagcataatagcactgaaasttaagaatgtgtccattaatatggaaatgaaaacattttacagagcattggaatcaggatgaaacataaagaaaagtgcaaatgttgtgtgggcatgttacctaggagcagatttgtgtaatgctttcatctgtgtattataaaatgggaggacaggcaaaacgataagttccctcgctaatctcttggaaactccattgtgtcctagcagagatcagttatctgccctctacaatgttactgtttacatgaagaaattaagattttgatgctaaagtagaagtaagcaataaaatataaagtaaaattaaaataaaagtatatgatagataacattatatgtaatagaaataaatgtaagaatacagtagaaatcatcaacacaatgtatccctttattcatcaaattcctgttgaatgagttctgaatgagcactgaggaaagttgagtgaatagagcggtaaactcaacacagcccctcttctcatgaagttcatacattaatcgagtaattataataaaaaatgacaaatattaggaatgacagggtgctttgaaaatgcaaggtgctctccaattagttcaaatatgtacatttatgaaatatgaaactaggattaatagaaaattgtaactagagcacatattagggtccagaaagcaaagaccagaataaattgaaatttataaatgaaatatcagttatgctacttgcacagtggtagaatgttgacttggaagaactattgaactaattgcactgatctccattaaaaaaaatggacaggaaggagtttaagaggttattgaagctcaaggtaaggggagaagttgtggaaagttcgcttaaatggattcacttctgggcacagtggctcacactgtaatcccacattttgggaggccaaggcaggtggatcacctgaggttggaagtttgagaccagcttggcccacacggtgaaaccccgtctctgctaaaaatacaaaaaatagcctggcatggtggtgcacacctgtagtcccagctacttgggaggctgaggcaggagaatagcttaagyccaggaggcagaggttgcagtgagccaagatcatgctactgcactccagcctggacgacagagcgagactccatctcaaaaataaaacaaataaataaataaatagattcatgtctctaggataacatgacaatgatagcatagtgtcaaactctgtgacatttgagaaactgggaagaaggttgaaatttgataagaatgtggtattctattccatcttttattaatttgtctattcatttttaaaactactttagtattttctatatgtcaggcactgtgctaataaggttgatatgaagtttaagtcatagagaacatgatccctgacctcatgaaagctcatactcttgttggaagtaagaaagacaccaaagcaattacagttgagtgtgatgaattcaagaagacaactttggagcatcaggcagcaatggagagaactaaagtgatttactcctagggatgaggaaagatgtcataaagaaaatgatgctttattggagtttgatttttgttggtaattcaagaacaagtagcctattaagcacaaatatgagcaggtacttataaaggtacctaaccattttttaagcgttttaataataaaggagaaaaataagtcaggtggtgtacaaaagttgattttgttttgttttgttttttgagatagagtctcactccgtcgcccaggctggagtgcagtggcgtgaccctggctcactgcaacctccgcctcctgggttcaagtaattctcctgcctcagcctccggagtagctgggattacaggcacacaccaccacacccagctaattttgtatttttagtagagatggggtttcaccatgttagccaggctgatctcaaactcccgacctcaggtgatctgcccgcctcagcctcccaaagtgctaggattacaggcgtgagccaccgtacccagccaaaagttgatttctaactcattgtataacaaagtacaaatagcttcagttggaaaatcagtgccattcaatctttagttgtctgttataaggctctgtacttgtcactaatccatcaggtattttttttctagtacgtatttttatcgataacttggaggaacgcatgagacataaatttggaaatgataacaaagataggggagggtggctgaaacatctatacagaataaaactgaatgctttctatggacagagatggtaactcatgtctaataagataaattttattatcaataataattgtaaattcatgtttaaatgaattaaatagacatgagattttagaaagcttcaatacatcagagcacaggagacctgttatgagacagtgtgatacagatgcagaaatagacaatgaatacttaatgcttgtgttatcttgacagaagtgtaagttcatttcagcaggggtaactagcaattgctaccataacctactatgcttgggctcaactggtacaatatgtccagttctgggtgccatggacatgattttatattttaaaatgtgattattttggcagagacttggaaagtccagacatacctaaaatagcaaaaagaggcacagaaaggaacttaaaacagaagcagtcgaagcaggtacagacaagtggctgaggcatcctgagcagataatcagtaggcaccatgaaagatgtcctagaaggcaagctgtgtgcagtctcaagaagtttgggctactgtaacagtagtagtagatgcagaccttcaattaaacttaagtgtagccctactccagatgaatgaccctaaaaagaaattggaaaatggggtaaaatagcaccctctgaaatgactcaaagaactacagcaaggcaagacccaattcctaaagtaatggaacataaagaagcaaaaaatggaatgctgctcctggacattaaatagcaggcagaatccttgatcctgaagattcagagtagagccaacagcaatgcagataaatctaatkttttccacagtttcttaarttctccttatagcacagctttgatccctgattcatgaacagggccaaggttacaggtgactgtgattttttatatttgggaaaattaaaattatagagctgatcaaattacataaataagttagtgttccccccaactctactgcacaattgatacattcctagtgaaacccattaattgaaacttctcctgtgagttgatcactgtgctaaattcagagaatgtaaaaataaatgaagcaaatgctttgatacagaatattcacattactataagtaatgaaaagtcattgatgtttttaatgcaggaaaataatgggcaaagttctggaatgttaatgagcagcaaaaaagggatttgataatctattcacatgcagcaaagtgaggttaaaggaatgttagccagtcgaaatatttgttaaaaggtattacacacatgtaatattttaatacttttcttaataaggaaaatagtttatagaatattgcagagaatatatcaagataattctgattaatttctcattacataagtacaatattaatatatttgctttgcaaaaaattttaataatacaggcatgccgtttgttcacattttatgtgaatttcaattgtatggctatgaaacaaaatgtatataaaaatttataggtctcacttcatgagaaaaatattacacaaaacaaataacttccaaattaaaaatcatcaacaatcacctggtttgaaatgagtggatggtaaactacatcattaccataaggtggcaccagagtaactgtggcaagtagtataagcgctgaattcttctgaccttgtttctgcatttacataattatgcattatgtttataaccatattcataatttgaagctttcacaacaaatgaaattattctatatgtaatgtgtgagctgtaactttctgtcttcagtaaaccaaacctgttggagaatctacctcattctttaattgctgtctaatattcctcagtgggaatatgttacaatttatttaacaagtcctgcatcagtgatcatttaggagtctttaaatttttcaagaatgcaagtgatatcattttgaattgaagaattgtctttgtgcacatggacaagtatgtctggagtatatatatactgccagaagaaatgtttggctcaaagtaaattaacctttttaatactgataaatatygtcacattgtcctattaacagctatagcagtttacactccagccagcattgcatgaaaaggcccattttcccttatattgacatgactggatattttctaygtatctttttaaatgttgccaccttatatttaaataatgttattattgctaaatttattatttctgaattagtaatgaggttgcatatgctttaaaacttttagtgaccttttgtgggttttgttcaatgatttgcctactgatacattctmcgttttttaacttatttttttctgatctgtaagtgaagaccattttcttatttttatttattttttatttaaaaaattagagatggggtatcactatgctgctcaggctggtctcaaacacctggactcaagccatcctcttgccttggcctcctgaagtggtggggttacaggtgtgagccaccatacccggcctcattttccatttttaagggagaattttttttttcttttcagagtttttcatatgttatgaatattagtcattagattgccatgtcttctaattttgtaacttatcattaaactttgaaaatggtggttttcaatgcaaatgagttttaattcttaggtcaaacatgataatgtttttctcttatggtttctgagttttgttttcctttgctttgctttgttttgctttgaaagaattttttaaaattttaaagctctagaaagatattctccttttttgttgtaatgcaatcatattggtttttttatatttagtatttttgtatatgtggaatttatgtttctaatatatattcaataccaccttagcaccatgtatcgaacagatatttttcttctcagtgatttaaagcattacctttatcaagtaccagtttcaaatatacatgatttgtattgagataattctattctgttctgcagttgacaagaatgttaacatttcacaccaataaatgtaatggatcacagaattttgcccactttactgaaggagatagagagatcagagctaagggatttgcatgacgtcctgtgcccagatcgacaggcatcctgggccgtggagcccatttttcttacttaaaattcagtctttttcctattctgctgcaaactacgatttgagatcaacaggaaaataggtcactttattctcttttaccttgattctttttccgtaacagaggagtattcaagctgtagtcggcatccgtgccaaaatgggggcacgtgcataaatggaagaactagctttacctgtgcctgcagacatccttttactggtgacaamtgcactatcaagcttgtggaagaaaatgctttagctccaggtaaaaaaaaagtatacgcatctttggatttgctcattgtcataaatagaaacacgttttgaaaatatttattaatgaatatttaagcctgcttaatctggatccacttgacaattccttttactttttcgaaacttactgaagaatgtacctgatttacaagtggaaatgtccttttgttaggcaaattcttattcacatgcacctgttgaaattttcaatattgctatatagaggcagtttatggaaaattctaccccctcacaaactttttttctcttgtgcatcctaaaaatatatggatgtatatatctgactgatagaaacactttctcctcaaacaagcagttaaagaaatacgcctttgatttatgtctggtatggtcatttaaatgaggctttaatacatgcttagtaacacgttttctgtgaaggttaaactaatggcaccattttgactgtgtgagaactgttagaacatgctcaaatgtattaagtaaaacaagatggcttttttayttatttaaattcataagtattggtgctttggatttacttcaggagtgcaccatttctgatttttatacagaaatgtatgtgcagcataaaaatgtgttatttaatgactgcaaaaaaacctatttcaaatcagctttttcttaataatatcctgcatagtgaaatgtaaattttttagtctgtttttagatctcagcctttgtaagtacaattggcattaattacacagaaaattgcctttgtctactttgctgcagtgaatatgactttatatggttttcgttttagcctttagaaactgcttgacaaggtgccggaaaaattgtttctacatcatgtcagcttcaattcctgcaaggggctttaaaacattctgacataaccataataatcatagagtgctttgaattcctttatctctggggagatcaaagcaacatgcaaattatctttgaggcatttctgtgaggaaggtatcaaatgttatttttattctgtcctgatctaaatggagaaactgaggcaacaagaggctaagcaatttagagtaatttaccccagagaagagacaggcattgagacacgtgcacctttgctaagtttgatggatggcctttctcttctgctaagactttttgtaactgagataaaaatgacgaagatataaggaaagacaaaataagataaaaacatgaaaattaactcttgccattttttcctctaacagatttttccaaaggatcttacagatatgcacccatggtggcattttttgcatctcatacgtatggaatgactatacctggtcctatcctgtttaataacttggatgtcaattatggagcttcatataccccaagaactggaaaatttagaattccgtatcttggrgtatatgttttcaagtacaccatcgagtcatttagtgctcatatttctggatttttagtggttgatggaatagacaagcttgcatttgagtctgaaaatattaacagtgaaatacactgtgatagggttttaactggggatgccttattagaattaaattatgggcaggaagtctggttacgacttgcaaaaggaacaattccagccaagtttccccctgttactacatttagtggctatttattatatcgtacataagttagtatgaaaaacagactatcacctttattgagaaacagccagtgttttcatttatctttgcttgcacatctgctctgttttggtttttctacaggaaatgaaaatcaacttgtttttttaatatgagtaaacttgtatgtctattttataaaattatttgaatattgtttaatgtctgaatatgaaagagttcttgatcctaaagaaatttagtggcacagaaaacaaagtgaatttgttagcataattattcctattcttatttcttcattttaagtcattgcaatggaaagtaatattataaaayggtaattacaacatattatcagtcacagttttctttccaattaaacacttaacttttgttattccctgtatataaatatataacacacattttctagattcacaaatttaaataaattactcaaaaaatgaaaattgattttgtaaacttttatttttactctttacgttgagttgatcaattttccatactaagattttcattcagaatcaaaattaagaaagttggactgaaaatatgaaaaatgcttaactattgttctcttcctataattctctaattataacatagtaatttacatgtagttggacatgtacactcaagtctaagaatatatgagtggatcatttaccgccccccgccccacaacatctataaggggcaaaaagtctttttctaataagtattcttctatggtagtacctacagatctgcccttcttcttctaaagggtaagtcataatctgtgtaatactacaatttatgggatgctcactatgccctgtttctcttctaaacaatttacatgtaatgtctcattcctcacaataacccttgtaaagtgggcatgattaccatgatttttatagttgaagaacctaagacacagagaccaaggcccatgagctcatagggctgaggcaggatttggaatcaggccatgtcttctccagagcccacatccatcctttctctatattgcctcccacagatgtgctaaaatttatttaactaatcctttatcctctatttgtgttgtctcccattttttattattacaatattactgtggtgaacatgcttaaaaatacattccttggatatctgacaacgtgtttctgaaaaacagattttcataagtaataataaaaataataataaaaaagttttggtatggtaagccttttttatgaattgatttgtttaatgatcactataacataatgaattacatattaacctatgatatttgtactacatattattactctctttctgcccatgagaatcagaagcacatagaagttaaataattttctcagtagtataaccaatgatggagaatttctgggacaaaggatgatcataattttccatttcgatgggtactaacaatctaagtctatgaaaaactgctctttataccccacacatcctcatcaaaattaacaatttttgaaatatttccagtcctgaaagtgaatatcttctatttgtagaagatacttgaaaatttttcaaatttgctaaaacttgaaagcatacatccatacaaagacttgtaagtaaatgttcatagtcagtttatttgtaatagctgaaaactgggaatcacccgcatgtcccgcgacagacaaagggttacgcaaactttcgcatacaaatacaatagagtacaacacctgggaatttcacaataactatgcagaagattttaaactgcagtctaacaaactttgtcacctctgcaaggaggaactctaaagtaagtattgtccatcagaatgtcctgcgctgagtcaaaataatcaggccttcataccctagcctcactcagtactagattcaggctgccaaagaagagtgtgacctaagagttaaaaccgacagctggatgcattagtccatcctcgcattgctataaagaactacccaagactgggtaacttattaagaaaagaggtttaattaactcacatttccacaggctgtataggaaacatggcccggaaggcctcatgaaacttataaccacagcagaaggtgaaggggaagcaggcacgtcttacgtggctgggggaggtggaagggggagaggtaggaggtgccacatacatttaaacaatcagatctcgtgtgaactcactatcaggagagtagctggggggaaattcacccccatggtccagtcaaatcccaccaggcccctcctccaacactggggattataattcgatatgagattttcgtggggacacaaattcaaacatatcactgaatgatgacaatttttatcctgttatgtgtaaacatgtcattttcaaaaacatttaaaaagttcttatgatatcttcagtccctgcctaaaaatttactataatctaaatttttaaaattttatttcttcaaggactcacagattaaaatacaatttttgctttccaaatatacttttcaacatagatttcagtgatttcattatattgtttttctttactgttaccagaacagaaggaagtaaatcatttgacaatgttcatcattgcattgtccaatataatttattgatttttaattagataataacatttagcattaaataatgctttggtgtttggaaatataattattaataatagtctttatttttatatggattcatagaatatacaattaaataacaaattgccaccaatagccaagaggcattatagcaacttttaagttgctgtgaacttgcttggctatatttttaaagccactcaatataatcaaagataatttagtattgtatttttaatggtcatcttcaaacttattcatgtagaaaaaaatatagcactggaacgtttctttatttcttctatggacatagccaagtaccttgaatattattttgtagattcaatttcagagcccttctctctcacaatatcttcctgccacaccagctcccaaagtacatcaggtcactaattactgatgaaaatctcaaatccattcatttattacttaataagtagctaattattatacctaattgaaggtacataatataggaggcatgttaaattatatataacaaataataaaaagtatataaagtaaatcagtacagacaaatgttgcatttgaaatacataatccggggtcatgatggcatttactaccaccagaatcatggatagctctgtaagaatgagaaatttatcttcaataaccaccggtctcttttttttttttttttctttgcactattgaccaatcttctattacctccttttgtatcattcccagaattgagagacttcccatacaaagccataagtgtctacaattgctctttcttactcatttcaccagttaaaattctcaatttggaagaataagctattattagttaatcattaagaaatgattaaaataagccatcctaattttcatttggcttggtttttagtgcacatagagataattttttggttgttgttcatctgtttcaaaatataaatttattaactcacattggaaacctcgtgagccatacatagtatatgtcttcaacaaagataattttcaatgtagcaaaatttttctcattattcaaaattttttctatcatttatcattgcaaggcacctgtgggatacattaaagcaaaaatataggcctgcccttcctagagtgtacaatttagctgagttgctctcctgtgtggaaggaagggatgtttgcttatttcctgtcccggtgatttcaaaccgagggtttcatcaacagcctggggagtgttattaagaaccttcccttcagtgcttttaccacagctcagtgagaattctcaatgagctatactgcatttgtgttcagagaaaacaacaataaagtagtatttatttctctgggctgacatcctaattacataatctaaaactctgggaaaagtccaaattttggagtttttattatatttactcatgaattgcttcatcaactttcaaagccagggctttagtcaaaacacttttcagattccaactatttaagttagcttaggctgccacaacaaagttccatagtctgggtggcttaaacaacagacatttatttctcacagttctgagagctgacaattccaagatcaaggtgccagcagatttggtgtctctagtgaggtcccttttcctggcttatacaaggcaaaaggctgccttctcattgtgtcttcacatgcagagagagaaagagaggaagacagagtgaaagagggagagagaggagcatgagggcggagagcacatgaatgctctggtctcttccttcttttaaagacactaatccctggtcggggcccatcatggggccccaccctcatgacctcatctaaacctaattaactcccaaaaccccacctccaaataccatcacatttggggttagagcttcaacatatacatttgaggcagggagggggcacaaagatgcagtgtatagtaccaagtgttgaatgtagtgatatttaggatggtgttttaaaacattctttgcatagattttaaaatatcagtctatagtagatcctagttgtaacatgatttcctattagattcaaataaacatttatatcaagcccactgaagataacagtgaaagtgctacgtaacattgtcttaaagttggtgtttttttcaacatattatttggattcaaatatttatttggatttcctatttttttgattcatactaataattatatctactcaagttaacagtgaaaatagtacatgatgcaacccaaggaacaggtgttcttataaataccactttactctcctaacttgaagccactgataaagaaagaaattgactcactgaattcctcttaccaggatacagacgattatggatagtttctgttatttttgtaatttacttcccctcatttatgtttgctgccactatcatcttcaaaatatgtaattacgcataatatatataaacagaaccacacgtacatttctttattggtatgaaatctatggattaaggatgatagtaatttgccagaaaatatatgtaggaaaaatacatttatttgtgcttccaaaccctttctaaaagcgatttaaggtgactagatgtataatttgtgtggagaaaagtactaaagttatacaaagacatttagttgctatttacatatcaaatatatctcaagaatatggtctttccttatcctaatttcttaggtatattcacatgcattaatttttatgatttgtcatagagtaaccttgctattaacaaaaaataacctacaaagattcctcccacagtctcaaaccctccttcaattctctactctacctttttgcctaccatcatagctttgctattttaatgaatatatttaggtttctttattccagctgaagagaaagctaaatagtgtagaagttattctgtagatgaaattcaaagaccctccagagattgcatgtctttttaatgtgacttttactgccctttctgaatcttgtcattaaatcccttgaatcttgattctatttcatatattaattctatttcctttaaatggtcagcagactgacagatcatcagtgagttttcctctatcacagatctctgttaacagtaagttatgtaatctaccccatgcaatgaagggcagaataaacaaaggtggagggaagaataaacaaattgcatttctgtataattgtggcttctttctttccatgtgtacactcaaaggagaacatctgtttgagaaaaagaagccatcattattatcaacagcacacctacatgcgctaaaggcattcttgggtatcacaaaagaacctttaaatttaagaaatacattgtaggtatcattggaacaatactagtatctgaaaactgattctataatctgttttgaagaataagtatattaaaatgcccacagagcattttagaattccatgaggccacataccaattgctcatcaataaagttcttggcactgtggctagtggaaaaaacactgaattcagtaaatgctcagaacatgctggaaatatagaaaaaattaaatgtcttaaattcatgaaaaaaatatctgagaaagttataaaacttagaaaattttgtagtaaaattcattttacacatcttaatggagatatatatgaatttttaaatatcaatcccaaaactaatcctaatttttctttttataatctgaagaggtaaaatatgacatctacatttgattaatgttgtcatcttcattgaattaagcctacaatgaagacatcgaatcttcttaaaatatcctcattctgggttttaacaaacagctactacatgctctagctatatcctaacacactgatgcagttttgccaacaagatgtgacttcttcacacttcaaattaaaatcctaagtacctccaccaattgaacagatacatcttggccaaggggatcccagagacaccttaaaaactgagttcctggccaggacaggatggaaagccagacatgcctcgttatactgaaacaggacattttccatgaccactttgtgggcctcacagcagaggtacctcacttactcagtccaacccctcacaggagtgggagcacacaggtgaaagggtgcaagagatagggcaagtgcttctgggtgccagcagaagcaaaactccatgcaggccttgtagcagcatctcgcaggagtacccacaacccccaaagccccagaggggtgtgttacagtgcactcttttagctttgcaatctgtggacgacttaagtgttaaacagctcagttggcctctgcctttttatgtgaggcagttgctctccaccagtgagggcagagggtcagtgtgacagcctttagcatccacacctgtgtgacacccaagctcttgtccaggaaaaatcagattgcacaaatgaattaaagggtggtgaatgaggaggattttattgctgatggaagcggctctcagaggaagggtgagctggaaaggggatggagtgggaacttcccctgaagtccggccatctccagccagactcttctctgaagtcctgcagtcaagccgtccctctgaagtcaaactgtttctctctgatgttcaa

SEQ ID NO: 17780 - DNA, 149000 bp, Homo sapiens
ttcttatcaccatgacactaaagaaaaaggtcattctcaggtcatcaaatgccactctcttgaaatctttatttattcaagaagctctgtaaattaagacagagcaagaactgggcaatgtttaaaaacctaattataaaaccattattactttagatagaggactgcagaccagagtgcaatgtcacccaaaatagaaacgtctttaaagaattgcaaaggaagaggccaggcatggtggctcatgcctgtgatcccagcattttgggaggctgaggcaggcagatcacttgagctcaggagttctagaccagcctggccaacatggtgaaaccccatctctactaaaaatacaaaaaaaaaagcaaaaaaaagccaagtgtggtggcacaccctataatcccagctactagggaggctgaggcatgagaatcacttgaacccaggaggcagatgttgcagtgagccgggatcatgccattgcactccagcctgggcaacacagcaagactccatcccccaaaaaaataaataaataaataaaagaattgcaaaggatgaagccacagagctctgctaacatgcaccatgctgatcactccattggaggctccaaactctaagaggctcaggcttgcctcctctttagctaataggaaatgaagaggcctcaagaaactgctgggcttccttgggcatggaaatgaccaaagatgctatgaatggatctattgactgctcagatgcatggctggagtcaagcacatgacagtcaggtctggcagccctgggagccattctgtctctctaaggcagaggctttacccattttttgacaacacatcttatccccaatatctatttatttgyttataaataatatagcactagtatattccgtagtaccacctgcaaattatatagtacttatatgctataaacattatacgtgcacaaacatgaactgtctaaggaaatacaaagaaaaatctgaaaggtctatattattttcttcttttgccccagaagatctctcaagcaccattctgaggcaatggttctcaaactttgtgtaaccaagaattacttggagatcttgcttaaaatgaaggttcactgggccttgaccctagtgttgattccattactcagtattcctgggatgggcccataagttgtcattgtctgagctccccagctgactcttattctcatgctcaattggattttgcagccactgatccagacccttgtgttttcctgccccttacattttttgctacaattatatcactgtggtcttattgttatctacctcctggacaccttcgtgatcccctcagtgaatttaaacattaaaaaaaattagctaccattaattatttcctgtggcctaggattgctgagggcttcacatgcattgcctcacttaatcagactagggaggtattattagtcccattatacaggtgaagaaaactaaagctcagtcacaatgtcttatccaagttcactcagctagtaagcacaagtgacagactaggaattcaagcctgtatctgtcggattcccaaggctggactctttttttttttttcttttagagatagggtctcactctgtcacccaggctggagtgcagtggtgtgatcatagctcactgcagcctccacctcctgggttcaagtaatatccctgcctcagcctcccaagtacctaggactacaggtgtgtgccaccataccaggctaattttttggtttttatgtttatatagatggggtcttgctatgttacccaagctagtcgcaaactcctggcctcaagtgatcctcctgcctcagcctcccaaagcactgggattacaagtgtgagccactgcccactgcacccagcctcaaagcatggacccttgaccactaagtatattgcccacaaaataggtcattataatttattgaccctctactatgaaccaggcacttggcttgacaccttacacacaaatctctaatattcatggcatacctcttttcctagaggtattaatttcagtccagagattctgatgtgcaataaatttctctattctctgtaacccatctaaattcctgactcttaacccctattttcaggccttctggatttcttctccccaccccacccccaaccccagtagttatgccatagttctggacaaatacaatagccaggcatggggtcagggrartgtgacctagtcctctgtcatcagtccacattggtggccactgaggggcccatcctcccatcaacatgacctgctggccccagagactcactgctctcccaccctacatcaagccaggtatatcttttgcccatgtgccaacacagccatttcctccctgggttcttctcttccagcaggatttctgggaagcaaggtactgtcccctctgctctcagacccatagacaaacctcccccttccacaccacctgcaaagcccaagagaatgtctttctagtgatggcaaggtgaggggttccttctcccttcacatcccctcaagaaatgttagtcttttgcttttctttgttggctagaattcacctgcccacactttgggaggccaaggcaggaggatcacttgagcccaggagtttatggccagcctgggcaacataggaagaccctgtctctaaaataaataaaataaaataatataaaataaaataaaattcacttgccctaaggtcctatatttttggaagacaaaagatttgtagccttctctctactttgcccctcttaagtggaagggagacagtttgggagaaaaataagttgatatctcaaaatattatctcagatacatgttgtccccattttataggtgaggagattgaactcattaaggttatataatattatatacagcaagtagataggcctaggacccccccagttcaggaaatctcatactctgtgaagtcctcccctcttccctgccagtagcctccctggtcagcttcaagaaaacacaacagagcttgtgcattaaaaccaccactggaaggtcagacccggtgatggggcaggctggaagagcttaggtagaggtgaaagcagacaacaccctgaaaggggacaggtacccactcctccttgtcattttccaggagagccttatagaatttgagttggcatgagatgatgttagaggaatttggggtggtgcaagtaaaggaactacaagagctagaaacaatcttgaaggcttcttcccatgttgaaagtgttcttaccacgtagaaagtggtaagaaagtgtactctgcagaaatttggggggcgggtgggggcacacggttggtatttcagaggcacttggattcactggtgtcttttgatgagtttgtgtcccgaataaaatggggagtggcggtggttactggcagtacccagaggagaggagatgagggtgggcacaggggagaggagcccgagatgggtagccagctggtcttacgtgccagctttataggaaaaaaagtggaactttcagattctgcttaactgtgcaggagccagccaagtatccaaggcagaagtccttgctcagaaattgtatatctgatgggcacggtgactcacgcctgtaatcccagcactttgggaggccgaggtgggtggatcacaaggtcaggagttagagaccagcctgaccaacatggtaaaaccccgtctctactaaaaatacaaaaattagccaggcatggtggtgggcacctgtagtcccacctactctgaaggctgaagcactagaatcgcttgaacctgggaggtggaagttgcagtgaaccgagatcgcgccactgcactccagcctgggcgacagagcaagattccatctcaaaaaaaaaaaagaaaaagaaaaagaaattgtatatctgacgggatggtccgcaagcttcggggcttgggaggaaggtacagtcataggacagaacacagctttagactgggtcaagatcgtccaagtctggtggtggcttcagaaggccctttgaatgaggctcgtccaggcaataattaccatgttatctaattttgcccacttaacgtttccacttggatgtctaagagccatctcaaagccccacgtggccaaggctgaatctctaatcttcccccaacagacctgcttcactcacagcttccccttctcagctgacagcaaccccattaatctgcttgttcaagccaaaaaacctggaagtcatccttaactcctctctttctcccacatctcacaactcagcagtcagaaaatcctgtgggctctaccttcaaaatatatccaccacccatccaccactccgcagttgccctttaccatgctgggccacgccaccatcacctctcactgggccactgtaatagccttctaacagatctccccactgcaccctggctcacttgcaaaccagagtgatattttaaaactataatacaaatcatatcacccttctgctcagagtcgccccccatgtgtcaatgcataaaagtcaaagtccttacaatgtctccccattcattggcctccttgctattcctggagcacaccaggcatactcctacctcagggcctttgcacagactgcccgaagctctcctccccaagacgtccacaggggcaactccttcacttccttcaaacctttgctgaaagtttaacttcccaatgcaattcactctaaccactctgcttaaaatccctaccttctccccaaccccctgcttttcttgtagtggttcccattacattctaccagtctacctaatttttttttttttttttttgagacggagtctctctgtgtcgcccaggctggagtacaatggcgcgatctcagttcactgcaacctccgcctcccaggttcaagcgattctcctgcctcagcttcctgagtagctgggattacaggcactcacctccacgcccagctaacttttgtatttttagtacagatggggtttcaccatgttggtcaggctggtctcgaactcctgacctcgtgatccgccctcctcgcctcccaaagtgctgtgattacaggagtgagccaccgctcctggccagaaatctcttctttattatgtctactgtccgttatccaactccagaaggtaagaacctccactgatacataaggacttgtataccccacgtgcctgcaacagtgcttggcacctagtaggcataccaaaatatataaatgttgaacaaatgaagaaagttaaagtaaaactagaggtccaaaaatatcacaaaagccatctatggtcgccttttccctacctgattttgctgagtggccttacttttcagtcctctacacagctggaacattaatgaacacagagggggaagaagtgtgtttactctaggatcacctctcaatgggtcacttggcaagggcatctttgcttcttcgtcagctccttttgacacgggggtgaagggttttctgcaccacactttgaccacaagcatcaccaatttcactgaacccaacagaaatttggaccctctgggggctctctgcgtggcagggcccttttctttttctttgggcttaggctgcaatttgaaacaccactttcctgagccagcatcccccttgcagcgctgtcacagggaggcttaggcagccacgtggaagccacctaccccgacctttggcagaatttccaaacacaacacagtagctttaagttgattaatttggaactctgaccttggccccaaaaggtaagaatacataacaaggtattttattctcaaaatgtgtcaggataagaagcacttctgtaaatcgacctttttaaaatagatataattagatttgcagttgggggcagtaaagaaagggtctgaacagtggataacatgttgagaggttaattattaatgggcagtcttccctaacaaagtatctaataggcattgtggtctctttggcttcagaaattaccaagaaagcctggaccccgggtgaaacggagaaatggacacaagtcccctgtgtttctccattctgttggttttatgcatctttatccaatcaagtgcccttggacaaagcctgaaaccaggtaagagcctgacttttctccagagatgggcatgaacttttctttttaaaaygtgtgtcacaargaatccaggggtttctgactgtatgggacagagcttgcttcagagcgtgccaggtggttctatacacgacctcacaggttcacagggacacgtagccgtttgtaaacagaaatgaaattttagaaaatcatcctcggattaaaagtcttctaagagtgcctgcagctagcagtgaagtctcttgcgtatctgatatggaaacagtcatgctaaaagttattcagcrgcaaatgatatgaaagcgattcagatcttcctgagagttaatgtggcatctaatttgcaaccggggagccaggcttgcaatgaaatgctctgtcggrttggggttgtctaattgcctgcctctctcagaagagaggggaatttatgagagttctatttccagtcaggtctaaagtagagatawcattgcacaatttctagactttgttttgctgccaaaattttagtctgagrctgaagaatccaacagccgtcctgcctgttttgtttgtaaattcacaaactagattgatggcgaaagacagatcaaatgccttatcaggaaggtagtagagtggagcccagcttccaggctaagcagtggaccaataaatgacggatcagttaattgaacaatttggccagactagacaggtgtttgggaatttgttttggtactggttactggtcaggagctagtaacgctaaggtagagtctgagatttttcttttctctaagactagccttggagagagctccgacaactttgagaattagaaattccctaacgggatgtacctaaaaatttcagaagcttttttcccctttaagaaaaaggctgttcctttgtatttgactattttacttcataggccagttaataactgagtagcagtattaattattgccattcactaagtattttctgtgccaagcactatactaattatttttgacacatcatctcatttataaagccacatccaaaaatgacccttacataataatttagagccatacaggtaaaattgctggtaatctttattcccttggttcatagtgattttgctaaagggcctttcctgccctttgccccggaatgttgtatttgtttgtttactttttaatgaagtttataacacacttctagaaaagggcctctatcataaatcctcaatgagttctcacaaactgaaccagtaccccaaagccttccttgtgtgccccttgagccttaacatatatgattttttcctttggggagatttttcattaatagaaacacatcagttgctcttttgcgtctggcttctttcgttcgacattatgtttgtgaaagtcaaccatgcagtttcgtggagttgaggctcattcattctcactgctgtagcattccactgcgggaccatgccacacttcctttatccattctactgtggattggccaggactgtttttgcaatggagccrtgggaattggaagctgtcagtgctgagatagaggttgaagggagggatggcctcccccaggcttctgggtattgtccagattttccttgagcaatctcattgtcctgatcagcctgcttctttccccggggcctagtttgtgcaaatgctgagagaagtggccactattagcaagagggttcctcagaaaagaggatccaagtcaggaggcctcttgttctcttggaagcagaatctcttggcagaattctttctgcaatgagtgagcccaatctgtgtgcatgtggctggtatgatgtctttctggggaaaccgcagggaagccggtgtcctgtggtggagcccttgtcaggaaagtttctacaccaatggttctcaacaggggcaattttgccctccaggggacacttggcaatgtctggagacatttttggtttttggttgttaagaccagggagagagtgcttcccttccagcatctagtgggtagaggccagggaagctgcttcacatcctacaatgcacaggacagccctcacaacaatgaattgtctggcccaaaacattattagtgcagaggctgagaaaccatgatctatgccaagcttcaactgtcactcatcgagcaccaggaagtactccctcaaggacccttcctctttagcccctcctcccagcctacttcttttgagtatttattattaatgacatcttactaatggagtcactaatgtgctgcacacccagcatgtgccaggcactccacggacattttatctcatcctcaccatatggttgagtaagctggcagttaagtgccttgccggcggtcgcatagctggtcagggcagagcagggagaggtacctgcagcctcaatctgtctactgaggccgcagtgctctstgtcgagcccacacccagtgatttgacagccagaggtttctagaaaaacattctgctcagttcctctcacagagagggagatttagacagttgttcctgcccttcagcactaagggggactggatagcgtgagctgcttgaagcccacatggcacatcacacttatgcccagccccaatgcctgagacccaggttccccagtcggtgttgccatgagagccaacgctgctcctagaccctggcaagtcccaccttcccggtactgggcccactatcaacaggcaccttctccctcccctccaccccagcctcagcttgcaaatcctaggagcagctgaaagctacctattcagtcagtccctcatgagtgtcacaagcatacatgagcacctgccatacgtaacgcagtgcctgagtacaactcacacactctgttcacacgtttcctctcttaaaaatcactgaggaccccaaacagtgtttattatgtgagatatcaatatttccttcattagaaattaaaactgagaaatcyttaaaatctgctaacactttttaaaatgataataaacccttgcatrttaacacatataatgtaattttatgaaaaataacttgtattttccaaataagttttaaatggagaagagtgacattgttttacaaagaaatgttgcaaatctctctaatatctggcttcccaagacagctggattatcttacctgtttctgtactcagtctgttgtgatgtattgytttgtttgaaatgtaggaagaaaatctggcctcccatagaggaaaagggaggacatcctaaggcgatctccctggggccttggcctgcaaaccactgcgcttgtgcagtgggcactgtacaacagggggctgcacagccgtccccaccttgcaggaatttacagtcaaatggggtgggagtggggtggggagggaatagggggccatgggactgggtggaggggggatgtgccatcaataaaagagcaaccgtctgtggagaatttaaatacaaatataaccaaaagctgatctgcctgtcattatcacaattataaagaatgtcagccgggcgccgtggctcacgcctgtaatcccagcactttgggaggccgaggtgggtggatcacctgaggttaggagttcaaaaccagcctggccaacatggtaaaatgccatctctactaaaaatacaaaacattagccaggcttggtcatgggcacctgtaatcccagctacttggtacgctgaggcaggagaattgcttgaacccgggaggcagaggttgcaatgagccgagatggcgccgtcgcactccatcctgggcaacaaagtgaaactccatcccaaaagaaagagtatcagcgataaaggcaaagctctttccagaaaaaaatggttttatggcctaagttctaaacaatctccgtggttactgttggattttatgtagtaagtatatgtaagcttcaaattcatcacatctttattatttatcctttcataaatattgtgttctacattgacattaatctggagaactcccggttatgcacttggccccaacatgcacagactcaggggcgtgttcttgttgcaagagtaagtgtgcgatggttcagatcctttgacgtccttatgtctccaacctcagtggcacttattacctgcttctgcatgtaaacagtagatttgaaacaaaaaatgatagcgtagtggttgtacaaacaaaaaaccagaacttgaattatttcaattctctcatcctaggtgacccctgtaagcttctcatatgtgtttaaaatttaaagcaacaaaacagattgtgaacaatgagttgtaacatcttgtttgataggtaaaaatttggactcatacgaaaaatatttttactgcatttgaatatcttaaagttaaaatgtatttgtctttttaaaaattgttcactgctttataactaaagaagaaatcgagaaagtagtgatgattgctgatttttacataaatatgactgaaaatacttttgtcttatagagcagagggtcattaaaatgatccgttctgtgtgtcaaatacatgaggtataccactgagtcacatatgtaaatgttatcagctagaacagaacatggcatgagatgaggaccatgagagaggaatgagtagagaagcagattttacttccaagtggagggaagaaggcttcttggaggaggcggcatttgagtagggtgttgaaggatggtatccggacagaagagaatgaggctttccttgtacaatagcagaggtacacagctgataaagtacatgtgcttttcaagcccaaatacctttcaaaaaagaccatctaggaagaaaaagaaaaaatatcccatagaacggtgttgatagcaacacttgttaaactgcaacaaactggaaacaatgtgaatgcccaagtgcaaaccactgaagttggggactccagctactgctaagtccaacttcgaacaggcatggttttgaatacctactactagaagtcacagaaacttttgggggcaataatgatgaagttcagaaacaaaagcctattgctggcccctaagcactcacagtttaacaccagggatcttagyacagaggatgggtttccaagagtcgttgagcctcctgagatggtgcccaaggctgtgtgtgtgtgcattttgagtggggagcaggtgtcataactttcagcaaattatcaaagggacctgtgacctctgaaaaagctcagtaacaactggtcttgcagctttgtaaaacaagtataagaaaattgtatatgcaataatgtagggaaaaaaaaacaggactaaataatctacatgttgaatcataattatgaaaacactgtagacacatgctgtatattgctagagattctaagtatatttaaagatatataaagggttttaaggtttggaggatttaagtacttaaatgtacaagaaaaataaaataaaaaggccctgatcagctacagttagattggtcatcccaagacgacccccgggaaagggattttccactgtccttccgacctgccaccagcacccaactttgcaggttcagccacactcaaaatcactaccccagcagggtctgtcagatttctgagaggcctccacagttacatggaatgtcacccatgactaatatttgagatagagtccggagatgaaactcattcttccaagagtgcgtactattctggaatcagcagagggccagcccccagcattccagggaaattctatctttcccatgcaagagaccctcccatccatggccatccttcctagccctacagctgagcaggtctgtggtcctgctgaaaggtccaccctggagagacgggggacagcagcctgtcctccactctgcttgcctctcacagagacccaggactggaacccatattctttcattctgagctggagagagaaactgcagggctgacggttgaaggcatggggtctgtaagctgacccgaaaacatgaatcgccaaatgagtgcgcagccaaaagccaagagaatctggtacctggctacccacgatggccctctccctgccctcctctccacatcagctgccacagtgctgcgggcatgctgggtcatcacagttggcacagcagggagagaggcagaaagaggctgggccccgagacagggcagaacagtccccatttcatcatgaggggaatgyaaccacccaggcctcagcctgggtgtccctgacagccacgggctccacgtagaacagaggtcacagcgattctcacagccaggaaggtactgtgcgctggcccccaggacagtgaccagtttcgagtggggcgctctcagctgggaaatggggtccaacccaccagggaaaagggctgactaggggccaataggaccctccagatccctgcccagcaggctggacttcagtcccaaggtgataactagaacaagggggccgagcctagtctgtccagcagcgggtggaggagccgcggtaagaaaggcagtcgggtcttacattcaggtacctacttggggcgagaagaccaaatccagtcactccagccctggaggagtcagggcgcccrcccggctgccccacagaaggtgcaattcctaaacatggtcacaaagtagcgcagtgacatctcagctgcttcggagttccaggagagggtttctggctcaggagaatggagtttctgggtgactggaagatgaggctgttggctaacttccctttccttcccacttaggggtctatttccagaagcattcctcatttcattttttccccagtggggcttggctaggggtggggaggcatggggaaaaagtgaagagaagagaasgaaatgcatggaatgcaagcggaggcctctttgtctacagcgttttcacctccacttgtgcaggttcatattcagggcctggtgaagtcagttctggcacggctctccagtggactggcagtggcccttaaaaatagttctcaggaagatgtgtaggtggcgacgctgagtagtgtttatgtcccaacatgaagagcaggcctcattgtgtgtgtcctgtgattacaactgtgtgaaaatacatgtgtttgagaaaaaatgctggaagaagatgcatgaaaatgtttatacgtccgttgagyttgtatctgaacttttgtctcttcccctctttatgtaatgttatagtatgtatatggtatattgactttcatgatttaaataatcagaaaataaatttactacgaaatgatraaataaaggagtttgactagatcagtgatcctggaactgtagtgggtaatgaagcacctaaaaggctgctttttttgtttgtttgtttttcctgagacggagtcttgctctgtcgcccaggctggagtgcagtggcacartcttggctcgcagcaacctctgcctcccgggttcaagcagttctcctgcctcagcctcctgagtagccgcgattacagacacacaacaccacgcccagctattttttgtacttttagtagagatggggtttcaccatgttggccaggctggtctcgaactcttgacttcgtgatctgcccgcctcagcctcccaaagtgctgggattacaggcgtgagccaccgcccccggccagggcttattaaaataagattctggggccctaactacagagttgctgattcagtgagcctggggtagacttggatatttacgtttctcagcagttcccaaatgatgctgctggtgtggggaccacagagaaccactagagaaaaaacaaaagaaccaagacttgaaactaggttactgacttccaggctagggtgcttcctacagaaacaacacgaggctacagggcaaacctcacttcacttctaactttctagggttgaaggggtgagaatcaacatccactgctcctggatactgacttcttccccagtagctacaaccccaaaagtatttaaaaccccaagatatttgtgaaaatgtatttgtccaaaataaaatatctacatgctaaaaagaaagcagtccttgaaatgaacaaaaattcccaagctgagcattacttgtaattggtagaaaaataatcattgcaaaagctaattaaccatccaccctgagcggctccttggcaggcctgaaaatatgatcargaaaattcttttcctatgagtgaggcattatcaaagcagggcagagcctatgggttatccgttgactaggactgacctttccgtgactgccaaaaactttccagtgacaaatgttccagcttccttgtcccaagagaaactaaagtggtaagaaaacaaactgctttatactgaaacataacaagatcaacagcagctgtgacagcatttattaaactgtccgctgtgtaccaggccccatggtcagtaggaaagtatatccctgagggtacaaaaatgaaaaagcgtacatccactcaccaaggacttcccactgtgccagggtctctagccccttatggggtgtgtgtgggggcagggaggttggagattgggagaggcgcataatttcaacacaatgcaattagtttgtaaataacactacatgcaaaatgttacaagagccctgaggcagcgcaggttagctgagaagcctttacagaggaggtgatatctgagttgaatcttgaagtttccttcaagaagtggaaggacattgtaagcagagggaaaaaaaacatgaaccagccttgcttgactcagaggctggaaaagggagagtgaagttgggaattcttgagattttggggtggccctggatggggtacataaaaagaagtggccagagggaaggacaggaagggccatcctcagaagttttgtccycatcctggaggcagggcagaccactgatgaggggggttgtttttaaaaggctgcctttcccagatggattgatagacttatctcagcctggctaaaaccctggccactccctgatagagaacaaggttcccagcaggcaagggcaggggtggggcccagcagggaccagttttgcaagctcacctggccctacacccgcaaacactcagcttttcctccaagacaagcctcaaggcttggagcaagtctctttgaagttttcttatgaattgctatgcttaacactaaatcatgggaaagattaacacccatgaaactgaagcaggagcacataacagragcttaatatgaatcttccatcttaaaaatatcttattctacatctgaaaagagaaccatttggaaattccacgtcatactcacttatagacttaacagcaatttcaactttaaaaattcattcccacctgcattatatgacttgattcttacagtagccctgtaaagaatattgggtaggaattcttattcccattttagagacgtaaacattcacyatccgcggaccatggggaacacagctgacatcaattgcaagtcagtttctgtggtttactgcagcaagggagagctcactccagacttgggcttgtgctggttgagtctaaggaaggggtggaaagcaaggggaattctggattggattctgtcaaaaaggagtccaattcaatgattcggcatcataataatttaatagttatcactaattattatttaatataatcaataaatgatctagcagatgggaagatgaaaacagggctgagctggctttgatacagcaacacaagtcattcctgttagtcagaagagggaaatgtttagtcatgttttttgattttggagtggcctcctccctgtcttgatgcaaacacagatgtggagggtctgtgctgcacatgtttctgttcggtgggcattgtctctgttcacttgtgaatattatggtctggctgacggcagagctggtttttgttgctgtgctgtgttttcgtgtagtctctcccaaagggacttggggaatgcgtttgaggtctcttaatacctatgccctagctgcacagctttgggtgatgccctttacctccttacctctgatctctcaggagtaatagtgtcccttccacactgacattctgggtgtgaatgggactgattagaatggtcatcgtggtgccaggagatctgcagtggtgaccttccctggtatcagctatttaaatattatcaggaaagagaaatgtggaagcaaagtyctatccattttaagcatgtgaccttttaccctaactgaaccttaattgactcatttgcctctagcaattcaaagattcccagacacccggaggacaaagatgggattctgtaagaacagcccacgcagtcaatgacccttatgccatttcttgcccggaactgttttattcagggcctgacatgcagcagtgtttgattaagtgctgacaatgaaaataggtatttgatgctgtttggaagaaaactcttacatttcttgaattgaactaagatgtacagaacaacagaaaccattatttttaagaatatttaaatgtgccaagttctttgcctatttatgtcaatgaatccagaaaaacaccctgtgagataggtattatccccacttcacagatggggaaattgtggctcagagtgttgcaaactctccttagaccactcagctaataatttcctctctggtatagctgaaacatgggcttgcctgaagggcagaggcagaagaagcctccaarcctcccaaggtcctgtgattctcattgatgcctacttctagtggttctggtgtccctctcagagcccacatgggtatctgagccttcagagatatctcatttggtttggggggttgtttttggtttttctgagtctcgctctgttgcccaggctggagtgcagtggcgtgatctcagctcactgcaatccccgcttgcagggttcaagcgattctcmtgcctcagcttcccaagtagctgggattacaggcatgcaccaccatgtccagctaatttttctgtttttagtttagtcggggtttctccatgttggccaggctggtcttgaactcctgcctcaagtgatctgcccacctcagcctcccaaagtgctgggattacaggcctgaaccactgtgcctggccgagatatcccattttggataggggagcctgggacatatyctcaacttccgtgggtctggccactacttatcagaagtttctgctcaccttacacaactgtgagtgatggccaggagcagcctcagtggcccaaggggaaaaacctctggatgaagccctggacccctcacatctcagcctccatcactgcccctggctacccaaagtcaagcccagaaacacagatgtgagcacaaacccaggcagcccatagaaggcacagccctgtgatgtcaagcttaaaaattytgggctacttttaaggtcaccagggatatttcgaaagagctgaagctttttcctccatccaagaatcctctatcttccaggttgtttttatgagctgaagaggaccctccacggctcctcggtgrcttagtagtatcaagacaacacctgagaaagctcctttcatgcaaatctctgtctcacgcatgtgaagagaccaccaagcaggctttgtgtgagcaacaaggctgtttatttcacctgggtgcaggcgggctgagtctgaaaaaggagtcagcaaagggtggtggattatcrttagttcttacaggttttgggatrggcggtggagtttggagcaatgttttgcgggcagggggtggatctcacaaagtacattctcaagggtggggagagaattrcaaagaaccttcttcagggtgggggagattacaaagtacattgatcagttagggtggggcagaaacaaatcacaatggtggagtgtcatcagttaaggctattttcacttcttttgtggatcttcagttgcttcaggccatctgggtgtatacgtgccagtcacaggggctacgatggctcagcttgggctcagaggcctgacagtctccttcctgcctgcgacacaggtctaggaattattccacagttgggcactcttggtgtattattgttcatgccctggcccccacctttgtgccgcatagagggactccccttcctgaggttaatgattgggaaggtgttaaagcaggaagaactgcaagaaggcactcgtgagtgagcctatccactcattcctggaagataaacaaacgaccagtgtggctctccatactcagagggtggtttctggatgtcagagatttcgccacacaccagctctgtgccaggccttgtgctaggaccccaacatggtcactcratattcacacagtctagcagtctgccaggactgccaggacagaggaccacagactgggtggcctcaacaacagaaatgtattttctcacagttctggaagtgagaagtcygaggtcaaggggtcagcagggtgggtttcttctgaggcctctctycttgtcttctgatggctgcgtctcttctgtctgcacacagtcttctatgtttctgtgtccgatctcctctttttataaagaccccagtcatattggattaaggcccaccccagtgaccttatttcacccaaatcacctctttaaagactctggctccaaaagcagtcacattctgaggtactgagggttagaacttcaatgtatgaatttgagggaacacaaagttcagcccattacacccagcaaacactttgctaggmcctgctgtgacccgggtcctgggcttggcactgggcatacagtggaaactgcaaatctctctttgttctatttgagcttcagcaactctccggaagscttccgcgttagaaaaaaggcttacaaatacacaggaaatttgaaagtgagtagtaagtccacaccaggcccagacagggggcctgtgctgaaaggtgcaggaagcagcagccctgctgagacacacaggagcyggctggccggccgctagcagggtgggatggggagtgggggctcagggagcctgggctggggagaggcatcckccctcttcaacagaatgattgggactttctggcagcataarmaataaccggcaggagaccaagaaggcgccgtttagctggctcatgtgtgagtgagtgatgaaactcaccctctggcttggcgccttatggaactatcaactctgcatgggtgtgctcagtgtggaccccaaacctgctccctctggctttgagaggtatttctcccatacaggctggcttcagccagggggttgcctagactcgcccaggcctcagacgaggggaaagggccaaggccggctgccactttctcatcatgtgcctgcctcccttcccamatagaagggtcaagcccaaattagaagggtgggatgatggctggtgcctgaggacagagctggggctaggaggacaaactcctgggctcctcttcatgtctgggctacaagatcctggcataaacaggggctcctggcacagcggaaataaaccatgggtccctgagggagactctgggtgagaaaagagacccagatttggagttgaaagacctgggcctgagtcccagctccatcacttcccagcacgtggccttgaacaaatcactcaaggcctgcagacctcggtcagtcattagtaaagagaagattactattatagagaccccactgggctgttttgagggtgaaatgagaccacgtaagtgaacgcactttgaaactatccattgctggtcacaaaactaaygtgtrtacgcatctatttactaaatagtcatataatactcacccgattcatatgctactcccagtgtttttctctactttttattacaaaagtgttcaactacagaaagaagtttaaaggatacaatgaatttccatattccctccagatagactcaataactgtttgcattttcgtatatttgctgtatgtgcatatttatatgtgtgtgacttgtaaaaccagttgagataagagggggaaaggaagagagaaaaagacacacacatacatatcccatatgaaagttgtggacatcatgatacttcaattctaaatatttatacgctagtatttctttctttttttgagayagagtctcactctgtcacccacgctggagtgcagtggtatgatcttggctcactgaaacctccacctcctgggttcaagcgattctcatgcctcagcctcctgagtagctggaatgaatgcctcttactaaggacattctcctacatagccccagtaccatcaccacacctcagaaaattaaaaataattttatactatccaatatccagaccttactccaattttcccagttgtcccaagatagttgttgatagcgtttttcagactgggatccactcaagatcctcctgttgccctgtttgctgagcttctgccatgtctccccagtgtctgaggttgtgagcatcttggttacttgctgccaattctcacactcatctgtgctgcccaccgtcccatggcctcttgcggacctctctcccatggcgctggctccttgcacccagctatctgcttgcacacctctctccctgctggaggataagcaccccaagggcagtggccagtcttagctactgttgtttccccaggacccacacaggcctggcatggagcaggcacgtggcaaatgactgttgcatgtttgaatcttcatcagagggctaagcaacacacacctttaaaaagtgagtgagttttggccaggcgaggtggcttatgcctgtaaccacagcactttgggaggccagargcaggcagatcacttgaggttaggagttggagaccagcctggccaatatggtgaaaccccttctctactaaagatacaaaagttagccaggtgtggtggtacgtgcctgtagtcccagctacttgggaggctgaggcaggagaatcactcaaacctaggagggtggaggttgcagtgagccgagattgcgccactgcacccagcctggacaacagagctagactccatctcaaaaaaaaaaaaaaaaaaaaaaaggaaatgagttttaagtaatttcatctgacaaattctgtacccctgccggagctcatggaaagcatcccagagacccaggtgacctagctcaggccctgccctacttccccatctacaagtggccactggggctctgaaatcgcttggactctcgactagtctgtgctcgacatctgtgacaggaccatcgactgagagggagagctgccctccagaccacaagtcttctctggaaaacacacacgtatatgagaagttggctgtgttcccattataggtcttacagaagtgattccaagtcttgtgagtttctgtggaaccagaaaaccacttccggaccagcaggagtgagaagaggcgcatgcatatcatgtttgcattgttttcttgcatgtgtcacttcaccacaatgctcaggacctcaatgagagttttaagttctcccagcttcaaattgtgctttccaggccagagcttctcaaaatttaatgtgcctttgaatcatctggagagcttgatacaatgaatgtttttttaaaagtagatttgggatgggctccaggatcctgaattcctaacagttggtctgggtgacgccagtgccactggtccctgaactacactttgagaagcgaagttctaaaggtcacaaaacaacttctcatttcttcagtgaactggtaattagcacctacagctaaatataaggcagtgttctagcaytggaggaacaaggaaatgggaagaaatacaaagaagaataagacacaggcctttgacycaaatccaactggatatccctttatactacgtctagcattttgcttaagtgggacctaaaaagttactccaagctgcctcccctagggtcttctggctgtttctggtaatgtgtattcctgctgatgctcaagccctttgcaacaagttcctaacatggtatcaaatactgggcacactagcaaacttcagccataaattagggcccaaatgttgtcaccaaatggctgtgtgactttggataaatcactctcctctcacgtggactagggttgggagctcttcaagtcccttcctgtctgccaaaaggtttctaagcagtttccaagccgtttcttgcagttttcccatcaagccaggtgaaggcaagtgttatgtccccatcagggtcccccagccccctcttcttagctcaggactggggctttctggggctcacctacagtcttcctcctttccttcctaacttcacacgcatttatcaagcacatactctgcatcaaacctgtgctcaaggacagggaggcaaaggtcaataagatgcactccctccctggggaggagacctaaaacagaccgcaggtgccctgctgcgtggctgkctcaggctctcagagtgtgaaggagagcacctcactcagcactggcagaggccggcaggcctaagtgggccttcaccatatgccaggcctggctaggagcttccctggaagattccaggtracgcccagcaaccctcaaaggaaaatgctagtattgtccccattttaaaaatgggaaaacaggcttaaaaagtcagatgtctggcccaacatcacacagctaatatggattcagtgaaatatatgcaaaaatactcagcagagtggcaagtagtaactaaacggtaactaaaatacctttttcaaatgacagaacagagagtgggggccagtaatctgcactctcagacaaaactgacaagtgggagaaaggcttgtctmccctgaaggacaaaaaccaggcttgggactggccacacatgaygagaaaactgtgagaaaagaagcaggagagactttggaagagggcttggcaggccggaaagcgctaggkgcacacgacgggcagtgggggctcaaacasaggtgggagcccaggggaggaggkagcgattagtcatgctggggaggctccaagggccctttgtccttcctagatggctactcagacgccagtctgcgagcaccccasgctcagctgctccatgcttcagccaccatgcaacccatctggataatggactgttatgaagcatgttggcagccatcgattaggactaaactctatgctcattgggttgtatttgcaaggatgctctgctaagatccacagcagaggtgcatctctctccttctcatttgatggcttggaattaaaatgccacccaacattctctgccaaagacatgaagatttatgggtcactgtcaatatcaacacatgctggccattatttgagtctccttgctgcttgggactgattgctatttactttgaaagataaatgtggctttgtaatccatgcaggttgctgggaggaatgggttttaaatgcatttgttcttttttttttttttaagacagagtctcactctgtcaaccacgctgtgcagtagcacgatcctggcttactgcaaactccgcctccagsttctyctgcctcagcctcccaagtagatgggattacaagcwtgcgccrccgcaccctgctaatttctatatttttaatagagacagggtttcgccatgttggccaggctggtcttgaactcctgacttcaagagatcccccctcctcggactcccaaagtgttgggattacagacaggtgtgagccaccatgcccggccttgggttttaaatgcatttgtttcttcccttggagacctttctattccactccattctgctttgtctggtgatgttggtcccaccctgtacccaccatcagatattctaatgtcctccgaggctctggaacaaagaccagagggaccagcctgtcctctgtccagagtcatcagtatgacagtatggagagacccttagcaccttagtagaaaaattgcccctgtcttatggggtgacaccactcatatatgatctggggcaagagtcaagacccccaaggagcttacttaaggagcaataggttgtcccctttgcctcttctggtctttcgcgtttctgagcgtggtgtggaaactgagtcaggagctaaatcarttaggtcactggttctcaaacttgagtgtgcatcacaacccactgaagagctttttaaaacacagattgtggcccccactctagagctcctgattcaataggcctagggtgcggcccaggaatgtgcatttctaacgatgtcccaggtgatgctgattctgttgctggtcctgcatcccacctgaagaactgcctcagaacaagagtgggaagcattagagaccaatcatgggagagatgaggctgctggcagtgtttggcacttgggaaaaagaacagcaccgtctaaaggagaattttatyaagtttcagkgaacaatgtgcaatttaaatctttttgtaggaaatcgtcagttaaaggtcaatttccataagtatgtggatctatgtattttggaaatgcattgaaatgttacrtgggtctgggaccacacaagctacccactggtggtctgctatacctaggtactaggaaggtcaaggtactgagtaggtcacagtcttgccaccgggatgctttgctaactttattgagtgaaagtagtaagaaatgcctggtattgataagagcccaccgtgctagtttttaccaatggtccctaakcgattttccctgcagcagtcagggtttacaggtaaaactgggcccaggscaataaaggggtacagtctaaggactctgggagtttcctgatgaatactagaggtctttggaggcagacaactttttctttgcagcgggacttcmcattataagccatgatgaggctgcaattgcgatttatcagtgctgccttccttccccaggcaacgtrctaggaagaatcatggtttactgaaggcaggctaccctccccatcaaagcctagtggactgggcaagcaatcggttgggattcattacttggaggcatgtatccccagagcaatcaaaggccctgaccggcacaggattgggaggctgttgctgagacccaggcctcgagtgacaggtagagcagtggggtggaggaaagtcaacatatttggagatacgaaaaaggcaggtaagtaattgtattcgttgagactttgggtcacaagaataataatccaaaccaaattaacttgtggggaatttatttactcatgtaacatagatgtccaaattataagcttcagggacagctggatctatgaccttaataaagtcaccatgtttcttcattcgctccccacccccttctcccttcataacacttcagagtgccagattcctcagtccttggaactcaaacttccagagagaccayacttcatcacatacctatggcacatgttccagaaatgattctggccaggtgtccacccctgaatagatggccacaggyaggagaatgggatgtctgattggtctgatttgggaaacatcctatccaccacttggataggatcaactttacccaaacaggactgatcaggatccacatgggaggttcgctcckttggaggaggagatgccagcagaccgtggaggactggctgtgaggcacgaggatgagcgggaggcaagggcggctcctgcttccacagaggcgagcaggaggatgctcctgccctgctcacacagctgtggctctgcaccttgctccccgctagaaggtgggctatcgtagctaagctacctgggcagagcagacctcgtgagtgtggggaaaatcctgggcagcataacagactcatttgtagggcaaagggattttcagttagttctgtaacacactggagaaccaacacaatgctcaagcatcgttcctcccagaggaagcagatgggtgagataaataaaaccacactttcattggcatcctaggatgctcggggccctattttcaaggctgtgtatgttgaatacacatttcagtgatgctttagtctattccacagtgatkctcaaattgtggcccccaggccaacagtatcaccatgccccgggaacttgtttgaaagacaaattctccatcccactcaagacctcctgaawcagaaactctgggtatggggcccggcagtctgggttttaaygcaccctctgggtgattctgaaacaggcaccaaagtttgagaacgtctgcctataaatgtatttgatccaatccatcaagttcaaagggaccacctactataaaaactaaggcttatgttcagggtttattgagcagtctgaatttagaagagtgtgaacgtgaaacagttttctatttctcccattccagccttcagccacgcactatcaagttatatgcttccatccctttatagcatcctgggcagattcctttaacttttggtcagttcgattattaagttattttactttattctaaagcctcaatctcacatctgatttgacattcttcccttctctcatgagctagactcaaagaagatggaatctgcagtggggaggggataggatagttctgctctttcactcctcttttctctggagcaccgtggggtagggtggagtgggatggggtgggagggcagggtgaggcctggtcctgggattgctgcccctcatttttcagagcccaacccccatgggactgggagctggtagtgagggtacagctgggggacacagaggtcctcatctcttgtgagtggtctgctcttgctctggttcactgtggtcccatctgctgctggtggccttggcctgtgaagatgtggatgtggttttctgagggccctatcggtgtgagcccagcccatttgtcactaaggacagctgtggccccttttggcttctccaaaggtccatgcccctcctactctgtcctcctgtacaaagtctcagaaatgacttcggtcttcttccccgcctctgaggattgatgggagctgaggtgtggggacccatcccctcaggtacactgcctcatagtatttcttctccccgcttggctgagcctcctctcttcagatggctaaarcaggcacaacccccacgttgccacacagtcccatwaactcctatggatacaggtcagtctctctccaaaactccatcctcatatccccagcaccacatgggacctagaatagcaacgtctcagccagcatacagcctggaacaatatgaccatttctgcctcctgcaggcaccctcattccgcattctcggtaagtgattctaatcggtcccccaacttgaactctagagactaacaatgggaagaagagaactaaattattctcccagcaattcctactctccctctcccacttgtctgtctaacatgggctgggggaaggtggtgatgggaatagagactgcttctttgagagccctggagtttgaagaatttggccccagttgctggcaactctcattacagagtgtgggttccgtacattggcgcggtggcttatgcctgtaatcccagcactttgggaggccgaggcaggtggattgcttgaccccatgaggtcaagaccagcctgggcaatatggtgaaatcccaactactaaaagtaaaaaaaaatcagccaggcctggtatagtcctagctactagggaggctgaggtgggagaattgcttgagccacagagagcgaggctgcagtgagccatgatcatgcacagcaagaccctgtctcaaaaaaaaaaaagaaaagaaaagaaaaagaaaaaaaatggatagaatgtgggttccttagcacctgttgtttcagcagatgtcctggtgccacatttgctatttgcaatgcgtcttcacatacattatctcagttgaccccacagtgattctgtgaggtgtttaacctataaggaaacaggctcagagagattaagtgacaagcccaaggtcacacatgcagaggtgatggcaagatgggaacccagcccagtgactcctgagcacctgttctctccctgctgtttcatgcaggtgcctcagccacacttgtcttccagctctgggtgaacttggagcaaataaccagagaaatagcttgtctccaaggccacagagcagctggcaggggagagtttggggcaagggatttccttagggaaaacaccaattcgttctggtcatgcmcagtcacatgggtcccaaccatcaccttcccaggccaaggtcttaggttcccctggaacccctttggctttactcccttcctgggctgggggaaagggtggggatataagctggtacttccaaagcagaaagctggggtttggggctgacagagcygaccttgagcttgagctccatggagtacccagcccaggtcaaatggggtcaggaagccatctgtgccttctggatggctctgtctgaatgattcacttctgcctatggtgggtggaagttcatggttttactcccacatggtgaccacagtgcatggcaattytctagtcaacaggtggggttggggcctctgctacacacaagaggcttctttcttcaagtttaagacttctgatgctcacaagaccctcccatgcccttaccacgtgcagcgctcacccccagggcctggggtttggtgagatgtgtcgcccacatgggctgggatcatattttccccagggaagatgaaagccctcaccctctcacaaagccaattgctaaattttcaagaattttgcaagctgatttttaaacatagccattattttaaaattacattatagaacttacaatgaaacaaatgtttaaaatgacagtaataaatactcaaaactcctctgttctcattttactattgtctctgtctgtaaggttatttccgtctgtcgtactgtgtggtggaaatactattcaatgatacaccaaagtgaatctcttcccaactccgttatcagtaacatcacagtgggagcttaacagcagccatgatggctgtatttatacatggacattggcaaacattatagattagggtttgatgtattgttttgttgactgtgtaaagcaaggttcagcaaacttttctctgtaaagggccagacagtaaatatttttccttttgtaggccataggtgtctgttaaaactactcaactctgctattgcagcacaaaagcagccacagacaatagacacacaaatggacctggctgtgttccaataaacctaattcacaaaaacacatggtgcaccagatttgtcaggccatggattgctagcccctcatctagacttaagagagccatagaaaaaaaatgttagtaatgaagattaaatttagaactgtcccaattgtaactagcacaaaacattaaggaaatattcttccagtgctcaaaaacaatgatttgattgagcaaagaattcatgtcattgttgaatgattgagtttcaaygtgtccttatttcatttttgtcttcttcattaatgtaaataaacctgtcagccaacctacacttgtcatttgccaccataggttgactagtgagacaagggtccaacaaacatcagcaaaagtattctgtgaaaatcaattgctatttggagtttacaataaagaatactgtatatttcattattatttataaattgtataataccttgatagcaatgaaatgcacaatatatgcatgtatgcgtgtatatatatatgaatatattttcttccagagagccagttgctgagtatccaccaatgcaccactgcctgaggggtgtctacataaaaagagacctaacagcccagagcagcacttgttaaggacccaaggcatggtccmgaccccaaggaagggaagggggtcagggatggatagacaatctggaaagttctccaaggtggtctgagaaggcttcatgggggacagagagccgtaaagcatggtaggactcaatgacaaatgaagaatggctgtacttcagacaggcacacagcatgagcgcaggaggcgaggctgaagtcagggacaccgagacaagagggtgagcatagggaagcagaagggaatgaagtggggtcaaatatatgtaatggcatggaaacatgctatgagatcaagccaaaagaaaagaaaaagtagaatgcaaaattttacatttgcattaaggaaaaaacacgttagaagaamatgcacttaaataaattgctctgtgtgatagtatgatagctgattatgtatttatcctcaatgctttctgtaccttcctgttgttctgaagttgtattactttgatattcatggggaaaaataagcttttccagtatgaagggcaaaaagcactgagccaaacctgaagccatagctaaggacagggcacatctcccctgatgcagcccagaggcccctggagggaggtgctggggggtgaatagagactaggggtgtcactccctcctaggaggactgcaggagcacatgggtagccaatgctaaggcctcctgcccccatgggcctaagtagccctgtccacactggggatctgcccgctacctcatagcctcaggtagatgtctgktctctctttgcaaatgtcccccgcaacccatcacattcataaaggcaacaaattggggaaaacgagaggtcctctgtctttttagggcttcaccactgctgttttcccaactaaagaaatatgtacatatgtttaagtatactttaccatgcgyagaatgggaaaaacagaagttattctagagaacatctcgctcaactcgtttattttactaataagaaaatagaaactatggaggtcaagtggcatacccagggaaacagagctaagtgagaactaggctccagcagagatgatgcccagggccgggcacctcctttgtcagcatgcaggtatcatcagacaaggccaaaacagcactgggcgatgtgggctgagcagcccttggcttcgaaaacatgatttttttattattttttgagacggagtttcactcttgttrcccagaatggagtgcaaaggtgcgatcttggctcaccacaacctccacctcccgggttcaagcatttctcctgtctcagcctcctgagtagctgggattacaggcaggcaccaccacgcctggctaatttttgtatttttagcagagacagggtttctccactttggtcatgctggtctcaaactcccgacctcaggtgatctgcccgcttcagcctcccaaagtgctgggattacaggcgtgagccaccgcgcccggcagacatgacgtattctaagcactcctcaaatttacctgtggacagcaagaaggcctacaaggcaccccgtttacgatatgccacttggctccttcagggcagagctgcagcagcagtccttgtttctctgtgccccacatcccctcagcatgtaagaccacttctgccccacccattgctgaatgggaccttcagatgctatcttctccataaagctttctatgactcaggccgcatcattttgtggtcaactactttcactattattgtgtttattctccctaaaccagccaagcaatcccatttggtaatcgaaagagcaagtagcactggcttggtcatttccttcacataaacctgactgaactggatatatggtaaggatttccatcttgtacataaacacttgtccacctccgtgattcacacaattccttttccactctatcccgggcccatgtctccatcctgcccctgatgctggctctgcaggcattttctacatggctgyctgtgtacatgccrtgtggttagtcttaaatcaagggctcctagagtgcataggacataccagtttatactttttctcatcaggaatatgtgtagctggaggattaagaaatacattttcatgagctagacaataacaaaaattaaatggcaaaagtccttgctgtccttagtagctagggagctttaaaaataaatacataagcacctgtttccgtttttttactcctacagaagcagggaaattgctggagaaaaaaaaaaaatgtaagtccatatattctgtactgtgtcccttggaagaataaaattttaaatgaggtcatcaggaagtgcttcctaaatgtgaagttcacagactgaactttgaagtttagcaatggacttcccctgagcaaggtcggcttatgctattgttagaccagcagctgagcctcccccaccacgtccttctacctcttgcaattaaagcacagcccaggcaggtttttcttaaacaggatttttctttatgttggtgcatatgctgctgttataatagcagggacattgtcctcattcccagctctttcctccaagtcaaaacatttagaatgacaccacccaaagaataagtcttacttgaggctttgcaacctctaacccttcccacctctaaccttttcccatctttatccccgttatcttgggtgctttcagttttcagagaccagctttccaacagggctaaataacactctatggtttctttccccatcagaaaccaaagaactccctgtttctcagcccttgccagcagaatctggtcacccctctgcccctcaaaattacacatcttatacaactagctcctgtccctgcaccattcctgtcccttgtccttgatcctggtttcccagtggaacaggaaaaaggttttacagagggttttttgccaccatctctttgttcctcaggagatgattaagttgtgcgttaagtggggaaaaagtacattaggtcaaccccaaaatctgccatcgataacatcagagtatgtccatggctttattagttttctagtgaatatttaagagaaaaaggwgctaggtcatagaacattgagaaggctatacatctccccttggctataggtgcaatacattccaagagggagagatggtagtcatgcctcctatttttttaggtgaggtatgtattttgtagttctgctgggacaaaaacagctttcagtcattgaaaaccaaaggcccagtggacatcaggaggagatggcctccctcactgcaagacgacctctgggtcaaagcctagtgaaactttggcttttcccagcaagcaggaagtgacatagacagtgtctttttagagacctcactttggagaatgctcagtgaggggcaaacatttgctggtgacattgtagttctgtcctttgctaagcttgagtgaaaatcttttggagaatcracttttttctttcttttttttttttgatgtcccttagagagctcacaataaataaataaatcaaaacaaagctaaaagttcataaaaaagtctcaggcatggtccagattttcaggaaaccagcagtttctggaggaagtcccacccgctcctgaaaacagaaaaaataaacgagagagagtccaccagcaaacaggtgtttagtcttctctggagtcatattaagcaatttttacatttatggaaaagcaaacactccccccacatagggtgtggcccacactgggatkgaaaatcagcctcgtgctctgcaccgtgttctggtggcttctgcagctgtcacaggaaggaatccacacccgtccccaaggacgcctgcacgggaacagatgcccgctcccttaccccttgggggaaggacagaggtatctgagggattcagccctgggcactcctctcagcttcctccttcacaggcggggccctgggaggccctgagtggggccactgcgttgctatgagatcagaacggtagccagttggtgggtgcagcaggctcacacctagcaagaacctacctctccctttttcctaagaagggaaaacaactctcaaggctcaccctggaggcccaaagggaaggctgtatgggtcccgtactgcagcttccaagcccacggtggttacgtctgagcaccctgtagggctctgctctgaaagtcttttcagctcccaatgagcattgttcaagccgatgaacatccccaaaacccttccactctcagggcctcggccccacccaccacctggcatctgtctttaaggatgtttataacagagttctgaaataaagttttggctttttcctggagttctaactctgcaggagaagcagtgaggtaggactttgaggaattcaggaagtggagaacagctcatggtgagaggaaaggctggggccgacttgggatgtggatgtgcaaaaggaaaggtgaaggctggatgggaggcagggtgggyacagttaaggtgggccctgggccaggatggcctcccaaccagagagtagccttcaacatctcagcctcgtactgcgtgccagacactctaccaagccctccacttaggtaataatcacgtcttccamcctcactctcaccctgtaagggagctcttagaataacgctgctctccacggctgggaaacccaggctctgatgggtgacatcacttgttcaaggtcactcagccagtaagggccaggctgggctgcaaactcaatggcccactgcagagctcacamaggtccatttcctactcgccatgatgttttccagggagagtttagagaagctctggagctgggaaaagagggcagctgttagagaacagcgagcgagaatgggaagtcaggagacccagagctcaggaacagacttccttggcaggtggcgtagtcccatggcctctttagctctcagttttctcatctgcaagaggacaatgggccagattggtgcttctctgagagaaagtaccagtggttttgaccaagggactgacccgaacatggcatgtaagaggggtttgtttggggttggtccacaggatggttacagaggaaggaagaaagccaccaaggccaatttgaagatgtgcagaaacccagaagtgaggtgaggacggcagttctcaagtgcagagcttgaagtggtcactgctgggagggagacgtcataacaagacccaggaaacacttcaaaggaaaaactaacagcatttaaagattggctgcaatagtaacaataaaaaaagctaacatttactgaaggctataccagttatcccaccaagtgctcaactaccaatcctcacagcagccrgctgcaggaattatcattgctcccactttatagataaggaaactgaagtttatagaggcagagaaacttgcccaaagtcacaaagctggcaactcccagagccaggatttgaacacagtctcagtacagagcctatggtttctttgtttttgagacaaagtctcactctgtcaccaaggctggagtgcagtggctcgatcttggctcactgcaacaattgcttggctccctggttcaagcgattctcctgcctcagcctcccgattagctgggattactggtgtgcaccaccatgccaggctaatttttgatttttttttttttttagtagatatggagtttcaccacattggccaggctggtctcgaactcctgacctcaagtgatctgcctgccttggcctcccagaatgctgggattacaggggtgagccactgggcccygccacctatgttcttaatccccgtgcaactctgcctcctatctatgtgccgaagaaaggaacaacactcccctccagacctctgcctttcacacccattggccttggatgcccttgtctccccccggttccgattcccttcaaattccagctcctttaaactttcacaccttactctgtccacccctccacacctgcctcgtgctgtccccccgcccccacatcccactccacccccacagttcaaacctgctcatggaagtcctggaatgtgttttctccctcatcctcagtcccacccatcacacagcctgcactggatcatccaagttacatgccaaatgtctgtacccctctgtgtccaagtgaggcccaccttcctctttgcttctgtcatctattttcctgtttcttgcatgcattgcactgtgttcattatgtctattgttgactgcttgttcatatttccaccttccctataggatcgtgagtgctttgaaggcagagagaggctgggccttagtacagtctgtttgcagcacatggcatatagtggatgctggagaaatgttgatgactgaattgacatgattgattgattggatcaaatgaatgaacacaagaataaatgaacatcgggatccaggaaaggggtccttctggcaccaaccctattctgtccccctaaacagtattacatttagtgtttatgataaaggctttcagcacctttttgaagagttggtaccactggtccactttctgccctgcccttaatccatccaattggtttagatactcacacatacattctttctttctctctccttcccttactggaccccagaccaaagccaaagaaataaatgtcccctctcctgctctgtttccacttagataaattaatcctcagcatgagaggaaccaaagccagcaccttagaagtcaggctcctgtcagctcrgtttgctcacctgcacacagcccttgacttcctcctcctgtgtgggaggagcacagccctgactcagaggccactccaggcaatcctctcctcccaggcaatcctawaaggaacccactggctgagctctggcctctcggcagagggggcaggcctgaagaaccctttccaagaccagctgagctctgctggtccgctgggccctgcctgcagagttattggcggagttattcttggtgctcattagcactgcacaggctgtggattattcctttattgctaagtggcccccagaacactgcagactcatccctccttttgaagtccttgtaaaagactccaagaagtcgattccaatctcttctctcccagcgtggactgcccctggagcagcactgggggtgtgtggctgttagagtggcagccaagggccagctccccagtgaaaggtgatattgtgcttctaccgcacacctgcacgttgggatggtgtttgccttccggcctgactgctctgttctcatcttccatggacatggaggtgggaggggaacttatgtgtcattcactccagggtcctgatggccacttgcgtagagcaaagaatgttggtagggcctgcagtctaggttctagcttcagtgagctctggggcctcgggaaaagggcttgatccctcagaacatctgcaggagtctgtgacccagaccacaccaagctttcagaaactgctctgctcttttactctcccactcctctccaccctctcaagctgtgctatatccacaatgcaccagcccaggctgactcaacttcccgcccactgctcccctttaagctacagcacccaccattttgccccaaactcgtctatcctacctgagctcctgcagccagactgggtcacccatgcccctcctctaaccaggaaagaaaggaaagaatccatcaggtcttttctgtgtcctgagattgcgcaggtattcacccgctccactcccatctccttgacctctttcttgccctgtttctcggcgacctaggcattgggtcctggtcagttttccacttttccatcwctcccttaggacccctcaacctctctgctcatcaaaaaagtccaataaaggcattcatctctttgaatacttaattttacagtacctcttgcataactttcaagtttgaggtcaatacaaataaaatcatttaaaatgtctgatattaaacacttctgacccgaaaagcaaaaagccttttaacagatagttayattgatacaagagtccacaatgayaggtttcaaagatgaaagtaatggatcagtaaatagaacagtagagaaaacacagatgaaaggcaaataaccccacctgaaaaatccaaagctttcattttttttgaaaaaaaaattgtcaaaagcactgtattattttttaaaatcatgataaaaggagcatgcacctgtcaccctcccaaccccctctatacttgcccctttctatctttaagtgctgtggtctttgtggtgactttattggctcaagtttcctaggctggtactctcagagcctggtttcctaggagcagtactcataacgcaggtgcgatggacacctgtaggtgggtagtgccgcctgtgtgaaccaactcggctccaaagagcctaactccctatctgcatggttaatccaatcaaagcccaacctgctttcccacacaacagagttcaacagagcttttcattaaagcaacacatcatagcaaatacttaactagtacaaataaagcattttatttaaagcaaggtttaaagacatataaacattaagcatcagagctccattctttagttgctattcatcacagcttatgccagtccttgaattctgtctaacttgggtagtagccaattttctaactcaccttcaacttcttgggatgagtccttcccgggctccttgtttttctagaaatttcagtggcttgaccacacatcaaaacacacagggtggccaggcatggtggctcacacctgtaatcccagcactttgggaagccaaggcgggcagatcatctgaggtcaggggttcaaaactagcttgggcaacatggtgaaactcggtctgtactaaaaatacaaaagttagctgggtgtggtggtgtgcacctgtagtcccagctactcaggagactgaggcagaaaaatcgcttgaacctgggaggtggaggttgcagtgagccaagactgtgccactgtactccagcctgggcaacagagtgagactctgtctcaaaaatggggagcgaggggggagcccaccacacaacaaaacatatagggcttctcatctaaagtccgaataaaagaataatactatggctggtttgcactggaggaaagaaaagccctatcactgctaccttacttttctgatgttttgggttcctatgtcttatcccctcaggaaccaggggaaaaagaagattctgtgtcaagtgcaccctacatctgtccatgtcaccccccttcttccaatcagaacaactcatttcccccacttgactgctcccctaatctttgcaccttggagcaggatgtgtttattgattgatggatatttacttataattggtacctcttatgaaagccaacagtttttacatctggcttttaacacagactgtgctcttcaatagtcttagtgtagactgaaggtttttcaaattcacatttttagaaaagagttccattaaattccacatgaacaacagaaaaaaatttaaatgggacattacagtgatcaattatagattgtaggacatgactgacatgtagggctgggctgggaggaagagacaaagaccaaatgctcaaccaagggcagaggtggggtgtagattacgggtcagaaccgtaacataacggatggagtcccaagtgaatccaggaagttggaggaagcaggtaagtacttgggttaggcattcacaggcctaggaagtcagctggggcaggaaggctcagacaaggcaaggggaccaggaagcttggacccgtcctgggaagatagagtccaagagggcagtcatcaccggtcccacactaaaagcatcaaagctctctaatcttctgtcttctctactctctctggtgtgttgtcaaggaaggaataggtacgtgggaaactagggagacaatcatagccctcgatgtctaccgtttctaattaatacagggcagaggaattagatcttttggtagagatctaaaattcctctgaagttctatcaagccccatctcctgatgattcagtgctagttctaaaataggaaaacttacttccaaaaccaacagatgtttgggctgtcatcattatgcctgtactaaactcacttgtgatttcactgtgaagtcctgtctgtgtaatttattaggaatcatttatgtaagattatgtagaaaatgttactagtcgtgagatatctatccatctcaatgatttgacttttacagcaatgcgatggracgtgctgagggaccatttggtcaactttccacctaatggtggtgtgattagaactcctagcgggtgactcatagagagtgattagaagtaaaaaggttctggaaattcccccacactctttaaggcagcctttgtcaggtrtcttagtttcgtgaaaggtagactgatgttttccatctggtatacaaaacattttctaagtagttatagaaccttgaacaagccacttagctctctgggcctgagttttctcatcttataaaattaaatccatcaatagatcacatgatctctatggcttctttattctaaggatgtatggtaattttaaacacttggttagccatcttgaccaaactagcatcacaggtaagaaacaagctgcgaagaccaaaattcttctctggtttatacactctgggtcagaggcaaccactttctatgttgtttgggctacttttccctaaacacataatggctttgtctgcatcaaaggtcatcttctattttcctgcccattcatatgaccccataagaccttccagcatctcagtcagctgagcattttacctcctgcaaagcacatggtttccttcttctctttgcaggtcatatgaaatgctcacacagtacttactgtaatcacttcgtaaagttgattttcacatatcttcatccagaaaattatcccaactgttatatataactttattctaattgaataattccagttttcaagacacttttcagacacccattgtcttgtctgaatcctcatgacaacctcatttttttatagattatacagcattcctacttatatataatagttataactttttattcctaataaactttcgcatgacgtttcatcagattctgatagtttcttttgtttttcattcattgcattcccatccaaatgtttactgaccctgggaaataaatccagtagaccaatgaagcatgaatccaactcacagagggtggttagaactaaaagctgaaatggacttccgtgatcacctgacccactcatccctgaccgtagrctcttgttcacagcggccaaaacgtgcatgtctctcaggggcttcctgcttgtggagcagaacctttgcttgcgggcyccttgtgtctgtgagctcctcagaaccgctcttgagctcacagtgcctgatttgcacgtattggtttccgctccgttgcttattctggtcccctcatagaagcaatgttatcctttcttcaaacccgtcctttcccagagagctttgcagccacttttaccgggtttaatgagtcagctgcagagtttatgatccggtactaggccttctgggaagcagctttcctgggcttacgtcaggctgttaaagaccctcctggccttcctgccgacatttgctcggctactttttcctcctaattaatgcctctatcttatcagagtggcccattctcaaatgcagtaaatgagtccttgatgttctatgttttattttggaaacttcccactctgctcatatctgaattggtatttgctcactgttgcgcagtggtttgcctaccaggtatcccttacatcaaatcctgtccgccgcttagaaaaaccacagctaaaagttgtttggcaactcttggtgttcacagggttttcccactgagggtcagggactgcacagcggttgagagcttggactccggggtcagctggaactgcttctaacacaaggaccgctcttaacaaagaactgaggcttcctaaacttcagtttctgggtctgtaaaataataggacccacttcctataaatgttgagaagattaatgggaatgatgcatgtaaaatgctcggtacatgataaaagcccartgattactcattatcccactcaatgcttggggaaaggcaaagcagctaatattaccccagattatagataagaatactgggttcaaaagagatcacttggcttacccttgtctatactgcacctgcatgaatcatggacctgaacccaggtcacggccacytcccagacccttgctctctctgcttccccagcagcgcctctcagagtgaacacctatgtccatgacagtgattcccaaagtgttgtccccaaaccagcagcatcagcatcacctgggaacttgttagacatgttagggtctcaccccagacctaatgaatcagaaactctgagaatgagggcccacaatctgggttttagsaagatctccagaagattctgatgcacacccgtttgagaaccaaagctccatggaatactaatttgcctttggatctagccctgccgcccactcgagatggatggtccacaaatctcaatgtgattcctaacatgagttaagctgtccaaccctgtgacgttatcaggggatttgtgattaatacatagtgacaccatttaactgtggcagaggttcttacccttggaagctcattagaatcatctagggaacttataacagaaaggcccaccccagaccagttcagatctaaagacagcctggactgacaaccacagaactacagagctgmcacccagactccatggaactctgctaggctggtaatatttttaattcattaagggtttatgtgtttaacaacccaggtccagtaaattggctcctttcctccctatgaaccttggacactctggctggtcaagcctccacctcatgcccacttgtttgcacagctactaacgtttatgaagtatttgcttaatgtacctaagctccactgcccagagctatcccacttgatctgaaaacgtcatgatgaggtatggtaagcattaaacattagttcaccatagttctatttttttctaataacttaaacggcttcagggaacattttgtgtgtgtgtgtgtgtgtgtgtgtgtgtgtgtgtgtgtgtacgccttaagagactggatctcactctgttgcccaggctggagtgcagtggcatgatcgtagtttactctaacattgaactcctggcccaagtaatcctcctgcctcagcctcccaaagcactgggatcacaggcatgaaccaccatacccaccctaaggaatatagttttttgagcatgttggagtactcagaaytctcagctcagctcttggcccacttgggtctcaaccatttagagtactgattaccaaaggaagagcacaaaggaagaaaatcagcttttctcctcttcctcagtgtgggagaggggatttggcttgggctcaaagccatagtgatgctttctgctccaccccctttcaattaaagatcaccagcttcccaaaaacaggccaccctcattttccaacctggctcaggcagggaagctgagaagcttggggctgcccattcacccagtcaccaggcagatagacaggtaagagaactgggaccttcaggcctgccctcgggaggactggccaccaggctttacagcccagagcagagaaacactgtggccgttgcaaaactccttgagtgaagtgaccctaccctctactaaaaacgtggcccagtggattccagttactaacaaagctcgttgagaagatgcaagaaaggaatggaacaatggctaggacctccccgcggcagcacttcccccaagagaatagaggagctgatgggcacgtcacatttttctcaatgctggatgacattccatcaccttcctcatcttcatggaattttttttttttttttttgagacaargtctccctttatcacccaaactggagtgcagtggtgcaatcatgcctcactgcagtcttgacctcccaggctcaagggatcttcccacctcagactcctgagtagctgggactacgggtacataccaccacacccggataatttttgtaattttttagagataaggtttcaccacattgcccaagctggtctcaaattcatggcctcaaacagtgcttcgggttcagcctcccaaagtgctgagattacaggcatgagtcaccgcacccagctggaatgcattctttgaattttaaaagactgtaaatgagagatttgttcagagaagagggtgtttcctatgtacaaaaccaaagaccagcttttattttttattaggtattatagtcacaaaggtatgaaagggtatatagtaataagtctaagaaatttttatgaagtttttgaagtaaaaagcatttttataaaattttaaataaaaattttaataaaattactcaattgttaaatgtaacttaaaattactttttcataaaattactcattttataaaacacatttttcctactttgaaaagtagtacatgcttaatacagaattggaaaagacaaaaatacagaaagaattgcatttaactcctttttttttttttttggtagagacgaaatctcgctctgtcacccaggctggagttctgtggcgagatctcggctcaccgcaacctccgcctcccgggtgcacaccattctgctgcctcagcctccccagtagctgggactacaggtgccagccaccacrcmcagctaatttttatatttttagtagacatgggatttcactctattagcagccaggatggtcttgatctcctgacctcgtgatccgcccaagtcaaaacttcagattttgccaaacaccttgaaagtatgagtagatagaggaagactcgtccttttgtctgcctccttttcatcttcctaatacctaacacctctctaatctttctagaaatgggtaagaaaagcttccataaagaaaggtggagagaattgaagcatggtagtatttttgcaggagaaattataaggtttgaaatttatggaggcctcaggacatacccaatgacctaaggtctaggccagagatggtaagtaggattttttttttcttttctcttttttttttttttttttttgagatgcggtctcactctgtcacccaggctggaatacagtggtgtcatctcggttcactgcaacctctacctcccagattcaagcgattctcctacctcagcctcccgagtarctgggattacaggcactcgccaccatgcctagctaattttttttgtatttttagtagagatggggggggsggtggtctcaccatgttggccaagctggtctcgaactcttgacctcaaatgatccaccagccttggcctcccaaagtgctggggttacaggtgtgagccatcacacccagctgataagtagctttaaacacaagtgaggattcyattccatcaggaatggctgctttatgcagaagaactctaagattacatcaggctaagggtgacagaatgctgtaatccattagccttatctgtcatggtcatggcagcagcaagaggcagtctgagtgccatacactgcagtaatctaggggtgagctgaatagtgaatggagatttgcctaaaagaaacttctggagtcagtgctccaaaactctgaatcaaccaaatgaatgaattgagccaaatagaaatgcatgactattcaatatttattatgtagagaggcttagaaagggcaggcacctggagttcctccaccctcctcacccaatcacaactgcccttactgccctaccagtccagccacgtgccctttcccacccctctcaatgacccttgggctccccagtgaagctccctgagggcaggggacatagctctttggggccataaaggcattagctcacccttctcagccccttacacatttactgggtacttagatcaggccaagtgtggtggctcatgcctgtaatcccagcactttgggaggccaaggtgggtggatcacctgaggtcaggagttcaagaccagcctgatcaacatcgtgaaaccccatctctacgaaaaatacaaaaaattagccaggcatggtggcacgtgcctgtaatcccagctactcgggaggctgaagcaggacaatcacttgaacctgggaggcagaggttgcaatgagcaaagattgcaccattgcactccaccctgggcaacagagtgacatttggtctcaaaaaaaaaaaaaaaaaaaaaaagaaatcttagcaggattacatctgtaacccyggcactttgggaggccgagggaggtgaatcacatgaggccaggtgttcaagaccagcctgaccaacatggtgaaaccctgtctctaccaaaacatacaaaagttagccaagtgtggtagcatgcgcctgtaatcccaactactcaggaagctgaggcatgcgaatcacttgatcctgggagatggaggttgcagtgagccaagatcctgtcactgcactccagcctgggcaagagagtgagactcttgtctcaaaaaaaaaaaaaaaaatcttgccccttccctcaaggggctcacagcctgtgggagagggaaaatagatataattatatttaaagaattataaaacaaattgtataaatttaaaattataattaaatcattgtaataatttagatcagaaaaaataaaggcaagtaagtgccaggcatggggctaagcattgtactcacccactgtattccatgttgtcttcacaacggccttatgaggtttgctagtattgcccccattttaccaagaaactgaggcttagagcattcaagctagccaagggctaagccatgactcaaacccaggtgtgtctgactacggctgttactaagaggggaagggaatcatctgaacttgggtttcactcagaaaggggcatggttttggtaactttgaaaacactaccaccctaccctctagcactggcagaggggagctggacgcctggacagctggggagggggaggacggcagccagaagcaacagcctctgcagtcccagcagctgggacctcatgcctcaaccaaggatcagcactgggtattggctcagagtagtgaaggctgctgggggcctgtgtttcctgcatttcctatgtttatgctgccagggtgggttttatgtgaccagagagaagcagggaaaattgctgagaagtcagagatctgccagggaatcagtgatgagccccaggaaatgctttttgtctaaaaatatgccatttccgaaaggaaaacagtcattagagggtgtgagaagccctcgtrgtgaggaaagcaaaactgtaagactcaatgggaggccagtggaacaacagagaagcccattacccacccacttcctgtgcgattaacaagacgtttggaggatgaaaggcaagcagacaaaatgacaacccacagacacaactccaggggaaatgtctggggacagcataggaagacgcagcagggaggtaggaggagaaaaaactgctccagttaatatctttctggcatcggctggttcagctatagatttggctaaaattacctgtgtacttactagacgccaggcagttagggggctttgcttaaatcactctcctgcattcttcacayagcacttgatgaaggaggaaagtgagtcttggaggttaagtgacttgtccaaggttacacagctgggaagggagaaagacatggctccatcccaggttccctgatcccaaatctccccctcattgcaatgtaccaagctgcctccaataagatcaagagtcttgacgatccccaagctagtccactcagtccagttttcctgccagactayagctgttttgcattccttatcttgtgttgaagcaaaccrggtaaggaaactccccaccttttttattaatgactcattttcagccaaaacacattgcagccacatcaggtacatgtgcccactcagcaaagacgtactgtgagaaagtaacatctaagttacttggtccaaagcccttctacatcaatcatcaagcaaccaaccctcctttgctgaaatctccaggggactaggccctttggtgggggaagaggggacggtttcttcaggggcatctcacccctgggaagtgcatcctctctgctgggggcagtaaaaaggctttacrtgggccactgtggctcatgcctgtaatcccaacactttgggggcccaagcagggtgattcacttgagcccagaagtttgagaccagccgggcaatataaagagaccccatctccacaaaaaaatacaaaatttagctgggcttgatggtcccacctgtggtcccacttacttacttgggaggctgaggcaagaggatcagaaggtcaaggctgcagtgagccatgattgcaccactgcactcaaacctaggcaacagagctagaccctgtctcaggaaaaaaaaaaaaaaaaargaggcttttcacgaatttcacattccaccctccaccatctttgatgtaggtaatttatcagcattttgtagaggaggaaacaaggtctcccctacgttgagcccaaatcagtttgaccttggggaacacagtgagcatccctgcgtggaggtacgcaggatccctgagggtgacaaccttcgaggtcgttccctggcctctctgcccagggtgagcatcctcagagacctcagctctcctctcagcatgcaattctcctccactcatggccctcccagctgcccctggcttctcaaagctactcctgcatggaggcaagtacaactagccaatgagcctcctgacctgccccatcccagagagcaactgctgctaggtcctcgtggattctgggcctctgtccagtgaccaaaggagaggacacatctccagctaccatccctccacctattttctaaggaaaccaatgagttctcaaatgccacctgtggtggccccttctcagccctcaccctgagaggccttccccaagtcagaatttcccacaggggaagttactgtgggcttctctctccttcccccacctcatgtggtcaggaagtccagctggctttttctcctgtctgtctctcaaatgtgtcccctggctcccctccattgccactgccctcttcagtgtctggcctgtgctccyacaacaacaggcttgaagctggctgccctctcccctccatcttccacaccataatccaggtgatccttctaagaggcaaaggtaatcatgtttcttccctgctcaagatctgtcaaaagattctgtggcctccatagaaaaggcagacagcccggccacccaggcccttcaccatctgcctcttgaccatctccagtgtcctgcagtgtcctgaatataccttttccctgcctctgcccaacacactcccgttctttcaacacccaactcaactattaccttctctccatcagatcttccctgaaccaccccccagaaacaaaggtgastgtcccctctggttccccacagccaccccaccacttacccctgtgctcaggcactcctggagcactgcattgcaaccattggctcacacatctgtctctaccagcaaaccactaaaccgtgaataagtggcttcctgagccaggccttgtgcaatgaatggatttgcaacaaagggagccactgagagattacatgagccaagtcatggcaattagtccccatggaagcagcagctcagggcagggtccagacttgggcagacttaactatgcaggacattccattaacaataagcaccactctgagcatttcctatgtgccaggaactacgtgaagctctagattctgtcattagaaaggactgagttaattaatggaaagcaggtagcacagtgcctgacacagtataagcactgaacacacgttagcaagaaaagtgacagatcatttacgggatggttcttacaccaggcagcgtgccaagcacagtccatacattgtctcactcttcatgacaaccttaggaagagagcagtcctgtttgtccccattttacagaaaaagatactgagtcttggctaggctaagcgatctgctcaaagtcttcagctcggaagtagtggatttggtcttccatccccagtccatctgctctggcacccaggttctcagagtctctggtacagcagggtgccaaagtccagttgagaagaaagcaggccaggtttttcaggcacagcctgatgaaatatccaggggaaacacatgggactagcaggcttctttttctgtcccatttagtctaatatcacatttaacacaccatcctctaagggacagaagtcacaggaagccatgcagtctggttcctcctgatttctcctgtgtgccacatagttatgcttccttctgggaaggtgtgagttggagtcagtcccctcctgcatgcagctggggaaactgaagccaacaccattttagttactcacatggagctaagacaatcatacaaaactcaggcatggggtcagcccaccagcagtgtggacctcaccctgccggctgcrttccaaatgacagtggcatggtgccacagaaaaaacrtgaggtgtgcagctggacccccagaagccctgactctgccaggtgctagctctgggacatcttgggcaagccatttggcccgagtctttttccccacctatgaaacaagccagagagctcattcctcacaaggctgtggtcagaatgtgcctctgtacttgagaagctgtaaaatgttcctcagttgctgcccttagtagggagctcagaggaaagctagttttgcctgtgcgtttctgtcggattgccctgtacccagggcacgtcctgctctctgacaacaatcagggtcattctaactcaaatcaaacaacctggtctcagaactggtcttgcaccaccatggtgttaagctgccttcccacttcatccatgtttgctaagccgggtgggatctttcccctacaaactcctataggcggccacatttttcttttaaagatattttcccttcgactatagtccacaggcatcagaggatgaagctagcaggttgtctgtatgtagactttcttccagggaggaaagcagctttgctatctcctacctttttaaacaaaatctgccttgattttgtctgccaagatatgtctttggatggsgtaaagcacttctgagggaagctacgtgagccacgttgtagctggagagagaattgaaagaggaagccgagctgagaccaccacagttccggggctggagcccagctttgcagaatgcctgyatagcagtttgaccccaacagatgaggctgttagggacagaaatgaaaagcactgagagaggggaagtgtgggtggagcttatggacattctatgagccaaagcaattttgaagtctaatcatttggagggaaaatatttgtcatgtcattttaaagggtacaaaacaacacagaggaraatgaaagggttagaaaataattggagcgcttctccctttacccttgtagaagacagctctccggttttcagctccactcattctgtcctccattggaagctcccccagtgtcttagagatggatgatgtaaaagttagaaaatgcctgtgtttcctgcttgccttaatttaagaaactgcttgactgaaaagtgactgaatttcatttataggataaaatacttgatctccagggaagccaggcctcaatagatggatttttaccatgtcacttccccctagacctgtgggaactgacctgagtcttggggaaaatttgagccacatggcagtccgcaggtgcccacaagtccctctatgatctgagtacctgtcttcccagtctcatctcacctccctcctctccagccagggggacgtgcaccctatacccaccccatgcacacctgtcccaggctctggctttcagctcctaccccagaaatgcccacctccccccatagctcagtgtacccaagcttggcccatcctaaagccatctctgataactccaccacaacctgtcttggtccaagctggaagtgatgagtgaactctcagaataaataatagtagctcacatttcttgagctaagagccagacacttcacaaactcactctcacatttctttttttgttagtttgtttgtttgggagacagtcacgctccatcacccaggctggaatgcagtggcataatctcggctcactgtaacctccacctcctgggttcaagctattctctggcctcagcctcccaagtacctgggactacaggcgcacaccaccatacctggataatttttgtatttttagtagagatagggtttcaacatgttggccaggctggtctcgagctcctgacctcaagtgatccaccgatcttggcctcccgaaagtgctaggattataagcatgagccactgcgcccagccagctcactctcaacttaatcctggaacaaccatataatataggtattactatgatttatccccatttcatagaggaggtaattaggacttagggaggttatgcaagttacccaaggtcatatagttgataagtatcagagccaagagttgaactcataccacctttcccaagagcaccttgagctactagaactactgcacgcttgttttgtaacatttacagaactatagttcagtgggcaaaggccatgcatgattcttcacacctcccacaatactgagccaccagcaatcaatgcatgaataaatgaatgaatgagaaaatacccacagactagagagttaaggcaacttttacaaacattaaaaggatgccatgtcaacaaaaacacattaagcaccaaccgtgtggtccacattctgacgggctctaggcctcggagttgaagccagggtccactggactttcagatgttcaatgaattcccactttccaacctagaagacagtcttctatcgaggactgcttttcagtctcctagctgctgctttgttcattattgctcagcaaacagtgtgatttatgcatgagacacacaccttaagatgcaatgtagttcttccaactgtcataactactaaattgaattgaatggcaatctactggtagctcaacctctgcaggaaaaaataatcagcctgaaaataatcaatgcaatagcactgtagtgacactgtcgaaaactgtacaaacagtaggaaaggtaatgttgtgactgtcatttattaatgcagagttctagtgttcctaagataaagatcattgaaatgtgaagcgcatttgtccaaacagaatttctaataaatacctttgattgttcctttgtctctatcctttactaaagtcaggcaattagcagtgtttgcaatattacaggcaaatgaaattgggtctctgcctggtccgcctacagaggacttctatagcaataaaaataatcaactggattcttcgttttctgctgggtccatgtgatttccttaataatgtcaatgcagattgtaatttgtaggaaaaaaatactgcttgcatcaggcatgaaatttaagaccacagaaatgccatcttttcttacagaattgttttgttacaagggtatgtggcttggacgattagaagagacctcaggtgtggtgcccaattcatctttcatagaccaatattttgtttcccaaatgtgccttgtacatttctccaataccttcactctctagctgttggtgagggaaaggacaaaaattagagtcataaaatcaccattaaccccccagcttgaccactcactagctagtcatttaggctccgtgggcctcagtttgcttctctgtaaaatgaggcagaaaactatgaaagtgcctccaatctaagttccccaggctcctaagacaaggcctggcccatagaaggcacacagtacatgttgyttgagcaaataagtcagtttcttgtatggtatctggcatgtgatcagcataattaatggttgcttaaaaattaacagtctgttccccaccagtaacattcatcttcttcctcttggcctggtgaaatcttacgcattcttcaaagctaacatcacattctgctttgtctgagaaaccttcccaagaccacaccaactagaagtgatctatctccctaaactcctaagacatgtgttgtccataagcttcattcattcattcattcattttatgtatttatttattttcgaaatggagtctcgctttgtcacccaagctggagagcagcggcgcwatctcggctcactgcaacctctgtttcctgggttcaagcgattctcctgccttggcgtctcaagtagatgggattacaggtgcctgccaccacacctgactaatttttgtatttttagtagagatgaggtttcactatgttggccaggttgatcccaaacccctgacctcaagtgatccgcccccaccttggcctcccaaagtgctgggattacaggtgtgagccactgtgcccggcctataagtttcatttaaaacmagcttgtccaaccttcagcccaggactgccttggtccagaagctttgaatgcagcccaacacaaattcataaactttcttgaaacgttatgagattttttcatgattttctttttgtagcttatcagctaccgttagttttagtgtattttatgtgtggcccaagacaattcttcttccaatgtggcccagggaagccaaaagattggactgtcctgatttagaacttgggactcatggccttgtactgtaggttcccctctcaaaggatttcttagctgttcagttatgtcacaagcttctcggaggcaggtccagagacttcggttcctggtgatttaaacagcccctagtcaagagcatggcacacaacagatgttccataagcatccacagattgactgggggaaatgtccaattcccatggagatggtcagatgccctggagaggccacagtgattacaagccctacagccctccatgggatacactgggccaaagacactggtacagaagacttgtcttctgtagaaagtttgctccatttcgctaaatatcttcccatttgtaaggaaactgatatcctcatgacttgtggtgggagggaaattgtacaacctcttcaggggacagagtgacaatgactctcaaagtttaaatgcacatacaattttaaaagattaaaaaaaccataaatgtcctttgacacagtaattgcacttataaatgtttatctcacagactgacctacacatgtatgagaaaagtcattgagaagattcacttttgggttatctgtagtagcaaaagactggaaacaaatgtctatcaacaggtaactggataaataaatcaggatatatccatgtacaagaacactatgcagccttttaaaagactgaagttggccaggcacgacagctcacacctgtactcccagcactttgagactgaggcaggcagatcacctgaggtcaggagttcaagaccagcttggccaacatggcgaaaccccatctcttctaaaaaaatataaaaattagccaggcctggcacctgtaaccccagctactcgagaggctgaggcagggagaattgcttgaacctgggaggcagaggttacggtgagccgagatcgggccactgcactccagcctggccagcagagcgagactccatctctaaataaatagatagaataaagtagaaatgtatgtacttgtgtagaatattctccaagatataagtgaaaagacaaggtgccaaccagtatgcatggcttcatccagcttaygtaaaaagggagatgtacacatgtgcacttgtatgtgcctatcctgtctccagaacaatagcaacggctgacttggggcagcagggaaagagcctggggtcagaagcaggaggagacttgtcactatattcggtattctcattcatatggactaaattttttagcaagtgcatgcattatctttcttttaaattttaactttatttttaatcagatgatgaagtcacatgcacaaaatcatgaaaggtacaaaatggtacatggtaaaacgtcttcctcccagccctgtccccagccacccagtttccagcctagagacacctaataggaaccctttcctctgccctttttagagacagtccatgcattgcagagattttcttttaaaataatcacaatgaagtgaactgggagaaagcttccattgacctcaccaccctctccagctcatgctctgttctccagagccaagctttcacacagggttgtctacgtgtatggagtggtgaaaaagagttccttgggctttggagtcagacaaacctgagtcttcaatagttgacctaacctctctaggtcttatggcttcatccataaaatggacaattcatacctggctcttaggttgttataagggtaagaaacagtccatgaaaagcatatgggtcacttagccacagccactctaaatttctgggcaccagcaccctccatggctgggaccaatcctcactgagcagtgttcctggacacagccagagaccccaagacccctggatgtccccctaatcccctgagaagtacatcctgtatttctgaggtaacattttacggtaaacttctacagcaagcaaaaaaccttaaggagctcatgatcaagaccagtcctccctgggtttgggggcttttgaaagggcccaggtttagacatcaggaaacctgtatttgaggcctgactctgccattaactgagcctcctggagtgattcgcttctcatcccaagccttgcacagactgggtggtgattcctgaggcccagaacctggccagccttatagcgtcagtcagggatgtgttagtggagcccttcactcagcgaaagcatagctggctgagtctctagacagagagtgtgttgttcaggctaaactatctccctaccatggacataaaatgacatgggtakagaacacactaaattcttcaaggtaacaaatttaaattcttcaaaaagggagtggctatttaaaatatctctagttcatttttagcattactgaaattcaatgtaaatcacagtggccatatagagttgacatataaccctccctctgtcaaacaccaggttactaaagtcacagggattaagaaatgacccttggtaacaaaagttaccaatgtagaccagttatgtggcaggtggggagagctattctaaggttccttctaactccaaggggctcagatcggatatttggcaagtaagcaattggcacactgacsctgcagtttacaaagtgattcctacgatcctgagggtagaagaagattttgctcctggcagaggttttgcaggatgtgggtggggttggagaggaggctgctgtgagggtagaagggggtaacctctgtcccttcaccatgtttatcttgccatatcaccatccagcattcacagtccattgcccaaaataaaccacagatacaaagtagaaagatacttcatctattttctaagtaaatctaggaagttaaagatcacagctgtctccaagaccatgcccgttgagtaaaaatatctcttggcaagttgtcctacatcaattttttttaatgagacctcttttttcctacctagtattgataatttaatagctctgcaaaaagtgcttctgaagcaagaaaacttagtattttctaatttattctctgggagatttgactgctaatcaaatatcttaattccctccatacttaaagggggcattttaaagtgactttcccagccgttccaaattacttcttgaggtttattgtttgcttttaaatttatgtccaacatgggctctcttcttggggactgagctgtttcagaaaatgatggaaatttggggtgaatctaccaacagtgttcagtctttccaaaaagacagttcattaaaagctgaaaggtttgaccctctggctctatctttttggcctaacatcctaacacaggtgtggacagggtcaagcatgcaggcctgtctctgatacctggttatagcaaggctgtccttggcatttcacctccacctcttctgcatcatacattgtttattttcacctcattattccattcctactccatttggtgataatccactgtgtgctaggcacccttctgggcaccagcatatagaaaaatgccttagcattcgtccctgccctcaaaagggccttgggatcaagaagaagtggacacgagcacatctgactaaacacaacatcatggagggtgtatccaggatatgagcaaaatgctcagagacaactctttttatttacgtcacaaatgcttctacagcacctactatgggccaggcatcatgctaataagggctttaccaatattaattcatttaatcctcacagcaacccactgagatgaatactattcttatcctttggtactgtggggaaactgaggcacagagcagggaaataacttgcccaaggttacacagccagtcagctccaggtggggctcatggggcatgggccctggagcccacacactctgactccagggcccacactcctaccgtcgggccacactgcctcacaacacactttctcgccaaattcagagacacataactaaaaccacttacaaatggagtatgccaactgagaatgctacagaacacattgaggaagtgacatttacactaaaatctgaatgatgaacaggagttaactagactaacaggggaggaagtgggttgcaagccgtggttctgggtggggaaggagtgcaatgtgttccaggaactcaccaaggccaccagaaaaggagggtggaaaagaaggaagaaaacagctcaagaagaggctaaaacatgagcagcaaccatagcattcagcaccctcactacaggccaagggtcattccgtagttgggttccrcaagaatgataggaacctaacagctttggcaggggtaatagcatcagytatgcatcatccactgatcacttgggctgacatgtagaatgcattggaagaggacggcggggttaagcagggagaccccgggggaggcagcagcaaggagagagttgatactcccttggatgggctggaggtggataaaaatggattcaagcgagttttaggagacagtatcaacatgttatgctgcatgtttgcttatgatgggtgaggagagggaggagtcaatggtggctctgaagattctaggtattcacagggtcgggaagcacttgtttgtcacmggtttgttgggtgccggaggggaagaaagtcccgtgcaacagccacatgcaatgttcatcactcccctggctctcaggctgcttcagggctccagaccctcgcacgtgctgatctcgggctaagggctgtttccttccttcgactgaagacctttcatactgtaagattcagcttgaaagtctctccctccatacacatcacacgctgacactggaccaggcacttatttggatctcacaacatctctgcaaagaagatattgctatgcctgttttacagactactgagaatcagagaagttccaaagctgccctgtcatttgtggcataagcgagagagcccactgacatcccagcgctgccttcccagccacactgagggagaggtgggcttggcccttgaggccccttcttctcaaaggcattgaggttactttccatgtagattacggttgagaacaatgagaacttctggagcacattctgtgggctgtgtgaggacgtcggcaagggaacagactaagatggctagaaaatgcccctctttcatctctagaattcatctagtgaagcacttcccaagcctcaggtatccagggtctccctgttcttcctagaagtaggttccagtgaacagaaagcccacagcataactaagaaaaagctgtgtgtctctaccatgctggtgaatccatgctgctccttgacctgccactccttgacatggacggctctattctaacagtgccactctctcatgtcactgtccctctgcctggttcctcctcctctcttatctgcctgsagagtcccactccttggatgagtctcacccagagcatccctcccccatctcctcaggctgggtgtagggtgaccagctgtcctagtatgactgggcctaacggatgttctggtttgtgggactttgggtggtatatcagctcaatcccatgcaaaccaggatggttggtcaccctagttaggcatgtggattgcccctgcttatggcaagcccagcaagtatccaagctgtcttgcactcattggttctctcctctgctctttccccaaaagtagttatgaccctctgagatgaagccctgtgccttgttcatcactgtattctcaacatctaggcctggtacagaccaggttgtgtggtcaatgtttgtgcaatgaacgtacgagcccagactcagcatatttaggagatggctcctaccacccagcaattagagaggggaggcaacgcaggcggaggacatctaccaatgcagcacatragcaagacacagggcctgagaataactgaaccctggcccacagatgccaaagaactggttttgcttgtttgtttcatttgccagtcagaagcgtgggggataatttagtggaatcccttcacagataggttttaacttgaaataaytcaactataggtgcttggcaaacaatcaaatagtgaacaggcccaagagagaaggaaataatttagatggcagatggcagttggctccactagaagtgccacctggtgagcacgggcccacagtgggtgtgaggcgggacaacgggggcacacttccctcctgygtgtgtacctcacactgtgctaggatgattatggttctggcatacaaagtcacttatttttcatgcaacctggtccctaaacttaagaaaatgcctttatctggtaatcaactgggaaaaacattggctgaaccccatactttcaagtacttatgagattttcaaaggtggttcttacacactaacttaagagtccccagatggtgagtcccagctgcgccacttcataactaaatgatcttaagtagctaatgacttaaccttgtagagcttccattctcatgggcaaatgaaggataacatctctccctcatgggctcacagtgaggattaaacgaagggaaggtatgcacaacagttagcagactgcttggtacaaagtaagcgctcaataaaccaaagctattatttttagtggtggtaatagcactgcttttctttggcatttaaagctgtgtagctaatctgggcattccaccaggttgctgaagcaatagacggccccttaataaatagcttccagacagcatgtcatttaaaactgaatgcatttttgcttctcagttgttggacatattatttactacctgatggtcttgctctggcccaaacaagctaattattgcaattccagagtacatgccatcatccagaaatagctttctgtagagtggggactgaaattaacaggcaattagcaagtttaaaaggatttcctttccccatccccacccctggcacctctaacacattaaagctcatcacagcagttattttaaggaaattcagcagaggtacttgcrgggcccraggtcatcttgtgttggccctggatagatcatgaaatcctgttgccaaggagcatggtgggaatgtggcaggaaggctaaagtcaggaaagccacctcagccactaagtagccatatggcctggggcaagccactactcaactctgagcttcagtttcttcatcagtaaggaagtggccaggcacggtagctcacacctgtaatccagaacttggggaggccaaggccagtggatccctcgaggtcaggaggtcaaggccagtctggccaacatggaaaacccccatttctactaaaactacaaaaattagccgggcatggtagcaaacacctgtaatcccagctactcaggaggctgaggcaggaggatggcttgaatccaagaggcggaggtggcatgagccaagatcatgccactactcccaagcctgggcaatggagactccatctcaataaataaagttaagaagttagactgctcaattcctgagactccttccaacccagcaatctgacgtccacactggggctgaccactgaactacatggaggcacatgcctcagtttccttatctacgccattcatctaacagctatgtatcaatccctgttaggcactaggcactgtgctaggtgtttggaagagtcattctcaggcctatcctatctcagcaacctgtaggaatgtcctcacctccagagttagcccccttggaaggaaaatatttagtcccacattcatttctttcctatatgaacctggaatcactgggggcagcctctctgaactgccccattttctgaaaagtgtccgaagtacagcccaggcatggggcattcagcacaaagggcccaagtcttgagagggagtagtttaggagtgaagaaatcccagcctcccactatccagtcttaaggtaaaaagaattgtacagatgagcacctttcttccccttggtatttccctttggcatgacccaaagaccactcccataaagggccataccctagtgttttctgacaatctagggatgaattccctattacatctcaggatgggagaaaaacaggatttgggagtyctggtttaatcactaaatgaacttaatcttgacttctggttttgtcatctgcaaaaggcaagtggtcctgatggctacttaataaagctgtctgtgagccaaatgagagtgtgcatctgcaagtgcattgtaaactgcaaaaataattgtggttctctctgggccgccttctacttcacaacaatactgagctgaccttacagataagctgaacagatggttgcctccatggtagtatttgaatagcaccagaaagtttcacctctccaaagcatctttctgctggcctgaaattcaaccattagggattcattttgttgcggtgggggggggggcggcttacaagcttcccagggttcaggagcactctattaaatagctgttgtaatcacccagcaggttcttcctattcgctgcatagacaaaaccagttcaccaagaccacgctattgtagtagagtttaacacaaagccagctacgcagaagacagttattactccaatcagtctccctgaatgctcagcggttagggtttttcaaggatagtttgatgtacaggggattagggaatgggtgctgcagattggttggggatgaaatcatagggttatggaaaacggtccttgtgcactcagttggcctctgggtgggggccccaagactggctgagtcatgagcctcaagtccggatgtagtcagtctaaaaaacaactcaaaagatccatcttaggctctacaatagtgatgttatctacagaagcaattaggcaagtcacaaatcttgtgacctctggccacatgacccctgagcagtaagggatgayagaaaatttgcctatatcttagcagaattcaggcccctttcataatcctgaccttctggcytttcactggttttgcaaaagtggttgagtttggggagtggctattatccttgctgtaaggttcaactataaactaaattcctcccaaagttagcttggcctacacctaggaatgaccaaggacagcttggaggttaaaagcaagatggagtcaactatgtcagatttctctgtcatcatttcacaaaggcagtttcactgtgacctgctaatactgtgggraaaaraaaaaaacagtactcattgggccttaggcatattctaggttctttgcaatacttaattttgtttttaatctcaaaccagtctgagacaggatttactattcagcacatttttgaaactgggaaaatgagtctcgagatgtttaggaaacttgctaaaaggtcacatgagtgacagggttaggacttaaacatgcgtggggtcgggaagatggcaggcacagggtatcaggccaggggagatgccctagagccagcgacactcagcctacttaacttcttctaagagccggtcacctccataaggacagccagagcttctgccaggaaagaaagaacgttgatgctattcgttttccaaaagagcgtatctcctccggctaatctgaacrtatttcttacagggctcttgaatgcccctttgtagctgagtgggtgaaacggcatcaccaacatttggccctgctgctccactgagagccggcgccgttcgcgggataattatcctgtagtcttctcacctccggagagaatgcaaggcgccctccttccaaatctggcccgtcacgccagcaccacttatttttagaagctgttttcccctcatagtttcacaacctctaatctgccactctccagtgaatataaattaaaacacaacaatgaaatatggagaaatgttttctcccgtcatctccagctctctgaacccggggctgggagtgggtggagcgcctgatttgtctcccaggcgacacggaaagggaggcagtgagacgtgctacctggtcgcttccggctctgatgaaccactgccarccagttattagggaggagggcagcacttgcaaaaatttcaggtctctgagagcccagagcctgagaagtgtggaggatactaattacaccmaggtggaagcctggccacagctcacctcctaaggaaagagcgagcccattaaatagccaggaaggaatggagttcacaggggattagatttctagattatagcctcagagtcattctcaaatttatctcctaaaatctggaggtcaaggaacaaaagcacccttgaagaacaggtaaagggagcctggtctgaattcttagctcctgacagccaggccgcaagaggacagacatcccgtgcacacacgcccgccccatcgccaaagaaagctctagagctagacacttagactggcctttcatgaaatgacagcacctgccaaacacaatagggaaatagttagtccagccaggcagtgccatagagtggtcagagcatgggaatttcaagcagacagcagcaggctttaatcctcactctactctccccagatgtgtcaccaaggcaagtcactcagcttctctgaggctcagtttcctggcctgtagagtgggaataattataatactatcttggttgtcaggtttaaaagaccaaatgaatgtcactgcctggcagactacttaaaacaataagaggtgctaaagttactttaaaccaaccytctccaccctctccttccccacctcagtttcataccccagagaccaaattcctgatggattcctaaatgatatctctgccaaatactggtgccaggtgctgggcaaggcacagttttgcaaccagctgtcaggcagcaacaacttcacagtcgtacttttattcagtgtgtggtaaaacttctgggacaagagtcaaagtcgtagggctttagtgggaaactgccattgcctgaccagaggtacaaagcactggcccttccctcatccctggcctgacctaagagggctggggtaccacaggactgttgaccccactgagagctcagggtgccagaaacactgcctgccacgtgattcytattggtccttccagagatgctaacaggcctggaggctggaggtctctctgcccacactttcacacatgacctggagcagggggtcccagctctgtagctgcatttctgacccagttggataccttgacatggtcccagcaagcaacagagcacccattgtacagccttccccagccccagagagggactgtccctgccaagaacagaggtgccacccagaatctgacagcaggggaggctccccaagcattctacccagaagaacaagcaccctccccagatggcctgtggcccaccctgccctcagttcctagcagatcctcaacttggcctgctttgatgtttgtgaatggcaggtaggaaaggtcaggcaagtggaagaaacctaaaaccatgctctctatggccatggaagcttcctaggtattattacatagctgtagtatattaatattactgtcattaattgatattattgtaatgttactataatatacatagccataatataaacacattataaagctgtaatagcttatctttattctactatgtggcaagtctgtactaagcattctcctactctaaacccccacaaaagtattagctatgaactatcattgaatttcgttttacaaacaaggacaatccaaagaggccaagttacctgcccaaggccacacagtccacaagagcccaagttcccactcaggcccattctyttagctctgtgccacccagctctgcaaatgtagccacccaaagccaatcaagccagwggtagagttctaaaaccaaatctagggctctgtcccaccaatctccacctggtgcctggaattcctctatttttgttttttgttctgttttgttttaaagtttcactcayccccctccttaaacccaaatatccctgggacaggatggaaatccataaacaggtgcctgagtaagacatcattcacagagccttttcctcctgacagctggccaagaacaggagagggggccctgggcaaatctgcaggattacatcagagcttattttcccccgtatgcccctaattttctacatgctcttccattcctgatggattcctaaatgatatctctgctaaatcctggcgccaggtgctcttccattctcccagtgatccagaactttcttgctgtcatgaagaaaactgatttaataagtaaactcatacttaggaagcttcccatccaccctggccccccatggtatctcacatcatcatcagaccaaaagaacccataccctcatcagtgatgactcagcaaaatcaacttcacatgattaggaagctcacataactagcaaggcgaggaggttctctctgccggccacctcctcccgccagcactccaccacagcctgcctactgtctgcccgtttggactagcagctggtgctgtgggatctttaactccactgaaattatgtcacaaaaytggggcatcgtagggaacctaggaaaacagacaagaaataaagactccatatgtgcctggcccacacccgagtttggctcactatgcacacattagatcctgccattcacaatttaaaatatatatwtatttttttgtgtatatatacatatatacacacctagaaaaaaagtatgtattttgtatatatacaaaatttattacrtataaataaaatttatacaaaatttattacgtataaataaaatttatacaaaatttattacrtataaataaaatttatacaaaatttattacgtataaataaaatttatacaaaatttattacgtataaataaaatttatacaaaattttgtatatatttgtatatgtgaaatattttttaaatgttaatatatctataatatttatatatttgaatatataagtttatatatatttatatggctcactataaaagaaattgaaacctccttaagcatgaacaactcccacgggtgttttcttcatgagacgcacaggaagatggcaatgggtactgaaaggaatgaattgcttgtgggggaactttatttactagaacaaccccaggtaggaggagaggttttaagaaatgagagtaggggttctggaggaggtcaccttgcctcctagtacagaggtaagactccactgaggctggagaataatgctcatgaggagattggcaggccccagatccctgcagctactgggacagaggcttcagttccttgccatgggggcctctccctaaagctgctcacaacatggcagttggcttctcccacagcaagagagagaatccccagagagagcaagaggctccacaatggaaggcctagtctttcacaatctaatcccagcagtgacatacccatcacttctgctctgttattggtcagaccaaccctggtgcaatgtgggagaggaccacacagggtacaaatcctgggaggcaggggcccttgggccatttgaagggtggttactccagcaggtacagagtatggtgagcccacatgaggaggtgcccagattgcagccatagatccttgggcaggtcatccaacctcatttacgctgtttgcacttacagaaaatgagaataatagactcgtcagggcttggcaatgcctatgaaagtgcattgaacaaagggaagtatgctgcagatataagacaacatggttttgattgtaattactagtaccagtagcacatagttgtgaggactcctattctgttgagctaacagccctgacccacctgtatcaatcagtgccaatgtatatttcacattgccaatacccagcgtcagataatgaagttttgcaaaatacagcttgggtgggatctctttaatgacctgttaaaactgatttatagttagctttttacctgaatgcacataaggaatctggagttcttgctagttcttgcttggaaatgatctgtttcttcatctgaatgtcctcccttcatctgatttccttagcaaccctggtttttctgttttgattgacaatacaaaattaaatattagtccagtccctcactgggctatcacaggttccaaaacacccagccctcatgtcattgatccaacatcaaccgttccaccggtccttccctcccctgcccccttaccctgccctaagggctctcaagacagacctgtttaactctgggcatttagaacacagaagactttctcaccagggaatctctctttctaaaatccccacagagctggtcaagcaagaagagcactggactacgcatcaagacctggggtgctgatcccgactctcatccttgactgcagtgtgggctgggcaggtcacttcactgctctgagcgatttagttctggttttgaaagactgggtgattctacccattattcactgagcacctctgggccttctattatggcctcctccctttcctgccctgcagctccctgccaaaaacaaagcctatgcaaccttcgtagatactcttcatagaatctgtttctctccctgtgggctctttccttctgagcactggcaggacttaaccatatgttctaggcattgggtgtgaaaccagcaaggcttggtgctggaaatttagcctcatcttcccaaccaccatagctaactcttgtcaagtacttgctctgtgtgccaggcactgttctacctcattaaaacttcacagcaacgctgaagtggctattatcatcttcattttatagatgaggaaattgaggctcagagagagtaagtaacttattcaaagtcacccagcccacatgaggcagagccaggattcatgcccaagcagtccagaacccaagcacgctgtcttgggactggattttctttccccatgaagaatgtaaatttcttaatcacaggccctgtttattttacacacagtcagcatctrcaagtctttgttaactgattacaggtttctgtaattctaggcatgttaagcgtagggtcaagcataaactctgtccctacctttccagaacatatgctctgatatattatagcagacaaatgcaaaatttccaagactcgtgggatttagaagggatttttctcaactcttcttttccagataagaaaagggaagcttgaggagattaagttacttctgaccacatagctccctgctgcagaaccaggacagaaacccaagccttctcatccctatcacgagttggatctagggcagtggttctcagtggttctcaactgggatggtttcgctccctcaccccatgggacatttggcaatatctgggggcatctttgcttggcacagctggagaagaggatgttactggtatctagtgagaagccaggggtgctgttaaacatcctacaatgcaccagacagccttcacagtagaatcatgtggcccaaaatgtcaatagttctgaagttgagagatccattctgtgggatttaccacttcctctaaggctctttgtttctgtatctttacaagcagtcatctacagttggacaccttgtcttattcatccttggctccagtgctcagagaagtgcctggcacgtaataaaagctcattgaacaagggagggaaggagagagggagaaaaggaagggaaagaatgacagaaaaagatatcaggctttcctggcaggcaaagaaagtccaacactataaatcaagacctctgttcataaaacagaagatgtctgactgtttgaaatcaattcttgtatatcattccagagagaagactaactccgaataccttaattatgcgttagcacaatttagacgaatactcacaaaattaagcagagaacccaagccctgctacagaagtcttccccctcaaaaaaaaaaaaaaaattaagatggagtctccctctgtcacccaggctggagtgcagtggttcaatctctccagggattacaggtctgcgcmactgcacccggctcatttttgtatttttagtagagatagggtttcactatgttggccaggctggtctccaacccctgacctcaggttatccacccgcctcagcctcccaaagtgctgggattacaggcataagccacygcgcccggcccttttaaagtaaatcttgattgatggacatgatgaagtccgtgaggtacaaatgcactgccttttacaaaagtaactggttccttggaggtgtccattgggaagatggcagtagttagagctgccactgaggaagacataataggcagctctcattccaaggcagctgagccacgaagaaggctggcctgagtggtcagtgtgcagtaaatccaaatctttaaatgcagttcatgcttcacccccgaccgaatgacaaatggctcccccgtcagagcaagctggcaggtgatgcaccactcctcccctcccctgccacccgtggtgggacaatctgtcagcagccactaattctcaggaatggatggggaagtgggggaagtcaggctgtgtttattgggcaaggagaaggggtctctgagcccaaagaccttcttgggaaatgcagctcctgcmctccacagcaaataatgctcaatgaccagtcagggagagcttgtctgggctctcttcaagctatggggagcatctagaaaatgccttgaaaccgtcagatggaaacatcctctcatcttcctccctcctggaagcaatgtgctccgccgctcttccaaacccttcctgtctctactggtacacctctccaaagccctctggatacctcccatgatatgcctttcccaggctccaggtcagcacaatgctctccccactctattccccaaatgcatacctgtctccatcgcagacaccttcacatgcctggctggcaggagctcagccctgcccatctgcctgtctttgttgtgcgaccaccttcagggtcctcccttgggctcagcagtgagctgacttgccatggagccaatggagcttaggtgtcaagatccttcacttgcacaagcccctttcaacctcctctcccccaacacacaattatgtattcatgatgtattttttttcttaaagaggacctccaaattatatctaagattcaggctctgtagaacctggctctttccggccaaaatatgatctttacagagctcaacatgccttgcacacactaggtgtttaataagagctgaaggatcaaagagaatggatcctgaccatgattacaattaattaagaaagtgattaacaggaaagggaagattggtgtttctctcaggcgagctttcctaattcttcctctaccatcaaactgaaaaaagccaatagtctcccctatctcaaatccaggatcctcggaagggtttgttaagtcacagccagctggaccccacctcgcaaggatgtggttcmataggtctagagcgggacttacaatctgcatttctaacaaattcctggtgatgttgccrctgctggtccgaggccctcactctgagaatcactttgagcccctgcgttatcartaggggccatattgcccccaagagggtgaaattgtatcttgaggtgggtgatgaaaaaagtttttattataaagcagatatatatatatacacacacacatatatatacagtacacaaacagggtgcagtatatccctggtgctaaaacttcacgggtagacaattagggggtaaaaatgtctagaaagactctttaggggggcaatcatgataaaacattgagaaacactgacctggcccaagtgcctacttggtgcttactccccagcagctgagccagaagccctcacctgcagagacctgcagcccacaccatctgatactgtggaagaagcattagactgggagtcacaaaacccaggttcaaatcctagctctgcagtaacttcaggccttcccagccacacccacttcagcttctgtactgaaagagacaaagttacaaccaaaactgccagggaaagaatgctgtgcgtgcttggaagagatacatgagggggttgtttatacaaataggagtgagcaatactccacagggcattgttgagtagcaaaagcaacacattaaaccatctcccaaggaggctgggcctgtcaacggccttgcttcgctgagcatggaaaagcacgtgtcaggcagagcaggattactcggcacaagagaggccaggctggggtgggaagaatggagagacagtgcctgccagtgacaggctggggcagggygwgaacaccagggaacatgcacaycgatcctgatttgagcaagtgttctcagaggcagctctataaattccttcaccacccctaagaattttgtactttgtcgcctgcctctaaacaatgcctttggggacagcagattctttgggggtagagccaaaagaggctgagtctactttaatgttatgctggctcaaaaacagactcacacatagtgggaaccaccagactcctgggttacaagtcttgtgtctctgttaactatgtgtccaatctcccaggccctaaactaggattctttaggaatgagtatgtaacaggaaagggaagatctgtgtttccctgaagcagctttcataattcttctaccatcaacctgaaaagaaccaatagtctcctctatctctaaaccagattcccatttcttccttagaaactatgtccagtcagccaccgaaccctataagttgatcccagtggatcaactcttccgctccggtttctctgagcacctaggaactggtccctgtgtctctcctggggggatccatttcttatccaggccccagctctgcctgtccagcccaggagccacccgaaatgctaaatctgtcttcttgctaaacaagttggattgtcataactgtatagccctggtctaagtgaggttggataacagaagtggtctaggaaaactgtgtcctggggaggaggtaaagtgataaataggatgtggtcacggtgtcctaggcagtagcccctcacaatgccagtggatgtcaggatcacgaatcagggaggtctgwttcggtagaagacatgagttggggaggtctgatttggtacaagagatccagaacttgtgtccagctggagtaaggagagtaaggtatagcagagacaggacaaagtaaattggacctcagagacagggcacggggcagagtctgattccaactgaaacgtaaggatccccacatccctcaacagtccctcagatggtgaggtttaggacacagtaaggaggggtggaaagagcatgggtttgggtatgtcttccctcatgaaaaccgtggagccagaagcagtagtgttacagtgatgtcatcccctgaggctcagtttcctygtaggtaaggtgggaatggaaatgackgctgcataggctgtgagatgattttgtgagatgtaagcgcccaacagatggtggtgatgacgatgttggaatcaggtgactctagcctcttcactgtcacgcttgctctcgtctgaacgtgcttccatgtctccatrttgctcttgtgtccacaagcaaaagcaataatccattgccatttaaccagcacaaaactgaatgaggctgtcaccttccttttctgaaacacatgcttcagacagcgcagtctacagtcacttgagggctgggagaagatgctgtacaatatttactcctgttgaaaattataatcaataagtccctgactgttttcatatgtgctgctactaagctaccactccctgaccttgagcagatagatttgggatccacgtgtagccctgttaaattttgtcttttcagatttagtctctccctctctcttctccccccaccacccccctctccccccaccaccccccttctcatcctttttgacacttttagatttgatatctcttctagcttcttgacatctgaaatgtggtgaactcatcctctatattatccaaatcaatgacaaaactcttgactaagacaaagccacgtcaaaacacaggaacccctacccccttggaagacacaccaggccattcattgatacttttggggtgcattgctcccattagtgacacaaccttaccattctcgcagccaatccatatttctcccatctttcctcatgggcatcactgagaaaccttagcaaatctgcttcccagacccttctgttctcctttcactccctcatttgatcagcctctgggtcctgctgactccaccttaaaatgcctcctgtgcaccctttcctctgcgtctctacaaccgcacgcctcacagggatttgtcatctcctcccagaacattgcagtgatttcctaacaggccccctcgcctatatacctagactctttctgggagggatttaaggtggctcagcctatgtatattcacatgtctccacctactcccaatgtgatcattacctagaggcctctcatacttttttttttttttttttaatrcctgaagtttttttgtttattcctttttgttttccagctctacccaccagtatttttttgttgatgacagatcttctcctaaaatgacaaagaatttagaaacattttccatgtatttttaacatctgcgtcagtgaacaaagaaatcatagttgatgatggggtggggagggagaaaagggaaacttaattagctttagtttttataagaacttccatcagcgctgaatgaactggaatatgacatctgattgggcctaatcacaaggaagagtacattaacttgccgtgaatatatttaccagtttttacaataccatttttaaatctctacagaagccaattttcttacaagaaaattaccctaccaagattttttttagaacaagcaaacccaaatttctttcttaccctaacccagttcatccagctctgacactgtggcctgaggacagacactgatgctatcttggagcctctgcctctccacccttcaggaatgttctgcaccctgaaggaggtaggaaaacttgaggatgcaaagaaaaaccagacatctgttatgtctcttgatgttagggagtgggagtgaaattccagctcacccactctcctggggaggctagaatttaatgggatgcttgagatgcgtgggccgagggtgaggctgcagccaaagatgcttgaggctggacctgaaggtgatttagtgaccagagggcaatgccagggagagagagccttgcacggagttagtgacactacagttcccagagtggggcaggaagaagcaggcacaccatgacatcttctcattttctttccttctctgccgttccccagatgccccctcaccaattcatcagccctttctttccttccacacaagctgctcagcactttggctctgctctggaaacatttccattcctgtgctgctacagaacccaccctccccaccagattggatgcacctggacagcaggattgtgacttagctgccatcccgagttttacctggcacacgcaggtgctaggtagtattccttcaaaacaaggaaaaggtggtgtcgcatccctacttagctcctaccgttgggttggtttgcaaattttgcattgaattccatgtaattttctcttttttttttttttgtttgtttttatgaaaacgtatcatttagcctgccttaactcttgctttgaggtcacaaatgtcaaagtggttaactccaagtcacctccaagaacattattcctattgggttaaggctccacccttttgagctctaattatctccttaatgtgtgagaactgggggaatatgttcccaaattagaaataagttctctaaaactaaggcttccaatgctgaagagaatgtacaaaatgagaaaggcatactcagtccttcacttacacagtcaaagagcaatttttagggcactcccatgtgccagacagcccaacaggctttagggaggcacaaggatgaagaggacatggttatcagcacccccaagcaactctcagcctgtagagctttcctaatcattcaacaggtatttgaggtgctgaaacattgtttaaaaaaaaaaaaaaaaagcccaggtgcaaacacttctatcagatgtgccatgcatcattgacaatagtatacacatattatttataatatgtataggtgctttataaatattaactcattttatctccataataactgagctatggacaataaatgattattatggacaatctcttaaccctcacaattcagacagtgttgctaatcccatgtcaaaaagggggaaactgaggtgcagaaaagttaactttcccagagtcacacagcctcttaagtggtagaaccaagattttatttgtcttcctggtgtaagagaacttggtgggttccttaaaccctgttcaggatctgtcactggatttgcctgttgtgcattcagaggctggagaaggagtggagggggcagagtccaaggtaggacactaagagtcagggagaggtgatttgtgaaaggctttaggggcagcgccagcctctggataacagggaccctggtggtaccaaggaatcattggcaggactctgggagatgaggacttggtctgcatggggcagcacctcgcatctgatactggcgcatatcagcaccctactggacacattcaaacaggcagcaccctgtgagtgtctcagcaccagcacatcaaccttccaattcaccaactcactccagggaatgtgaagggcagggttccactgggccgcaccacccagcccggggtggccccaaaggcagaggggatgtgagtgctgtctctgtgagcctaagtaggccctgcacctgccagagacagggcacagagcaagtgtctgagggcaagtcacctggacacagcagtggcagaaaccaaggagtaggcatgccaggcaggtctccagcagcctctgagtttccaggcacagggcccacaccagggtggactttttatatgtacatacacacccacacacccacacccccacccaaacacacacactgcaccagtcccgtttcctcagatggacatttttcagaagaaagccaatgacactagcaagtccatgacccatttcaagatatgacaggacatcattttccaagtggagaaaasaaaaattctcagaaagccctgtataccacagaaatccatacaccagtttcaagtctcatccaacagaccagccagagtgcagggccacagggcaccctggctggagtgaacaagctccctccaaaccccctcaagattctaggcccaccagcataaaagtcctcttgatggtggggtcattccaaccccatctggggttgtaacctctcagagcagaggaaaataaacaggctgttgtcaggcagcccagggcagaagtgatgacacctgctcattctgaatttatctttattatacattatggccacctgtggaccattcagaaaagatgctttttgagtctcaagcaagtgactctttaagccgaatcacaaagaaattcccattttggccagttctgtttctggacgtcaacacccccctctctgtatgaataaggggtcttccagatggccaggaacagcactcaacaggccaaaacaaagcagagggtggcttgagaactacactgctacattcagcctgaggcccagcatcgacctggccttctcccacttccaacaactcattttgtagctttttggttaagaacaaatttggatttcttctttttctcctcccagtaatctcaaatgtatcagaagaaaggaaatttctaccattattgtcagaaacaagacaagtaaaaggccatcctcaaatactagtgttctcttcaccagacagcagcacacgtggagagtagcagatctctaagcacgacccagtgtgtaactccaaatggccccattatcctatctcgaggagagctgcgcatgctgtaccctgttttacatggcctgccatgcttctggtagcaaagcagtaatctcctggttatgtagcactggggatgccaataacagccagataaagaatagaactcatgaggccagttattttcagtcaaaccaagctacaaaaaccacagtcatgcagaagctggaggaaccaccaaggcaaagagaatggaaattcccttatgctagacagcacaggtccccagttttctgggrcatctgaaacttgatgtgacagcactgggagaggccaacagtccacgaataggccaggacctaaggggaaaggctaccactctacagccggccatcagggtgctgggctacagcagggctggcaggagcagacggaggccacatgccaactccagcctctgctacatatggtcccagcccccctactcaccagccatgyggcctcaggcaagtgggataatccccgtgtctcagtttcctcatctttaaaaagtgggataataaaagattcatgtactttatagggttgttgtgaggatcaaatgatttaatatacaaaaaaatgttgacaacagggctcaacacaaagtgtgctcaacagctgctgttggtattggtggtggtggtgaatggtctgccagcttggtagggatgtctatgaagtgggacaaacatttcatgagtatgaagatagactgttcagatgatactcatctaatgccattggcagctcctctctttattgtaccaagatctgtttccttcacgtttcacccaacgtcaaccagcccttcccttctttggactaagtctcccttcaacacatcctcaaatgacacagtttccagtcccctcactcttagtcaccctccttggaacaagctcaagttgctaaacaactatctctaaagccagttcccacccgagccaacattccaaggccaaaaaccatcacctctatcatgagttgagtatcctgctttcattaggggactgcactgacgtggctgcaggttgctggtcagccctagggagccagtaccatacagccccgcgagctccctcctcacaagaggcggctgttgcctccttgtgccagagctcctgggctttggatagaggaattccactgcttgggtctcatccttactcaccaacttggaggaacttccttagagtggatggcagccgcccctccccactctgtctctgtggtgtgtgccccacctaggctgtgtttgggtgcctgtagtacctcttcctgttcttgtctcaaacacacacctgtggggctcctttcccagcaccgtgcttcacaacggggctctccttagcccaggaggggagaggctgtgcagaaaggagacttctatgacacccttggggcaagggtgttgttttgctccttccatagatctctgaagccacagctatgcaggagaacagaaatagaagccagccacacccagtcttctttggcatgggcacgttgaacgggctcagttctcctgccacgactgaaagggcaccctcccacagaaggcacatgaccactgttccaagacagtccagatcaggagagaggcctttgaccagggcaaagcaggtgctgatgagaaggcacagcaaaggtggcccaagccactctgcctattccctatccctcccctgttaactccactcacaattccaaacccagagccctagcttctgagatatccaggtaggcgacaagattttctttctccacatgatacagactgctgagaggctcccctaacaaagcaccagtattctccctgaagacacaggctcaaattatgctctattcaaagctggctgtgttcccaactcctaagccctgctggctccctctgccccccaccctgacgtgggggaagatgctacaggtgtgggggtgtgttagtccattctcacactgctaataaagacatatttgagaaatacccgagactaggtaatttatagaggaaacaagcttaactgactcacagttcagcatggcttgggaggcctcaggaaacttacaatcattgcagaggaggaagcaaacacatccttccgcaaatggtggcaacaaggagaaatgcccagcgaaggggtaggggaagctccttataaaaccatcagatctcgtgagaactcactgtcacaagaacaagctgggggaaaccackcccatgattcaatgatcttcacctggtccctcccaggacatgtggggattatgggaactacaattcaatatgagatttaggtggggacacaggcaaatcataggagtggggaaaccaggagaacagggaaataaaattggttttcacaatagctaaactttccctatcctcttgagagtatttctaagcaaaagagaaatatacttttctttttgctttctctaaaaaaagaaggaaagaaggaaggaagaaaaaaatggagggagaggaggagggaaggaaggaaggaaggaagcaaagaagaaaggaaggtcaaactgacttgatttagctcattattaaacatgcaaataagaaaattcctgttcttggaatgtgatcagtcatctgcataaggtcttgcgacatatctacgattgaattatttctttgaatcaaggattcccccggccacacacaaatcagtacttgccttactttggaaaacgaaaagagctcactaaagtggtccctcttataataaggtgagagtggcctctaggacaaatttcagcttgtacaattctggaatacagaaagggtagctggctagcgacctttttccatactccaccaggcactgtgtagrggctaagggaaagcttcccctttgccctctgaaagctcactgaaaactcacagaagacagattagtagaagaaaaggcatacgaatttattttaacatgtctagcactggaggatccatagagaacaattacccattaacccttcttcataggggaaggggagatgggggaaatgtggcaatttgagggatggtaaatgatttttagggggagacgagtggacttggggaacttacaatggccatggacraagtctgttgggacttcagagcagacaagggctggtaaatgattctctttgaaatactgaatgagcaccaaaacagaagacgatggtttgtgacaaaatactgtccaggtgtgttgacagacttcagtctttcttcctgtgatatgggttcagttgatgaaaactcagggaggagactagaggtaattgctttcttccttggtatttccagactttaggcagataagggatgaagagaacaacttcatccagagctttgggagagatgaagaattgagagatggggtagggccaagggtggggggtagggagtgaagatcagagagaccctgaggctcttcttatttcagcatgtcaaagcaccatattttggggtaacagttgctgagccccaacaactgccaccccatagtcaaattaagccgatcatccccaaagcaatattagtccagtccagttcctctcatgacaaatgacctgaacacaggattcagcgagtcttactcgctgtggtcattttggaggtagggagatcattaacccacatactttgataaaatacgaaacgcctttcctagctggttcttttcctctcctataggccgacccccctccatccctttattagtattgaactgaacaaattagttaatatgggaacatttggatgtatcaactttgctctgaaacaaaaatgtattcatccccaaactctatgctgggggctgagggagagtccttacgactgacatagtccccaacaaggttctcattagtcccagtttttttttgacaccttttcctccgcattcacatccttctgccctctccagcactgtgcaggaagaaccaaccaacctgaccttggtgaaagggctgtgggtttttcaacccttcattcctgctactttttttttttaattttttagtattcttctgtgcatcctttcttctctcctaggcttctcacccagcctctctgttgagtactacttgtagacagagctccctcattcacaacatcccaatgtatttgtcctgtatcaaagcaaaccttatacagtagctcttttaagaactgctaaaggaatgaaggaacaaaactgagccaaataaagcaaaatgaagaggatatgtatgcaggcaattgtgggaacatatcaccagaatcctctcttgttattgtacccaaatccacacattctcctcagtgttgtctgggaaatacatcaatccactgtgaatggtttagatagaatagaatccatcaatktcaccagcttsattcctcctcagatgatgagccactttctccactccacctccagggctggccccagtcttcctaaatgttcattaactcctattaggtattccgaaactctcaggttttctgagycagcatagaatggttggaaaagcaattgctgtagaatcaagaagactgaaattggaatactggagcaactacctactagccacaggcaggttactctctctgagtctcaggttccccatttgcaaaatgaagcaaagctatctactccaaggattgctgtgaagattaaaagaccacgtgctaacctaataggtgttcagtaaataaatatatttttctatttttccctgcaaaattcatttcccaaacacaatctttgttcttttttttaacatataatagccatactatggcttaccaactccccagtaagccaggactctctgtatacgcagtgttttgccacatcatttacatggatgaaattgtttcctatactcccaaatttaccctgcttggtggccaagaatcacttctgtccctattactagtgatatcatgtctgcatttggaaacagacaagtgttatacaaaattacataatmtgataggaatgctgtcaatggatatctattattatatttaccagtcaaaattttagttsttataactggtatcaccaattaaaaaattttataagaaaggggtttttgtaccattggatctattgaatcattaaaaaaaaagagtttagaaaaagaagaagctatttatatactatttcattccataagactttatccagttccactgttaataaaatgtacatgcgcagaattgtattgttttctccattactaaacatgtatttgctgagtaccttctgaatgccaacatggtgctaggtactgggcatagggtggaagacacaatagacaaggacacagctccctggtatgggaaacagatactttatgtcttcagttgtaaggtccactgttgttcctatttaatatctttgaatgtggaatatatcttacaatgctgtgggctagggcatggttgtgacattgataaaaagggctcttaactgccatcgcttcagttgacttgcttgcctttttgagtggcagtgcatggcttgagcttaatttccattcagaaggtttttgaaaagactaactcattatttgcacataaaaaggcacagagacagaggtgaggcataaatttgatattcatcattagagtaaccatcatcctatgttttcttacaaagtaacaaaaagtgttttatgaaatgtaatcacaatatatgaagctgtgctttactggtgcacatgcaagaggattgcccatcaggctctaagcaaagcaactaagagtaggagaaactgccaaaccctaaagtaggggaaagaaatctccaaacaacaagaggcactgtgaccaattcacataagactatcactaagacatcaggttttaacttgtaacttgcttttttccttgttagtggtatgttaaacaatggtatatcatgctatttgtgtatactggattcaatgaaatactataataaacaagtaagcaaaacataagatcataacacgtcctgaaaggacctctcagcaagagtgacacattgccaagtaatgcacattgttccacatggagttggtgaggataacagcacttccttccagaaatacttyagtatacaaagtgctgtcacgtgatgacgtctcatttcagcatctcaacaaccgcacctggaaggccttattattttgtatatttayggatgaagagactggatctcaaatagcttaagagacttccctaacataactcagctaatgcctggaagacccaaaactagaatccagggctcctgactctacatcctatgtttttcttctcggctacatgaaatggtacaaaatacgaattaaatgattatccatggtcttgtgtaattctggcatgtttccagctaagacttctcagctgttcattcaactcaaaggcatccttcagtcctcttccccattcttctctgtctcggggatctgcctggggagagagtgtggtgaaagcagagtaactgaatcctcactaaccccaaggccctaacgcaaggagatgcaggcaataaatcattccattgcatttaccattgcattgcatttaccattgcattgcatttacccatacgtggggctctccagggatggcatcagatgctgcaggaacatgaatgataaataccacatcccaagggttagggcccaggcaagttctcaggggagagctatacatatgactggtaaaacccactatgtccagaagacaagggcaccctgctggtttgcatgagcaaagctaaattggcgctgacaactggcaataggtattgagagtctttttaaaagttgatgtcacttaatctagtaatcccatttccaggaattcattcaaagagaattaatctgggatatagagaaaggtctatgaataagattgcatcacagtgtggtttacatttggaaaaaactgtggttgtaacttaagttacaacagtagagggttgttcaaatattataattctggtacaaccacacgttaggattctctcttgccaattattgatgtcgtgggggagtgttcaagacaaaacatwgagttataaaatcaggattctaaattatatatatacacacacatacacacaattaaactcaaacatacacatggagacacacacagcattttaaaacctagaaggaaatcacaaccataatacaatagttatctctgattatgggaatacaggtaattttggtgattttctctatgytttcttttttttctttttcttttttttttttgagacggagtctcaatctgttgccccaggctggagtgcaatggcatgatctcagctcactgcaacctccttctcccaggttcaagcgattctcctgcctcagcctccccagtagctgagactacaggcatgagccaccaagcctgactaatttttgtatttttagtagagatggggttttaccatgtttgccaggctggtctcgaactcctgacgtcaggtcatccacctgcctcggcctaccaaagtgttgttgggattacaggcatgagccactgcacctggctgtttttctctaagttttctacaatgttttattttgctttttaagacagaaagtccacgcaaaccagtcaggaatagatgtgaaaaatggggatggggcctttgaaccaggagcaatatgagaaggtgagaaggatggcctgggccggctgggtctgcgagactacctggaaaagccacgggaatcacagcccacagggtgacatctccagatccagcagtcttttaggaaggcagatggagtctcagacctgtcccacccatcttaaagtggcctggtcacagggtcagagcttcagcagacagaggcgccctgggataagttgccaaatatgggttgagcaacagtggcactggaayraggtaggaggcggggaaaggggatgraaggtaaaatcctgcccctgtcctcaaggtacttacagtcaatgtgaggaaggctgacagccataaaatgatgacctatgacaacgagggtcgttccacacacatcctccagaccccggcacaagacctccgcctttcatctccattatattgggcaaaacacaaagcatcaacgaaaaaaaaaaaaaagtaaaagtacatagaaaaggagacacagaggaatacagaaaagcaaaaacctccttcaaactggtggaygtttcatcccaaaggacgctcgacctttctcaggcatcctgccactgaagaagtcaattactcacggcccacagtccctaggttccgctcagcacagtctggaatcaagggttcatttaatggaagcttaacagattcagatttctctaatattccacatccccttctgccaagaagctgctttgaaagatgacactcccttgatgtgaatttgcagcctgccccattaacaaggcttcagtcagaaaacatttttaaatcaaccctgttccagacacttgctcccaaggacaaactagaagaaactctgcaccagctcaaaccttccaagcactttgatgatcagaaatgaagggaaatattagaacaaatcttattaatccaaatattctcaacaatcttcaaagcaaaccgttgctctgggctgcagaaagcagagctcatgcagagccggccctttctgtcctaactcctgttagccaagccagccccctaaaaacagacctcagaacagcagagggaaayattcagaatcaaaggtgatgggaggaaaaaggaagaggaaacaggtaaatgaaagaaggaggatgaggattggaaagctgactacttaaacttttagcacgtccctcaaataaaaggataaggtgttgtatgccacactgcctcaaagcaactccctcagttcacagttgtgcagctgagaattctggagaaaccccacggcagctggcatctatgtcctggctccactcacaaggggctgagaaccccaggactcctcaccatgcacatttctcttgggtgtggtgggaggagcatttccgtttccaaacctcggggccatttgctcttagatacacaaacatctccccagcctttgccaagttcacccagccagaaggccataatgcagaattagtagcatttcaatcatttccgtgacgagctggtgacaggctggaatatgatgagtgaagcaatcagatgttgttacaggaaagaggcatgagaagagaatgacaacagagtggtacagtaataagcatcatcgtaaaagcccccactggcatcaagtttatcatcgccagcataactaaaggagccagaacacctgtttgtaatggggattccagctcctccactttctagctgtgtggctgagcacgcttctcgccctttctaagtcttggctgagcatctgtggaaggtggatagcaatcgctacttcataagattgtttagtgattaaagtcaaacaatgtctataaggcatttgcaaagcattagcagtaccagtagtaccagtagtagtagaagtagtagtagtatttggtattataaggagtattttatattatttcaaataggattatgcactatttcattatacccttatctcatatagaagacatttttaatgctatttgattgaaagtagaccagagactcagaaaggttaaacctctttcctagtaagtataaaaagttaatgcaggccaggtgcagtggctcacgtctggaatcccaacactttgggaggccaaggcgggaggatcacctgaggtcaggagtttgagaccagcctggcaaacatggcaaaaccccatctccagtaaaaatacaaawattagccaggcatggtggtgcacacctgtaatcccagctacttcggaggctgaggcaggagaacagcctgaacccaggaggcagaggttgtggtgagccaagatggtgccacagcactccagcctggacgacagagtgacactccatctcaaaaaaagttaatgcagaaataaggctgcatatcggtttcctattgcttctgttaacaaattactacaaatttaattagttaaattgacactatcttacagttctggagtcaaaagtcctaaaattaaggtgtcaacagaactgtgtttcttctggagactctgaggacagaatccgtttcctcacctttttcagcttctagaggccacctacgttccttggcttgtggctccttcctatatctttaaagccagcagcatagcatcttccagtttctctctctgattctaagcctcttgcctctttcttataagaacccttgtgattacattgggcccattcaaagaaacaaggataatctccccctctcaagatccttaccttaatcacatctgcaaagtcccttttccatataaggtaacatattctaggttctggggattcagatgtggacaaatttggaggtggtcattattcagcctaccataaactggatcctgttctgcagaacatagctatttggagcaagaatgggagttttgtttgctttgctttaaactctttcatttctttactcagcaaataccatagagcagctactatgtgcagggcacattcataactcataacctcctcctctctggatataaccacatcagaatcgagcttcattagtgtgatataaaagaggtctttgcatatacacacacacatatatatatatatatatatatctcaaaatatcaccaaaacccatactttaaaaaacaaaaagggcctttggagatcatcagccaatccccttattctataaaggggcagaggagtaatacaactatcccagtgtcaaatagggagtttgtgagacataatgagggcctgaattagatctggaggaaaaaaagtaaatggaggtatttttgagaaaaatcagtgagctgaacggcaatagggtaggagaaatgtaggggtcaagggtgcctaaagttcatggcttggggatgtcactcacagagctggggacagatagaggaaagacacttttgagggaaaatatgtaktcagtgtgttctagaactcggatctcttcttagtgtcactgtgaaattttccattacttcatctcacttcctgttctctcataagcgcgaacacrgggctgtaatcatcgtctgaccaccacatgttagtgcactgtgtttcttgctgacacctggctaggctttgaggatgagtttccatcccaacatctaccaacatacaaggagcccaaggcaatgggattttctgcgcatctttgcttgaaccttaaaggtgctgccccattgtcttctggtaggcctcgtttctgggaagacgtctattgaattcttatctttgtcactgagtatgcagtttgactttttacctctagcttcttttttttttttttttttttttttggtcactggttttcagcaatttgattattctgtggcttggtgtagtttccctcatattttttgtgttttgagatcattgatcatcttggatctatgtatttagtgctttcatcaaaygtagatatttttccaccattattatttctttaagcatttcttctgtcccctttcttgtctcctttggaattttcaattacatatatatgaggcctcttaaaattgcccgacagctccctgatgttctgttaatttattttcagcctttattctctgtgtttcaaatggatggtttctgttgctgygaattcaagtccactaatcttttcttctgcaatgtgtaatctgttattcatcccacctaatgtatttcatatctcagacattgatttttgaatctctagaagttcagtttagacttcttrtatctcccatatttcttcttagcatgcttacattttcttctaccatcttgaataaatgaaatatagttataagaactgttttaatgttcttgtggactaattttaccatctataacaattctaggttggttttgattgattgatttttctcttcattatgggttgtattttcctgcttctttgcatgcctggtaatttttgactagataccggacattgtgaattttacctaattggtgctgggtattcctacattattttaaatgttcttcagctttgtcctggggtgcagttaaattacttggaaatagtttgacccttttgagacttgctttaaaactttgttagatgggaccagaacagcctttagtctagggcaaatttgccccttgaatccaaacactgtttatgttgttaatgatgacaaaatatccatgtcccacactattccttactaagtctcccttcaacaattgtgtttgagtagaactgttaactgcctcacctcactctcctgtgtattcacaaggcaaagatccccaaggttttgaccaatacccaatgttgttttggtgccagcttgcacagcaccagggctcttgcctctcakagagaattgtgccccctctctccactatgtggcacagcacattgagctcaacaacgttctatcagactgatgttgccataacactgcatatcttcacccaggaggggcgacagccctaagtctcttatgtggcaaaataaaatccaactttcagtgctaaaaaggccctgcttttctggagcgaaccccttcagaggtctcacaagcatttaaaagagaatttctagaccacaagtttcagtgtggagagctgcaggcttagagaattgcagggatgtttgaagccctgcccacagttccaggaaacaccctktgtatatgagctcctttcccacacaaatgtgagaaggaggctatgaccctggaaattgaacacagggcaacagaaaccctgccgaaactattcttgcattgacattagacacaaaaacacccatataagcttgatttgctgtcacagtcaaataaaacaataacatgtaagcatttcaaagagattccactgacattctcacttgtgattctgacaacaagcgtgtaagtaagaaaggcaggcgtcacagctcctaagtgacagacgaggaaatcagccttgcggaggttaaatgatctcaacaaggtcagacagctagttggtgcaaagtggggccctgaacccagatcttctgactcttggtcaagagctctattcattccgctgtgtctgctctcttactatatcagaaaagggaacagccaccaacttcctgtgttgaccctagaccaggacttcttgatsacagcacacttaacatttggggctggataattctttgttgtgagaggctgtcctgtgcattgaagggtgttgagcagtatccctggcctctacccactaatgccagtagaactccccttgccccctgttttgacaaccaaaactatctccaggtgttgccatgtttccaaatgccccaaggtgggggaaggtaacagcagagcaaacttacccctcagttgaaaaccactgccctaaatgatgcctgagaatgctgtccacgtgtttgagaaagcagtggtgattaagttagttctgtgaaaggagaaacaaaatcaaaagaggaacttgtgctgataccagtgagtctgggaccacgaaacttggccgtgagagacagaattgtgcagcaccagggagttatctaaaaagttctcttctgggccaccctctgaacttaaccttctgtgttctcgctccactccttcaggctcagtcagctctgcaaaacccaatccactttccaaggaaacatttctggaaggcaacacggaattagttaatgtgatgagaggcagaacagagcagttaagatgcaggctctgcacataccacaacgtggatgaatctcacttaatgttgggtgagaagagccaggcccaraagagcatctattgtgtgaatctactaactcgaagttcaagagcaggcaaaactaatctccggtgatggaagtctgaacagttacatctgctggtggtgttgcctggagacacgtttcagagaatagaaatgttctctgccttgatsktggtggtggytacggtggttgtaaacataatagacactcacaacactcacagagctatacacttaggattcgtcacctaaaaaaaaaaagaaagaaaaagaaaagaaaagaatgttgactctagaaccaaattgtctaagtttcatccctgaggatgactctggttaccttagagcattttgtgaaaagttaataaactacacagggtatacaggaagtgcacaataagtatttgcatcattataattaacagaactacacttcagccaagcgcagtggctcacgcctgtaatcccagaacttcaggaggccgaggcaggcagatcacgaggtcaggagatcgagaccatcctggctaatatggtgaaaccctttctctactaaaaatacaaaaaaaaattagccgagcgtggtggcaggtgcctgtagtcccagctactcgggaggccaaagcaggagaatggcgtgaacccgggaggcggagcttgcagtgagccgagattgtgccactgcactccagcctgggtgacacagagagactctgtctcaaaaaaaaaaaaaaagaaaaaaaagaactacacttctagccagtcaggcaaagccaaggattaagagagttactctgaatttctctgctgccccctctgcctcacctcccatgcattgaacacagagtgtatatgtaagtcctcccaccccaaccatcaagacaggcacatctgccatttttctctgtcttcttcagttccttccaggttctctctgccttgcttaggagctgcccctgtttgcagagctcttcatcaatrgactgaatatttacagaatagcgcagttttgattaaacagttcatttcactggagactggggtggtgtattgtgtctcctccggagttattcttggcatcagcagcccttgctcttagcatccgtttctttacattttaaggtggagcataagaagaactgcagtgaaacagatcagatggggggcaggtgggatttctctttacctttccccsgctatttcttggtggatttatcccgttatcttcgctgctatttgctccttgctatcttttattcttctcttttgaaactggccgagtcagaaggaaataaacaaatgcaagggtgygtagaaagagcattagatggtaggtccagaaacttggactctacatccagcatctagtgatgtgattgattgatatctgttttagcttttcggsacctcaggttttgggctgtttttttttttttttttttttaatctgttaattgaagtgattggtctagatttgtggtctttgaatgtgtgtcagccatggaaaccttcctacaaacagaatctcaagcagcaaatgttaaaacctaaaagcaattttgtttgggttgaaacaaggtgggcgggcagtcaggaacccacccttttaacttctgtgtcctctgccatctcctgtagcagcccccaaagtagttccacaagatccttggccttgggatgctagagcacaacgtctaaaccattcgatgtgcctatttagaaactcatttcctgctcttaaagcgctcagccctctcccctacacataaagccttgcctccatgaaagcagggaggactagccttcgaaaccccagcacacagaggtgagtgtgagcacagctcaacagtatacaagcccgctggaaagctgccccagacagaatttcctcagttgcatcctatggactatcagtcccagaaacgcttggccaaaaaaggaaatacggagggcgggggcagcttgcttcaaagtaattgaggttgagagccgctgtataccatctgccccttctagagattaaattcacagtagcttcttctctcgggccagcaggaagcctgattaatgccgcttaatacgacacttcccatatttatttggccacaaaactcctttttccccataactcctattaatatcacaggaaacagtttgagatcagaaaagccttcacaaaggcaatttttaaagactgagttataaggctcaaaataaatgaggaattctagaaaaggaagggaggagggagaaggacactggtttggggtctggagggctttaagatgagggcgaaacaaggaccacccatgattccaaagaatgtccggaacttgcttgctgtctgttggtgcctttctttcagctcattcctagagggcggacagaggcaggagttgctgtgttgctggccagtggctcctgaccataggaaggggactgtgggtgtgagaagtaaagcagagcaggcccctgcctctgttctccccttccgcctggtattggctcaccgtgacaaatctttccctaggaagggcagaaaatgaattatcctgttaaatcaattcagcagataacccacctctgtgcaggccttgtgctgggaccacacagatgcataagacacgtacagcttagagcctagtcatgaaatgggaaataaacagccccatcctcamggtctgaacaggggattggggagcacagagaagggccccaccccgaccagctgtcaagagaactatccatacattctaattcctccaaggttgagggctaaggtgtaggaagaggagagaggttccaagcagaaggaattgcagaagcaaaggcacagaggcatccgggacctgcgagcagctatggctggagccgcgtgtcgcaggatggagagcgtgtgaacagaggggactggaagcggatcctcccaggaagcagttgcaggcggtcatgctacagtgagttgctgatagtaggaggggaagaaagaggaagggggagtggaagatgactcagtggggggtgagccagtgcctggaagagaggaatgtgtgagcagaatgaggaagttagcaaaagctggttgaaggtaggaggtggaaagacaagttcagccctcaacaagttaagcaggttatataagaagtccaggcatggatgacgatgatcataatcatgatggggaggatgacaaagatgactaggaacgcyctgtcatctctctctctctctctctctctctctttccttcctggttgtgtgagtttgcagggagacgggaggttgtgaagaacaataaccagaagagagtttgcgtcttcatcagaaagcacctggggcaggtagagttggtgctagcttctccatccatccctgacaccccagccccattcatcattcagcagaagacaggctgggctggcccaacttggtcctgtacccccaccaccccagaaccccactggtccatagtgaggatccsttctctttgactctcctccttctctgtgactcgcctaagcctgatcctacaccttctctcccagccactgcctcagcttcctccacccccagcttgggacgagccacctccctggctgggtagcatgggacaagccatctccctgcagaggcagagaaccagtgacactacacgcaaaccaaggccatgctgcaaacagaacaccaaggcaccctcgtcttaggatgcattatattcggggtagatgytgaattctagtaacacattccctggggtgttttcaaatccagacacactggagccttgttccagcctcactgtgggcgaaggccccgggctcacctccagcctcaggctggctctggctgctgcccctgttccatcctggcaagcggaactgaacaggcccgactccacagcccccggtgctgccagctgcaagctctgctgactccaacctcaggcccctgcgtgcctgcttctaaatccacacgttcctgctccttcctgcccctgctgccctctcagaatgccacttctttctgccaagacctcaggcattgctatggcccagccccatctttattgatgtcggggctctgtccccttgcagagcccatcccaytgccacccacatctgggacagcaaaagacttctcagtttcctccagagttcagtttcttccaaaaagctcggcacatcttagctgccagtgtgaactgtgagctcccagagatgcccgtggcactttccaacattcgtcacttttgacacatctaaaatatcctagctcccagagctgcgtgagcaccagcccagatggaccggctgctggggaagcatcagtctctccagggcctctgtgaagccctggggcagtagggggatgtctgacaaagcttcctaactgaggagccccacttcctctcgctctgggcacccctgccaaatragcgggcacctctatgttccagcagccctcgctgcccagcttctgagctgcaagccagcttccttccacagaattctctgcaccttggcttccggtggctccaagcactttgccatctgccgagtcagttctgccagagatgaagcagctgatgtggggagttctctgtgggggccacctttcctctctcaggtcacctttactctcagaaggaaactgaccccctgacctattaaatagctgaaatcaagggccactaggggcccaagtcggtgaaggtgcaactgaaggcaagaaggtcagcatctagctagacagacacgtaagccaagaagacagacgaggtgagtggaccctttgactccacagtcagacagcaagagagctactcccagagttctctggggcacgaaggggctgcaggggtaggtgaacagcatccagagaaatagttatcatggaaagtgcaagcaggaaacaagctgggatttttttttttatttaaaattatttttcaggccaggcacagaggctcacgcctataatcccaacactttgggagcccgaggcaggaggatcacttgaggccaggagtttgagaccagcctgagcaacacagtgaggccctgtgtctatgataaataaataaataaataaattagctagtggagcagggctggtggcatgtgcctgcgatcccagctacttgagaagctgaggagggaggatcgcttgagcccaagaggtcaaggctgcagtgagctacgatcactacactccagcccaggcaacagagccagaacttgtctctaaaaatacaaagaaataaaagaaaagaaattcttttaaggaagtaaatactaacatggctcagaaattaaaagaatgtaaaatagaatagatttgcaaaatctcacccccatcccacgatgtccatatccattccctcctccccctttcccaccatgggtaaccacttatattcatctcatctgtatcgttccaacataaccttacgcagctgaaagccaacatggagttatttacttatgcccccacccttccacaaaagtatcacactttagatactgttctgcaccttactttggcaactcagcagtacattctagaaatcttttcaaatcagtacagagtgtttctttagtcaagctgcaaagtattccattgagggatatgtccccgttcagttatctagacactagatggacacttgggatgtttccagtattttacaattacagacaatcctgcaatgaatgaccttgcattaatttcatttcgtaagtgtgcagatatagccacagggtagagtcccatgcaggaaatgctgagtaaagagaaaatgcatttgtaactttcatagctgttgccaaatccctctccattggagttgcaccattttgcattcctgccagtgtctccatcaaggtgtgtggtcacactttttaatgtttaccaatctgatggttgagacttgtgtctcagtatatatttactttgtatttttcatcttaggagtgaggttgaggatcttttcatatgtcaaagggccattcatattcctttttctgtgaaacggctcctcatgtccttggttggcccattttttgttctgtgggttgctgtccttggtctccttgatttctaggcattctatagatatcggggatattcgccctttgtgttatgagttgcaattattttttctcactttattgttcattttttgcctctgcttatggtctttttttaatttagttggtcatacagaagttttttgtttgctttaatgtagtctaatttaacaatcttttacagcttctgaattttgaatcacagagggagattcttattcaaaaggttatcaaggaattagcccatattttttttctggtcattttatgattcctgttatttcatttaaaaattggatccatttggagtttttcctgatgtatgatgagaggtatggaccaaacttataacttttcatctttttccagatctcccaatactattttttaaagtccatctttaccccagcactttgagaaattagatttccactgcccagaacaacctggccaatttgagaagtcacttctatcaaatactgaatgcaaacatatgcatttgagtgttctgggtttctattctgcttctttatccaagctcctgtatacacagcttgaattactgaatctttacggtacgtgttagtatgaaataggacaaatcttcccccatagtcctttttagttcagagctcccctggccatttactggcaagctgagctctgtcactggggctctccttgctcactgtcatgttttattctcttctctcctacaaggaggccaatatatgcctgcaggcatccaaccagggaaagaggcaagcacagcccactccccaaacaaggcagaggcaggggtgcaaggccttctgggagagtcccagtaggccatgtctatgtacccctttgaggccggtgttctggggaaaggccaaataggagacctatgtcttcctggaggtttggactttgccctgaagattctcagcactgatcttctggtccatccaatctgtttaaatgagggtgatcccagataacctcaacataaagagttatcctgtctgatattctgtctcctcatgatctgttactgatcaggtgcagaagaacccttcaaggaggaagatgttacaatagcaatatcaatgcctacttctactaccaccaatgccaccagggccacctttattcattgagaacctgctatataccaggcattgtgggaggtactttacacgtttatctcattcacttacaaccccatgaggaaaccatctgtaaacgtgcccagaattgtggctcattagcggcagagccaagctttggatcccagcctggttccaaaactcatactcttcaccactgggcaacttcttctcagaatgatctgccaccctgggatgatgcaaattcccaggcctcccagacctactgaatcagctgctctgggaatggcacccaggagtctgcatctccagcacatgaatacatgagaaccactgctcacaaatgtaaaaagttaggtaatatatcagggaggctgtgaggatgagtgtttccttagcagtggtgtaagggcagaaccctggctggagtgttttgcagtcagactgatttcctcattagcagagagtgttaaccggtagcctagtttggctcctcgaggtgcctgattcagacagagcatcccacagctggagcaccctagctggtggaggcagggactcagccaagtaggctccagagctgccacctaagcccagtagatttctcttgcccagaacaacctggccaaatggaagatgggaggctgaaatcctcactccaaggaggggcctccttttcttggcacaaaggcaccgcrccaagctacacagctaaggcagtgtgctacctaaagcaggtgcacagaattcacagagaggtaccaaataggctggcaaagaccttggtggataagtacccacaaatatctggaaggaactatgttgggttgagacatgagaaggaagagatcttaggcaagtttggaaagggaaacaacacattgaatgccaacccctggactagayatttcatcaacttcgttcatcctcactaccacccacacaagacggtcttcctatttccaacttagaagaaggaagttgaggctcctactggttaagcaagcttcccaaggccatacagctaataagtgttaaacaatcaaacacagaactgactggctccaaagccagtgcccgccccactggccactccactaccctgcctctgccattgctccctatggcaacctggaaactgtsgggtacctgcccgtggtctgaagtgggcaggcagcagtcagctgggcctccagatatgggtggtgaagggaggatacaggtccaaaagaatatcttaggggaaatagtgcacatgcccagaaaacttttatagtctcagaacttagatgtgcggagaaatcgaattctggtcctggtttgcttttttagccagttgtgggccttggcagtcactgaacccctccttatttcttcatgaggaaattaacatgcctaggataggaaccgctgtgctgcagaccccagggtcaggcaagtctcaaagaagatgagagtcaccaagggcctcaggaaagctgaagggcacagggtgcatgctgcagccatgacctcaacctctgtgagtctagaggtgaccatattggccacacataagctcaccttccccctacatttcataatccttccctcccatcagggccagcctttgattaaaattcccaagattatctgaggagctggcggtaccacccaccaatggagttcatctggctgcctttacaccagccaccttatggctgggtgggcactttcctattcttcggccaacacaacactttccaaactgtgtgacagttgtttatttacttgcctctaccataagaccatgagctttttgaaagcatggtctgtcttattcactgttaggtatcacagtgtattcacaatccctgacacatagtaggtgcttaataaatgtgtggttgaatgaataaatgaattaatgaatgaatgaatgaatgaatgggatcagggtgggccttcagtctctaaaagcatacccaagagccagccctctcagccgcaggtccgcacatggggaagccctagggaggttcaaggactagatcaggcccattttctcatcaggcagcccccaaacctctgccccaaagagcacatccaacatgctttcagcccacactccccacccacggtttactgcctgtaatcccagctactcgggaggccgaggcaggagaatcgcttgaactcgagaggcagaggttgcagtgagccgagaccaccccattgcactccagcctgagtgacaagagcaaaactctgtctcaaaaaaaaaaaaaaaaagaataaccttgggctgtttggccaagttaatgcttaatgctttcctcatgctgcaagcgtttatctttgcccagattccagctccagggaggggaacattcctgcagaacagccaggcgttcccaggtcacctctgctctcactctcacttttctttttgcatgattaaatccggcctaaaaacacgtctcaggggcacatatctgtcactcataataatcctataaggtaggtactactgttagtcttattatatagttgagacacagagaggttaaataactagcccaaggtcacacagttaataagtagcagagctgggatttaagccaggcaatctggctccagagctcggtgcctttttttttctttgacagggtttggctctgtcacctgagctggagtgcagtggcacaatcactgctcactgcagtctcgacctcgctcaggtgatcctcccacctcaacctcccaagtagctgggactacaggcacgcaccaccatacccagctagagcccaagctcctaaccgcttctgctgtgcagtaacaagccacgctcagggcatgggcccaacttgagtttcttccatccacgggtccagactggaaaggaagcagcratcttctcttcttttctcactgagtataaggcacccaattcatcttctggcagctgacctggaggacggagtggccctgattttccttttacaggtacaatcactgccaatactaaagcagtgcctgtccctacctgccagggcacccaggatccttgtctccagcagtaacttcatgaggtaggtggctctgggctgagacaggacttgcatattcctagatcccttgactgtgatgtcgaaggtcctctgcccccacccctccttctattccttgtaagcttcacttggcaattgtgtagtttatgtctggtacaggaatgaaggataaggtcaaatgaagctcaaagccaggagctagatagtcatgatatatcaaataaagttttggaacaagaacacaatgggattaatttgccaatcaaaacagcgcttggcaacttgactgtaagccaagatctctcatggcaagagcagctgaagggcctgtgattgtccagctcctggggagcctccctggcctaaccgtggtcagatgccagcatcacagcccccttagctgggtaaggattctcctagtgctacctctgggagagaaagaaaaaaatctagtctgagaatgacaccagcagacagcagctctgccaggtgtttgaagggtgaaggtcatgggactctgtttttactaccctggtcaccccaattgtttcggggtattttccatagacaagaggatgccccagtcagctgtcttccgtgattcaagacccagtctactgtcttctgtgattcaagacctgtttcctcttgtgccgatcagaggccttatttggaggcatcggcctttatgtggcatggaatgtaagccctctgagctttaacagagataggaagagtcctagaacatggcagggaagagggtcggaacctctgtcctccagcacagtagaaggatgctggcttgaatgtcaggagagcccagagtttctacctggatgcatggtttggggcatgtcaggtggcctttctgggtcccagtttcttcaactgtgacataaggaaggtagactagatcatcactaccaataaaaggtccctggtccttggggagcagtggttggagtgggagaagggcatcgcccagctattttccaacacatcgtaaaagatatcgcacaggacaactgaatgttgacttggtttgcttacctgtggaattctatccacttggtgtggtaaaacggattctcgccagagaactggaagtgtagatgggtggtgttacctatatccttgattgataagagaaggaaaatgaatttttcctcaataagtacaggttgtttgaaatgcaggctgggtgcagcgacgctgcatggtctccaggcgccttgtgtttctaaccctcttgctggacaacttggcctccacagggtagtccccagggaacccttggccatctccggcctgaaggaatcagggaagaccttccggacatgccaagtctccctgagaccctgctccatgagggctggctccctccccgacctggtcttttggttcaaagtcagtcctggagttatgtctgccaattgaccccaacctccagaaaactcagaaacagcctgtcctctcaggcctgcaaaccaggagcagccaggcccagccctgacttatgcaagtaactaccacagaaggcctgctgtgcagcctatgcckctcaacctggatcaagggcaatgtggagaaaccacattattgcttgactrtagtgcagtattccaacaatcattttaaatgtgcactygtgtaaccatgatcaccatcaagatgtaggatatttccatctctctttagagattcccttttgccctttgctagttaatccccaccccattccctggacccaggaaatcactgatctgctctcaatcacaatagctttgcttttccagaacgtcctgtaaatggaatcacacagtttgtacccttttaaatctagcttctttcacttagctttatgcattttagatgtatccatgttctggcatgtgtcagcaattgttcctttttcctgctgagtagtattccattggatggatatgcgacaatttgtttatccatttaccagttgatagatatttgggttgtttcagatttggggttattatgaataaagctgccatgaacatttgaatatttatgtggacatatgtttccatttctcttgagtaaacgcttgaagtttactgggtcctatagtaagtgtacatttgcctttaaagaacttgtcaaacggttttccaaagaaagtattttttgttctcaccagcaatctatgaggagttctacccggttttgtcagtctttttaattttagccattctaaagggagagaagtgatattccgttgtgttttaaatttgcatttctcccaygactaatgatgttaagcacattttcttgtacacatgtgccctttgtgtatcttcttttaaggatatctgttcagttctctcaccctaccttgaacctacacagggtggaatgtgcctatgacctcggaaggactttagggaagcaagccccactttccccagagaggattccagtacaaacggaaagctcttctgaatggcatactctttcataaccagatttcttaaaagaaaaaaatcattctgattctagcctgaagtgcagtagaattcaagagaatttaagagaaaagtttagaaggaaaaaatttttggcaagaaaaaagactctacttacttttttccctgggatccacaaaagaagaagttgtggcctcaggctacagtagtatggagccaaaatggactcaaaaaaaaaaaaaaaaaaaaaaccccagaataaatcagacatgaaaataactttccttccatcccgtatctcattttcttatttgacaaaaaaatagtaaagagcaactacaacaacaaagaagaggtgaaacaagaatgcaaaaaatgatgggaagatggcaacctccaaaatgtaataaattaatttcagcagctttaaacctaaagctatttgtaaagaatagctagaaaagaaacccactcaagacaaacttaggaatttcttctgagttcaaaacaatatcttaatgacctgaaaaattaccacggctttacaaagcacctcattcactccttaggagtgaattataccttgggtaattgaggttcgacattatagtgaagtgatgctagggtgtcacaagaggtgaaggacaatacaaagtttagtaactattgtgcacattcagaaattgagacacagaattactttcaagaaaaaagkaaatgggagggtcaggtgtccaggtcagggcaaaattcaagatggtgggagtgggagaaacattcctcaccatggccttgggcagaatctgcttatctccagacaaagctcagcaacagctaggagctgaatctgtaaggtccagcagtgactaaattcccacacaaatgtttccatctttccatcgtgcaagaaattctgaagccaacattgcccagctacagatcattggcctgaccacagaagccagggacagagctgcggttacatttattacataggattgttccatcctgagcagagtacatggcctggagagttttcagggcaattatgaaatttcggtcttccagaggacccttgccaggtctaggaatattttcagcagtggatgtttacaaagcaaaagcccccccacacacacattagcaaattaaataatgcatgttgtatgaaaaaccttgtgaggggcatagcaatacccgaggcttctttcttatgcacttgtgtgcccagtaccagccaatacatggaaagggctcaacaaacactgaactgagcaacagcttctagcccaggcatcatgggcgggaggcagatcctgactccaatcaggcctcctatggtagaatccctggttctctcccatggaaggtgccccacctcaattgcctgcagtcacccatctgctgatgtccttacccaaaagaaaatgaaataatttcttcttgtatgaaatatcaggaaccctcaaacctaggagttaactaggaatagaaaaatcacttgctgtaagaaataatattagaaatgtaatggctggacccagcttctccttctaactaattttaaggattgttttgctgctctaggaacttactgtcatacagaggacaaccccaagcctccctagtccatcaaccccttttcctggatacaggggctgaatcccttgatggatttgatcacttacctcaatttaatattcctcctcctaaaaccacagtatcatccccagattcttatcactggtgtgactacctcttctgaagacatgagaaaagctccagtttcagaaggtatgcttggagaatgtgctgcttctagcttatccaatatggaaccaatttcttcactcatagctaaagcatatcctttcctcacagcttatcatagagtggccaggtttaaatgagtcaatacaaataagactgctggaaaagtgcctggcacagagaaagcattcaatatatatcagcttttaaaaatgctgaagatcaatttgaatatatatgtatatataaagagatataaataggatcacaygtaaggaactgattctacttttaggaaactacactaagaaaatactaatagattccgataaatatttatacataaagaacatcatcagagaattgtttgtaatagggcaaataaaaccttgaaacagcatacattttcaacaatagtggartaagtaaataaattacggcactttttccaagtatgttttgaagaatttttgatgctatgagaaaatgataatgataagtgaagaaggatttaaaaccatttatgtaacatgatctcaattatacacactgtaaataagaatctatggaacaaatatctccataagaaaacattatgaagatatactccaaatgttatttgtgtttttttctaaataataatattctttattttttcagcacttttcaaattatactgaaatatattttcagcatacatacaatgagcatcccttaattctacaaaaagcaaaataaaatatgaaacagttaaaagtctattgcaacactataatttgaaggggaaaaaaaaggctaaggacmtacagtaggccactgggcagacaaaggagatcattctgagcctgagtcctcagtatttggtgacccagtagagaggcaagagagggcataagctctaagctttccaccttgggcatagagatgaatgacggtgttatgaaccacaataggaaacgtaggaagaaaggaagaagaatgggttgggaggaaggaaaatacatttagtttggccttgctgagtctgtagtgcccaaagagtacccaggcaaagatgcccagtcgagagctggtgatgtgcaaagctaaaacttgtaggaagaaactgcagtaaaggtatgagggtgggcacagcagtgagtccttgaagccacgggcttcccttaggatgcccaagtgtcctaagtgttctaggaataagcgacagactctgatctcatggaggctcagacccctgggcttcagggctctattccttccacccctaaaygtgacctgaagtggcccctgcctccctcagtcctagaggctgctgctcaattacagtgaagaatctcttatagactcacggtgacttaaacgctatttggtgctgtggctgctatttcactgaagattacagggctctcagagttaaccacataaaacttgctgctatatatttgtaacctcctttttcaataacacatagggaaaccatcttgggtttcaggaccaaaaaagtgtgagtgcctggccaccaggaatgctataactgatcccgcttccctctttgatgtggccaaaaagaagctcagaaaaaaatctgtggcccatcttcagcagccttataagatcacatagtgtacatttttgggtgttaatattgacattcctatctttattgttttactgcccttattttctctttgtcccaagttcttcaactatgaatttttgccaactacttcaagttaaaaatgttcttccatgtcatgcccacccagtgattctgtttgtttctacctcttgaagttacacaaaataagtctagtctaccttctccacaacagcccttcaactctcatgtcatcctcccaatcttatttttataggcaccagagccccactttctttaacaattgctcgtggatatgagctcttaaagagtctttcctccatctagacttgactgatgctttatcttctctcgacctcttccctaaagcccctacgcagggcattcctccgctgcaacacagcaaccacttttaatagttgcttttcaagcttgcatcccccaccccaccatggggctggggactcctgaaaggagccacatgctgtctttgcctccaactagtacctagccagggggcctggggcataatacatgcttaataagtgtttgttgaggaagtgaataaatgaatgagcacatacctgtatacagtatacagcttcctcgctcatacacatgttaaagagagctaaagcctccgggaagggagaaaagagagggccctgttcagtccagttgtttgtggggctttccatctgacaactgttttccatggtctctcctgaacagcctcgaagcctcagccacctgggctggagcgtatctcacagctaaatccagagtaaatatacacaagacagaattggtcctatgaggacaactggggtgaatttccacagaaagaaaggatttcactgatcagaaatgtaagatgctagatgctccaattggtacttattctaacaacgctctcttctctaggttctaattacatgtcaggcattgttctgagctctttacaaatatcttatttaatcctcmtaacaacctcataagataggcactatttttatccccattttattttcatatgaccctcttaacatttgaggcagctatcctaaaatgaagaaaggtgtagtgtttcagtctctgaataaaagaaaatgagctacattaggtccaatgtataaatggctgaagattgagtgccagcctttgatccaagatctggatctggcaggacacctcaccgctcactaacatttattgagcacccaccattgtgcccagkgctaccctccatgagttcgctgacaggtggaggaagcacacacctggataaataaatcaccccgctgcagggcaagtgtattaggatcagggaggcagtacggtgctgagagcaagaaggagtaattatctctgactagatgagaaggcttcctggaggctgtgaagtctcagttccattttaatgaatggagcagcagagacagagcaggaggtgaggtgcaaaggtaccggcatccaaaagggcatttgggaactgttggtagcaggagaacgaaaagagaggaggaggtgggggatgagggatcatcactcaggtggtggccttggctgcaataccatgaagctgaaagtcactaacaggtattgtcatttctgttttagactctttgagcagctgtgtgcaggaggacagagagaccaagcagagagagaccagttaggaggctgctgtaataaaccaagcaagacacagtgtgcacgggaactaaggcacaggattctagggatatttaggaaacctgaagctttggactgatcgagaagctggcatagcagtgcaaggtgacaccccggcttctgacttagacaggagggcagccagtgaaatcagcaggctaggttggaagcaggcttccaggagtgagggcaagctgagactctctataagctcagaaaagccaaagagagcggcagaaattttcttcattatctcagaaaagttattcaaattcttgctcacacctccttttaataaaatatgatgcatttcattctgtcttcatagtgaaaaatcattgccctttgctgagaattaataaccttttgagttaataccctttgggtaggaaaattggtttcattaacacctccccttgcactttgtaggttcatcatctcttggtcctgctgtcccctgaaaccaaaagcccaagacatattatttgagaagcctgaatgattttattctcagaaagaatgatcagggtccttattaawtgggctgaattgagttcactgaccaaaaaggtcagagcggccttgtgtctgctcctcagccgcaggggagcccaccttctaccagaaggaagggatgagagcttcctctcccagctcttggcctgatccctaatcttggcagaaaagatgcgcccatcttgacatgccacgccatggaaacgcgccaccttgccaggctctaccaggcctcttggcagaggtgtccgtctctggtscagcaccacagacaggacagctgtcgggctgcctggcagagttggatggccactcacccacccctccaaagtggctcatggtcatagtgaggctcccccagaagagaggctggaaggcccttcggtcaaacaacagaaggtgatatgttaaaaacaatcttcctctccttttccacctcccacggccttggaaagcctccgaatggacattcctctactcttttctgttgcaaactctttagcagcagcctggcatctggagcatgaagcccagactcttcagcatcccagggccctccatgctctggcctgcctggccttgtctcctgcctctttatgtatgcaaggttgcatgcctgtgagcctcgactcatgttgctccctcagccacccctgacccccgcaacaaaacacacacacacactcaatcatcctgcaaggccrgggtcaacatcacattccctgaaaagccctccctgaatgccacaccctccctcaagcggcatccactactccctctgtgattcccccaaccctgccccacactcacccctgtaccttgtccctgcaaggcttacctgatataatctgtctgcacgtgaggacaagttgagcctcaggagctaatacatagtgtcacccagctaagatgctctattcactgtctctctaggtagggatgtagggatgaaattggagacagcgacacctgggttcaaatcctgtctctatcagtttttggcagtgtgatttggggtgaggtgcttatccaccgagcctccaaaactgccttgcctatattccttatgacctagagggtgactctagtgcttgattggctggtcactgggataacaggctagaggatctggtgatctcaacctcctaggccaccctccatcacttggccattccactggaaacagtctttggggctccccacagttgtggctcattctgatctccagcatctcccagtaacctctttggcttgtgcttgtagaagcagcctttgagaagacggagggcttcagatgaagcagatgccaggctaagcaccgtccccaatcttatattgcagagccatttggaagaagagctcaagctgttgaaacaaacaaaacgctgcatgagatgaagaccagattcctgctctttggagaaaccmatcagggctgtcagattcgaatcaatcatccggacacgttacaggagtgcggcttcaactcctccctgcctctggtgatgataatccacgggtggtcggtaggaaatgctgacatgccgtttttctctccgatttcacattttctttttttctttctagcgtgttcatgttcataaaaagatagggagctggtgataacaactccatgcataatgtttatgaagcacgttctaattttccaagtgcttccccacgcattagctcattgattatctcgattccatgagtaagcagcgtgagaaaatataattatctccatgtttcagatagaatgtggctcaaagaggycacacagcccattggggcccacaagggattgcagtccgtgcaggaagaagcctccttcctgaatctgcatgttacacacagggggacataggaagccagaagaatggactcccaatgaaatgttgtatcagcaaggtttaagttcagcagcaaataacagagactcaaattagcagtggttcaaagaaaacagaaatttgttttcatttcgcaaaatattccaaagatatatgtaacccaaaaaccggctagacagctttggtcagtgargtcctccaggccccagctccttccagttcactgctctgccatcttggggtgtgaccctcatcctcatagtccaagatggcagctagaggactagccatcacatctttattccaggaagcacaatgtwgtaaaagatgtacacaaaggagtcaaaagcaaggtttttacaagagcttyattgagatataatttacaaagcgtacaamttatccatttcaagtttacacaattcaatggcttttggtataaaagagtgttttttaggtgtcccagagcctctgtgaaattctcccagttacatccattgaccatatctaagtggaaaggtggctgagaagtataggctgttaaagaaaatgtagccttttagtgatgctaaaaattctattactatggaagaaggagagaaaggatattattggcaatagatgaagtcaaaccatgtgagaacttgtctccargaggaaatcctgcctccccagtgtctagcccacccatgatttcaagcatagttcacaatttgaaccctccagagattttggtgtctacttcatgacttagaaacctttccctgccatctagttgaaaagtactcttgaaacccccatctatcctatcctggagaggaaaatgaacccttccatcacctgcctcccctcacctctccctgcctcccacatgacgttccagcaacatctaactgcttgtattaatagcttcctccacaccccatgcacctgccttctctcttcttggtcttggcttagtctgtgccctctgcctagagtgttctttctcctcctcttttcctgattaactcccacttttcctgtaagacacagtcccaaacaggtcctcctgcaagccrttgctgccttcatcccagcactcccacagggcrttcagtgtcaccgggagttcccgtgtggccctgagcactctccaccactgctctgcagctcggctttctaattgtctgtgtttctctgctctrctaggccgtaagcttctccctgggaaggattctgtcctattctcatctaatagactactgtgggccactatccattatgtaatcagtgctccaaaatgtttgttaactgaattaaagatcaaatgaatgagtcttgtttataaatgcaacatgaggaccacaggagcctcttaccaggatgcttttaccaaaatgcactcttcattatcaaaattctgtccaacctagtatatgtctcctcctcctattactgctaatattaataacaacaacaactgcagtaacraacatttgttgagtccttactatgttccagacactgctctaagygctttagatctattaacgtatttctccttcataacaatcctggaaggagagcattattaaccccattttccaggtgagaaaactgaagcacagagaaaaataacttgcccaaggttactcagctagaaactaggagagcctagatttgaacccaagatgcyccatgcacatagaaggcacttggtaaatatctagtaaaggaatgcatcttaccctggaatggcatgacaggccctcaggggagctctccagcttcacccgctattgtcaagccttcacctcctattgtctagccttcacctcaccaactttcctcctctcccctgacataccacactgccctttcatgattctgtgactctgcacgcactgttccttctgcctgggatgccctagacctcaccactaccacattcacctgcccacctgtattctttttgtttctttgttttgttttgttgcgatagggtctcactctatcgcccaggctggagggcagtgtgatctcagctcactgcagactcgacctcctaggctcaagccatcctcccacctcagactctggagtagctggggctagaggcatgcaccatcacacctggctaacttttgtattttttgtggagatggggtttcaccatgttccccaggctggtcttaaactcctaggctcaagcaatccccctgccttggcctcccaaagtgctaggagtacaagcatgagccaccgcgcccagcccccacccatattcgtcttactggactcctattgatcctttaaggcccagcacaagtgtctttgctctgtaaatccattaggagtgccctgcaaattggttctcaaacaaggcacacacacagaacaattctctgtaaacawtttttacctcctactatgtcaggctcacagtgcccatcccgctaagtccagcataacgcagtctgcagggcagagccagtgctatgggtttaggggtgaggtggggcagctgcacgcagaaggaggcgtacaaatggccctaagggacaggtcagcttccaggacctgatttacacatatttctccactgttttaaggtttagaaagtccctaagaggaaaaacattaagataattgttctcgggagggggcgggggggaacrtttggaaaaatctggagacatttttggttttcaaaacctggggcagtgggtgggtgttgctggcatctagttggtgaaggccaggaatgctgctaaacatcgtacaatgcccaagacagcccccacaacaaggaattctctggcccaaaatgtcaactgtgcatggctgagaaacgtcatagcaagcccttcctccagcattatccaggagctggagaaggaagaagggtgagcrgggagaaaggaaactagtgcgaccctccctctgtcccctcctcaggtggacggcrtgctagaaaactggatctggcagatggtggccgcgctgaagtctcagccggcccagccagtgaacgtggggctggtggactggatcaccctggcccacgaccactacaccatcgccgtccgcaacacccgccttgtgggcaaggaggtcgcggctcttctccggtggctggaggtaccgacctgccccatccttccttcacctcccttccctcctttcccttcctctgagagtgaatgaattaagctggtctccaacagcagcccaggcaggagaagcactaatgctcagctcacaggaatgagaaggcacaggactgacaccagaccccagggctctctcagacgcctcccttgaacccctgtttcacagaaccaccttcycccctctcctcatccrctattcctcttatgctcacccccttagacatgctaagggatacaaacacaccctgtaagctatcaagcccccacacaaatgagtgggatcacttctgtagggcattagtgtccaggggaagacaggcaggcaggaggctgcagctaccaggcgaggtcacaggtacctgagtcccaggagagtcagccagttgagagattagtttcagtttggagtgtgaataaggcacctcatttctgagcaggcacgaagaacagggtgggcgccacaacacactggaccgcaaaaggctttcatccaggcagctcttctcctgcccccatccygctgctgtcttccaggaatctgtkcaactctctcgaagccatgttcacctaattgggtacagcctgggtgcacacgtgtcaggatttgccggcagttccatcggtggaacgcacaagattgggagaatcacaggtaaccatgcctaataactcacacactgatctccactccataggggcatccaacaaggacctgcttttccaacaggctyatcattaaaacaccccaacacttattgtgagggatcagcgctcatgagaggacttgtgacattctttcaaacatgaccaatgtcatggattgctgttccagagaattcagagcaaattatagcctcaattcctattgcctgccctcaaacgaatacctcatgttggtgtgccaaatgggactaaaagatggayttttctagcaagaaagagtcttattttttaatctataatttacaaagtccaatttgggcgagttaaggagtgaagaatcacagccttaatttgctgtaattcatcagccacgttagtgcctccgtttccacatttgtgaaacgtgtatgttttagtctgggacccatttgggttgagggagggagctctgcatcmaaaacttcaccccaaactccatacacactcagaaatggcccaagatatccaggaaggtctgcacatgtgcgaggaaggccttcctcccaggcttccgtgacaccaaccccacccttcacactgccaggcattggatccaaaaacacacagctggtgagattgttccccagtccaagtctgaggcccactgataccacaggtataaaacccgggaggcacaggcaaggcctttctcggwgtggaagccccagagtgccccagcctctcctcctgctgatcccttcccatagctctaggcttcaacgacacaaggtttttctctacttcacaaacacaccatggcctcttgtgcctctgggcctttgcatgcactgtttgctttgcccaccactcagccactcaaactcctcctcatccttcaagacccagcaggctcaaacaatatttcacaggccaaaacaaagagcattttacatgaataacaaagttgttgcgaatttatattttatcaagtgaggacatttttttttcttttgagacggagtttcgctcttgttgcccaggctggtgtgcaatggcatgatgttaactcaccgcaacctctgcctcccgggttcaagcgattctcctgccttagcctcccgagtagctaagccacacccagctaatttttttgtatttttagtagatacggggtttcaccatattggtcaggctggtctcgaactcccaacctcaggtgatccaccatctcggcctcccaaagtgctgggattacagacgtgagccaccacggccggccatgaggacatttttacaaacaactactatctgctattaccattcctttataaaagaatttcttttaacttgagaaagaatggggataatggcagacgtttcaacagaatacacttgtgattatgacagctcatttcctcatgcttttttgttcatcttgctggtcactggggaagcctggtcacagacyggcgtgtggcccccatggatttaacccacaatagcctggggatgagcagccctcccactgaagaagcagggccagaggtcagagtccacacccagcgaggcagcctcaggcccaaggcccagaaccctctccatccaactggtgctgtgggtcacattaggcgtatcagctgggcccacccacctcagagacagcaggaaagctcaacaccctcttgccgtcttgtcatcagcctgataaagaaaggaacagaaatcatatcaggacatttttctttttctctttcttttttttttttttttttttgagacagagtctcattctgttgcccaggctacagggcagtggcatgatcttggctcactgcagcctccacctccctggttcaagtgattctcctgcctcagcttcccaagtagctgggactacaggtgtccaccaccacgcccggctaatttttgtatttttagtagaaacggggttttgtcatgttgcccaggttggtctcgaactcctgacctcaggtgatctgccagactcagcctcccaaagtgctgggattaccaggcgtgagccaccgcacccggccaaggacatttttcatttgtcactgtgggtagggctggagaacrggtgatctcacggctcactctcaattccttcgccccccaagtagggaaggaaaccagggctggggtgggacaccagagggtcctccagagaaggcagaggaagaaagacagggaaaaaaaacttggagcgcataaatactccccaaccacrgtcagccaggaggtgccaccttacttcatgcacagacatctgtcacttgaggcccagagctttgagctcccctacttgcacacaacattttcacatacagtgaaatgtcccgcggctgttctggacgttctaatgaaatgacatcttaggagaaaaatcagcttgtttagggaaattattgacaacatacaggcaaataaatttcattctttgataggtaggttggaactacttataatgagcatattggctttttttgtatgcaaacagatggtcttgaaagtagcttgagaggtactcaaaaytgatttgctcaagtaaatcaagcattccctcataaccttattcctttttttttttctttttgagacaggatctccctctgttgcctagactgggtcacagtggtgcagtcatgattcgctsctacctcaaactcctgggctcaagcaaccctcctgccacagcctcctgagtggctgaaactacaggcacaggccaccacatccacataayttttgtattcttttttattttagagatggggtttcactatgctgcccaggcctcctggcctcaggcatcataaccttgtgtctaccactggagagtttccgcaaacctctttccccrctagctaatgcccagcctgtgtgtcattgttagcaccatgarctactgtggttttactgagaaaaggttacggcgaggttttctagggaaggatcagccctacgtgtttcttcttcctgctagttcactgatgtataataatatccaaaagctaaaaagcacatctctcttcccctctccttgctccygcgtaacccttacccctgctttmccattagggctggatgccgcgggrcctttgtttgagggaagtgcccccagcaatcgtctttctccagatgatgccarttttgtggatgccattcatacctttacscgggagcacatgggcctgagcgtgggcatcaaacagcccataggacactatgacttctatcccaacgggggctccttccagcctggctgccacttcctagagctctacagacatattgcccagcacggcttcaatggtgagaatgaagtcatgggccgggagcaccggcctacatttcaatggggcctctggaattcagcggaatctascaacatacgggactcagggaagagttcagcaaggataggggcccagggtgtatggtcaccaagcccacccagagagaaggaatgctggagtgggcaagggtgcctgtcccccagcaggccactcctggcaacaggccaacgccacgccctgaggatgaacagagggcaccaacaggaaccyccacttctcacyccagccccatgtgcccaggcaaaccctctcccggggtaccagctcttctgagagttgagtccggatgcctgtggttattcttccttctctggaagtttcctcgttccagggaccgcctctattctgaaccacatraggatccacttaataggttgtggcttctcgatgaaggtctcactcttcatcccaccccatcagtttaattgaggaaattactcagactctcccaatgggaaattcagcttcaaatatgtccttgttatgccctttacctcagggcagacacggaatgtgctgttatctgggttgtgatcccacttctctctcaagtcctaaaaccgaaatattaacatgcacattgataatatgcacaggattaaagaacaaaaatgtcagcagaagcagcacattccacgggcattccaaatttcttgctattataaaatatcaccctgattaagacatgccaatcactccaagccaagtagagccctccacccctacaagccacctcaccctgatcatccaacactcagctgagaacacactctcttgtgatgacaccatcctcgcctctccaatatcagagtgaccttcacactccgcatcatctcattttggctggactcccagccttccaccgcccaggcctgagagagccttctgggaacttgcccttatcattgcttacatccctcccacctcccccactccaacacctcccctccagccaccagcagttcccagctgaccatccagccctcatcccaaacttcaccccacccaacaaagctcagtacagaccatcaggatggtgtatgggctttatttkcctggtaaacacatttctgaccaatyattaccatttgctcttttgtgctaaacttcaaagtgacrgaaccaaatgtaggtattcagcttgcccaagcttgggctggtttttctcagtcgtcttcacccctgtgtttgaaagggttcctggggtagttctcccagccacagctgcacaggggctcactggataactgcagattcaccttcactacctcctgggtggatgagcttgggtgagttagtggatgtcttggaagctcagttttctcgtcgaaaacagyggcctcaaggagctgcagtgaagatgcaggcagtggaggagcggagggcacgcagcatacacagcctcctagtaggtgcccaaggaatgcagccgctagcgtccaaggactgcagtgactaatcttggcatttagcctccagacaactggggaaatagcttttggcaaagtcacctgtgctgtccctttacagcaagtgtttcacatatcttgtggtggttcctcaacatcccttgagaattatttaccacagattaggttaaaatttggagagttaaaaaaaaaaaaaaaaggtcaaatccttagtagatcaacctcataagcttgttttgggggtgaggcctgtccagatctggttactgggcaatgtccttccaaatccaattcttgtgctggtttcacaggcctgttacctaagggatgcaatggctgctttgggacacaaggtagacattgtcgagaggcctcagcgttctccagaccatcagagtgccacgggattgtctcgtgtatctagttatattaagagaagaggagtcccacrcaagcctgttccagaaaacccaccctccaggcatcagcacctgggcattttaaattatctcatttgagatagaaatatttctataataaattacactaacctgctctcttaatgaatttgatctttccttagtgacttgggtgcctattaaaatgcctactgtaacacgctgtcataaaggagtgctctcaggatcccggcagtgcccrggattttgcctgacactacatgactcagagggtctacttcccttagtttcagtcagttgtcacatcctgctcttgtcaaggggtctgccttgacaagcccacccttgcctgttctgtgtgctactgctaacctcctgtgggmtgagaaccaaggtgatcctctgagttgaggctgctttgggttaaggggtgataacgtccttcttgccctgtgttccagccatcacccagaccataaaatgctcccacgagcgatcggtgcaccttttcatcgactycttgctgcacgccggcacgcagagcatggcctacccgtgtggtgacatgaacagcttcakccagggcctgtgcctgagctgcaagaagggccgctgcaacacgctgggctaccacgtccgccaggagccgcggagcaagagcaagaggctcttcctcgtaacgcgagcccagtcccccttcaaaggtgagtgtggagctggggagccttcagaagggcaggatgcagtcccctgtccaaagggctcagaagtccccttggcttctttcctggaggtgcttcagctctgctgttgcsgtgtttctgaaactgtgcaggctccagacagcaacgttgwcacagccyttctcctgtcccaagagtgtggccaccttgccgccaagggctaggaggagaaacctcgaccatttctgaaacgatccttgggttggcctctctgtccattttcatgctcccctagaatgttagatctgcaaggccacacgcagtttacctgggccacccggatctcactgtacagggacgtcaggcatctccaaacacatcctagaacccagttctttcatctctgttcacggcccccatgaaaaaactggattctagactgcatttcatttcttctaagatttgaatcagctgatctgataggacatgatattcaccctgaggcactcccaagacaagattcagcttccagtgtttcccagccagatttttaaccacagggcagaaagtgggcccagcagctctctggattgaatggaagattgtagaaagggctgtgaccacgtcttaggctgaggccagcagagaaatactccactgaaacctaaatcctcctggagggaacaagccgacatctgttgccattaacatttctgcctaatccctaaaacagctcgggagtgctttagcatctcactgtttcatcgcacagcctctccagtgctgggagaagaaatctgatgtgctgtttgactattaccaggcagatatttgtatctggagaatgtaaacaggccgtcaccaccactttgcttttagggagcattttacacaaaacattcgatgcagccatcagctccttgtggttctcccaacagccaggcgaggatggcagggctggttattatcccattctaaagaggaggaaagcaaaactcgcgtggggtgcccacagctgtgcagctgtaaggagacctggaacagggccacctgactctcagtcgtgagttcaaactcccaggcagcttatttttgaggcacaggatttctctgtgtatcggaacttttgctctccagtcaggtttccctcccttgagtcaagcaggtctaggaatgacagaaatttcttgtgggtgcgcacrgcatctgaagagtagttggtgtgagggcaggatctttcgggccaaagggtccctccactggctgtcccttagggctggaggagatggcagcacgcaggtgagggaatttggaagtcctcctgcttcggggagctcctccgctgcaggctgccaattaaagactcatttgggtgaaccagctcctcttttaaatggcaatgccgcctggagtgattaagcctcttagataatcacatttcactggatctattttaatcatggaatgttcgcatcatgaggagcagttcaaccctgccgtttttcagatggggaaaccaaggcctaggcagggaaaattatttgtccagagacaaaaagctcttggcagacctggcatttagacctggggcctccaaagagtgagcagagtgatttttaaaaactcctaaacctgccgctggtctgtttatggggataagaggggtatggaagagaagggtgggggaattgctttctccttgaaatcacctgggaagaaaagaggtcatttttcatcttccagggctaaactgggcacttcatctgatttggcccagccctaggacatctactggggacttggagattgggaagggaagcatcaagagaaggaagaaggggaaacaagagcagtaggcatgaaccaggctgagcttctcccatttgccaacggccccactgcccgaccaccatrcactgctgatgtgaactcacaaggatccctttgttattaaggaagaccaaagaattgcattagggcatcattatctcacccaccagctaccaaaaccaacgtactcatccatccgtatattcttcaaacacagtcctaccctcagggggctcggtggagactaacccacgatgagttccttggagaccacatttgtgtctctttattaccgactacttatcttgctcctgggacatctagtgaggaggaggttaagggcaggactgactgaaactggtcaggaaccgaaagccccaggctggagggaggttccagtgccgagctgtggcttgtaccacaccctctccttttctttcttactttttttttttttttttttttttttgagaccaagtctcactctgtcgcccaggctggagtgcagtggcgtgatcttggctcactgcaacctccacctgcagggttcaagtgattctcctgcctcagcctcctaagtaggtgggattaccagcgtgcaccaccacgcccagctaatttttgtatttttagtagagacggggtttcgccaygttggccaggctggtctcgaactcctgacctcaagtgatccacccgcctctgcctcccaaagtgctggaattacaggtgtgagctactgtgcccagcccataccctctccttttctgctcccccacaaattctccccagttctcctgcagcccctccagtgagcaaagtcctcacccgctcaacccagtttcacttgctagtggaaagtaacgtctctgtggtcacatcaagccaccctgggcatggctggaaagtgcactcatgcgagactcgcctgtttgaagcagctgctcatgggatactgctatctatataatgttatgttatccaatgtggtagccacaaaccatatgtggctayttaaatccaaatctaagttactttaaattaaatggaaccaaaaattcagtttgtcagttacacaagccacctttcaagtgctcaaatacgtggctgctgcatcagagaacacagaaataaaacatttccatcgccgcggagagttctactggtgatgctgggatgaagattttaatctaggccaccacagctacaccactccctgcccatcacaaccgtgatcataactgacttgggcccccaaagcctattccaccagccacctccagcattttgatgaatacatattacactcttaaaagagcagacttgcccaaccccggcctacagagaaaccacaatccccatttttcaaaaacatctaattgtacaatgtattttagtgcagggtctggttgggcaagataaacatcgcctcctgattgtagtttcacaaaggatgactaacttggcctgaattcctctggctcccaagatatttcgacaaaaccatcaaaggatctattttctacaactgtacaccagaactcgggtaaacactgcgagagtacagcagtagcaagagagaattgggaaacagtcgccgagtgaaacgaggcaatttatcgcccacttycattctcactctctcacaaggaacctttaccagtttgggagcctgtttttaagggagggggagggaaacggatctgtacggagtaaatcctgtttcgccagtgcctcctctcatttcatcctcagagcagtcagatgaggtaaccgggtggagaggagggaaggggccctcggggggcactctgcccgggcactgggctggatgtgttgtacacgttagctcatttcccatttgatcctcacagcaacccccagacagggagagacacacgcacacacagagacacggtcagggcaaagtcacacaatttgtgagcaggaagcrtcgcattgaatcccagcctttgctccttttactgcacttggcctcggcgtaggaccaaggccctcgactgagtgcctctccctcctgcggcattccagctgcatgtcccgcctcctcctctctgccctccttccacactccctcttccatatctcctccactcttctcctgtcttccccgtgctgcccttccccctcccccgccccctcacccacggccctgcactccaggctccctgggtcgggggtgaggggcacttgcttctgctgctcgccgcagccatgagagcacccttccttgctggtcggcgagatgacgagccaagctgtgactcgggcagtcggtctgtttttggcttctctcagctacttctttggaaggtttccactgacttcagggagagttccagaagaagcagggggtgtcgtagacagcacaggcttggggttgggataaggagtgtcaagaatcttggccttgctgccaaccacttatgtgaccttgacctaatgacaaaacctatgtgggcaccaaggaagaggtgtgaatagacatggggatgaaccactagcacgggacctgcaggtgggtctcaaaacctgccccggtcagttcagtgtggaggaaggaagtagatgacacccgattaacaccttctggaaggcaggcattttttcatcgccatcttatcacatttttacagcgacactacaagaaagttcctaacctgcattcacagatgaggaaatcgagccccagaaaggctatgtggtctccagatcacaaggaagcaggcatcagagaggactcaaaccctgggctctgtctatccgttgagggcccttattccacccacagcacaaagagctggcaacaggacgccagtcagcacaacagtcctggccgcacacacacactcccccatctccaccgctcgcaggcagcaacagacccccacagaaggggcaggcattggccaggcacggtggctcacacctgaagtcccaacactctgggaggccaaggtgggaggatctcttgagcccaggcgttccaaaccagctcgggcaacaaagcaagacgccatctctacaaaagaattaaaaattagccaggtagagtggtgcatgtctgtagtcccagctacttgggagactgcaggagggttgcttgagcctagaaggtcaaggctgcagtgagacatgatggtgccactgcactctagcctgggtgacagagtgagaccctgtttcaaaaaaattcaatttaattttaaaaagaaaggggcaagcatccagtctcgtgacatcagggcatcacttaaatgggactgtactgttaaaccaaaatgtggccacgaaaataccgacacatacaggtgttacatacaaaggctaacaaaatcactttccctttttcttcytcactcgcgcctgctctgagttaattcactttcattcagccttgccggcactggctgccttctttgggcagcaacaccctggacaacaccatcctgggcccctcaatcctatgatcttcagcttccctctgagttagaggcatttcgggtctaggaacaagccctctgggcttggagaaaacacaagaggtctcattcctaccatctccatgagagaaatccatacacggagggggaaaaaaaaaaagccctctttgatgtttgcaaagagagtcataatatctcccagagccaacatctaatgattcagaatcattgtttctgggaggcaaaaaatagaaagaaatatattctcttttcataaattcaataacctgatcttgtgaaaagaaaatgtaagttttttcttttttaaatggcaccagcagggtccacacagggttacaatccaggatttttcctagtgaggagactctccggaggcctcagatttctgctgtaaatggagtttccctgatcacattcgaggtcaatggactatttcatgcctttcatctttaagacctgaaataatttctcctgccagaacttgggagtatgttgtactggtctctttgcagtcacaggattaaaagcgttttccccaaatcattttttaacgtccttattaaacatgtcataaggtaaagtgggcaaaatcactcacacttttttccttaatctttgtaatagcatcattgtgctgggggtggcagggtagaatgataggcaaattgtcttttcttttcttcctttttttttttttaaagaaaaacacttacaaaaatccaaataagagtaaataattaggactgsgtgtggcggctcacacctgtaatcctaacactttgggaggccaakgcaggaggattgtgtgagcccaggattttgagaccagcctgagcaacatacagacctcatctctacaaaagaggaggaggaagaagaagaaggaggaggaggaggaactagttctcagcaggaaccagttctcagcctgaaagactcatttatatttaaagttaatttcatttaaagatttctccaaaaaagggcagtcatgcaagattctccgtgcagacatggagtttctcaggagtgctcctgcaaactcaagggtgcctcagccatcagcgcaggttccgtccccagcccgttccctggtgagcctcagaaagcatgctggcttggctcttcacagcccacacaccttggcacgttccatcctcctgcagagatgctactctagggacacatgttgtagaaataggcaattctcattcataggatgtgcaagctaaaggggcctttgcatcctctaaagctgactcctgggttttacacaagcactttctcctaaaatcgtggaaccatagcatctcaaatgcagaaatcaatctcctcctactcacaatttaagaaaaagggaagaaaaagtgtatcgccaagacaagggcatgaaacattttccccggctcaggggccagacgtttaggggacaggagagcgtcctttgtggcagcgatagcccaggatggatgtcaaggggtcagagctggcaggcagtttgtcttggtggcttcattagaagcaggtgttgaaccacagcttttcttcaggggctgttggccatttgctttcaagggacagactcagcttgcagaacgaaaacagcaggcgatatagaaagagtcttttggaattagacacacctggctttgaatcctgctccactgaactatctggataactataggtctccaaacctccacttccttatttatattcaccaggataattaacactgtgtcggtctaggtctcagcagaaaacaggactccactggcctggatcagctgaagaaagcaagtgggactccttacaacagggtgggcagtgttaaggaaaccaacaaggactgaggcgrctccctgcctctaacagcaggacagatggagccagggaagggactagctgtgggaaaaccagagccatggaggaggggctgctgataatcgtgggagggcagtggctgcacagtcaggctccagagcacgggggagcagagggaaaatgcccctgcctctctcttctccgccctgatctcctgctagtgcctctccctccagtggtcacacccaaccagaaaccaatcgacaagggagcccggcagatgcagcctaagggatcccatcctggggctcagagctgagcagtggagggcagagtggatgaggacagcaggggtagagggagcagatgggcactacccagcagggcatcattatttagcctgttatgaggagaaagatgatgtatgtaaaacacttagtatgtagcttaacacatagtaggatctcaacaaatgggagctattttatcatccttggtgtctttaatgcagttatatatgcatgttgttcttcactcagagagcctgtgaagtactccttggaggcctagtgtgtgctgtgcccttgtggagatacaagcagtagtgtggttccgagatggcctttggggagataagacatggacacagatgcccgtgagacaaggcagaggccacaaaggaccacaacttctagttctcttttttttccttttcaatacttgtaaaagctctttctttttccaataggattccaattagaatacacgtttactgcagaaaatgtgaaacttgcagaagaacataaagaagagaataaaaatgaccactctgccctctccagagataagcactgttaatatttttgtgaattcccctacttctatgcattctgttttgcagagttggtctcatactagacagtttcgtagcctgtgtttttttgtttttgttttctttttcacttctttcataagcattgaaatcattccaaaaatagcttttaatggcttcataagagtaaatcacatgtttgggacaatgaactgagaatcagcagactaacttctaattgcagcttcatcagttattagccacgtgacaacgacaagttacttaactttttctgagcctcagcttcttcctttgcaaaatgatgtgggagggaagataaagtaggcatcttataaagttgttgtaaagagaaatgagataattatatgaaactattagctcaatgtctgggacatagtgaagcgctaaatagtagttatcataattgctgttattagttcatagccatccctctattactgaatatttcaggtgttttcagtgtatttttacacaaatgttaggacattttttaactgaaatctctttccacaattcaactttttccttagaatatataaagctagtggtcctgggtataaacatgtaaaagttcaagttctggagtcaggttgtgtgagccgacgccccagccatataygacttactagctgtgtgatccgagaaaagtcacttaacttctctgtccttcagtttcctcttctctaaaatgagataataatcgtatcatttgtttgagggtcaagtgagatgacagaagcaaagcacttggcaaaaaccaaaatagatattagccaatgttattatcatgcatactgccattatatgctcttttttttttttttttttttttttgagacgtagtcttgctctgtcacccaggctggagcgcagtggcgcgatctcagctcactgtaagctccacctcctgggttcacrccattctcctgcctcagcctccccagcagctgagactacaggcacccaccaccacgccccgctaattttttgtatttttagtagagaacggggtttcaccgtgttagccaggatggtctcgatctgttgacctcgtgatccgcccccctcagcctcccaaagtgctgggattacaggcgtgagccaccgygcccggcctcattatatgcttttaattgcatttagcactgggctaaacacacagtagacttccaattaatacatatcatattaaactgaattgaagatcggttactatgagtgttccttgagaactctggaaggtaccctgactattcataaggaggttaacccaaggccagtcctcccacatcttaccccctcccccactttggaaagaactttctttttgtctcagtttgacttacaagactgttcatttgttacagagtttccttgacaaacccccaaatagtgtaagacctctccagaggcttctgggatgacaggctaagtccctctctccagtggtgccacccaagagtttagggacccttcccaggacttgcgcctatagctcttttctttttttttttttcttttttgagacagactcttgccctgtcaccaggctggagtgcagtggtgcaatctcagctcactgcaacctctgcctcctgggttcaagcaattctcctacctcagcctcccgagtagctgggactacaggcgcccaccaccacacccagctaatttttgtatttttagtagagacggggtttcaccatgttggccaggatggtctcaatctcttgaccttgtgatccacctgcctcggctcccaaagtgctgggattacaggtgcaagccaccgtgcccagccagctgttttcttacttctcacccacagcctcttttgctgtcttgagggcatcacattgctttattccaggcttgggatttgagcatctattgtattacagcaggggtccccaacccccgagctacagacagtgggcaattaggatccgggcctcacagccagaggcgagcagtgggcgagcaagcataaccgcctgagctccgcctgtcagagcagtggcaacataagatcctcatagcagcgcaaaccctattgtgaactgcacatgctagagatctaggttgcatgctccttatgagaatctaatgcctgatgatctgaggtggaacagtttcatcctgaagctatsccccctgcccccacactggtccatggaaaaactgtcttccatgaaacccatccctgatgcccaaaatgttggggactgctggtgtatagggtactgtagtaggcaccagatactacctgagctagctcttatctaaagcagaaaactcttggccaataaatcaactcttagtatttggctcttgttgtgaacataaataaacatttggtgcttcagagataacccctttagtaaacccaagagatatccccactcacatgagcaaattatatacaaaatccmaatgggaagattagtttatgccaaggataggattgtgtaatctagaaacttggcaatacaggcataccaggacactggagctggcagtaccctctgctgggcttgctgtatagctaccaacctccggtagaaatagtaccatttaggagttagtagattgattgatgaagagatgaatttccacatgctgggtacaaggratggatagtcaagtggctagttaccgtgatctaattttttgaaattctcctatgacaaagcttgaaactcaggtcttgaatcctcagaggtgatttccatgttgttagatgttaatgtgcattgtgatacgtcacccccaagcaaaccatcagttcattcatcccacaaaagtttattaagcacctactgtgtgcaaggcactgttaggattcgtggattaaccattgtctaaacaggaaaggcaaataygcagcaagtattccataaatcccttatccttttcccaaaccagacactcatcttgccmcaagccyggacatggcctcagaatccatctcaacagagggatccaggcagttcttatcaatcaaatggaattaacatgccgtattaaacctgtttgcaatcttggagctagaacactgtagatgcttagagaatatggagacaagagagctcaggaggtcaaggctgcagtaagccaaggtggcactgcacccaagcctcagtgacagagagagaccctgtctcataaaaaaaaaaaacaaaaaaaaaacccaaaacaaaaacaaaagccaatcctggtctggaagctggaccctgcatccaaccctggggaatccactggggagaatatggagacaagagaaagaagtccaagcagtaatcagccattttggaatgaggtaggataattttcaaaacagctccatagctgtgccaccatgcaagctaagcaaacaccatctagggtgagggaagctaagagcacagatgctgctatttgaccttaagcaagtcactttcatctatctgagctccagttttcttatttataaaatgggggtgatamtaacwatgcctacatcatagcgttgtgatgagtaaatgagatgatgcaatgcattcaacaatgcaaaaatgtattatcatttaacgatgccatgtatttaacaacgcctgtctaatagtaagccatttgctttcagtaactaaatgtagactgtattaggtaaagaagaataaaataaattatcctcttccaaccaacccatcagtaggaggacattccagacatgtgataaaacagaaagcttttaggcccaagttctagaactacagttatcttatttccattaggaaatacacttattgaaactcacagagcttgtttccaggaactgccccggaatataaacgcttggtcactagggcatatatttcttggctggagctctgccccaccctgaaacacaccccatcagagagcggcaataatgtaaaatggcaatgtgttctcccttgccttgtcaaatgcctaaaaggcatatattctttgatttacgaaaggagaccctcaccaaacacatgaaatattacagcagaacttgcatctagaactcagtgagaatgccagatgtcctatactcctattctgccatcttttgttggtgaatatttatcattattacattacaaacacaatataagtcctgaatagacatttaggaaatacagagaaggaaaaacaagaagataaaccaccatttaggagcaaaaaaatgttgttaacatattaatatctatccaaactcttccctctgcatgtttaaattttaagaaataagagatttttaaatttaaaatcactgcttaaattatcwctctctttctctctctgtctctctctctagtttatcattaccagttmaagatccagttcatcaaccaaactgagacrccaatacaaacaacttttaccatgtcactactcggaacaaaagagaaaatgcagaaaattcccatcactctgtgagtaggaggtgtagccccctagggtgaygacatttatttttcttgcagaacataaatggactctgtaattttcaagagtcaggccagctacaactactttattccagacgcaaaccaaaaactatctgagacacatgtcaatcaatttagtttattttgccaaggttaaagacattaycgtgacacagcctcaggaggtcctggtgacctgtatccaaggtggtcaggctacagcttggytttatacattataggaagatataagacatcaatcagtacttgtaagatgtacactggtttggtccagaaaggcaggagaactcaaagtggtttggggttggaggtgcaggggagcttccaagtcatgggtgcattcaaagattttctgattggcattggttgaatgagtttatctaaagatctagaatcaatagaagggagtgtctggattaagataaggggttgtggagaccaaggttcttattatgcagaagaagcctccaggtagcaggcttcagagacaattgattgtaaatgttwcttatcagacttaaaaaggtgccagacttagttcattctctcccagatcagtgaaaagacctggatagkgaagggaattctctacagaatgtagattttcccaccacaagacagctgttcagggccctttcaaaatatgtcaaagaaatatattttagggtaaaatagtttaatttctttcagggcctgctgtctgtcatgtgatgctatactagagtcaggctggaatttggtgtcttattgctacaaaaagtctgcttcatcagtcttaaaatctgggttttaatgttaatgctggtcagttgtgcctgaattccaaagggaggagagtataaagaggcgtgtcccacctccccttcccaccatggcttgaactttggaatgcccttggctgagaggaggggtccattcagatggttggagggcttagaattttatttttagtttacatgggcttgagcatttaagcaccaatcacatacagggcactgtgrtaggcgccagatactacctgagctagctcttacctacagcagaaaactcttggtccacaagacaactcttagtgtttggttctttttgtgaacataaataaatatttggtgcttcagaaacaacccctttagtaaacacagcccatcccacatggccatcctggtcagacaggacatccacccaagcccgaaccctcaggtccctcctcagcctctccagttcccaccaactgctcaatgttatgcactgtgggctgagcagacagggaagccagagatggccccaccacggcctgcagtgcagaggcaggtggtgaggggcggagcaggtgttcccaagaggtcccaagagcctttccagtgagttcgtaacccagaaattcaagtggtatcttttgacttggcacagatttccaatttcaatcagcctgctctgccagcctccccatctgtccttcaccctgttacccacctgctcactctgaggctccccagcctctctggcctctcaaccctcagcatggactctccctggaaagtgacactagcccctcacccactccagagatgatcctgagcttcccgaaaattgcccccagctttggatctctgatcatcacactgattcagtcattcagcaagcatttgttgatgctctgtccaacacctacctaaggatacagaggaccctagcctctggatgctcacaacctggcagggcggggggattcctaaacaattcttcacagcatactcgggaagagctatgccaagccacacaagggacccccccccaaccccaccatccatctgcctcgccctaaatccactgctgcctctgcactgccaaaaatctctcccaggggatggttctcaatagtggaaagggcatctcgctgctctgtcaacgttgggatattttagtgtcttggagattagtgagtaaagctgatcatgatacctcagagtctgcatttaaatcttgctctaaatyggtgcatcctttttatgtgtagtttttctattactgttatgcctcactgttttaacagaggtttctatttatatggggggaggagcattacttgggagagagtgcatgctgcaggcatactatgttaaacctacagagagctgaactgtccagacrccgttgccaaagccccactgtctccacagcggcttcttcctagaagctaagctagagaaagttaactagatttgttatagtgggacttctcggagcctttttgatgtgttagccagaaaatagtatagttttcgcaattttattatctggaaatcccttttttatcctggcacacctactgctaactctatcaatagtctgttgaacactagtttgggaaatgcagcaaaaatcccaagtcattcagggaaacacaacacatcctgaatgtgtgtgaccgtcactttgctgttacgactaaactgattgtgtctgattttctttgtgtattcaaggggcaaaggaattgctagtaataaaacgtattcctttcttatcaygctggatgtggatatcggcgagctgatcatgatcaagttcaagtgggaaaacagtgcagtgtgggccaatgtctgggacacggtccagaccatcatcccatggarcacagggccgcgccactcaggcctcgttctgaagacgatcagagtcaaagcaggagaaacccagcaaaggtgactgctgattcaatctcctattaaygtccattaagcacccacttgtgccaggcagtctcacaatttaatactcacattcatcatgtgaggtgagtattattaggcccyagtgatggagtacagaagctcagaaaggtgaagtgactatcccaactttacayagccacaggtgccaggacaaggattcacacccaggtctttgaatacacaccagggtctccccactgcccgtggctaacgctgcctgcctctggagcctgaggaccaccacactaaccccaggcttctcaagcttcagtgcaggtgaatcaccaggtgatgtcagtgctgccagtccaaggtgctgtggtagatgcaacatcttttttttattgtttgcccaaagtaaatcttttaacagatcacaatatcaaaaatctcaatgtatctctctctctctctctctctctctctctctgtggtcgtatctttcaaatgtcagttgccaaagaatcactgggaagccaaacacatttgcagaattcctggacctacccgcagattcatggtgggcttgggaaggggtccaggatgcctgttgttgaataagagccctaagaaactccaatgtagaacaatgggtcacccataagaaatgctgctgtgtttgatttaacatctcccgtggccccaaagtctccagggatacgaaggagctggggtggggagcaaagaaaaggaaggacagagctgggcgtggtggctcacacctgtaatcccagcactttgggaggcctttggcgggcggatcacctgaggtcaggagttcaagaccagcctggccgacatggtgaaatcccgtctctacaaaaatacaaaaattagctgggcgtggtggcgcacamtggtagtcccagctactcggggggctgaggcagaagaatcagttgaacccaggaggtggaggttgcagttagccragatcgcggcattgcactccagcctggatgacagagagagagactccgtctcaaaaaataataataataatagaaaagaaaaggaaggatgctccagcgctcctgaagtcctcccagcaraagaaagggctgcccagcacaccctgccatagcaaccgtgcttttcggtcatccgtggttctccacggcagaattccaggcatccccgggccctctcctctctcttcccttctctattcaggaaacggtctctcctctcccaccttcacttgtcgcgaaggccatgtttctctttggcttgtcctcagagaggtggaaaacagcaggtttctaacctctgaactaccctcttccstcaccccctgggtttcactgccaggtgccggcctgtggcagatgtatgcccctgagtccctttatacaaccgcactctgagattttatctccctgggatgcaaaatcctggcaattactgagagcatactctgccgtctgccaacagatctcccaacaggatcaatctgggaagattaaactgctcgctcctcttctgcactgagctcttctcacatgactctttggcccattggagcagcgctgcttctgagctctgaccctgcccagatgctcttagctggagagtaattcctcagtttaggtggctgctcaccctgacaatcccatgtggcttgacctgaaagggtggctaaagcacaacactaccttctccactggggcacacccatgtggtacggaagaagaaatgaggagagggaggggcctggcccttccagggctcccacacggggtgagcattgaagcaggtgctccatggcattggtctcacgtgatctttgctgtgatcctgaaatgggtagtattggctgtgcagattaggaacctgaggctcacagaagttacacagcttgaggacattgctcaaaattgtcccagtcyagatttgactgggatttgtctgatttattacccatttgttgggggtgtgctgtttccaacagttccttcttccattagttttggttccattaatctgaattttctcagtctawtctagcagagttgcagtgctggacattaacatatgtatgcatcaaacccatccttagggctgtaggaggtactgcatgcaggttatgggagctataattttttttaggttgtaaataccgagtgcctcctctgtgtctacacagtgccaggtactatcggagaatacaaaaaaaaaaaaaaaaatctgagttgtggctcttggtagaaataaactccaggacctaaccaggaaaataagatgaattaattttactaacggtgtggtccatcccagggcttctcaaactttcacgagcatacaaagcatctgggaatcatgttaaaatgcaggttctgctttagtgagtctggggtgagcctgatgttctgcatttctaacaagcgaccaggcaatgctgttgctgcaggtcaacagaccacactttgaatagtgagagtccagcattacacaacccgggaagtgtaagaagaaagttcagacccgtacacttggggctgtgctgcaacatgctttgaggaggccaagaggtgttcccagggagacaggcagccggcaaagcaatatggctggcaggatcggatggactccagtgtcagccagtcctaaactcacattttaacttcactgctcacaatctgtgtagcctcaaacaataacttcactcttcaagactcagttgtttagtgataaacgagaatcataatatacatttcatgagactaataacaactactaattttttagtgccttttgcagaccaaaatcccagaatcgggatgggaacattaaactctacactcgtaatatcgctgctaagtgcaagtgggaaaagaagtaggttaagtaacttgctctgtgcctccatggaagaaattcagtggaaggtggttttcttcccccaaaggcacaaaatcagggatgagtagggttgtggagatggtgaagagaaagagaagaaattaytggccctacagcaagaccaagtataataactggctaaacctaatgagaagacattcaatttccacagtactcatataaatgcaaaataaaatcaaagaaattatcactggttactcattagtttggcaggaattcaaaaacggacaacacccagagttagtaaagatgtggagaaacgggcattctcatacactattagtgagagtgtaaattacaggcattttgtaggggaatttcattcaacaactaacgtttagtgagtacctaccttatgccagacaatgttgtggacaccagatgtataatagtgaacagacaggctgggctaaaatacaaaaaaattagccgggcgtggtggcgcatgcctataatcccagctactcgggaggctgaggcaaaggaatcgcttgaacccaggaggcagaggttgcggtgagctgagatcacaccactgcactccagcctggcgacagagcgagactccgtctcaaaaaaaataaaaaatatatatatatatatgtatatatgtgtgtgtgtgtatatatatatgtatatgtgtgtgtgtgtgtgtatatatatatacatatatatatacatatatatgtatatgtgtatatatatatatatgtatatgtayatatatatatgtatatgtatatatatatatagtgaacagacagagtccttggtctcatgaagtttacattatcacatgtttaaatatgcatactactttgagccagaattttatttctaggtgtcttatcatctttctggagtatctgtgcacataatcaaaatatgcacaaaggctatatatgaatacatatgtacagaatgtttgttgcagtactattaaataaatactatacataataagtaaatagtaaactcttgagaaaatcttaatgtctaacagtaggaaaatgcattgtggttcatccttaaaatggaatgtcatgaagcaggtgaaaaatagtgaaatagacttctacctactgatatgagcaagtctctgagtaccattttctggtaacaggaaaaattgcaggaaaacatacacaacatgatgccactcaatatatgtaaatgcataggaacaagtctggaaatgcataaaccaaatcataaatgtagagaggggagtgatgttagtgaaggccgatggtgaagaggttctttattatttggcttcatttattcctttaccatttgaattttcaagaatgcattcacaaattactcatagcatttttaaattttaaaagtccagtttagtgaagacttgaccttagacgcaattcaaagaaaaaagaagtaataaactagaatttttctacagatatatctatagatatatatttaacagatgcaattggaaataataacacaaaatggtatctcgggccaagccaacagccaaagcagtctagttgttgtttccaaaacacatagtrgtgtcctctttagtggacaatgtcagctccaatatgaggaaggggcagggcttacagggctgagccaggcagaaaccgatgacactggcctcatgccaaggacctttaagaacagcatttacaaactggagcttgtccaaggagggaaggctgaggaggtaagcttgccttaggaggaagggttgaggaactagaaatgtttgccctgaagtcaaggcaaatgtggtcaaggaaacaatagtcaccctcaaatcttcgatgagctgtcataggggagaacaaaggagggctgccccaggactttccttcttacagaactgaaatcaccccagtgwagaactccaggaagtcttacactgatggctttcactgacttgggttttgtttttctctgaagttacaaaaatatttgcgaacataagaatctaacttaaaaaaagacatcacatgccttacacaaattgagtgaaatttgataaagaatgaaacacttcaataagctccacctaaaacttaatgctgtgtttgcttcctgttttctattcagaatgacattttgttcagaaaacacagatgacctactacttcgcccaacmcaggaaaaaatcttcgtgaaatgtgaaataaagtctaaaacatcaaagcgaaagatcagatgagatttaatgaagacccagtgtaaagaataaatgaatcttactccttatctggaatggctgcyttatttagaagccaaaattacataaagaatctcacacaaagcttaaataaagtttagatttaaggggggtatgtttcactctcataaactgagcttttaaaaacgatatgatataactattttccagtatcagtacaaccaaaaatgtcccaattttatctctggttaaatgttaatatatgcaaataagtacaaatgcaagagccattttagatctgttgttctaatttacaatgtcttttataattaagtttcccacatgtccttgctagtttattatgacccatttttgaaccatgctagaaagatacttttttattaggtaactagtgcttcaataaagcaagattctaattaatcaccactagttgtgtataccaaatacacatcctttaagacaatacagttcttaaaagaagaaaaattataattattctaatatttatacaaatcatataacgatttcacagaaccaaacacttacaagtagaattctactaaaactacttgtgataacagtgaaagctagacaygtggtcattttaataatggaattacaaattaaataaacataattattatatcttactaatgcttgcaacaaaagctaattttaaaaacttggaatgtctcaaagcatttgctatggactgaatgtttgagtcaccccaaaattcatatgctgaaatctaatccccaatgtgatggtgtttggaggtggggcctttgggaggtgaycaggtcatgagggtggagccctcataagtgggattagtgcccttataggggataaaggatcagaactctctgccatgtgcggatatgagaaggcaactatatgcaaaccaggaagttgaccctcacctggaagtagactaccagatctgctggcacctttatcttggacttctcagcttccagaactgtgagaaataaatgtttcttgtttaagccatccagactatggtaatttgctatagaagcctgaactaactgagagagttagatgtcaaatttcaaactgtccaataagtgaaataataatgttttgaccagcaaattccatcacaaagcacatggtgacaatggacgctaaatatggtaatcagttagatatgtgttttacataattcagagaggaggaacatgttatgcacattaaacaagctaacctaacttgcacttaggctcagctatatacagaccataattcatattctcttcaccaaagcggggtaaactggggctcatgaaaacaaaaatcctggaaagatgtctgcctctgactaatcaatttaaaattatcttgcatgattcacttttatttccctttgaaagacctagaaatctaaaacttatggggtggtgggataggaagaacagctggtcaatgtttccaaatgaagcattctgtcctgaatgctaatcttacctgcaaaagtatttgaccctacttttagggaatgtgtgtgagtgtgtgtctaaaattgatagataataaaatgaacatttcccattatgtctaaaatactaaggtttacaataaaatgtttgcattggattgccaggttttatcattaatgatccagaaggaatttagaatatcacttttgaaaaacaacagggaaacactctttgctgtatatgcaacagagtccatgcatatgtattccaggagacatgtatgtgagccttgaaatcatcgcagccagaaacagcccaaatgtctgccagtacgatgcagaaatgaactgggttatagtcttgctaatggactgtcgtacaaccgtaagaaagataagccaaagctacacacacaaaagaacagagctggggccagcgtgaggcagcgagacatctagggagcaacatttaaggaagcactcatgcatttttcgtttgcacaaagacacaaaaaaaggtatagtatgatacaaacaatggataaacacctgtaatcccagcactttgggaggctgaggcaggctgatcaattgaggtcaggagttcgagaccagcctggccaacatggtgaaacccggtctctactaaaaatacaaaaattagctgggcatggtggcgcatgcctgtaatcccagctacttgggaggctgaggcacaagaatcccttgaacccgggaggcagaggttgcagtgatctgagatcgcgacactgcactccagcctgggcaatagggtaagactccgtctcaaaaaaaaaaaaaaaaaaaaccaaaaggaaacaaaacaataaaatcattatcacaaaagtgaggctgtgataatcccaggaaagaggaagggcaccctggagttccaggtgccagcaatagtctacttcttattccaggtggtgggtacacacacgttcactgatttaaccgttctatatacatctacatttcacgcactttttagtatgaatgtcacctttcacaatgtgaaaattaaaaagggaaaataaagggcagagttaaacaaacatgtttctactatagtgtgatatgtttcaaaagtaatatagtttcacaagcaatataattagaaattatttcatctttagtaagaaaacttgaagtgccacaatacatggtaacattttgggcagagaattcaacaagcatccaacgtgacaagtggttaactggaacatttgaaactcctcttggcatgtccaaatctggttgccaattctgttgtcggtggattattttcacttggagggatgtgttcatcgacatcacattttcttaagtatattcgagtagggaagtcaaattgggaaactgaataatgcagtcacatctgttcgttgcacatgcaaaatgctggctcgtgaactgattatacacacctctctccaaagaatctgcatttatgagcccactcaggaaagataacactagcatcttgccttttaggcaaaagcttatttgtgcttctcttgtaagagagcactgggaaagaaatggaatgtcgattacactgcagctgggctctttgaggtgagtaagtcagagagagaaggaaacaagcactccattcaacattaaaatgaacgcactctgctgcatcgcaaagctccctgtcctcaatgttcaccttgagtcatgtcggccgcaaatactgcaaaagcttggattgcaatacacgtctgtggggcagcaaggcaaggggtaaagctgcccagtgctgtgcttgccctcccacagaggctggaccaaagtaaagtcagagggatgggaaatagacaagcaagatgaagactaaagaaagtcagtcccaaaagggaccatttacatggtcccataatacatacttctatttgaatcccaatgatccgtacatgattaatggctcccgacacatctcattccttcccttctcttatcccttcctccttttcttttctcccctggaattgctctgcctaacttagtcctatttatctacccaggcccagttattttcaccagttgcctcctagcctggccaggccacagagatctttctctcttctgagcgcctggcaatcacataagtgacgctctccgccatccacttggcctttagttatttgtgccccgctgattcccctccaacctcccagcctccctgctgctccctgccctccattcaaccattccaggggagcccagacctccttccctactcgcacgtttctctctttataggcaatctcacccactcctatggctttatttatgatcaaccacataggccaaccattctcagtgtagagctccagcctgggccttctctccagacccgtattcccatatattatgcaattgtccattccacagttcccgctgtgtcatctctccctgcatccaaaaatgaatgcatgatgtttcttgcccctggaacctgctcatccccattctctctgttgtttatctccttgaaggtcattaccacccacccagttgctggtggtggactctggggagtcatccattatgtgtcctcccctttggcccctcacaatccaatgatcaccatattccatgaattctactcttatttcttaagcgtgtctatgtctccccacctctactgccatcaacccagcccaagccgaactatcgcttacccagacatttgcaacaactttccaactcatccctcagacaccctcctccctctcaatcccttcccctcacagcgaccagagtgatcttaaaaaaaaaaaaaaaaaaaaaaagttatatcattttcctgcataaagccctcccaatgacctcccacgttttttggaaaaagtccaaaataattaccctggccttcaaggctcccagtcaagcccctacttttctccccagtcttgcctcccattactctctgtctgtcactcactaggccattgtccagctccacccacggagtgtccgcccagcctgcattttatttttaatttttatttatttatatatttattggagacaaagtctcactctgtcacccaggctggaatgcagtggtgcaatcacagtcattgcagccttgacctcctggggctcaaacaattctcccagctcatccttccgagtacctgggactacaagtgcacactgccacatccatctaattcctaaatgttttgtagagacaggggtctcactatgttgcccaggtttagcgtgcactttagaaatgcctgaggagctttaaaaactagccctgcctcagccccacacctagagattttttacttaattggactagggcagggcccggagattaagactgttgaaagctccccaggtgatcctaatatgcactaagtttgaaacccagaggtctagacaacaccagccacctcagttccttcaaaagcgcaaagctctctccttggccccttctgttgcttacactcccacctctcctccattgcatgcttgcagctccaagttaggtgttactgcttgggagatcatttaacaattatctcatcctacccgagcttcaagcagctcaccctgccatccatagtcaatgtttttttattctcctggtgaaatgatttgtggccatgccatgcagagccacattggagcctgaggcaaaaggaaaaatcagtaatagtgaacctgtstttatttatatatttattttttagatgggtctcactctgctacccagactggagtgcagtaacatgatcacagcccattgcagcctcaacctcctgagctcgagggatcctcccaccttagcctcccaagtagctaggactacaggtgcatgccaccaagcccagataatttttatattttctataaagacaagggttgcccaggctagtcttgaactcctgggttcaagcaatccaccctccttaccttcccaaagtgctgggattacaggagtgagccactgcacccagcctgatcttgctgtcacctaggctggagtgcagtggccaaatcagagctcactgcagcctcaacctcctggacacaagcaatcttccggcctcagccttccaagtcactgggattagatgtgagccaccatgacagcaaaatgtttatattttatgtatcatagatttttgcattcatttccattagaaaaatttttgcattaaaaattttcttgataactgagtttttggagcccccttacatttttgcactcaaggcaagtgcttcactagctttaccctagccgtaggcctgatctttgaaatggtttctttactgcctttctcccccactggccttgaagcttggtgaagtcagggagaggctctcattgttcactgcattattcccagtgctcagcctatcacctggtacagagttggcatcctgtaaatgcttgctgagttaataagtgacagttatctcttcttatctgtatttttttcctcttgattaaatcagaagcttcagctaccacacctgtccaagatagagttcactgcttcctcattcagcttagaaacaaagccaggttggcgaggcggttgacttcctccctccctcatctcttggccctgccggcctcctcts

SEQ ID NO: 17781 - DNA, 57181 bp, Homo sapiens
  misc_feature (1)...(57181): n = A,T,C or G, or insertion/deletion polymorphism (see Tables 1-2)
ctgtgcagtggctcttgtcccttccggggactctggaagctaagtccctcgactgctgccccaagagctattggctcctgtggggtatggagcatctgagccagggcaggtcccgtcccatgtaagtgtcattccctgacacctgagctgtcacctaggggaggaggggacagaagggacagctcctaggtggccgagagggcagctcttgatgctgtcctgccagagtgctgcgtcccaggctcctgttcccctgagcatgccagagctgggtgtgccctatcctgtcttgagagtccacatttccttgagcctaagaggaaggccgcctggtgagcaggtattgatcttcctattccccacccacccgccaggaggccttctttgatctcctgatgagatcagatccctcctctctaacctctgggcttttttttttttttttttttctgacagagtttcgctcttgttgcccaggctggagtgcagtgacacagtcccggctcactacaacctccaccccctgggttcaagtgattctcctgtctcagcttcctgagtagctgggattacaggtgtgcgccaccatgcctggctaattttgtatttttagtagacagggttttaccatgttggccaagctggtatcgaactcctgacctcaggtgatccacccacctcagcctcccaaagtgctgggattacagacatgagccaacgcgctcagcctgggctacttttttatgttactcatcataactgccattaaagcatgagttatagaaatatttttgttttgtcttatttttttgagacagagtctcactctgtcacccaggctgtagtgcagcggtgcaatcttggctcactgcaacctctgcctcctgggttcaagtgattgtcctgcctcaccctcccaagtagctgggattacaggtgcccaccagcatgcccagttaatttttgtatttttactagagatggggttttgccatattggccaggctgatctcgaactcccggcctcaagcaatccacccgcctcagcctcccaaagtgctgggattacaggtgtgagccactgtgcccggccagttatataaatctttattatagagccttgttccccacctcaaactccagtcccgggagagcaagcctcatctctgttgttcacagctgtattttcagttcccagctcagtgtgagtcacacagtgggcactcttcaaagacttgctaagtggagaatttctatgtccagtcattcctggatcacttcttcactccctcacgcagtcacaaagggagggctgcatgtggaatttagcattcaacaggctggaagaggtccactgtgaccccagggttaaggcagatgtgaggctgccagagaaccaggttggtgtcacagaagcacgtgaaaggtctcacccttgtcatgccttcgtcaccctggattccattccttgtgtaggagcttacaaggcctgtgactttgggcaagttgctcaacttctctctgcctcggtttctttagccataggatggggttagtaaatgttcatttcattgattctcgtctcacatttttttttcactctaatacttccaaaatcgagatgtctcttacatgtcttaatttaactggaagtggtattttccttggtgagagaataatagagagcaatttatccatagaattttttttaaagacagggtcttgctctgttgcccaggctagagtgcagtggcaccaacatggctcactgcagcctcaacctcctgtactcaattaatcctcccacctcagcctccccagtagctagctgggaccacaggcgcaccacaaccatgcctggctaattttttctttttttttccccccgaaatggattttgctcttgttgcccagactggaatgcaatggcttgatctgggctcactgcaacctctgcctcctgggtttaagcgattctcttgcctcagcctcccaagtagctgggattacaggtgcctgccaccatgcccggctaatttttgtatttttggtagagacagggtttcaccatgttggccaggctggtctccacctcctgacctcaggtgatctgtccacctcggcctcccaaagtgctgggattacaggcgtgaggcacctcacccggccccctggctaattttttaaagtattttgtagagcttgggtcttactatgtcgcccgggctggtttcgaactcctgggattaagcaatcctcccacctcagcctcccagagtggcgggattacaggcagaggccactgcacctggcctggcattagagggaatgaatatggtagtgcctgcttggtaccattcatggctgtgagcaccccgggaaaggataaggctgttcatttagcacagtgcctgtgacatggtgagcactgggcagatgaccaccgttatctgtgttaatctggtgttttcgtgcatgttattcattattatgcctcccgtgctttagggatcttggaggattttcatttttgtcatctctgtggatcctcaaagagccctgagaggttggcctaagagactttactcacccacctcgcagacgcgtgaagtggggctcagtgggtggagaagccacctggggcatccctctgccccggcctccccactttacttctctccttctgcccacccgccaggtcctggctctgtccagcggctccagaaaggccagtgcggtgggtgatgtggtcaakctggtgtccgtagacgtgcagcggctgaccgagagcgtcctctacctcaacgggctgtggctgcctctcgtctggatcgtggtctgcttcgtctatctctggcaggtatgccagaggaggaagaggggatttgaacggagtcccccaccccctccttctccccctcctccttccccctcccacccttcctcctcctgacttagcattcaagaggctggaagaggtccgctgtgaccccagggttagggcaagtctgaggctgtgggagaaccaggttggtgtcagagaggcacatgaaaggttttacccttgttctgccttcatcaccctggattccattcctggtgtagaagctcataaggcttcctcccctctccctctgccccagcctcctcctcctgccctcctcctcttgcacccctccctgcaccctccctcctcctgcatctctcccaccttctgcccacgcaccccctcctcttcctgcaccccttccttttcctccttccccctcctcctcctcttcctctctcctgctccaccttcttcttcctttctgctctctgtcatcttccctcccacttcttcccttctcccttcttctcctctaccgtcctccctctcttccctctgctcttccctctccttctcttccctttcttcttcctctcctcctttttctcctccccttccacccccatctcctccttctcctcctcctccaatcctgtctcaatttgcctactattgtctgatacgatgggaaaagtcctcaataaggatgaccttcacttgaccttgggcaggaagttcaccctctctgggcctcagtttcctctgtagaaagatgatgatgatgacgttgatacttccccatgtgctactagggtacccagtaggcaagttaaccatgttttgaagttaccagtaaccctgaggcaccaccatagccactgtccacaaaacacaagaggagaacattttagggggaaaaattgctacttagtgttcaaaaaacacaaagtagccatcaggaaacaaccaaacaaaacaaacaaaacatttactttccaacttcattcctttaacgttgtggtataggattttctttttttaaattaaaatcagactctgggccaggcacagtggctcatgcctataatctcagcaatttggggggtgaggtaggtggatcacttgaggccaggagttccagaccagcctggccaaccccgtctctactgaaagatacaaaaattagccgggcatagtggtgggtgcctataaccccatccactcaggaggctgaggcaggagaatcgcttgagccttggaggtggaagttgcagtgagctgagataatgccactgcactccagcctgggtgacagagtgagactctgtctccaacaaataaataaaagtaaaaataaaattagactctgtatcgggaactgcctaggctcaaatcctccttctgaccacttaccagttgtgaatctgtgtgcaaggaccctactctctctgtgcctcctgttcttgtctccaacgtgaggatcataattaacagtagcactcctgccccagaggggctgaggcattaaacaagcccatatgtagaaagcacttaaaagggtgccrggcacacaactgyaccctgtaggtatttgtaatattatcattagttacttttccataaaggataagacagtagatgctttttacactggaggccacaccatctctcctgcaaatattcatctctgcccttggagtgcagaagtggctgtagaccatactaagcaaacaggcatggtattcctccaataaaactctatttatggatgctgacatttgaagtgcatatcattttcatatgtcgtgaaatagtatccttttgattttttttttttttttgagacagagtctcactgtgttgcccaggctttggtgcaatggcacaacttcggctcactgcaacctccacctcccaggttcaagcaattatccagcctcagcctcctgagtagctgggattacaggcgtgcaccacgacatctggctaatttttgtatttttagtagaaactgggtttcaccatgttggctgggctggtcctgaactcctgacctcaggtgatctgcccacctcagcctcccaaagtgctgggattacgggcatgagccactgtgcctggccttgtaaaaactgttaatggcattttgattgtaattgctgaatattccaaaaaaaactcgaatgctcatgcatatgattgtttttgctagggctaggggccaggactttttccagtgtcttcaccttgtattccagggccttgcaaacaataggcaggtgcttagcaattacaacataaggcactcagacagggcttcatgtgcagtacataaatgtcatcattaggaagaaagagagggagagaggaagaacgtgggaaaattcagggcaattgatcaggttgaccccaccgttgctaaaaatcagatgagaccaggcggggcacggtggctcacgcctgtaatcccagcactttgggaggtgaaggccggcagaacacttgaggtcaggagttcaagaccagcctggccaacatggcaaaaccctgtctctactgaaaatataaaaattagccgggcatggtggcatgtgcctgtaatcccagctactagagaggctgaggcaggagaatcacttgaacccgggaggtggaggttgcagtgagctgagatcacatcactgcactgcagcctggacgacagagtgagactccttctaaaaaaaaaaaaaaaaaaaaaaaaaaattagatgagaccaacaagatatccatagataatgcaccatgttactttgcttgtgtacttttcctgcctcttggtagacagttcctaacatcaccgtgaggtcttggtgaaggaggagtggacactgaggttgctacagtttaatgataccatttttcccccagacagagatgttcatcttctgctcacattccttgagtgtttttccaagccctgctgtgggctggtgtttaccctctgcgcccttctccattgagccactaggtagcgccattgccgcataaatgaaacaaactggcccaatgttagaaaatagtgttcccaggccaggtggggtggctcaaacctgtaatatcagcactttgggaggctgaggtgggtggatcacttgaggccaggagttcgagaccagcctgggcaacgtggtgaaaccccatctctactaaaaatacaaaaattagccgagtgacacatgcctgtaatcccagctactcaggaggctgagacaggagaatcgcttgggaagcagaggttgcagtgagccaagatcatgagactgcactccagcctgggtcacagaacaagaatccatctcaaaataaacaaacaaataaataaataaataaacatagtgttcctaaggactgagacgggaaactgaggcacacagactggagttggggtggggcttgtcaagagaatgggtccaaataacctgtgcagaaatctcagaaagtcacagcaacttaaaaatcatttattctaccccccacttccacattttcyagatatagaaaccaaagctgagagggggaagataaccatcccaaaatcaccacgttggtgggggagcagggttgccagagaaaacacaggacattcagtgaagtgtgagtttcagacaaamggaagaatttctcagtgtatgtcccaaatatttcacgagacttagactaaaaccttattcactctttatcttcaaatgtaactgggcattctgtatgatgatttactaaatctgacaacccttgcgagggatgaaatgaagattaggaaaataattaaacgcaataagagaaaatgccaaatgagaacaactctattcccattttgcakacaagagaattgcacctaagggagatgacttgccccaaggccacactcaaaactctcagggtcaggatttgaaccaggtcccctgattccataggtctcaactttactgttgtggctgggaacaccccccagtcccactcgtgtgtgtgcacaatctgtcttgaatataactctctccctatcgtgtaagagggctgtttccctccctgacattgaaggaccccaccttcagcaggcatctcctgacacagcagaccccatgagcacagatccctgggacctggtggctgcccttatcagattccctgacatccccatcttaggacccaagtctgaccaccttcggggtctgcagctgtgttacagaaaaggggtcctgatccagatcccaaaagagggttcttggatctcgtgcaagaaagaatycagggcgagtccataaagtgaaagcaagtgtttgtttgtttgttttttgagacggagtctcactctgccacccaggctggagtgcagtggtgcgatcgtggctcactgtaagctccgcctcctgggttcaagctattctcctgcctcagcctctcgagtagctgggatcacaggtgcccaccaccacacctggctagtttttatatttttagtagagactgtgtttcactatgttggccaggctggtctcaaactcctgacctcaggtgatctgcccgcctccggcctcccaaagtgctggtattacaggcatgatccaccgtgcccggccaaaagcaagttttttagtaaagtaaagatctaaaagaatggctactccatagagagagcaacccagagggctgctggttgcccatttttatggttatttcttgatgatatgctaaacaaggggtggattattcatgcctttccttcttagaccatatagggtaacttcctgatgttgccatggcatttgtaaactgtcatggcrctggtggagtgtagcagtgaggatgacgggaggtcactctcgtagccatcttggttttggtgggatttggccrccttctttactgcaacctgttttatcaggaaggtctttgtgacctgtatcttgtgccgacctcctrtctcatcctgtgacttacaataccctaaccgtctgggaatgcagcccagtaggtctcagcctcattttacccagtccctattcaagatggagttgctctggttcacgtgcctctgagagctgggctcctcgggatctcctgacatcctgccccttctatccccagctcctrgggccctcygccctcactgccatcgctgtcttcctgagcctcctccctctgaatttcttcatctccaagaaaaggaaccaccatcaggtttggcttttgggaaagggacggaccaggcaggaagtagggaggaagccacaggtcctggtgtgggagatgsggaggggagagctgagtgcgagcccacgggtctggctttgttcttgtcgtctgtgagctgcccatcactcagacctgcaccccctccccctatcstctcaatggacagtggctccgtccctccaatgttcaggccacaggccctgggtcagttcaatgcctttttctctcacatcccatctgtcagcagatttgcttggcatcaccttcaaaatgcatccaaaatgtcacacttcccagcataggctctccaaaccccatgatctctaacccaggtcacagcagcaagcccctggctcactccccgcctctgccctcagcctctctccactcccagccagaggagacctatgcaaaccaaatacgttgtacccctcctctactcagacccacagcggccccattttcctcagactgagccaaagaccccacagtggcccaccaggcccgccctgagctggccttattgcttccaacctcaccttctacccatctcccctccttccctgcctttccccacacatctcccatcctcaaacctgcccgatctcacacatccctgcaggccttcgctttagctgttccctccacctggatcaccctcactcccgaagatcctctgtcacctccctgcagtcagggcggcttccctcaccaccctccagcaaggaaatggcacgtccatccctcccctcccagcagcagcctctcctttgcctgccctgggattgtttttgcttttttccccccacagcacttcccacaacatacagggtcctacaggaagcacccggcagggttgattgccttgttttccttaactggaagctttgcaacagcacaggccactgattgtggccaactcggcatctagttagtgcttggcaggcagaaggttctcagtaagtgtttgtgaactatggaagaaaggagggagggaagaaggaaaggaggagaggaagaagggaggggaaggagagaaaaggagggagggaaggaaagataggaaaggggaggaaggacagagggaaggagggaaggaaagaattgagggaggaagagaaggaatgagggagagaaggaagaaaggggggagggagggaaggaaatgaaagagggaagaaagcaaaggaaagaggaagaaaggagatagggaaggaaggaaagaaaaggcgggaaagagagagggagagatgggggatggagggaaggaacttatttcctctcttggcccagctgtcccagtgtccgtctgtcacctgggctgtttcttcagcctcctgcgtggactcctctaaaacattctaggctgggcacagtggctgacacctgtaatcccagcactttgggaggccacacctgtaatcccagcactttgggaggccgaggcaggcagatcacctgaggtcaggagttcaaaaccagcctggccaacatggcataaccctgcctccacaaaaaatayaaaatttagccgggcgtggtggcgggcgcctgtaatcccagctactcgggargctcaggcaggagaatcgcttgaacccaggaggcggaggttacagtgagccgagaccacaccactgcactccagcctgggcgacagaggaagactcrgtctcaaaaagtaaaaccttctccaggcagctgcccctctgatgatgcccccgccccatggtgaagcacaagagaccctgaattcttctgcctgactttaaagtgccaagtgaccctgcccacacggtcctctggtcacactgagtgtcctctgagtcatgctattccctgtgcctgggttttagstgcccccgccacccccctaccccccagcccccaccccccacccccatctcaagcccctcccctccctcttctccagctccatccccccatcctctgcctgctcagcacgcacttcctggtcatttaagatttagctcaggctgtaatcccagcattttaggaggctgagggcagaggatcacttgagcccaggagctcgaggccaacctgggcaacatagtgagaccccaactccacaaaaaatgtaaaaggtaaaaaaaaaaaaagacgtagctcaggcatyaaccacctccaggtagccttcctgatggtgtcatacccaggtgggctcaggctgcctctgttctccgggcatcagaggcttcctccgtggggcacattatcccaggggcactcctgcagaagtccaggtacaggatgatggtggttggaccaggagtgagggtcaraggtgctgagaggcagacaggtttgggacgcagtttggtgagatgaatgggatttgctgaagggtggctgtcagggtgcagggaagarttctcarctgtccctgtcttcatctctctttttccctccgatcccaggaggagcaaatgaggcagaaggactcacgggcacggctcaccagctctatcctcaggaactcgaagaccatcaagttccatggctgggagggagcctttctggacagartcctgggcatcyraggccaggagctgggcgccttgcggacctccggcctcctcttctctgtgtcgctggtgtccttccaagtgtctacatttctggtgacgtcactctagtctctatgctgagcagcactggggaaggagtgcgggggtgggggcagggtgaggtaggtggagccccccagatcctaccaccccgtccatcaaaacccactcattctggatcctgttctctctgggtccctgctgtcttctacaagaactaattaatcatattattctagcaaaggtggcagtggctgataaagtctgctgaactctcagagagagttccaggcttctaccgatgtggggaggagggtacagatgcaggggggtggcagaggtagaatcctgggtcagagtgacttccctgatcctggccagcagatgtccatagccaccctgtcactggacgtgatccttgtcctgccattctgtaatttatttcatattgctgtcagaacaaccttcctaaaccacagttttaaaaaatttgatacgtaggctgggtgtggtggctcatgcctgtcgtcccaatactttgggaggccgaggtgggtggatcacctgaggtcaggagttcaagaccagcctggccaacatggcgaaaccctgtctctactaaaaatacaaaaattagctggttgcagtggcgggcgcctgtaatcccagctacttgggagtctgaggcaggagaatcacttgaacccaggaggcagaggttgcagtgagccgagatcatgccactgtactccagcctgggcgacagagcaagacttcatctcaaaaaaaaaaaaaagcaccacaaatggcaccaacacctagagccctcaagtgctgctcctgcctgcaactttagagtcatcttccaagggactctagaatcacaagttccaccacgtctagaacaacagggctaccaagatcaaaaactctgctgtcccccgatgcctggaacctagaggcattaggttctcccctaggttctagtgatgcctagagccrtggggctgcgcactcatcaccattagcaatgcgctgtgtctttagagagagccttatgtagcttatgactgcggagaggacatgtgttagcaggactgggagtgggatctacggagggaagcacatgcggacatggcgggtgggccacatggaccgtgcaggcaccacagcttgcccaggctgccctatccatgcttgcgtgtctcactgttgccccacgtgtcccccccaccccccaggtcgcactggtggtgtttgctgtccacactctggtggccgagaatgctatgaatgcagagaaagcctytgtgactctcacagttctcaacatcctcaacaaggcccaggctttcctgcccttctccatccactccctcgtccaggtgaggtgggtgcaagggctggagccatcctgggagagtgcgtgggctacacctggctccagcttccctacccctgccatttgcagagragagggaagacagagtgggagggagagggatggtgtggagctggaaaagaggcggrtaggggcaagaacagaggygggcagagagtacagcaaatacatctggaaggggtcagcctttggagggcaatgtgcagacctttccacacacacctcagaacatgcatacttgtccatctgcccagcaattccacatacaagcaatcatgtcagttcccttttttatacaaagcgattttgtttctcttcctttgctatctctagtcctttcagcatggtgaaaacaagaaacggyggcatacctgagccatctccatgttttttattttttatttttatttatttatttatttgagatggagtctcactctgtcacccaggctggagtgcagtggtgcaatctcggctcactgcaagatctacctcgcagattcaagtgattctcctgccccagcctgccaagtagctgggaccacaggcatgcacaaccatgcccagctaatttttttttttttttttgtatttttagtagagatgagatttcaccatgttggccaggcaggtcttgaaccgctgacctcaggtgatctgcccaccttggcctcccaaagtgctgattacagacatgagccactgcacccagtcttatttatttatttattgtgtttttagtagagacagggtttcaccatgttggccaggccaggctggtcttgaacccccgacctcatgtaataagcccgcctcagcctcccaaagtgctaggattayaggcatgagccaccgcgcctrgccgccttatttatttatttatttatttatttatttatttwtttatatttattgagacagtgtctcactctgtcacccaggctggagtgcagtggcacgatctcagctcactgcatgctcaaactcctggactcaagtgatgcttctacctcccagcctcctgagtagctgggactacaggcatgggccaccacatccggctaatttttttaattttttgtagaaacaaagagtcttgctatgttccccaggtctccaactcctggcctcaagtgatcctcctgcacttggcttcccaaagtgctgggattaccggcatgagccgctgcacctggcctaatctctattttaacgactggtctctttcttccccaaagatgggtttgtgactgggagagagcgcccccaggtggacaacatttgaaattgttccacacaatggcttgataaccttattggaaaagccaccatcctcttcccagatcttgtctgcagaatggcagctggcttgcttcggtgtcactgatttgtaggatcgcagaggtgggagatcaccaccatcaaggtcaccactcgggttgcatcgtttcccatgaactagaaagctttgtcctcacgcytcctatgcacagagcttggtagacaggaagctkttgccacacatcttgagacaccgacacccaaaacctgagttctttgctcttcttgctgggtgacctgcggcttcggttttcctaggcccgggtgtcctttgaccgtctggtcaccttcctctgcctggaagaagttgaccctggtgycgtagactcaagttcctctggaagcggtgagtgctgagtctggcaggaggggtgtgggagggatgggggatgtgggggccaccccrgcccataatggcaagccagcatcagyactggrgggagatgggggctgcgggcaatggatgacacgtgcagatcacgccatctgcgtgtcacttggaaactggcaccgtgctgctcttctttctgctagccattcagcgaccactsactgagcgcccactttgtaccatcctgggtgtacaacagggaacactctaacacagtggtccccaagctttttggcaccagggactggttttgtggaagacagttttcccacggaccggggagaggcgcgtggttttgggatgattcaaacacattccatttattgtgccctttattattattacattgtactatataatgaaataattatacaactcaccataacgtagaaccagtgggagccctgagcttgctttccgtcaactagatggccccaaagcgggtgatgggagacagagatcatcaggcattagattcttataaggaacacgcaacccagattcctcacatgcacagttcacaagtgttcgtgctcctttgagaatctattgctgctgctgatttggcaggaggtggagctcaggcggtgatgggagtgatggggagtggctataaacacagatgacactctgctcacctgccctgcgctcacctcctgctgtatggcccagttcctaagaggctgcagactggtaccagtctgtggcctgggggttgaggactcctgctctaacagaccaggtccttgtcctcatgcagaaagtcccaggtaataagcatgacagcattttgatcaagctggaaaatagcagcatttcaagcaccattgcacgatgagacttaccaagctcaagttacctgggcttccccctccaccccatccttcttttatgccacgggccaagacaccctcccccttgttgcactgaagaacctgggcaaactgtgtacctggaaaacacccacatagtggtaagaagccgagcctgtggcattcaactgcccaggtccaaatcccagccccagcactgactagctgggtgatcctgacaagtagatcatctctctgagcttccgtgttcccatctccaaaatgggcatgttaatcgttatagcagctaattgtgacgatgaatttaattgatctgggctaagccatgagagctttgatttttagaaaatctttcaggcaattctaactacgtcttaaggatcaagaaccactaatctaattacacttgttatcacagtgaaataataataataattagtagtagtagcagtagtatttttgagacagtcttactccgtcatccaggctggagtgcagtggtgcaatcttggttcwctgcaacctccgcctcctgggttcaagcaattctcctgccttagcctctcaagtagctgtgattacaggcgcccaccaccacgcctggctaatttttgtattttttggtagaggcagggttttgccatgttggccaggctggtctcaaactcctgacctcaagtgatcctaccacctctgcttcctaaagtgctgggattacaggcatgagacactgtgccggccacagtgaaattaataacacccccttcactctgggaaggctgggatttgatgataatttatttcagaaattcactaaytttttccataaatgaccagattgtgcatattttaggcctgtgggccacacagtctctgtcacaactgctcaaagcatgaaatagagaaatgaatggatgtggccgtgttccaataaaactttatttataagaaaaggcagcaggcaggatttggtctctgggccacagtttgcctccccctggattatgtagccatgggacacrgacagaacaagaaccctgcggggtcacccasaagccagtgagtagcagggcaatttgttcagtgggagagatttcttcctgcagcctctgcccctgggggggcgggggatggtgcctgggggcctctccratgcaraggcyggccaggtcaggggtctcctgtaaatggcctcttgtgccctgcagctgccgggaaggattgcatcacsatacamagtgccaccttcgcctggtcccaggaaagccctccctgcctccacaggtacagaacgacacccgtagtaaccagcctcatgtttttagggagaagatgcatggggctcctgctgcctcccacctgagaggtggtgtaggtttccagcctgggactggagggtgggttwggctgggctggggctctgccggggaggttctcaggatacatctctacctcctgaaggtggggacctgcacagcatagaccagtatctcctgcagacggggaccagggcatctgagcctcccccattagggggagacacccctgtgctcccaggctggccaagacgatgccaagggagggctggctgagaggagccccaaggttcagccctatcagctgtgctcacttctgtgcctcctgtatcagtccraggtcatgatcatctatagtctccaactctatcgcttggtctttgtggccaaaaatctcagacagccctgaaactccctaagaagagaaggaatatgccccaggtagtatttgtattggttgtcattcactcacttcatcgatagagcactaggtatgggccacgctctgttctaggtattggggatagggcgaaggaaacagacaagggccctgctctcgtggggtgacatgctgatagaggtgaggcccaaacagaaaaccagagcaagggaacagagtacgatggcatgtctagcgagggaaggctttgcattcaagccgagatcataaggaaggagtgtctgggagaagagctgttcttttttttttttttttttttttttttttgaaacrgagtcttgctctatcacgcgggctggagtgcaatggcatgatctcggctcactgcaacctccaccttccggattcaagcaattctcctgcctcagcctcccgagtagctgggattacaggcgcatgctaccacacccagctaatttttgtatttttagtagagatgggttttaccatgttcgtcaggctggtctccaactcctgacctcaagtgatccacctgcctcagttcccaaaggactaggattacaggcatgagccaccgtgcccggcctgggagaagaaccttctaggcggtgggaatggcatcagcaaaggtcctggggcaggagagtgcctggacctgggtttctcaacctcagcanggttgatattttgggctgaaactcctttgttgggggctgtcgtgtgcattgtgggatgtttagctgaccccagtctctacccactagatgccagcagcaccccctactggttgtgacatccaaaaatatctctagatcttgccaaatgactcctgggggatgcagtcaccccctggtgagaaccactggccttttgtgttcaagaaacagcaaggaggtcagcaaggccagggccgagcagctgaggcacagagcggaaggaggcgggagatgtcattcctgatcgtcaggactttagctttgaccctgagtgaaatgggagtgctggcgggtttagctgggaagtgtcacgatctgacttgggttttaacagatccctctggtcactgggtggaggatgggctgtgggacgtggacaggagtggggcgggaccaagagtagcgggagggagggaggaaagagcctatttatcgcaagagccaaggcaggaggccaggctggtgaaaccctcaggctatagtcaaccctgtgtgtgtgtgcgtggtgtgcatgtgtgcacacatgtatgcgtgtgagcatggattgattgggtatgtgcatgcacttgtgtgtgtgtggatgcgtgcccacattgtgttgctgtgcatgctagcatgcttgtatgagtgtgcaaatgtgcatgcatgtgtgcacgctttgtgtgcatgtgtacatgcacaratgtgcacaggatagttcctcaaatagctagacaaggactgggaaaaagaacagccccacaggtcctcttggagactcccagagcaggaaagctcagctccgtctggggctcatccttcctcacagaggcgggctgaaccctaaccaaggtcatgtctcccctcttgcgtgtccagaataaacctcacggtgccccagggctgtctgctggctgttgtcggtccagygggggcagggaagtcctccctgcygtccgccctccttggggagctgtcaaaggtggaggggttcgtgagcatygaggtgaggccacccccagcctgtctgctaggatgtccccatcctgaaagtcccacttcctcgctgccttcccaccctccccatcccagccaagttcactttcactcattctctcyacctctcacccaccactgagagcccagctcccactgctcctcaaaacctatcccacctctgtccccatcatcctcctgtgaccaaagtaagttgtgttttagggtgctgtggcctacgtgccccaggaggcctgggtgcagaacacctctgtggtagagaatgtgtgcttcgggcaggagctggacccaccctggctggagaragtwctagaagcctgtgccctgcagccagatgtggacagcttccctgagggartccacacttcaattggggagcaggtgagagtttgggggtctttttgggacagggagacattgcagttgggagtcatttgggtccccgactcatcatgggcagtatgatggagaaatgagaggaatggttagggaagtagcggagaaaaagggctcagctcagcgtcaagcacgtgctaggtgctcaatacgtaatcactaattgataagcagaaatagacacaaagagagaggcagggagttgtggcagggattggcagtgaggagctctctgacaactgagagtgagaagacctagactcctgtcttactctgccctgccttgctgagtaatgttggtgtaattgcttcccctctctgggcctcaccaaggggtctggacagagatgtccaagaaacaggatatatgcatctggagctatggattgggcaggggttggcaaactgtgaccccaagccaaatccagcccaccacttgtggttttgttttttgttttgttttggagacagagtcttgctctgttgcacaggctggcatgcagtgatgcaatctcggctcactgcaacctccgcctcccacgttcaagcaattctcacacctcagcctcctgagtagctggaattacaggcacatgccaccatacctggctaatttttatatttttagtagagacagggtttcaccatgttggccaggctggtctcaaactccggacctcaggtgatctccccatttacctcagagacaaagcccaagtcatgacaatccctggcaaggtccctgtgacctggctctggtatccattagccccatctcccatcatcacctctcagctttactgcagccaccttagtctctgtgatattccctgatcccccacagcacactctggccccagggcctttgcactgctgttccctctgctggaaagctctccccaggagtcyccagggctcatccctcacttctatcaccttcacagagaggcctttcctgaccaccttatctaccaccacagccaccctactattgttagtgcaccctacacctgcacctgctttttctytttttcttttttttttttctgagacggagtctcgctctgttgcccaggctggagtgcagtggcacaatcttggctcactgtaacctccacctcctgagttcaagcattcctcccacctcagcctcatgagtagttcaagcaatcctcccacctcagcctcatgagtagctagaattacagccatgtaccaccacaactggctaatttttttttgtacttttagtagagatggggtttcaccatgttggccaggctggtcttgaacttctgacctcaagtgatccacccagctccgcctcccaaagtgctgggattacaggcgtgagcccctgaacctggctccccctgctttactatttattcttcatagcactttccacctgatgtgctgtctgccttacttgtttatggattgcctgtctctgtccccttcatgagaatgatggatccattaagagagcagcaactttgttttgctcattgctgtttctccagagcctagaaccatgcctggtttatgataacgaggcagtggttattagtggaatgactgaatgtaagaatgaatgaatggctgggtacggtggctcatgcctgtaatcccagcactttgggaagccaaggcgggagggttgcttgaggtcaggagtttgagaccagcctggccaacatggtgaagccccatctctactaaaaatacaaaaattagccaggcatggtggcgtacctgtaatcccagctacttgggaggctgaggcaggagaatcgcttgaacccagtaggcagaggttgcagtgagccgagatcaagccattgcactccagcctgggtgtcagagtggaactccatctcaaaaataaataaaaataagttttaaaagaatgaatgaaagacaagaaggcctagatagaaggaataagttaaagtaatcaatagtgcacaagggaaattatagttaatgatcatttacttgtatatttcaagatagctagaagagaaggatggttgtgttcscaatacaaaagataaatatttgaggtgatgactatctcagttaccctgatttgatcattacatattgtctacagcaggggtccccaacccccgggccatggatcagcaccagtctgtggcctgttaggaactgggcaggcagcacagcaggaggtgggcagagggcaggcgagtgaggtttcatctgtatttacagccattccttattgttcccatcaccgcctgagctccacctcctgtcagatcagtggcagcattagattctcataggagcacaaaccctactgtaaactgcacatgtgagggatcttatgagaatctaatgcctgatgatctgtcactgcctcccatcatccccagaagggactatctagtttcaggaaaacaagctcagggctcccactgatactgcatgatggtgagtcattatatattacaatgcaataataatacaagtaggccgggcgcagtggctcacgcctgtaatcccagcactttgggaggccaaggtgggyggatcacctgagggcaggagttcgagaccagcctggccaccatggtgaaaccccatctctactaaaaatacagaaactagccaggcgtggtagtgggtgcctgtaattccagctactcaggaggctgaggcaggagaattgcttgaacccaggaggcagaggttgcagtgagtcaagatcatgccattgcactcccagcctgggtgacaagagcaaaactccatctcaataataacaacgacaacagcagtaataataataatagaagtgcacaatcaacgtaatgtgcttgaatcgtcctgaaaccatcccccggrccatccccctgcccccaggtccatggaaaaatcgtcttctacaaaactggtccctggtgccaaaaaggctggggaccactgccctacaggtatccaaataccacttgtgcccctcgaatagttacaactattacatatcaatgaaaactaaaagaaaacaattaaaatttaaaataaaaaagtaggactgaaaagctgccactggatgagggaatagggaaatggatggtggtctcagtggagaaagggaaacaagagttggactcaaagagatagagagagtgagcaggaggagacagagtggattgggaagtgtaggtaactcctccaggaagcgtgcttgggaagtggagaagtgaggtcgggtaaggatggaggcattgttggcttgagagcgagtgccttggaagctgggcctgtccccagggaataggcatgttgagctgtacctcaccctgatgggcaggtgtgccctgacctgccacagcctgggcaccccagtttcaccctgtagatgctgactcaggccactgttccttttgtggccacagggcatgaatctctccggaggccagaagcagcggctgagcctggcccrggctgtatamagaaaggcagctgtgtacctgctggatgaccccctggcggccctggatgcccacgttggccagcatgtcttcaaccaggtcattgggcctggtggrctactccagggaacagtaagtttgggaacatgtgtcagacagtacagggcaaaggcagaggaagcacttagcatccagtcctaacccaagtttatctcacctcccccttccacttgagtccaatttcctctttgtattggtcagcttttgctgtgacaatgytatgtaacaaacaacccccagatcccagcagcttacaacagcaggtgtttcttccttatggatctgtgatttaactactacagctttgccttggatgattggccagggtcagatgtactccttgtcttcttgttttgagacacaggctaagggagtcccctctgtttctctatttggatatgctgtttacaagaaaggcggcaggagcacaagaaggggagctgtccccactctgagtccagggacaatacccccaccccaacccccagctcaggaggctggccaagcacatgtgtgtaacttttttctttttcttttttttttgagatggagtctcgctctgtctttcagtctggagggcagtggtgcgatctccgctcactggaagctccggctcccgggttcacgccattctcctgcctcagcctcccgagtagctgggactacaggtgcccgccaccacgcccagctaattttttgtatttttagtagagaaagggtttcaccatgttggccaggctggtctcgaactcctgacctcaggtgatccatctgcctcggcctcccaaagtgctgggattacaggcatgagccactgcgctcggccgtacattttttttttctttctttctctctctctctctttccttccttcctttgtttcttttcttttcttctttcttttcttctctttctttctttcctttcttgacagagtcttgctctgtcacccaggatggagtgctgtggtccaatctcrcctcactgcaagctccacctcccaggtttaagtgattctcttgccttagcctccaaagtagctgagactacaggtgtgcgccacctcacctagctaatttttgtatttttagtagagatagggcttagccgtgtcagccaggctggtctcgaacttctggcctcaagtgatccacatgctttggcttcccaaagtgttgggattacaggcatgagccactgcacccggccacatgtgtgtaacttctaccccttccctgcccagacacggattctcgtgacgcacgcactccacatcctgccccaggctgattggatcatagtgctggcaaatggggcyatcgcagagatgggttcctaccaggagcttctgcagaggaagggggccctcrtgtgtcttctggatcaagccagacagccaggagatagaggagaaggaggtactaggtgggctttgctgattctccaggcctggctcctgccacccttgggggaaaaggctcgaagggtcctactggcatgaatggagtgctctggccacaccctgtctgcaggcctaggcctggaagcagacagctctcttaataggtcacctttctccaagaatagccgataacatcatccatgagccaggggttgtgctaagtgcttctgtaaaaaatacactatttcatttgattctcacacatgccccagaggcatgtgaagttattgctgtcattttacagatgagcaaactgaggcaaagagagttaaatcacttgcccaaggtcacaagattagaacttgagtatgtccagctccagagtctatgcttgcagttgctatggagacagcccaagaargactttgatgcctagcaagctacaccgtgctagctagggtttctaataatccaaaaaaacagtgtgctggatacatggcaaggttctggaagtaaagttgccaagccaagctcactcacaatgactgaaaagtagcaactaacagcacatcacagaggttagctcatttaatcaacataatgcccctgtgaggctggtactagaatcatttccatttcacagatgaggaaactgaggcccagaagttaaggaactagtcccaggttacatggcttgtaagtggcagcactgggatttgaacccaagcaacttgattccagagaatgtgttttttaattgctaccctctacactatcccttcatgacaaagcaaggattcacatccaggtctccctcaatctcaggctttgcttcttctgagaacatctgcttagcactggcccaacctggttaaaaccttaagtgttgattcacaatgtcacagtcctgaagcttgaagatagaacttgcctgtttgtgttggtcagcttttgctgtgatgatgctgtgtaacaaatagccccccaaatcctagcagcttacagtagcagttacttgttgcttacaggtctgtggttaaactactacagatttgctttcagttactggccacacctgggggatagtggtggggaggtgtccttcctaggggagatggtacctgagggtaggtgagagttagccagaaaagagcattccagacacaaggaactgcttgagcaaggctgttgggkgaaacagaggtaacttgactttgtacagtgttaaatgctgtttttccaacctcaagttcatagtaggtgctcagttatcactgaytgaagaaatgaatgagtgagtgaatgcctgaaggatgttcctggaagaactcagagtggggtgttgagagaggttgctggagaygtggcaggagccagatcaggggaaatggatggtcagagcggttaaggccacatagtcagtgggtgtcaaagtgggtatctgggccgtgttgcgtgacaggactctcttgaccttgcagaaacagaacctgggaccagcaccaaggaccccagaggcacctctgcaggcaggaggcccgagcttagacgcgagaggtgagtccaccatggtgccacactcagaagggcacaggctgaagctgaagtagctgaagggaccacccgcatctcgggcagttaggcgggcaaccaaaaccattatggatagagaacctgctgaagtccccccatggtgccctgctgagggataatttaccaaaattggtccagttagccaagatgattaggccccyataaggccagttcatggaatgaacaatatgccttccaattgatggatgtcttcaagtgggccgaggccagcttgctggagttgtctgaatgctgcagtagggcaggactggttcctccccatagctgtaaaccaccatgccaggccyggccacttatgctttgacaggctggctatgcacagggcttgggtctgtatgcacagcatcacttgacgctggccagaacacgtgggcaaggggccaggaggaggcctccggtcccctcttttctcagctccctccagccaggacacagctgggytcactgtggagctgtckgcagcagaaggacctgctgcctgatactctcccctcttaatgagaggggtcttgggaagcagaacaacaggccactgataccagatggcctgagcttaagtgcctgctatacaggggtggtgggcggcagcgatcttgaggggcctcagtccccagggaccattggggctgacccccatcccagctagccaccctgagggcacttctcaatcacacacacactgagaaatcccaccaccttcacagcgcacaagaatctgaagtaagatcagatggataggtagtcatgttaaaagaaaaccagtagacacattaaggctgggcacggtggctcacacctgtaatcccagcactttgggaaactgaagcgggtggatcactagctagaggtcaggagttcgagaccagcctggccaacatggtgaacccgtctctactaaaaataaaaaataagtaaatttaaaaaaaaaagccggcgtggtggcatgtgcctgtagtcccagctactcgggaggctgaggcacgagaatcacttgaacctcggaggcggaggttgcagtgagccgagattgtgccaaattaacctctagcaaatttaatgtgtctgaggttttttgttttttgcgggggggggggggtttgagacagaatcttgctctgtcgcccaggtctggagtgcaatggcacaatctcggctcactgcaatccccgtctcccaggttcaagcgattctcatgcctcagtctcttgagtagctgggactacaggcacatgtgaccaggcccggctaatttttgtatttttagtagagacagggttttgccatgttgtccaggatggtctcaaactcctgacttcaggtgttccacctgcctcagcctcccaaagtgctgggattacacgcgtgagccactgcacctggctaacagaggttaactaagcaaagaatgatccgcacatcgggcagtccctgaaccagaatacgtccagagaggctctggtacagccacggggtcaaagattaayagacagaaaaaggaaggtgaaggacagaaaacagaagtgaggtacagaaacagccggattggttacagctcagcgtttgctttattggaacatggtttgaacggttggttgcctttgattggctgaaactcagtgattgacacaggagtaggttgcagtctgtttgagtccaattaggttacagttcactatgtacggggaaaacctttaggccaaacttaaaatatgtaaggaggcagctttgggctaacctcaatttaayagaaggtaggtagacatgtatatgtagatatacaggtatgtagatgaatggataaatggatggatggatagatagataatattcctatttttacagctgaggaaactgaggcacagaggttaagtcagccyactcatccacagataaaacattcaaagagtctttagcatctgaattgtgcataatttatattctgccagttggactgacaaatctgatggtatacagtaggaacaaaacaattgcacgaaagcttaagccaaaataaaaattctgagaacaggctgggcatggtggctcatgcctgtaatcccagcactttgggaggctgaggcaggtggattgcttgagctcaggagtttgagaccaacctgggcaatgcagcaagaccccatctcaaaaaaaaaaaaaaaagaaaattctgagaacagagttccaatggtgggcaagttaagttcatcctgtgaattggcatcagaagaatgggcttgcttgaccctggggtaatagatggcatttagctgggtaccatatgggaagaagggaagtgtgatatctggtcagtattctgttagataaatgaatgaatgaaagagtacagagtgtacccagagctcagtggctgtcagtgggcctgagggttaggcacatacaccccaccattgggagagatactgactttgtcttcatttcctctaaatgacaggtccatcaagtcagtccctgagaaggacygtaccacttcagaagcccagacagaggttcctctggatgaccctgacagggcaggatggccagcaggaaaggacagcatccaatayggcagggtaaccaccagcttcacccacccctccccacccactgtgccacctccaggggcccaagtcctcccaccaaatgtagcacttggcagtgatactcacctttcttgagcacctactatgtgccagtagcattctagatgttcattttcttaatcctcacaaccaccctaaaaaatagatatgataggtctatttcagacataaagaaactgaattcttttaaaatttattttattttgattttgagaaagtggctcgctcactcacccaggctggaccgcagtgatgtaatcatagctcackgcagcctcgacctcctgggctcaagcaatcctcctacctcagtctctcaagtagctgggactacaggygtgtgccaccatgcccagctaatgtttgtattttcagtagagatgggttttgccatgttgcccaggttggtctggaactcctgggctcaagtgatcctctggcctctgcctcccaaagtgctggggttacaggtgtgagccactgtgcccagccaagaaactgaagtcttaaasagttaagagacttgtttgtgttttcatatctagcctgggacacaacctgggactcaaatctaggccaatctgagtctgaagcttacactgtttctcatcttctatactgctatgtatctccacccacctacttacccattccatcatccacctagatgctcatccacccacccacctatccatcccacccactcatttatccatcccatccattcacctacccactgatttatccatcccacccacccatttatccatcccatccactcatttatccatccatcccaccccctcatttattcatcccacccactcatttagccatcccacccactcatttatccatcccacccactcatttagccatcccacccactcatttatccatcccacccactcatttagccatcccacccacccatttatccatcccacccactcatttagccatcccacccactcatttatccatcccactcatttatgcatcccacctactcatttatccatcccaccctcccatttatccatcccatccacttatttatccatcccacccacccaaccactcatttatccatcccacccactcatttatccatgccacccacccacccattcatttatccatccatcccacctagtcatttatccatccctcccaccaactcatttatccatccccacccactcatttatccatccatcccaggcactcatttatctgtccatcccatccactcatttatccatctatcccacccactcatttatctgtccaacccatccactcacccacctactcatttatccatcccattcgcttacccatccatctatcccacctaacaatacatccaaccattccctcacctatgcatctgtctgttcagctgttcatccattcattgatctttccatccattcatccactcattcacacacctacctacctacccacccgctcatttattcacccacctaccctctcatccatccagcaaacatgtacacaatacccactatgtgccaggctaagtctggtagagattagacactagtgaggatagacggagagtaaataattatgctaataagtaagctatgtccaataacaataagtgctataaagaaaataagaatgatcaggcgcagtggctcatgcctgtaatcccaacactttcagaggctgaggcaggaggattgcttgaggccaggagttcgaggctgcagtgagctatgatcatgtcactgcaatccagcctgggtgacagagtgagaccctgcctcttaaaagaaagaatgatgaaatagagaccactgagaaaccataccatggttggtatggacaggatgctctgagaagtgacatttgagcttccccaaagaatgtgtgaaggaatcartcatacaaagggcaggagaaagagcgctccaggcagagagagcagcaggtgcaatggctccgaggtgggaagtagcttagggtgccagagaaaggggtcccatgaggctggcaggcagtgagtgggggcgagataagaagcttggaatttctttctttctttctttctttyytttttttttttttttttttttttgagacagagtttcgctcttgtcgcccagagaagagtgtaatggcgcaatctcagctcactgcaacctccacctcctggcttcaaacgattctcttgccttagcctctcgagtagctgggactacaggtgcctgccaccacacgtggctaatttttgtatttttagtagagacggggtttcactacgttggtccaggctggtctcaaactcctgagctcaggtgacacacccgccttggcctcccaaagtgcttacaggtatgagccacccctcctggctgggatttcttctaagagcaagagatagccatggacaggccaacgacaagatataattagattaatgttttcaacagtcccgcctggctgcagctgtgcagagaacttcagatttgtaggagcaggaccttaagccagtggctgaacctctctgtgcctcagtttccttatctgtgaaatggaggttgttataaggagagacacatgcctgacctatggtgggtgttcaagaaaacccttctagctgggtgtggtggctcacacctgtaatccaagcactttggaaggccgaggagggaggatcgcttgaggccaggagtctgagactagcctgggcaacacagcgagactccatctctttaaaactatgaaaattaacaaaacatggtggtacaaacctctagtcctgactactcgggaggctgaggcggggggattacttgagcctaggagttcaaggctgcagtgagccatgatcatgccagtgtactccagcctgggtgacatgggcgacaaagcaagaccctgtcctcaaaaaaaaaaaaagaaaagaaaaaatattaatactagctccctggggattgtataggagatgggggttctaaggctggctggggcctgtcggggaaatggtgctcctggtgggaggcacagcgggagaaccggtgaggtctgcgtggtggtcccatctgccatgggcatgttttctgggagcctcgcctggccttgcctcaacccacccctcccactgggggctctctctgcctccctctccctcatgtgtgctacaggtgaaggccacagtgcacctggcctacctgcgtgccgtgggcaccccyctctgcctctacgcactcttcctcttcctctgccagcaagtggcctccttctgccggggctactggctgagcctgtgggcggacgaccctgcagtaggtgggcagcagacgcaggcagccctgcgtggcgggatcttcgggctcctcggctgtctccaaggtacgcctcacctgccctcctcatccctctcctcccagctgcaccaaggggtgctcaggactcctttaccccacccctccctgggtcaccctgtccccctggaacagtgtgcaaaacgtctggggtccaggcaaagatctgtgtccttaagatgaggctggagggaacgggaaggacagggcacatccctccttttctggaagcttcagaacctctcccagtccctccccactagcggaaggcgtctgcaaggcctgcctgctggtggctttcagtgcctgcccccaaacctccagacagagccagaccctccctaacaaatgcatcaccgctatcactccttcttctcctcgtcaaaaatggaaagacttcttcttgaaataattgtagattcacatgcagttctaggaaataaggcagccagctaccttgaacagtctgcccagtttctcccattggtgatattttgcaaactgatagtaaagtatcacacaaaggatcctgacacccatcaatccatggatctcaattatttatttatttatttatttgtttattttattttgagacagagtcttgctctgttgcccgggctggagkgcagtgctgccgtctcggctcactgcaacccccatctccgaggttcaagcagttctcctacctcagcttcctgagtagctggaagctgggattacaagtgtgcagcctggttaatttttgtatttttagtagagatggggtttcaccatgttggccaagctggtctcraactcctgacctcaaatgatctgcccgcctcggcctcccagagtgttgggattacaggtgtgagcccycgcacccggccctatggatctcattgtgatttccccagttttgcttgcacgtgggtgtgcgcatgtttgcctctgtgcagtcgtatccccwgttyagtctctcgcatccatcacgatggttgacagttgagatactgaacaacmccstcaccacgaggcgctctcgtgttgcccttttgcaaccacacccacccttctcctgcctcgcccaccctgtccccaacccctggttcttctccttttaatacgtggcctggctgaagggagtaacaggagtgcacatgtgagtttggcttcttatttatacacacacacacatatatatagactgggtctggctttgtcacccaggctggaatgcagtggcacgaactcggctcactgcaacctctgcctcctgggctcaagcaatcctcccacctcagcctcccgagtagctgggactacatgcacatgccaccatgctggctaatttttgtttttgatagagacagtttcgccgtgttgcccaggctggtctcaaactcctgggctcaggcaattcaggcaatcctccgcctcaacctcccaaagtgttgggatcacaggcatgagccaccaggcccggcctggtctcaaactcctgggctcaggcaatcctccgcctcaamctcccaaagtgttgggatcacaggcatgagccaccacgcccggcctggcttcatctttaaaggacagttgcctcgttttcatgttgattcgtcctcattcactgggtgacattggccacatcaccaaaatgctgtgagcctgtgacctcccctgtaaaatagggggcgccaggcctgaacttgaggactcttctagtcctaagaacctgtacacctactcaccacaactgcatgtacagtggaatactcaaggcgaatggttacttaaccaagaggaaattagggattctcagagtcagccgagccctggaattaacccaaatcctcatttgggtggcaaatagccctttcaaaatccttccacttccatccctcatttgatagctaagggcaagtcttactctcccctaaagatggagagatgggagctgagagagagaaattggttatgactctcgaatacaaagaataaaaaattcagctccaggccagatacagtggctcatgcctgtaatcccagcactttgggaggccgaggcgggtggatcacttgaggtcaggagttcaagatcagcctggcgaacatggtgaaaccccgtctctactaaaaatacaaaaattagccaggcatggtgtcagtgtttgtaatcccagctacttgggaggctgaggaaggagaatcgcttgaacctgggaggtggagtttgcagtgagcagagattgcaccactgcactccagcctgggtgacagagcaggactccgtctgaaaataaacaaattcagctccaattcaaagtgtttaagcaacaagagaattgattggctcttgggaccagtatccctagatttctggcttcaggtatggctggatgtaggggtccaaacaagaaatcgctttatttccctcctctgtgacagcttcctgtccagcttagctgctscccctggcagtaagatgatattccacagctccagcttggctacctccaacaaccaagtaccacttttccaaaagttctagtgaagtcccaggtctccctgtcattggcctgacttgggttatgtgttcatccctgaaccaactgcagtggtttggattggccatggrtgaaatttgccccaccccagaggagaagttagccccaccccaggcatacagattagcactgggaggaaggatgtgcatttctctcacagggctactgccaaacaagttgccacaaacttgggagcccagcacaattgaaatttgttctgtcgcagttctgaggcctgaagtctaaaatcaaggtktcagcagtgttaactctttgtggaggtttttttggtttttttgtttgtttgtttgtttgttttttctgagacggagtcttgctctgtcaaccaggctggagtgcagtagcacgatctcggcttatggctcactgcaacctctgcctcctgggttccagtgtttctcctgactaagcctcctgagtagctaggactacaggtgcctgccaccacgcccagctaatttttgtatttttagtagagagtagggtttagtagggtttcaccgtgttgctcaggctggtctcgaactcctgacctcaggtgatccacccgccttggcctcccaaagtgctgtgattacaggcatgagccactgtgcccggcccctcgtggaggctctgatggagaatacrccccaggcttctctcctggtttctggtggtcgccggcagtcgctggcattccttggcttgtagatacaccctcccatctgtgtcaccatcttcatatctcctgctgtgtctctgagtatcctctagtattcttatataaatggcagtcactgaatttaggacccatcccaaatgaattttgggggacactcttcaacccattacatcaagaaacaagcagggtacaggcgcagtggctcatgcctgtcatctcagcactttgggaggccaaggcaggcagatcacttgatcccaggagttcgagaccagcctggacagcatagcaagatcccatctctacaaaaataccccaaattagccggcatggtggcgtacacctgtggtcccagctactcggagggtgaggcaggaggatcgcttgagtgcaggaggtcaaggctgcactgagccatcatcatgctactgcacttcaacatgggtgacagagtgagaccctgtctcaaaaaaatataataatcagggtggccaagccataagatgtccaccatggggtagcgggagagacctgcgcagggccccgtgggccgctcctgagggtctccagccctcatgctcttacctcctctccctccccagccattgggctgtttgcctccatggctgcggtgctcctaggtggggcccgggcatccaggttgctcttccagaggctcctgtgggatgtggtgygatctcccatcagcttctttgagcggacacccattggtcacctgctaaaccgcttctccaaggagacagacacggttgacgtggacattccagacaaactccggtccctgctgatgtacgcctttggactcctggaggtcagcctggtggtggcagtggctaccccactggccactgtggccatcctgccactgtttctcmtctacgctgggtttcaggtacggagaggtcagggaggcttccgggaccggctgaggtcaactcagccagtcccctgtctctggggaagactccatatatgaggtttcacccagctggacatctaggggctgttcctagaattcccagggacagggacactacagtctttctggtatctccactagtgtctgtctctaaatgttcacatcaaagttcttttttttagagagacagaatcttgctctcctgccaaggctgaagtgcaataggtgatcatagctccctgcagccttgaactcctgggttcaggtgatcctcctacctcagcctctcaagtagctgggactacaggcacgtgccaccatgactggctaatttttaaatttatttttgtaggacaagtgtcttcctgtgttgcccaggctggtctcgaattcctggccccaagtgatcctcccaccttggcctcccaaagttctgggattacagggcatgagcccctgtgccccacggcacagttaaatattaagggccagagcctttcacgygtaatgtttttatcctgccgtaatttcttcctctccaattatctggaagccaaaaaggcattgcaaggtctcaaaggctattatatgaagctagattctttcaattgctgggaccagcraccaactaaaattagcttaaccaaaagaatagaatttaatggcttatatttccttgggggcatgggcccagttgtcatcaggacacagtgactctctccatatcttcactcagtgcttctcaaagtgtgaccccaggaccagcagtagtatcacctggggactagttagcaaagtacattcttaggccccagcccaggactactkcctcagatactatgtgggtcggcccatgaatctaggttttaattaaccctccaagtaattctgatgtacacaaatgtttaggaaccactggcttacctctggtctaattttgtacacgctctctttccagggcaggtcttatggccactagctatcatatcatctcaccttagcaactcaacatgcaaaaaacgtttcttcagctcagtagtcatatattaatcccagggaaggttctgattggccctttgtggatcatgtgtccatctctgaactcgtcacagtaactgaatggatagtagattctgatacactaggctgcatcatgtgaccacctctctgatcaggtcccatgattgacagcaccccaacccagccctttcccacaggaaaccagaagtagaaaacatggtagtcagataaaaaccatggctagggctaggcatggtggytcacacatctaatcacagcactttgggaggctgaggtgggcagatcacttgaggtcaggagttcgagaccagcctggtcaacatggtgaaactccgtctactaaaaatacaaaaatttagccagtgtggtggcgcatgcttgtaatcccagcttcttgggaggatgaggcgggaggattgcttgagcccgggaggcagaggttgcagcgagctgagattgcaccacygcactccagcctgggtgacagagagagactccatctcaaaaaacaaacaacaaaacccatggctaccactgtccccgacaattgtcctaggtcttctctaagttcacttgactccgaggatgggctgtttctgtctcaagctttagagtcaagcaaagatgggtttaaatccaggctctatcacttactgtggcactcaggacagctgctgaatcccccgagccttggatgttctcaccactaactgatgaatgacgcgaatgctcactctgcaatgaatgagacactgtgtgaaaagcctggcacatacagttgggtgttcagcaaattcagttcctccctgcctgcctgtctgccagctgcacccaacctgcagctgcaaaccaaataacgaatattttctgcacatcacctggcatgtaacccttgggttacatgagtgaaactgacttggccaactgccttcattgccccttacagttttgttctcccactgaccagccgtaaatgaagtagtcggcctcagtgctgggaagtgagacacttaaactaaattggtggtttctcaaccctggctgtcccttagaatcatctggaaggctatttaaacagcaccaaagtcaaggtgacatttccagagattccgattcagtcattctggggtggggcattagaggtttttgaagctccccaggtgattttcaaaaaaaccatagaactctgattctgcaaggaaatgagaacccagagagggcaagcaactagcccaaggtcacacagtaagctgttaacagatcctggtctggaatcctgtacttggggctctctgtgcttctggaaactacctctctatgtctgtggcttctcctcttccctctcccatccatccttctcagagcctgtatgtggttagctcatgccagctgagacgcttggagtcagccagctactsgtctgtctgctcccacatggctgagaygttccagggcagcacagtggtcyvggcattcygaacccaggccccctttgtggctcagaacaatgctcgcgtagatgaaagccagaggatcagtttcccgygactggtggctgacaggtaggaagagccagggcagagaagaccttgcaattcatccatatccttagagggtgagacctgaggtcatattgtatggtagmgaggtcacccagagagtcagggacatagttgaggctagatcccacaggcagtctatcagttctcaccgtgggcagatggaacatgaccragagattctcaacagcaggtgggcggggggtacaggaagaagcttctgttgccaggcaactggatcaacctcttttgccttggtgataaagcagccatataagcatcctcagccatctttaggtactaagcaagaacaagaacacaagctttaagcacaaatagacacaggttcaaatcccagctctgccacttaccagctggttgatttcaggcaagttacataacctctctgagcctcatttgtcaaactgggatcgtgctcatggagtggatatgaggattaaatacagacactcataggtaagacctgtaacatgcttactgcatgcctggcactgttctgagcaatctatgtagattaatttatttaattctgctaacagcttcaccaggaagaaactgttctatagatgataaatcctaggcacagtgaggtttggaaacttgtccagggtctcacagctaatactggcagagccaggatttgaatccaagcagtctggtaccagagtgtggagagggtcaagtacacactaggtgctcaatacatgtgaagtcctttttcctttcatctcaggtccccagccagctggggctgtgtattagtccatcttcacactgctaaaaagaactacctgagactgagtaatttataaagaaaggaaggtttaattgactcagttccacgtggctggggaggcctcaggaaacttacaatcatggtggaaagggaagcaaggcacgtcttacatggcagcaggagagggagagcatgaggtgggaactgccgcatccttttacgccatatgatcttgtgagaactcactatctcgagaacaatatggggaaaactgcccccatgatccagtcacctcccaccagatccctccctccacatgtggggattacaatttgagatgagatttgggtggggacacagagccaaaccatggaggccatggttcaggccaggggaatggcaggtggacatggcttggcaaattccagggacagaaaagcagccacacagggatgctcttcagaacaccgagtgtaccccagaccctaaagtgggcttagttgagacaggacggtgtcatcttcctctactccctgagcctgggttgcatgtggaggccattgctgggacccctgtgtgtacaaagctggtgtgatgaccagtccttgtgcccagagaagcatctccctgcagatgagagtaaccactcaccctgctgycgcttccctttgcaggtggcttgcggccaatgtggagctcctggggaatggcctggtgtttgcagctgccacgtgtgctgtgctgagcaaagcccacctcagtgctggcctcgtgggcttctctgtctctgctgccctccaggtactccccacatccccaaactgggcttgagggacagacagaggcagagactgtyggacccctgctagtgggacctttgaagaccctgtrtccaaaccmmcatggtgtgtggagtccctccaccaaggagggacacgcagctctacaagagccagactcagctaaggtgaacttgcaaccttgggcaagagtctttccttgtggagtgtcagtgtgctccttggaaagacaggccagaaatcccactacttctgatgttataaagactagttgagacaaagcatatcctgtggaggacatttctagtgcattgttaacttttgttttgttttgaagacagagtctctctcttttactcaggctggagtgcagtggtgcaatctcggctcactgagaactctgcctcctgggttcaagcgattcttatgcctcagcctcccaagttgctggaattacaggcgtgagccactatgcctggctaatttttgttaactattaacagtatgtaatgtcagttcatgacatctaygaaaaaaatatatatatacactcataagcatttgttatggaggaggcattattctaagagctttatatgtttttgttcgttttggtttgttgttgttgctgtttgagacaggatctcattttgttgcctaggcttgagtgcagtggcatgatcttggctcacttcagcctccatctccaggctcaagggattctcccacctcactttcccaattagctgggactacaagcatgcaccaccatgcctggctaattttttttttttttttttttttttttttttggtagaaacagtttcaccatgttgcccaacctggtctcaaactctaggttcaagtggtctgcctgccccagcctcccaaaatgctgagattataggtgtgagccaccatgcccagctgttttgttttgagacaaggtctcactcttttgcccagactggagtgcagtggtgtgatcacagctcactgcagccttcaattcctgggttcaaacaatcttcctgcttagacttccaaaaagctgggattataggcatgagccactgtgcacaagaattttataaatattaactcacttaatactgcccacaaccccatcagagaagcactgttattatcctcattttacagtcaaggctgctaagcttaaggatgaagtaagaggctggagcatgttgggtggcagtgagggaactttcctactgcatccagaaaggcctctctgaggaggtgacttaggaggaagtgaggttaacagcaggaagaaaaggcctgggagttgaaggttcatccctggtgtgttagaggaacagcaagaagaygggtgtggctggagagggtgggtgaaggcaggggtgctgggagacaaggttggggatgggatggcagggctagagctgctaatggctcatagggaggagcttggagtggttctaagtgtcatgggaaattggtggccacccagtcgctgcgagaaagccgtcagaatggaatcagtgggcctgggtcctgctgtgtgtccttgggagggccacacaccctctctgatcctgtctactcacctgcatcaagccagtttgtacaagctgatgtctgagggcttctttttgctctgcatgctctggttctactgaaggaagagagggacctgttggttgtatccaaatcccaatcccctgggcccaggtcctcagactrtcccattcctgcctcccctctttactcccctgggtctggcctcccagaaaaggttgggaaaccaggggggctgttgcaagccctcaagtggccttgccaaacccagccagagaggctttcttgcaccaggtgacccagacactgcagtgggttgttcgcaactggacagacctagagaacagcatcgtgtcagtggagcggatgcaggactatgcctggacgcccaaggaggtgatgggcgggaggtggggagggggtcccagcaaggacatattgtggggggggcaatgggtccctgttgacatctgctacaggctttggagtttataccctcttctcccctcactcaacccccaccactataggtcagagtcacagacagggtggcagcagtggttaggagcataaggtttggagccaggccaaatcttggttcctttgcttctgagcttgaggaaagcaggtcacccatgggagtgcagggaaccacaaggaacagcattgcaacagcaacatagctgcaacatgatagtaacataatggcaacagcaacacaatggcaatattccagaacatgagagtaatgcaacagcaatgtaacagtaatgtaacagcaacataaccacaatattgcagtaccagaatagcaacatagcagtgtaatagtaacataatagagacattatagtaacatgatggcaacattccagcaatacaaccacaacatagcaatgtaatagtaacgtaatagcaacattttagtaacatgatagaaacaaaacagcaacatagcaatgcaatagtaacacaacagcaacatcataacatgacagcaacatcccagcaacacgactgtaacagagtaacagagtagcaacataacaatgtaacagtaacaaaacagcaacattatagtaacatgatggcaacattccagcaaaataactgaaattatagtaacggaatagcaacatggcaatgtaacagtaagaaaacagcaacattatagtaacatgatggcaaaattccagcaacataacagtagcattataaggacagaacagcaacatagcaacgcaacggtaacaaaacagcaacatgatataatgtgttagcaatataacagtaacattacagtaacagaacaaggaagaattaattagttgatgaatagggtagaagaaatkgtgagagatggacagatgaatggatggaatgggatggaagaatgagagatggagggatgggattggagatggatggatggatgcatggatggatggatgggtgggatggggtggataaaggataagagatggatggatgaatggatggatgggattgrgtggaagaaaggataagaacagcagcatagcactaatgtaacagtaacataacagygttgagtttactgggaggatcaaatgagatcctgcaaagaaatgatttaatagagtgcctggtccattgcaaacactcaatacatgtctgctgctcttattagccctatttcccagattggaaaaccaagactcaagggggtagaatgatctgttcaaggtcacgggmacagcaaaggcagtattggtcttcccactgcacagtcatgtcctttcacaaagacaaagagaaatgtctgctcccactatagaaaaagagattattttatmataaacagtggctaataataacaataaaatagactaaaagtagccaccaccatctgtttttagcattgacatagtccatgccctctcttgttgaattcccataacaaccctgtaaaacagcaataaatacgtccattttgcggaagagaaaactgaagctgatagaggtgggccatcttgtgtgaagtcttagaggaaggctcctctgactcagtttcccctcctgctccaggctccctggaggctgcccacatgtgcagctcagcccccctggcctcagggcgggcagatcgagttccnggactttgggctaagataccgacctgagctcccgctggctgtgcagggcgtgtccttcaagatccacrcaggagagaaggtgagtggttctctcacaatgtcttcttcatggagtttaggccaaaggactccagggacaaggccctaaaccctgggcaccagcyacctccacagtgtccccacctcaggtcccctagctttcagacccattaccccctaaaatgaactcctcaccttccccaaacctgcttccatctggtgacttcctcatccaccttggtgtccccagatgaggaagcaactccgtgacttccttcttcctttaacattaacccagcacctaatatgtgctgggcagtgtgttaaatgctccaggtacattttccagtttgcacaaatgggatatttgctttcagctgggagacattgggaaaagcacttcatagctcagtctcagttttcccatctgtaaattgggactggtaatactgatctctgagttgttgtgaagtttgagttaatacatagaacatgcttagctcatagaaagtgctccagaaatgtttactaatgcttttattatttgcgttttcactctcacaacaacccctaagtgaggtgctagtactatcccattttacagatgcctcatcaggccccttcactgaatccctttcctccctccctctgaacctacagaggcttcctccctgtcctctccttgtcccctaaaaagcagtggatcctgtctcaccagctccaatctgctctcctgtgattttttttttttttttttttttgagacagagtctcactctgttgcccaggctggagtgcagtggtgtgaccttagatcactgcaacctccgcctcccagattcaagtgattctcctgcctcagcctcctgagtagctgggattacaggcacctgccaccacacccggctaatttttgtatttttagtagagacagggtttcaccatgttggccaggctgctatcaaacttctgacctcaatcacccccctcggcctcccaaagtgctgggactacaggcatgacccaccatgcccagccatcctgtgacctttatcagcatgaatgacactgcatgtcattcccctgctcaaaaccttctactagttccagcttcccttggggtaaagtgtgaattcctgagcttggcattcaaggctctacccaacccaggccctgccaacctccccctctcattcattgctctgccagggcttagccaacattgtggagcagctgcctctcggccaggggggcacatggtgctgtgagctccatgagcttctagttttggaaacccacttggtgtggtttacctggagtgttccccttccttgaactcctattgatccttcaagcttccatgcaagtatcccttcctccatgaggtcttctcttattacctctgtcaaatcccaggcagcatgagcagcactgccttgcttcccttaattgccagaggtccagaccttgataataaacagcattgttggctgggtgctgtggcttatacctgtaatcccagcactttaggaggccaaggtgggcagatcacttgaggccagaagtttgagaccagcctggccaacatggtgaaatcccgtgtctactaaaaatacaaaaattagccgagcatggtgacaggcacctgcagtcccagctactarggaggctgaggcaggagaattgcttgaacctgggaggtggaggttgcagtgagctgagatcgcaccactgcactccagcctgggcaatagagcaagactttatctcaaaaataaataaataaataaataaataawgcattgttcatcacactgtattacatttactcaattgcactgtttcctagaccggatgatgggcacactggagcaaggactctttaatttctatacttccggtgcctaaacaggtacttggcatacagtggggtgacccacatgtttccatcattaattaaacaaataatgttgaacccacaccatgtgtcagacactgaggatgcaatagtagcaagagagataaggatggagggtggataacagcatgggagatggataacagaatggacacatggataagatggaggatgaatggaaggatggatgagggaaggatggactggatggatggatgggagaaaataaatgaatgaaaggattagtgaattgatggatgaatagggaagaagaaacgagagacggatagacagatgaatggatggatgaatggaatggggtggaagagagatggagggatgggattgaggatggatgatggatggatggatggcaggatggggtggaaaaaaggataagggatggatggacggacagacagatggatgggatggggtagaaaaaaggatgasagatgatggagaggtgtaaatagaaggatgaggaaagatggaggaactaaaggaagggtggggagaaagatgggagagagatatcaggataagggaaagatagagaagaacacagatggaagactggatggattgatgggtggatatatagaaaggtagacagatggaaagagagatggaaggtagacctttacacaatgagggatggatagacagatctcgggtacagcagaaagatctccccaataaatgcccacaaaccctctggtcagagcaggcctttcctcccaaccccgggcaggtgggcatckttggcaggaycrgggcagggaagtcctccctggccagtgggctgctgyrgctccaggaggcagctgagrgtgggatctggatcgacggggtccccattgcccacgtggggctgcacacactgcgctccaggatcagcatcatcccccasgtgaggctggtggagggggtgggcaaagatgggaggcatggtgggaccyggctctgacccaccgcccctccccgccaggaccccatcctgttccctsgctctctgcggatgaacctcracctgctgcaggagcactcggacgaggctatctgggcagccctggagacggtgcagctcaaagccttggtggccagcctgcccggccagctgcagtacaagtgtgctgacygaggcgaggacctgaggtatggtcgtcccaccatggctgggacctgcaggtgggagaggaggggatggccatgccctccccaagggccttcaggaaatgcctcccccgataggattatcactctgttacattaataaccacatgtctcttatctgcaattccaagctctgacacagtctctgaataccaaggttttcccccctaaattagcagttagtcttctatatttacttggtggcaaaacccaacctcaactgacacagggctactgatagcctttattgctcttgctcagtatttattttgctatgaaaatattgtttgatatcgggtggtaacctcaccactcactgggactataatataggatttttttttttggtaaatgtcaagtgtggactgggcacagtggctcatgcctgtaatcccagcacttcaggaggctgagagaggaggattgcttgagcccaggagttcgagactagtctgggcaacatagcaagaccctatctctgtggacaacagtattagccaggtatggtggcatgcacctgtagtcctagttacttgggaggctgaggtgggaagaacgcttgagccagggaggcgaaggttgcagtgagccgatattgcaccactgcactccatcctgggcttcgtctcaacaacaaaaagctgtgtggaaagatacacataaaatttactatctcaacctttttttttttttttctttttctttggagacagggtctggctctgtcattcaggctagagtgcagtggtgaggtcaaggctcgctgcaacctccacctcccaggctcaagcattcctcccacctcagcctcccgagtagctggggttacaggtgtgagccaccagggccaggtaatctttttattttttgtagagacagggtttcaccatgttgcccaggctacagtcgaacttgcgtaggcctcccaaagtgctgggattacaggtgtgagcagccacgccgggcccatctcacccatttttcagtgtatagttwctgtagtgttaggtacattcacactgttacacaacagaactacaactctgtacccatgaaaccctaactctccttgtcccctcccccagcgcccagccaccagcattctcctgtctctctgagtgtgactactctagacactgcatagacgcagaatcataggatctgtccttttgtgactggcttatttcacacagcatgatgtcttcaagggtcatccacatcgtagcatgtgtcagattctctacctttttaaggccgaataattttccactacatggatagaccacattttgcttatccgtttatctgccagtagatacccaggctgtttccacctcttggccgttttgaataatgccactatgaacataggtgtataggtatatgcctttagaaaaaccaaagtggctgggcgcggtggctcatgcctgtaatcctagcactatgggaggccgaggcgggtggatcacctgaggtcaggagttcaagaccagcctgaccaatatggtgaagccccgtctctactaaaaatacaaaaattagctgggtgtggcggcaggcgcctgtaatcccagttacgtgggaggctaagacactgagacaggagaatcgcttgaacccgggaggcagaggtttcagtgagccaagattgtgccactgcactccagcctgggtgacagagtaagactccgtctcaaaaaaaammaaaaaaaacctaaggtgttctggatttataaacccctctgaccctgagggtgtccgaagggcttgtggtaggcaataatttccagcactagagaggcagcgttgcttggtgggtaagagtatacacaggtgacagactgcctgggctcaaatccaggccccccaccccacacccccacccccgccccgccctgccacttactagctgtaggatcttaggcaacttatcttgtgtgcctcagtttcctcatctgtaaggtgggaataatagcacctacctaccttgcaaggattgaattatatgcacaaagttgttgaaacagtggcaggcatagagcaaagagtaaatactcattttagtcctgagtcacactcctgataacatcatttcacagagttggaattggaggcctggggcttgcctgacgtcacacagcttaaaagtagtgaggttgggacaagacccaggcactctaacgcctgcatgaccatagtaggttctgatcatgtaaaaggatgctgtttcatggaagggcttactgtgcaagacagccatgctggggccccaggggtcagttcccacctgggtcaggggctcmctgggctcacaacctggaatctcaactcctccaccctccacgaagggtgctactccatgccaagggcttattctgtgacaagccyacacactttttttttttttttttttttttttgagacagagtcttgctctgtcgcccaggctggagtgcagtggcgcgatcttggctcacttgcaagctctgcctcccgggttcacaccattcttctgcctcagcctcctgagtacctgggactacaagcgcccgccaccacgcccggctaattttttgtatttttagtacatacagggtttcaccgtgttagccaggatggtctcgatctcctgatctcgtgatccgcccacctcagcctcccaaagtgctgggattacaggtgtgagccgccgtgccccgccacccacacacttttatgtgccatgtcgtcacgattcagcgaggacggatccattaggagcacagactctggggtcagaggacttgggttcaaattatggacccaccactagccttgagaccttggtcaagccactgagcttctctgtatctgtgtcctcttctctcaaaagaagagaacaataatatctaccttggtggacattatgaggattgagtgaatatatacaagcacttagaatgtgtttggcacaaggtggaaactagaaatagaactggacatagccataaacaggccaggcacggtggatcacgcctggaatcccacccaggtgttgtacacatctgtatttaaggcccacgtgacaccagccttgaatgtcttargaagactgtagatttgattcttgaagcagcagtgagtcattgtaggtttgtttgcaacggcatgactgaagtgaaagctgtgctttcgctgttgggggaaatataaattagtacagtcactatggaaaatagtatgatgatttctcaaaaaacaaactagaaatagaactaccggggcgcagtggctcacgcctgtaatcccagcactttgggaggctgaggtaggtggatcacctgagagtttcaaacaagtcggacsaacatggtgaaaccccatctctactttaaaaatacaaaagccaggcatggtggcgcatgactgtaattccagctacttgggaggctgaggcaggaaaactgcttgaaccgggaggcagaagttgcagcgagctgagattgtgccattgcacgccagcctgggtggcagagcaagactccgtctcaaaaaaaaaaagaaaaacgaagaagaaaaaaagagccataaacagaaaaaagaaaatagccatttcacaggtggggaaactgaggcacaaagggtttgaatgacctgcctacagtcagcctgctcaaagatggcaggaacaggcttcctatcagttctgcagaccacagaccccagaccccatgtgtggggatgcctgaacacaggcacctcactcctgcactgcttcagggacctgtttctgggcacacccacacatcaccatgtgccgacaaacrcacgtcccagctaattgtcccaatcgttcccagcgtgggccagaaacagctcctgtgtctggcacgtgcccttctccgraagacccagatcctcaycctggacgaggctactgctgccgtggaccctggcacggagctgcagatgcaggccatgctcgggagctggtttgcacagtgcactgtgctgctcattgcccaccgcctgcgctccgtgatggactgtgcccggtaaggctcccgccccggcctgacctcacagcagccctgcagtggtgggggaaggaggcggaggcagtcctgggccactgggcttcgggttagagctggaggggtcctgaatggggccagagcgggaggaatgcccgggaacacatgccaagtgggaaagctgcccaaggacatgcgcccagcacacgcttccaacccagctgtgagggccagggagccgcatggaaagcaggacttctatggagaaaacctcagcgcagrcacactgggctctcacagctgccgagagcctgggctggtgtccaragagcctctctgtctccctctcccccacagggttctggtcatggacaaggggcaggtggcagagagcggcagcccggcccagctgctggcccagaagggcctgttttacagactggcccaggagtcaggcctggtctgagccaggaccctcaaccrtaccccagttggaccagcccgcacagcctgcagtgctggagatggaagtgacccgtggtcatcgatagctccacacgatattgagtctagacctgtgtttgctctctgggaggaaaatggcagagaaagtggccaattatcacagagcatcagagccggaaggacctagcaatacacaggtctgcccgggcagggcccatctcgccctgtccaccctgcagccaatgtcaacagcgactctcagccccgctgtactctggactcacctgggggcctcaagcacatgcccaggctcccrgctagacccttaaatcagaatctctgaggctgggaactgccatgctgtgtgtactttttacaaattaacacttttattttgggataatcccagactcacatgcagttaaagaaacaataatatagagagattcgtgtacttggtaccccatttcacccaatggtaacatcttgcaaaactctaggataaagcatcacagccagggtgttgacattgacacaacaatcttgctcgatttcccgttttacctgtactcctgtgtgtgtgtgtgtttattttgtcccatgcagttttatcacacatgtaggctcatgaatccacaccagggtgaggatacggaatagccaccaccattttccgaccacacccatcactctcgctcctgcccccagtgaccatgctctgttctccagttgtgtgtgtgtgtgtgtgtgtgtgtgtgtgtgtattttttttttttttttttttgagacagagtctcactctgttgctcaggctgaagtgcagtggctcaatctcagctcactgcaacctccacatcctgggttcaagcaattctcctgcctcagcctcccgtgcagctgagattacaggcgtgcgccaccatgcctggctaacttgtgtaatttttattagatacgaggtttcagcatattggccaggctggtcttgaactcctggcctcatgtgatccaccctcctcggcctcccaaagtgttgggataacaggcgtgagctaccgcacctggccgagtttggtgtataattttaaagctcccccataggattccaatgtgcggccaggactgagaactacagccctcgcatctcctgctgctcctcctcccccaccagagatgagctccaaggacacaaaaaccaggtgcccccccatgccaagcatgggtcctctccacgcatgagaaagtcaaatatgcaagtttggtttccaaaacaaacaacagaggagccaagacttcacagccctcaatgggagaatttgcccgaggacttggttcttttttttttttttttttttttgtccgagacaaagtctcactctgtcacccaagccggagtgcaggggtgcaatcttgactcactgcaacctccacctcccgggctcaagcgattctcccacctcagcctctggagcagctgggattacaggcgcccaccaccacgcccagctgatttttgtatttttagtagagacggggtttcaccatgttggccaggctggtctcaaactcctgacctcaggtgatccgctggccttagcttcccaaagtgctgggattacaggcgtgagatactgtggctggcgggttcatttcctatatgtggttgctaaaaaccaaattccagctccctgggggcgccccagcacccgtcggaacacctggagtgtttctgttcacagttccgctccagatgctgctgacagccaaaggctggacccggctgagcgtggagaacttgctgtaaccaagggtggtcaatgcacagcttgttgcattcctcacacatttctttttttgttttttgagacagagtcttactctgtcacctaggctaaagtgcagtggcaagatctcggctcactgcaacctctgcctcccaggttcaagcgattctcctgctacagcctgccgggtagctgggattataggcacccaccaccacacctggctaattatttttgtatttttactagagacggggtttcaccatgttggccaggttggtcttgaactcctgacctcaggtgatctgcccacctcggcctccaaaagtgctgggattacaggcgtgaaccatcatgcccagcctcctcactcctctttctgacagcggtcagtatattaatactggactcaccaaaccagctgcaggcaccggaaaagagggactaagtctaaagtagccaagcctaaggccacacatagatcgctgggaagggcagcgtgagacattagacaactccctagatcctaacattatgtatgctagtcagggagtctcactgacctcgtggcattgccgcaagaatgacataatacatggatatgtgttcgtggaagcacagaaggcaatcccccaggctttctgaaccttattgacacgtggggccagatagttctgtgctgtggggacatgtcctgcacatcgtaggacgttcagcagcgcccctggcctcttcttcactagatgccaataacatcctccttctaccgccaccagacttgtgacactgccattaatcccccagggggtcaaagccacctagttgggccgggtgcagtggctcatgcctgtaatcccagtgctttgggaggcggaggcaggtgaatcacttgaggtcaggagttcgagaccagcctggacaacaaggtgaacccctggctctaccagacatacaaaaattagccgggtgtggtagcaggtgcctataatcccagctactctgaaggctgaggcaggagaatcgcctgaacccaggcagagaaggttgcagtgagccaagatcacaccactgcactccaggctgggtgacagagcaagactgtctgaaaaaacacaaaacaaaaagacccacttggttgagaatccccggtctaacctgccccgctgccatccatcatccacagatacttgagcagtggctttgctggtgtcaggggtggcagggcaagaactccaccttttcttaaggacacagggcctgctccgcccatcaggtcatgggactttctgatggcccatcctcacaggttttgtgatgccccttttggcctggagtaaacttctaactgcagcttctaccaccttcaaagtggggcaggaagtccgcattcttgacctgcccctagtcatgcctgcaaagctgtggacccacaactacctattcctagctccatttcacaggtgaggaaactgaggctcaaggggttgacatgacttgccaagttgacccagtcagtaaggacagagtggggatctgtttctgggtgtaataccaaagtcattgcacagggcacatttgtcctttagagaaaggaagggcggcagatgcagcctgtcttctctggctggagctgagccacctgccttgcagagtgaccctaggcaggggctgccatgtgggcatttggcaaactcagctggggatgacccagggccaccagactctctttcctaggctgtgtgccagggagcagagggtgggccacaggcggccagcacgtgggaaccggcacctgccagcctgctaacgagactgctgttgggcccacaccacggcagtctggagacgcgccagaggggatgcccaggccattaatacccccgccatgggctgctgccagtagggtctggctggtgggtggaacacgaatttcatccatcaaggctgcagacttcctctctggtcagtgcctgcgcccagtagactctttaaaactcaacagtccacctcgccactgcaaacacgtaactacgtatacctgacactgctttaaatgcccgccacgcacgcattcagtggaccagaggaggaagccacctcactgggccccttactggaacgttttgatgaggaaggtactaccatcaggcccttttgacagatgagaaaacaaacagaatgagtggcatctctgcccaagcagtgtggcttcagagcccgtgtcctcaccatcagtcactcactctgtcacccaggctggagtgcagtggcgtgatcttggctcactgcaacctccacctcccagttcaagcaattcttatgcctcagtctcccaagtagctggaattacaggcactcgccaccacacctggctaatttttgtatttttagtagagacaggatttcaccatgttggccaggctggtctcgaactcctgacctcaggtgatctgcctgcctcggcctcccaaagtgctgggatgacaggcgtgagccaccgtgcccggccagtgcgtgttttcataaggtcactacagccaccaggttgaggacactgatgtgtgtgtggggggctgggggcaaaagcctcgagaccactgtggcagctgttgtagggatgcagggagaaagtggggtggctgggaccagcgtggtggcaatgggaggatggggagtggatagattctgggtgttttgcagaaaatcaaacaaatttgctgtaggacccgatggtgggtgtgaggacagatgaacagttcaacactggaaagcaccagccccctccttacgcctctctggtctggggggatcctttccaatgtggagagttctgcacagtgaggccagggccagcacgtagtaggtacaaaacagagcttccttccacagtacttccactcccctggatgaggagttatgcctcactctgcctcctcttcataaagtggattaaacttgaactcagccccggattccacctgagcatgcagctgccccaccccaagacactggcacagatgcacaccaggtggagctctctgggactgcttaggatctgacctgggattttaagactcagggtcaggctttgagatctaaacacatctcacatccctattaagattcccgctggtagatccaactactactcttttgaaatggagtctcggcttgctctgttgcccaggctggagtgcaatgacttgatttcagcccactgcaacctttatctcccacattcaagcaattctcctgtcagcctccccagtagctgggactacaggcatgtgccaccatgcccaactaatttttgtgtttttagtagagacggggtttcaccatgttgatcaggctggtcttgaactcctgacctcaggcaatccacccgcctcagcctcccaaagtcctgggattacaggcgtcagccactgcacccagcctcaactacttctaatttaacaaaaaaaaagtttttatatagaaagagttccactatgttgcctaggctggttttgaactcttcagctcaagcagtcctcctgtctcagcctctcaaagtgctgggattacaggcatgagccacctcgtctagccaatactgctaattctaatagtcacaacgtyaccagtttttcactgggcaccttcatactctgtggttcctaatgcaagccaatgacatcattcaggcatgagccaccatgcccggctggctgatactacctattctaatggttatgaccttactggcttttcactaggcaccttcacactctgcagtccctaatgcaagccaacagtttcaatggggcatgagtcactgcacccagacactactactcattctaatggtcaccacctcgccggctcttccctgagcacctttgtacaccacagtccctagtgcaagccaacaatttcaatcaggggacaggaaagcttgagggaacaatggcagtgctagaacgttctatctgcacatgtacttggtgcatggttttaggtgtggcagaaatggtgtgctccccaaatacagacattccttactgcccagactcacccagttcgaagttagaaaccgaacacactagtctgactactccgctatccaaaactccagaaccacatcagttaggaaagggagaaatccttctcttccacaggcaccgctccatttcccagctcccgcagtggttgggttggggccatgtgactcattttggccaatgggctgtgagtgggattaactgcgtcagttccggtttcagacacagaagagtgggtgagagtcgtccactctcccttctcccactgtggggacctggaggccaacccttgggaggccatgtcacaaaaccaggacagcctggatcacttgtcacagggaagtcacctaccctggagaggcagctgaccctcaccaagaactgcgtgagcaagaaataaagccttgtgatcatttccgaagattttacggcgaatttgttactgcagcgcagcctcgcctctctggactaacataaagggattttcaggccaggtgcctgaaccccagcactttgggaggctcaggcaggaggatccccagagcccaggagtttaagaacaacctgggtaacatagcaagaccctgactctataaaaatttttaaaaattagctgggcacatgcctgtagtcccagctacccaggaggctgaggcaggaagattgcgtaagcccaggagtttgaggctgcagtgagctatgatcgtgccactgcacaccagcctgggcaacagagtg

SEQ ID NO: 17782 - DNA, 21364 bp, Homo sapiens
gaaataagacatttatccatttagtaattgcttaactagagaagaattacttcattcagacactcaagaatgtcaacagtcttatttataatgtatttaatagagtaccttctttattaactacctgtagatccaaacttcaggctgttctaaacaagaaactaagaacttaataagcagttagcagacactgagggtctcattgtgcttcagtggcccaaaaagagtagatacagacatctaaattgcctattttatgcctttatgtattgtagaaatctgccttactgttttgtgtagccacagaacagaaatagactaacttttttttagtaaactctctggaaacaaaaatcttcccagatatttattgttaggaaaatataatctaaaaattcttctgcccaaccccttggctgcatcccagtcttccatctgctttgtgcagttggattccctttgctctttactcataaatgattctctcaagcattaaaagtcacctgatagacaccaaagccataatttgcaagatccaggtggaaggcattttgtacttttgttcttacttttatactggaaatatgcaataaggctaaaattcgttttttaaaaaaagacttcccattttttttctcttggctaatgtagtagattagctatgttattttcaaaaatttgcattaactctaaataaaaaacagaataacatttgtaaaaagaaaaaagattagagaacacaaaggcttcaaactgagatacaataaattttttgtccaaaattaaatcccaaatcaagaaaacaacctttagatctgttgttttagcaactaataatctgctgtgcacatttcagttggtatttggaaaacatttaactctgtagctttgtagaaatgatattcccrcttgaacatagaggaaattgtacttattgagagtttaactcaagagttagtgcacaacaaaagttcattagtgcccatttcatgttctggaaagataaaatatcagcatcctatagagatgtcttatttgtatatacagcatttcagaaatcaatgggatactcaaaagattaaacaggaacatcctttacttatggaacacaggataaaataaatctaaaattaattgtcatacatcgtttttgaatgagaaccaaatgacctatcctaccacctctaattgtgaatacaggtttttcaagagtgtaccttcttcctcatttatttctaattgccaggcattgccaaacaaaagttaattctggaaattcttgtaaatgaagagaggtttttgatcagagaaggtgttgtttgaaacagccagaagatccagcttgcaacaattacggacaagctactgtgtcttaatatcaagctaaaaattccctggtccactgatgcaagacttattttactcaaattgtgaacaaaaagacaagtggtaaattaggagggaaaaaagtgaagcaacttttattaaataccatgcaaccatctggcaccactccgcaaagttgattattgactaactttaatagcagacatttttgtctattcctttaaacattttgtggaggaaatgtcctctgtattggggggggtggggggacagttggaggtggggggcagatagtggttgagtgtgagttggagggtagaaggaggaaattaaaagatgcattgataaagcagtagggtacaggagttatgcaagcaatagtttatgtaaagccacagagagagtgccttatgccagaaacagcaggtccttccaaatttctcaagctttgtccttgctaacagtaagcaagcctaggaggggatgcttgaagaacctggtaagcaactgcccggctctcccactaacaagtccatggatttctcagttaaggttacttaaaattgcaaaagctattcacttgctgaagattgtcaaaaatcactgaattttatagctttaagagagaatcttacagatcaagaagtcccaagcctgtatttttccagatataatcatttaaacaatcctaacctttgtgaggaaagtataggaggccaggcaaggtagacagagcttgaggccttggcagttgcttccttttgatctctaggggaagggggtgggggttaatatgtattcattaattaataccaacattgtattgaaaaaattgcaattagtcaatgataatgggttcttctgaacattttacatgacaaacaaatattcttaagtttaatttcaaaaagacgtggagtttctttctatttttttttttaagatgggccttgctctgtgccctcaaactccagtctacaatctcaaactcctgggctcaagaaatcctcttgtagtagctaggactacaggcatctctcactacacctggctagttttttttttattttttgtagagactgggtctcactatgtctccctcctcagccacccagagagctgggattataggtgtaagccactgtgccaggcctagccctggagtttctaatacattggtgatacaactctgagatttctaagcatggatttgtaaatgaagagctggagcttaatttttctaattcacacagcactgtttcaacattgtcttattcagtggttctcagcctgggaaagaaggagaaaggtgattttgccccccagaggacatttggcaacatttggaaacattttggttgtcatgactgggagtgttataggtatctagtggatagatgccaaggatgttgctaaacatcctacaatgcactggacagtctctcaaggaaaaatgatctggcccaaaatgccaacagggttgagattgagaaactctggtctaatctgaacactctgaatattattaaaacatatggtgagatcaagaatttattactgcattttcgttaataccaatttgctcaaaggcagtttgaaaaacagaccctgactaaaattgcatgtgcgttatacagggaaaaaaatatgacacatttgtgatttgaaaaggaaaaaaagctgaagggaaaaaattagatatttttattcataagagcattgccatacaattttcaatgctccagaaaaataaccttcttccattgacactgtgctgaaagaagtgagtaacaaaatggttataaactatccttctcacaaattctaatctattatcagactgttatttctaaaatatattaatacaccatctaaaaaacagccctcttatcagaagctatgatacataataagtcagaagataaatgcaccagtaggaatttattataatttttttaatttctctggattacagggcacgtaaactctgtaggaggtgcttattggagagtaattctgtgatccagaagacactagaatgtgttcagccatttagcacccacccaccccctttcttttccctttcctggtaaattttcctttatgttcataaggacagatgccattgctgtgggaatcactctggtttaagcctcttgagaaaaacagtagctaactatattagtccgttctcacactgctataaagaaatacctgagactgggtaatctataaagaaaagaggtttagttggctcacagttccactagctgtacaggaagcattatgatggcatctgctcagcttctggggaggcctcaggaaacttacaatcatggcggaaggtaaacagggagtatcacctcacgtggccacagaaggagccaaagaaaggtgagggggaggtgccacacacttttgaaggacgagatctaatgakaactcactcactatacagtaccaactgcggggtcggggggcaggggtggcagtgggggtggttgctaaaccattcctaagaactctgcccccatgatctaatctctacctcccaccaagccccacctccaacactggggattacagttccacatgagattcgggcagggacacaaatccaagccatatcactaaccttatctaaatactggccaataggataagcaaaatcatttttatagcttctttcaaaaaatcttatgtattaaaatgttgaaatgtataagaatttcatcaaaataagaacctcaccagatctgacccaagggagagaagattgttcaataaaaaattacaaatggatgaataaatgaatcctctcctttcaagttctgtgctccatacaacaaatctagatgggtctcatttagatgggatttagagacacctttcttaaatacctatcattttacgaatgaagctgttgtctaaagagtcctcttggccacttcctgaaaacaaatcaattatttgtgataactctcaaatgtcctaataatcccatggaaaatgtaaatgtaatgaggaccaagaattataaggtaagaagtgctaatgtcagatttttacccactacataagcccactcttgtactagggcagtgactttcttctttgggtgagaccttgaaatctgggattataattttgaattataattataaaatggtatttggctgtaaattatctcctttttttttctgttcctcacagttgatattatggattcccataaggattcatgtcttctattcactttaatgaacagttgttgggcaacaattctagaagagttccaattctcatcaggagaatggacaaggtggagaagcagagaaaatgcaatgagtagaatgtctaagtcatcactttggaattgactgaacataaataaaaatgagaaagatacgtaaaaaagaagggaatgggtaagcagggtgatgtctgggagaggaggggctccatagccatgagagtcaactctgtaacaccctatagggttacaacactgcccttcatatactgaggtagcagcagggaaactttttaattattagaaatattgaactttgcctcccacccccaaacatttttctcattcagttcctgttcttttttatttctgtaatttttactgtttcaaaaatgatcttttttctttcggaagaagcaattcttcaaatccagttcacataaggggatttgatatgttcaacaagctccaaatacactgtatccagcaatacctactacatgcctactttgagctctgagcaacctgcacctcaagcctagttctcattgttttgcttttggcaaattttcactaagtgcccttcctccccaaacacacgtatatgtctaccagaccctaaagccctttatgaacatgcaaactcctcccttctgaaaacctttgcgtgagtggtcagcaggctaattcatccattgcaatgtggctttgtgttagggttctgtttccgtgctgcctgcaagataatcacagatgtgactgcatcttagaagttcctgaatctttcaagacagtctggttcaaaagaaaattaaaaggtggaggtcgggcgcggtggctcacgcctgcaatcccagcactttgggaggccgaggcgggcggatcacctgaggttgggagttcgaaaccagcctgaccaacatggggaaaccccgtctctgctaaaaatacaaaattagccaggcgtggtggtgcatgcctgtaatcccagctactcgggaggctgaggcaggagaatcgcttgaacccgggaggcagaggttgcgatgagccgagatcgtgccattgcactccagcctgggcaacaagagcgaaactctgccacacacacacaaacacacacacacacacacacacacacacacacacacacacacacacacacggtgtagtttaggaagtaaaaaaaaaaaaaaaaaaaaaaatcagatctcccctcacacctcagatctgaaggcacaaactctagggccagggcgttcgcctacccaactccacatgcacttgcaggtcacctagcactcaggtacctagcactcaggtacattgtggctccttacctctcacgacagcagcaacaacgttgattggaagtttatcactgtgtgttacgggccatgggccatgtgtgttagaattttatgtgaaattaacatttaattctcacggacacccctgaaacagatgccacagcccccattttgccaacgaggcagctgaggttcccagaggctcaataccagcaccatgagccgcagcacgcaaggcaaacacagccggaggtgagcacatacctgcttcgcaccccatgcgcctaaccacaaggttccctccctccaggaaggccgttgtcttccctgggacgacttgccagctctgaggcatgacagtacgggcccccagaagggtgaccaggaggccctcctcgtcccagctgccggcgtcgccgcccactgcagggcccgggctgtgactcgtggggacggttccctgcgccccggcgggggaggtgggcggggaggggcggcggggcccggggcggggctcgggacggccgggctgggagctggagcccacagcgggaagcggccgccgcccgggcctcgcagggctaggcgaggcgagggggggcggggccgggcgctacgggaaggggaggccgcgcggaccgggagccgcaccgcccagccggctgcagcggccgcgcaccaaggctgcgatggggctggagacggagaaggcggacgtacagctcttcatggacgacgactcctacagccaccacagcggcctcgagtacgccgaccccgagaagttcgcggactcggaccaggaccgggatccccaccggctcaactcgcatctcaaggtgaagcccggggcgggcgggcccaagtccccgctgaggccgggaggtgcgggcgcccctcagccccgccctaacccgtcccaccattgccaccgggtcggccccgcagggtctgagacccgcacccttccccggtcccacccgtcaccaggccgcccgcgtagccaggaattcttagccaggttcctgtgcgcccaccgtgaccctaagagaagaggcggacgccctggcacgtccttccctcctgcttcccccgcccaaagcgctcccggttcccggggcgtcaggtyggctgacagttcggggtccctgcgtcctgtctcctcagctgggcttcgaggatgtgatcgcagagccggtgactacgcactcctttgacaaagtgtggatctgcagccatgccctctttgaaatcagcaaatacgtaatgtacaagttcctgacggtgttcctggccattcccctggccttcattgcgggaattctctttgccaccctcagctgtctgcacatctggtgagacggggcacaccgggtgkaccggctttctgaaacatgggcatattctccgccacctgccccctactctcctcttatcccaggccggcgtcaggaggaggaacgcgcatcrgttcccaagcagtaggaagaactggaaggccttgaaaggcaatgcgcttcctttagaataacagtttgggcttggagtttcaacaggagaaagaatgtcggtctttcctggggtgtgattttccttgcatacataaggctgggctgagtgtggaggcgggtacctggaagccacacttcttaccacaggctgctctcggggccctgttgtgactcgtacctgcggttctgggcaggactcttctttctttcattgccttttattcagtcactgcctgtgcttggggtaaaacaaaagtgatctctgagcagaatgccgctgacagtagaattggatgaggatgtcagacctggttaagcagtagtgtggaggggctgcttcaactttgcccctggcagatggcaaggatgggacccagaggaaagggaggtgtgtgcagttaaggcgagggtcccccccagtacaaacgaatgaaaactccagctgcgggataatgaatgagaaggcctccaaattactttttcactgatgaaacacaaatggaagtggcatataattaaaggggaaagaaatatggaagcccactgtatattgataggatattttgagtaactctattcatactcaaaatgtgtcctaaactgtagagaactttcttaagcatcttttaaattttttatggaaaatgtcatattttaccaataaatgttgttgtgttagaaaatatccactttaatctgagaggaagaatattcagatcatccccagtatcacaacagttgtcacgctagtgcttcaggttagtcctggtgaaaggtataacccaaggtacctccgtgtctttcttacaccttttatgatattgccacaccctgataaatactcggtgttcattgttagaagttaccaatttatcctttatttctctataccacctgaatcttaatttatttagtcagttagctagctagttagttcaacaaactttaaattgattgagtgcttagtttgtgctgggcactgggccaggatgaatgagagatagggtctgccttcagcttactcacagccttatcagggcagctggctaggtacagagatggacgctgagaaaacacagtcaactgacaaagagggaggaacagacaaggctttgaagagkgaaaggagtcgaaaaagactttgaaaggataaatgaaaattcaccaaatacgtaaaggatacacaaagaacaccaatttaattttatcactaaaggttgtaaacaattaaactatgttgaaggtgccaagattgccagggaaatgaaaatgttgccttagtacatgatcagcttcatgaaggtcaaatggatagttatattctgacatttgcacttgaattttttttaagatccctgagttggcacataagatttgggattcccaattaactaaaactaatcatctaacctctatgtcagttttctcactttcaaaactgtgaaaaactgagtgaccgcatagcatattgtgaaatgctgactatgaagctatttggaaatgtgaagtaccatatttatagtcaacaaagctaggcttcccaaagcttttgtgaaagaatttgaaaaaaaaaagtttctcatttactaagtggtggaaagatataagtaaaactacaattaaccaagcaatgcctctctccagctggctcttctgagaatgggaggtgtttttgtatagtgcttcaattggtgaatcatcaatgcacctttttttagccacataaaatgtattatttaatattatttaacttcagcttgtttttttaactatatttatgtggggcattaatatttaactrtmaracatttgtcaccaggcagctgtgattgcaagtagaggagtaatttcaaacaagaatgcttaaaagttagctatgccttgataaaataggtttatcattaatagattgcattcccatgacatgataagaccagatcaaggacagaccttacagaattgcaaacccatttgggcaagctttttttgttttgttttctttttatatatattttttaaagcaggggcttgtgtattgtttttaccaaaaagttagtggtgaccaaagctaggaaaatatgcagtagtggaactttgaaccatgtcacaatattaaaacaggtcagattttagatcctttaaacaaacaawcaacaacaataaaacacagaagtctggtggtgttggatcctagaccagaagtacgggccattaggaatcagtgaattagttggattccatactacagtcagacagagatagctgctgtttgttaagcacaggttattggtcataagtggatcataaccaaagaaatgtggctggagcacccatatcccttatttttgctggaatgcaaagcaaacaaatgcccaactgatggaaatgcgatagtagcaatctcatttctagaagacagttttcatacagtaaattgctatgaatgcagtctgcatgactctacaattactacaacactaaataaaagtctctatcctatggccttattatccaaggatatatattatccaaggaatatataaccttacatatattaatatatataatatatatatattataagatttacttaagaagtattggccacattcagcctcaaccaaattttgggtcaatcagaactgcctggagtttcagaagctaaactatttgtgatgttgagaacccaacttaagtttgatgtcggaggatcattagattctctgctccaaaatgagggaacacaagtaaacaaaaataaaatccaaatgagttaacaacaccctataaactgaactcctcgaatgtgggtaactgctttgctgaacaagaagattcacttttgacatgtgctaaattcccttttaggacatggagatctaaggagtcacggagatagaaaatttgttagcctaaggaagaatagaaagtacattgtattctggctgggagcagtggctctcgcctgtaatcccagcactttgggaggccaagctgggcagatcacttgaggtcaggagttcaagaacagcctggccaacatggtgaaactctgtctctactaaaaatacaaaaattagccaagcatagtagcaagtgcccatgatcccagctactcagggaggctgaggcaggagaatcactygaacccgggaggcgaaggttgcagtgagccgagatcacttcactgctctccagcctgggcaatagagtgagaacctgaaaagaaagaaggaagggaagggaagaggaggggaggggagaagaaagagagaaagaaagagagggagggagggagggagggagggaggaaggaaggaagggagggagggagggagggaggaagacagaaagaaaaagagaaagaaggaaagaaagaaagaaaagaagaaagaaaaaagaaaagaaaggaaagaaagaaagaaagagaaagaaaaagaaagaaagagaaagaaagaaagaaggaaggaattctaagtgaagtggatttggttaggaaactttctgatctaaacttcagccttttaataggccaatttgaggtcatcttgttatagttattttcattatatattctgccttcaaaataggtctatttattatacattataatgacagcatcatacaggcatttcaggggtacataataaatgtcaatcctcatagccagttctgagagatctcctggtgtcactttaatttgtagcaacaygcccaagaccacatatcaagtgagaaatataatagaataataagtctaaagttgccatcattgaggtttctattcagctatttatctctgaaacacttagtaattaattttcttattatataaaagtgtttcatgtatttagcacttgaaataaaacacaatttgtggagacagtcaatgtgaataattctatattctaaaaatatatcaatcaatcagaaagctgcctaatatttccttcattttgggctaagtacagcagaccctcatttaagtcatattttaatagcaaaccaagaaaatcagcctactcccttatgcccacccaggtaataataaagcttccattgaggctaccagcagtgcctgaaaatctcacaactacttttgtgctcagaggacattactacaacagagaacattatttagaaaattacatataaaattaaccatcctgaggactataaggatatgcagctatgttaggaacaagtgtatgaaaaataacaatttcaggatagactagttttcttgtgtaaaagttctaacatcatttgcagggttctttcaactataccatacagcccttttcagtgtgtgtgattactgtgaaaaaattaaaaaatataaaacatagttaataacataaggcataaaagaatgataaatttatgttagctcaaccatttactaagggtcaaggatgtcctcactgtttaaaaaaacttaaacgctagtaggaaagacagaaatacagcatctatttataataccttttgatacatgtgaaaattaagaagtttgtttcagtactttagaaatacaatgagggaatatccgatctagcctggtccaggaaaagggaagaagactgaggcagcaggaaaggctatcaggaagtaaaccctcagggaagtgtgaagacttaagcaggttaatgttaactggcagagaccaggtagataaagacatggttttatttatttttgttttactgtttcagatagcatgccaccagtagaaagaatattagtgtttattatctacatgactatatttttaggcaacatattttttgtgcatcttatcactttagtccatttgcattactatgaaggaatacctgagactaggttatttataaagaaaagaggtttatttttgctcacagttctgcgggctgtacaggaagcacagtgccagcatctactttaggcaaggacctcaggaagcttccacttatagtggaaggagaaggaggagcaggcaygtcacatggcaagaaagggagcaagagagagaatgtggaggtcccagactcttttarttaatcagatctcaagcaaactaactgagtgagaactcacgttaccaagagggtggcaggcactaagacattcatgagggatctacccgctgtgatccaattatccccactcggccccacctccaacactggggactacatttcaaaatgagrgtcagggggacaaaaaacccaaatcattatcagtgatcattgttcatttatttgtttcaaactctcaaccaaatttaagtaaatgggtcagtattttatcttttcatwcatgtacaagacagaccttatttggtaacagcaacaatcctcacacatctctcttccttccttccaggattttaatgccttttgtaaagacctgcctaatggttctgccttcagtgsagacaatatggaagagtgtgacagatgttatcattgctccattgtgtacgagcgtaggacgatgcttctcttctgtcagcctgcaactgagccaggattgaatacttggaccccaggtctggagattgggatactgtaatacttctttgttattataacataaaagcaccactgttctgttcatttcctagctgttctaattaagaaaactattaagatgagcaaccacatttagaaatgtttattgacaggtcttttcaaataatgcttttctaattaatagccaaagatttcatatctaactttgtaaccagaattatacagtaagttgacaccacttagatttaaaggcagacagttttgctttagtacaatagtatacattttataatgatgaacttataatgattaagggacatttctataaaaatactacaatagttttatgcacaacttcccattaaaaatgagatttcttatttgtttgtctgtttttactctgggagtaatactttttaaattacctttacatatatagtcactggcatactgagaatatacaatgatcctggaaattgcagtaacaaaagcacacaacgattatagtaactataagatacaataaaacaaataaatatgaaagtagattcatgaaaatgtattcctttaaaatattgttttcctacaggcctatttaacaagatgtttcattttactgtatattttgtagttaatataaatgttgctctaatcagattgcttaaaagcatttttattatatttatgttgttgaactaatatatgaaataagtaaatgtagctcccacaaggtaaacttcattggtaagattgcactgttctgattatgtaagcatttgtacatcttctttggaaataaaagataaaagagcgatacacaaagctttcttttctaacttttccaagcaaaatctaaaatgttttatgacatttttctggctgtgatcttaaaataattcatatctaaatagtattttgtctaggagatgctttctctctagtagttagaaattaaatctgtgtcagcattcctattaatgtctcactttactttcaagtaatattggtgctatttaacattttacagtaaatgttacttctgatactttagtacaatttcaactacagtgattcatgtagagagacaggggagttgtcaacttgggctactgaactacatgcataaactaaaaactaacagctacaaacttttaagatttctctaatattggtatgtaacacaggataaagttattcttgtcattttgaactgtagagtcctatttcagtgtgatgaatcactgttgctttgaaaaatctcattatttctgggccgggcatggtggctcacccctgtaatcccagcactttgggaggccaaggcgggtggatcatgaggtcaggagatcaagaccatcctggccaacatggtgataccccgtctctactaaaaatacaaaaaaattagttgggcatggtggcatgcacctgtagtcccagctacctgggaggctgaggcaggagaattgcttgaacctgggaggcagaggttgcagtgagccaaaatcatgccactgcactcccgcctggcaacagagcaagagtctgtctcaaaaaaaaaaagaaaaaaagaaaaaaagaaaaaagaaaaatctcattatttcaaaatgatagacatataccaaaaacaagtctataatgtgagtagttactaaaatttacacatcttaaaagtgtgtaaatgcttaaatttcagaattaccatcagaacctcaattgacattcctttgaatasgctaataagtgacaaataagattaataagatttttcaaaatcgccaggactggtgaatataaatgatgattgaactggaataatattggggaccaaatcaaatgaatgattaaattatgaagctcatatccttttgaaggtagttgcaaagagacatttcaaaactgccctaggccattgcagcatccttagatgggacgcataatcattaccttaaagcatcaccactcattttgaccatatagattttattatgttagtttaaaaggtcaatcagcctcatgactttatagttatgtcttgtatttaaaaacattttttatacatttggttatgttgataaaccaaaaacatttgattaataaaatatctatttgaataaattatgagctatcctttcaaacagctattggcaagttttaaacccaaaatatatacacatagttctgtaataaaactgtttgacttctcaagtaacatgacttccttatttctgaacagtactggttactttcaaaatgaatttttattgagattttccattaactatttttttcaaagactcaaattttgtaccaagtaaatccaggctttatgtacaaacatgttgtttgttttatttggggctgggggaggtatatgatgagcagacttctcggaattcataataaattttctaaaagcctacaaatgtgtgtattgcttttattacagtaaatatggaatctttcatacttatttttaccttattaaaaactcaaaatagataataaatacattagttattgcttatttgggaatgtatttttaaaaattattacattagtagttgaattctttgttttccagcacttaaagaggttccatataaatgttctatcatttgatgaatagtataaaatagcctgttcacacacccaccatacttcttcttttttatagtctcttcttgctaatcctaaataaactgaaatttgtttccaatttttaaaataagaaagtaacaatataaatcacaggcacttggatacctgtaccatgaagctagactagagtccaaaattatttttggaaagtgagtatgtgaagagtagttgctgatgttggcatacattttcttgtcagttcatctggaaaaacgaccaacctataataataaagcaggtgcttggctttttaaaatgttctttatagttttcaggaacttttaaaaattcatctttttgatagtcatccacatcccattaatttattttgatgcctctcttggaaagttgttggagtgtagtgaaaaaagccctgccctagaagtcaggcaactggattccagtctcagcattgccgttattgaggtgtatcccttcatgcaaagggtttaatcttgggttctcagttttcttatcgttaatgaaagaattgaactaaatggtctctcaggagcttcctatctcattgttttctgtgacttcagcaggatgaaaacttggctatgtatatgaaaaccaacctagctgtccagtccaaaaatatttttttaaatcagtgaattttcaatcaattacaggataggtgtgctataaatacaataattaatgcatgtacttttcacccttctattgattgtgagactgtatttggcctcaattcattaaaacagagatcctaagatttttatcaatgctaagtctttattattatgaatttctgaaaaaaattatatcttaattagaatttgcgattgaacctttaacaacatggggttgaactgctcagtccacttatactcagattttttttcagtaaatacagttagccttccgtatccacaggttcctcatccaccatcaaactggatccaaaatagagtattgcaagatgcaaaaccctcagacaaggagggctgacttttcacctccttgggttctgcagggatgacgggatttaagtatgcaaggatttttatatctgcaggggaattctagaaccaatccctcaagggtaccgaggaatgactctatttcattttaagattttctgtcaaaatcactgctatgccccataatcactgccatctttctcttttgcctggctatttgccacagcctcctaactgacctcacttcctgccttcaatatgatcaccaatccatttttctcttaaaaaaaacgtgattataccaagactaccctgtcatttccttgcttaaaactatcaattgtatgtgattgccctgagaataatattccaagttcttgagcagcatatgcaaggccttcgccatcaacccgttgtcatcgttagcaactcttctgtagctttactgaacaacccgtgctactcctgtgtacccatgccagcattgtttttcttctcatgcctgcctcactcttatctgtttccaaaactcttccacattaagtgcctcttctgtgtctacatctaaaatgttgtacaaattcctattatcacctgtcacgttgtaaaagtaaccctgttaactaataccattagactgctagttaggtatttgagaaccaaaaacatcacttcacgtttgctgggattctgaaatggtgcccagtgcttaatgagttccatcaatattttctgtatgaatgattatgtaaataaataactggagaaagcttgggataattgcagaactgagagtgggaattgcacaaaacttcataatttcttctttacaaaagggatttgaaatgtactgattctaataaaaatttccttcccaccattttctcactcatgaatcattaagttgagaaaacaaaaacgtatataaaccattttatattttatcgattggggtaatgcctgcctttagtctccattctcgtatctaaaatttacttttaattcttcaggggtagaaagccctagcatttagaaacttgtctggaaacacactttcatgctttctagaatgttgctatttcatttactattctattcctcactttgaaatttataacactgaaagattgtttctttgggttttacattttagaaaacacattgtctcatctgaatcccaggacaaattaaataacataatggagaaatcaaacaaataatagcttagtttttctagcttgcaactttatcattttagaatgtttgtttaagataacaagtgcttacagaatttttacagggttacatgttactttaagaaacttaaaaaaatagtaagtagagctgcaaagaaaaattaccacaatgaacgtaatttatcacaaatcaggatttggtacacttcttcccttcaagttgtgtatgtgtgcagggaagacaggggaagaagttgacagaggaggagtaaaggatacaggtatactagatagtcagtttatattttttaggaataaaaataagtttggcaactataatttaaccatcccaatttcytctccctattcaccccaaaatagcaaaatgagcaaaataaagcaccccttgctaaatttttaagacatttctgtgcccactctccagtttcttgctttggattgtacctgaaatgctgccattggaacttgacatcttgatacttttttaagtgaaacacacccttgagtggggtaacatttcaatctattagcagtcatctatttactttaggtgaacaagtgatctgagaaaggagtgttgaaaactacatatgggaaccaagcataagagctctgagcacaatatgagagcaccatacactgattaaaagagatgtcaccaaagagaaagctgtgacaaagggaaacaagaggctccaatcacatggccttcagccttcccagtttcgcttttggacaacccaaatccctagtgaaaggggcatggaatctgaacaggagtgsaggaaattgaagtcagctaaagacttttctttttatccacaaaggaaagttgcttttgtcttactgaatgaataggaccctaggagtgggcatgagggctctgctggaaccatgtgccctaaagacaatgccgaagcgtgcaactgaaaatgaaaatgaaactgtaacttgtgaccatctatctgtgtcttctttcgccttgcctctctgtgctgttgactgttgcggcatgtctgcggcaaagaaagaccatgctgcagtcagagaaatcagaggacaccacttcaacaattaaccaaaaataggacagggacacctatctgcctgtgcttggacgtattaggtcattcagctcagctgtgtgactggagaaatcattttgcctttataggaaaaggtaggggtgtaggatgatgagagaaaggaagagacatgactcagagtgggaaacagcacgtagccaagggcaaatatttctctcagacataaatggatcaggaagaggtgagagcagcaggtcatctttggagcattcttttctttcctgcctcccagtcacttgtcaccgagcaccaaccagtaacaaaaggggagagaagggcagtatgcaggacctgtttctctaactgactggcacatcggttccagccaactgctgtctcagctaactagggcagtgaaacaaggagtcatttggaaagtttcagggatgcacactccacatcgcagggaggcaagtggtgaggaataaccaccacgcttattttactgaggaggaaactggttgaaattctttatgtattatatggctgggagacctctgatctcagtacaaacaataacaggagtatttagatttgtcgagcacttataatcttctgggcatttacttaatcagtacaataaccctacgatgggaatgttactgtcattcccatttttcagataatgaaactgatgctgtgaagttaaagaatttgccctagaccacagtcaggatgtgagccaagagagcctgacatcagagcccacactcctaatcactgtagagatgattttctatttcctgaaagaatgtgtccatggctgttcttatggcttccagccaaaatcttcttttttcattcatccacctttcctactctgagaagcacctttttttccattctcccatcaatggaggcagtttcatgtcctcagttgtaagagctgtcccaagctagcacytgggcttcatgtaacctcctcactcggcctccatctaatccctgaacccctcccccagccctgtatgccgcttttcagggcacaccctttctttctccttaggatctgagctctagaccttacactccagctaaagtcagaaaaatagttcccaaatgccattattctcattttttgtaaattttgtagcattttattccttcacacagacttccctaatatgtatcaaaagcccagtgatgatttttcttctcaatgctaaacatcctgacatgtaaaatattaataattacagcaataatttcagtttggactaaacatattgttttctagacagaatccttattttgtattttcttcattttgtcggaaatttcttgtcagtttgtacatccttttatgttatccaattttattgtcagttactttgtcttggagatcccagggaaaaccatatatgaatttattttctcctattgaataatttgctcattataaattttatttattttattttttagagacagggtcttgttctatcacccaggctggagtgcagtagtgcaatctcctaggttcaagtgatcctccctcttcagcctccccagtttctaggacttcaggtgcataccatcgcacccagtttctacatattttctcacaaagtgacagtggtaaactgatcagtatcaaagtcaagaattagattgaaaaaatgggaaatcatgacactagaatacataaaaagaagcataagatgcaaccaaccctttctctccagttatctgtagcctttttggggcagacataggaatagcacacattattcagggttaggtaacataaacaagatgaaaagatccccacagaatttcttgtctattcaatcaatttcacatgttgtatgtgcaggggccacgcaggggatgggatgggtggagtgaggggcatgatgaaagcactggaaataaaacaccaaaaaataatttgttatcatatagaataaccaagtgagcaatcaactgaatcattaatatacattttatttagacgaggaaaatcctatgattattacaatttttaaaattagattgctaaaaaagtatcagcattgttggtattatttgtcctggaagtgattgaagggtcctaggaaaaaaaataactgtgtaaactgatttttattaaaactatttttttggccgggcacggtggctcaagcctgtaatcccagcactttgggaggccgaggtgggcggatcacgaggtcaggagatcgagaccttcctggccaaaaccgtraaaccccgtctgtactaaaaatacaaaaagaaattagccgggcgtggtggcaggcgcctgtagtcccagctactcggaaggctgaggcaggagaatggcgtgaacccaggaggcggagcttgcagtgagccaagatcgcgccactgcactccagcctgggtgacagagcgagactccgtctcaaaaaaaaaaaaaaaaaaaacaaagactatttttttttttttctgaggaaaagaaatcctatgtggggttatcctaagcaacaatcttatttgactaggcacaca

SEQ ID NO: 17783 - DNA, 64146 bp, Homo sapiens
caaactttgatctggctgacaccaaggatctgtgacacagttctgctgagaagtctgacagctgctttgctgaaaatgtttgtggctctggaccaggctcagaatcagtacaacctcatctgtcatttgtagtgtaagaagggtctgagcctcagacccaggacttgttgcctgaattcctcagctgtgcttttttctcccacacctttccacatgccaaccctggggatctgcttaactctgtttttgccccctgtggctgctgagcagaactacctctgtactttgtcctcaagcagcaaagtcccacacccaagcttttgtggaagatgccaatgataacattagcaggtgaagcccaaagacagcattttggcaaggaggtgatattgggataggataatttttcttatgaagtgtttgagggccccagtggccatcaggtctcctgatgagttggaatagaggcaaagagtcacaaatctaagtcttcctccctctttagtgagaatccacagtaggtgcttgtaatcccagctgaggcaggaggattgcttgaacccaggaggcagaggttgcaatgagccaagatctcaccactgcattccagcctgggtgacagagtgagactctgtctcaaaaaaaaaaaaaaaaaaaaaaaaaaaaaaaaaaaggaaaagatgagcctggaatatcttgctgtgccaggaagtaaggaattgcttaaggattgagggggacatgacaaaaggacacagaatccagtcattagaagataatttgagcaccaaagtaaataatgttataatggattataacccattgaacacaactgaattcgtgattccgtaatgatataaataaatacatgaatacattaaaaacttgatgaggaatatatagttatgtagtatcaagaatctgcccacaaagtatttcttttttttttgagatgaagtctcgctcttgtcacccaggctggagtgcaatggtgcgatcttggctcaaaaatcaaagtaaacatcaaccatcatggaacagattgaaattatttgtcaccagatatgatgcaatgagaagtcaaagcatcatctgtgatattcctgccaaatctgcatagtcaggatctgattatgaagaaacatcagataatcccaaattgagagaaatttttaaaactccaaacctatgcttttcaaaagtgacaaggtcaaggaggttgaggaaagactgaggaactgtgtcaggctgtggttgactaaggagacatgacaactagttgcaaaatgtgattcaggattctaaactggattctgaaatgaatacaatgaatatcattgggacttattgaggaaacactaatggaaatgaggattagatggccctaatgcatcaatgttaatttcctgaattttaaagttatattttggttatatagtcaaattgccttgcttataagagctatatactaaaatatttcaggtttagaacttcaggtccaaaattactctcaaatgttcaaaatagagaaaattctctgtttgtacctccaactttttattacatttatagttattaaaattatataaatataaaatacatatgcatttgtgtatatatgtgtatatatagatatgcatatatatagatatgcatatatgtagataagtgatacacataaaaccaataatggactcatatctaatctatgcaagcccttcacaaaagatttgatattgccaaaggacatttgaaaaagcacccggcatcatgaaccttcactgaaatgcaaattaaaactacaataagatattattacacacacatcaaaatggttaaaatgaaaaaagacaatatgctaagggttggcaagaaagagaagcagctggcactctcagtacaattgtaaatttattaaaccatttggataattctttggcagtcattaataaaactgaacacatgcacatgcagcaattatgctcatagttatagcaacagaaatccttatattgggataacaatgtattagagtaataacagcattattcacaatagccacaaactagaatcaactcaaaagtccttaacaatacaatgaaaagataaattttggaattgttataaaataaaacactctaaactaacttacgtactgctatttgtgacaacatgaatgaatctcacaaacacaaaattaagtgaaaatactagatacttaaaaatacataatgtgattccatttatattacatttgtatgcctcacaaacaggcaaaactaacctatggcataatactggagttatctagtcggggaggaaggtaggaggagacataaagggacttctggggtcctggcaaaattatttttcttgacctgtgtgttgattacacagatatgttcaattcatgataattcattgagctatatacatttaggatgtttccaacattctctttgtatactacactccagtgaaaaggtttatttaaaacgaagcagtttgcattcacaatttcacccaagctgaggtttgcattactctctcactgtggagggcttcagccaggtgccctcctgaccatccatttgggcaatgataggaaatctctgcaatgtgagaatcactgaactgggaattaaaacctggattcttaaaaaataaagattatgtactaatgcactagcgaccgttcacctcacttattcaccaattccttatttctaataataaagtagggattaggctggtggatctctgagatctcttgtctctaattatctatgtttctttcattctttgaaaggaccaggcagaagtctcaacagaaaggaggaacagagacccatttttcaagaaataaagtgattgttttaaagaaaggcattgagatcattttatctaaaagaaggtagtgcacttcttttagagttcagagctatgtgagccaagcagtaaaataactatttttctttgtctcagataaattattcaccaaaacctcgactgactcaaattctaaaggttacaaaaccacaccctaattgtaatcaacctatgttgcaactgttgagttggttaatgtgtatttgaaagtcactgattatcctgagtagtgaaatattgcctcatagtacatggtaagtaaatgttggtgactctagttgaactgaatttcttgcttggagggaatgatgtcagagttaggagataggtttccagcctcagccctatcattttcagcctctgtgtccttgaacaaaatactgaatctccaaggcccagcttccttacctctaaagtggaaataattttaccacaggcaagggtaattgagagaatcaaaagagttatgatgggtataaaaattctctgtgaattgtcagaatccctgtaaacatgtttgataaaacattgtccatatgggatttgacaaaacttaatttttccttactgcagttagaaataactgcactaatccagtattatttccaatagccaggatgtagaaacaatctaagtgttcattcacaaataaatggatgaagaaattgtgttttatatttatatacacaatgaaatattttttaaactttaaaaggagatactgccatttgcaatgacatggaatgaacctgaaggatattatgctaagtgatatgagctagatacagaggaaaaaagattgcatgatttcacttatatgaagaatctttaaaaagtcaaatacatagaaacagagagtagaatggtggttaccaaaagtgggagccagaggaaatggaaaaaagtgtgtcaaagagccaaatttgtggttagataggatgaataagtctaaagatctaataaacagcaagaggactatagttaatatactatactgaaaatttgctaaaagagtagattttaggtgcttataccacaaaaaagaagttaattatagaattgattaatatgtaaatttgtttaaccatagtaatgattccactgtttatatgtctaccaatgttgtataccttaaatatatacaatggaaataaacaaataactgtactagtcatttagaataccacaatgacatctttacagaatatgcctttgtacaagcattgccattagtgatctagaaatgtatgtatcattttagtgatatatagagcctcatgagcgctaaatgtcatctccagttcaggtctgcacaactgtgtttgttctgtgccatgggtctgtttaatgatttccctacctcccattcaccactgaagcacatgcctgttgttctgcctataattccccttccttgctgtgcaatatttcattccattatttctgacacagaccaaaaaagcaatagaaacagcagtgtctggaggcaagtgggagctggagaagccatagtttctgagatcttacccacttaattctctgagattggctctttcctcagttatactgagtaggtttcagctcttcagtgacagagaggggagaaaccctagcttttatttcttctcttgagaatgtacaaccctgttattttgtgaacagtgtggtgtagattcagagtgagaaatgtttttaggatttattttattttgctaaaactgttctcaaggcagctctggtgtaagtgagaatataccacagcgggcgtcagaagatctcagttcaaatcccagcctgccatttatgagctgtgggacactggacaggtcatctgttctcctagagtctccctttccccatttggaaaatatgaaataatattctcagccgtccagtgtttttcacggggtttaatggaaaaaggtgtgtatgtttacttagttaattgataaccggtttagccatttaagatgaatgagtttgttagctgctttatgtttaggcagctgtaatgttagtactacattaaaatatttcaaaaggatctcattttcaaggaaaatgatctagtgtttgagaaagcattatagtgttgcagtcttgcagatccttagctcagctaggtccgagttgtcttatgcaggaagaattaggcacacagacactggagagtgagtggagtagaatttattaagtgaaaggaaaactctcagcaaagagagaggccctgaaagcaggttgcagattgccacttcacagttgaataccaggacttttatagaaaagctgatgaggctgggatacttatttgcataaggcgtgaattcctggtgtttccaccccttccttccattgcgcgtgtgggctcttagtctaagccactccatattgatttatttcccttcctgcgcatgtgttaaaggtaggaatttttcactgtgggcatatttaggcaagctccctgtgcaagttcccttatctgcacaaaacatctagtgtaagtacttggggtttttgtggattgggcaatgacctggaagggttggaggttctctggggacccttcccttactgcctgcctaatgcaagctggctaactcctctcaataggataaacattattttatgtacaaggaatataatacacagattgccctcaaagtcatatttccaactgctcatcaatctaaaaatccaaaattttgaataattttttgatgaaataatttatttcattgtttctcaattttggctgcacagtggaaccacctgggctgtttgaaaaaacctaggcctagccaggcacggtggctcatgcctgtaatcccagcacttagggagaccagcctggccaacatggtgaaaccctgtctctgctaaaaatacaaaatcacctgggcgtagttgtgcattcctgtaatcccagccacgccagaagctgaggcagaatcgttcgaatccaggaagtggaggctgcagtgagttgagatcttgccattgcactccagcctgggcaacaagagcgaaactccatctcaaggaaaaacaacaacaacaacaacaaaatcctgggctctgcttcagactagttaaaccagaatctccagggtggggcaccggaaagaacaagaaaaaagaacaccttatttttatcttcttcagtgagccaatgttcattcaaaagagagattaaagtgctttttgctgactagtcacagtcagagtcagaatcacaggtggattagtagggagtgttataaaagccttgaagtgaaagcccgcagttgtcttactaagaagagaagccttcaatggatccagctgtggctctggtgctctgtctctcctgtttgtttctcctttcactctggaggcagagctctggaagagggaggctcccgtctggccccactcctctcccgattattggaaatatcctgcagttagatgttaaggacatgagcaaatccttaaccaatgtaagtatgctttatgttcctccagtaatgtacaaggtgtatttaacctcacaattcttaaagttttatttcattttaaagtgataaatgataattgtatatattaatggggtacaatattacattttgatacatgtatagattgtgaattgatcatatcagggtaattagcatatccatcatctcaaatatttgtcatttctttgtagtgagaacatttaaaatcctcttttttagctgttttgaaatatacagtacattaatattaattatagtcaccttgctgtccaatagaacacccgagcttattcctcctatctaagtgtaactctgtacctgttgaccaacgtatccccttatttggcccatctccacctgccagcctctggtagccaccattctaatctctacttctctgagtttaactttttaagattccacatagaagtgagatcatatatgatatttgcctctctctgcctggcttatttaattaatatgatgttctgtagattcatccatgccgtcataaataagaatattttttcctctttaaaaggctgaatagcatttcattgtacatatatgtcacatacaaaatccattaatttattgatgaacacttaggttgtttccatatcttggctattgtcaatagcactgcaataaacatggaagtacagacatgtcttccacatactgacttcaattcctttgggtatatactggtagtgggattgctggatcatctgatagttctatttttgttttttttaggaacatccatactgttttctcaaatcacaatgctaatttacatacccaaggttcactttattccacatctttgtcaacacttgttatctttttatctttttgataataataatatcttatctatgagttgtgatgagttatctcattgtggttttaatttgcatttctctgatgattaaatttgttgagtatttaaaaaatatatcttggccatttgtatgtctttttttgaaaaatgtctactcaaatcctttgcccatttaattaattaattaattaattaawagagacagggttttgctctgttgtaggatggagtgtagtgatgggatcatggtccctgcagccttgagctcctgggctcaagccatccttctaccttagacccccaagtagctggggctacaggtgtatgccaccatgcctggataattttttaatgctttgtagagatgtggtctcattatgttgtccaggctggtcttgaactcttgggctcaagcaatccacccacctttgtctctcaaagtgctggaattacagacatgagccattgcacttgacccctttgctcgttttaaatagaattatttatttgttattgagtaatttgagtttctaagtattttgggtggtcagaatctcatttgtctagttttgctttcatggcctgtacttttaggatcatatccaagaaatcattgcctagaccaatgtcatggagtttttctatatggtttctttcagtagtttttagtttcaggtcttatgcttaaggctttaattcattttgagttaattcttgtataagggtgagattaggattctcttttattctttgcatatgaatatccagttttcccaacaccttttgctgaagagtgctttccccattgtatgttcttggcacctttgtcaaaaatcaattgattatagatgtgtgggcttatttcagggttctctaygcttttcctttaatcagtgtgtctatttttatgctaatgctatgcagttttgcttactatagctttgtaacatattttgcagttcagtggtgtgatgcctccagctttattctttttggttaatttgctttagttatttggggtcttttgtggttccatacaaattttaagattttttttctatttctgtgaagaatgagattaaaattttgatagggattgcactgaatctgtatattgctttgggtaatatggacatttttccactattagtttttccaatccatgaacatgggatatctttgcctttatttgtgtcatcttcaatttctttcatcaatgatttgtagttttcagtatatagatctttctcttccttgattaaatttattcataagtattttattttttgatgctactataaattaattgttctcttaatttcttttttagatattttgttgctagtgtataaaaatgccactgatttttgcatgttgattttttatccttcaagtttactgaatttgtttatcagttctagcacttttgtactgaagtctttagattttctacatataagattatttcatcaggaaacagacaatttcacttcatcctttcctacatgaatacatcctttcctatacgaatattcctatatgaatattttctgtctttagtctaattgctctgactaggacttccagtactctgttgaacagaaatggtcagagggggcattcttctcttatttctgatcttagaggaaaagcttttagcttttcaccattaaatatgatgttagctgtgggcttgccacatataaccgttaatgtcacatagaaacttctgtattactggaggccagttattaaaggttatatgttataggaacattcctcagcattcctcctgtaccagcagaggctgattattaaagtatgctattgtaaagcaaatacttcctgtggagtatgtttttcttttttgtcattgtcagaaatagtggaataaaataatgcattttgccagaagagaaacatttcaagtggtaaggtagaatcaaaatgataaaggcctgctgctttctttgcttcacagtcatttgctatatttttttgcctgaaggaaaatggtartggaagtgttttgtgattaaagattttgagaagtcagtcactgtatatgctatgtattttgcttagattagccatgatcattaaacgtcttaaaaaagcaaatcatgcctgatgtcaaagaaatatctatgagttcatcataaacataaacgaatgaaagaaagaattaattagtcagggccatctgggtggtaacagaatatttatggcctctgtacaaagctgctgtctgtgacctatgagtgtatagcatggaaaacatttttcctctgtgagatgccacacatcctgatactatctctgttggatccactctccttctgtggtgattataccagtggatctcaaagtgggctgggcagtagaatcatttgggtgatttaaaaaggtgtagattttttagtattgatgacaggactcctgcatcaggatccctatgggatgagctttgcaggagatcctgaagcagtgtcccagcagctgattattggtcaaaatatggacattaggaactgataaactgctcaggctcacagcttgactaagcaggcttcaaatttggaccttctgtttatcagctgtgggacactggcagtgaatttgaaattctttaaaatacaatctgtcttatctgtaaaatagagtaaacaaggtgttgatgtgatgattaagtttaatagcctgcatactacttgcttggcacattgaaggcactgtatatgtgcagctaaaacaataatcatcatctttgtctaaaatatacaaatatttgaagctgtatttgacagaataatcataacaacattatgatgataatatcagtctgaatcacggacaatatatagaccaaatactgagttttgctactatttgaacctccttttctatgtttagttctcaaaagtctatggccctgtgttcactgtgtattttggcctgaagcccattgtggtgttgcatggatatgaagcagtgaaggaggccctgattgatcatggagaggagttttctggaagaggaagttttccagtggctgaaaaagttaacaaaggacttggtaaatgtgcatgtatcgtgtgtatgtgtacatgtgtatgtactgggcagtggctatagggatggggaggatggaaaacaggcttgaagagctcctgggacagaacttgacctgtccacgtggctgccgagtgtcagctctcttgtccttgtttggattctccctcgtagcttctgttttctgttctgctaggaatccttttcagcaatggaaagagatggaaggagatccggcgtttctgcctcatgactctgcggaattttgggatggggaagaggagcatcgaggaccgtgttcaagaggaagcccgctgccttgtggaggagttgagaaaaaccaatggtgggtgacttttttttttcctgaaaaatgttttctaaaatttattttaatttatttttagattgatacataacttttatgcatatttatggggtacrtgtaatattttgttacatgcacagaatgtgtaatgatcaagttaggtgtttaggatrtgcatcactttgagcatttatcatttctatattttgagaacagacctgtgttctagctrtcttgaaataygcaatactttgacattaacacactgctatgttctctaatgacatccctggaaacctcctaggggcagccagatctttcatgatagtggttgtcagtcctcatatggagggtggaggtttgaagsagagagccaagggaggttttgtgcacctatgcttgttgtgtttgtacacaatgactatgcatacgctgtgagtataaaaggctcatttaatcctattgtgtcccaggcttggtttgttttcaaatcattacagcatgaatttagaaggttttgtctcatttttttcaaattattaaagagcaatgtttttcccaaagtgtaattgtgggttatctattctagaacatttcaccaggaatacttgtggcacagacatagtgggaatgacttctttacatcttttgggcatggaacaactgacatgtactttcatttgtttggtctatatttgtacagtcagtctcactaacatgtctgggggtttattctaaggtctgtgtctacaatttctaccataatgatgcttatctatggttttaagagactaggcatctttagtgtagcttttatcaattttaatttccctgttaattaagaagtaattaaaattatcagctggtgttatttaatgttactatttactgtaatgttttatatattttaagaaaatatatgctatagcatagtctttcaatttaaacaaatgccaagttataaaatgtttatttaaataaattttaagtattattaataactctttatcctaccttccctagttgtccattagctctgtattcagctttctttatattttccttcatctttacttgtgtattaatcatgttttttattttctatatttttatgaawkcttcaacatcttggggattttgtggtcctagaagggactgctgctcccaaagtcagacagttcctagagatagcaaatgtcttgtccacagcatgtctctgatttacaaagcacactctccagagccagagtcccatccaccttctttaccaaactctcacacatgaatccaatacagttgtccctccttatcagtaaggcattggttctaggactcctcttggataccaaaatccacatatgctcaagtcccttagatatggcataatatttgccatatattggagaatattgacaatattatttataatatttcccaatattagagaatattgacaagaaaaaaggtccgtacatgttctgtacagatgcttgtttttgctctgaatattttttatttggggttggttgaatccatgatacaccatggatacagagtgctgactatattctccttgtcttaaattattatagggccagttatgggacaactatggccacccctatatcccagagcccacagaaattgttcaaactatctattcccaggcttactcagtctaccctccctatctcactcatttcttcctgtgaaaaccccaatgaargctcagccccatggtttctttttgctcttgctgcctcctgaccaaccctggtacttccccatgtggctccccgcactccatggtgtggagtgcccctcctttaggaaccgtgagtaatgaactatcttttcaagggaagtctgttttggggcaacctgatcggttgacctcaccatatctaaatggatacaaaatcctcggtgaattttaaaacaactggatttgggagtaaaagtttatttatcctctccccatccaagttggactcacctataaagttcttgtcataatgagtctggttttcagcttggattacaaattaccctgatttttattatctccctgatatagtttggatgtgtgttcccattcaaatctaatattgaaatgtaacaaactaccaacagagaatactataaacacctctatgcaaataaactaggaaatctagaagaaatggataaatttctcgacacatacactctcccaagactaaaccaggaagaagttgaatctctgaatagaccaataacagtctctgaaattgaggcaataattaatagcttaccaaccaaaaaaagtccaggaccagatggattcacagccgaattctatcagagctacaaggtaccattccttctgaaactattccaatcaatagaaaaagagggaatcctctctaactcattttatgagggcagcatcatcctgataccaaagcctggcagagacacaacaaaaaaagagaattttagaccaatatccttggtgaacattgatgcaaaaatcctcaataaaatactggcaaactgaatccagcaacacacaaaaagcttatccaccataatcaagtaggcttcatccctgggatgcaaggctggtccaacatatgaaaatcaataaaagtaatccagtatataaacagaaccaaagacaaaaaccacatgattatctcaacagatgcagaaaaggcctttgacaaaattcaacaacccttcatgctaaaaactcaataaattaggtattgataggacgtatctcaaaataataagagctatctatgacaagcccacagccaatatcatactgaatggacaaaaactggaagcattccctttgaaaactggcacaagacaaggatgccctctctcaccactcccgttcaacatagtgtyggaagttctggacagggcaatcaggcaggagaaggaaataaagggcattcaattaggaaaagaggaagtcaaattttcgctgtttgcagataacatgattgtatatctagaaaaccccatcatctcagcccaaaatctccttaagctgataagcaacttcagtaaagtctcaggatacaaaataaatgtgcaaaattcacaagcattcttatacaccaatagcagacaaacagagagccaaatcatgagtgaactcccattcacaattgcttcaaagagaataaaatacctaggaatccaacttacaagggatgtgaaggacctcttcaaggagaactacaaaccactgctcactgaaataaaagaggacacaaacaaatggaagaacattccatgctcatgggtaggaagaatsaatatcatgaaaatggccataccacccaaggtaatttatagattcaatgtcatccccatcaagctaacaatgactttcttcacagaattggaaaaaactactttaaagttcatatggaaccaaaaaagagcccgcattgccaagtcartcctaagccaaaagaacaaagctggaggcatcacaccacctgacttcaaactatactacaaggctacagtaaccaaaacagcatggtactggtaccaaaacagagatatagaccaatggaacagaacagagccctcagaagtaatgctgcatatctacaactatctgatctttgtcaaacctgacaaaaacaagcaatggggaaaggattccctatttaataaatggtgctgggaaaactggctagccatatgtagaaagctgaaactggatcccttccttacacctgatacaaaaattaattcaagatggattaaagacttaaatgttagacgtaaaaccataaaaatcctagaagaaaacctaggcaataccatttaggacataggcatgggcaaggacttcatgtctaaaacaccaaaaacaatggcaacaaaagccaaaattgacaaatgggatctaattaaactaaagagcttctgcacagcaaaagaaaccaccatgagaatgaacaagcaacctactgaatgggagaaaaattttgcaacctactcatctgacaaagggctaatatccagaatcacaatgaactcaaacaaatttacaagaaaaaaaaaagatccccatcaaaaagtgggcaaaggatatgagcagacaattctcaaaagaagacatttatgcagccaaaaacacatgaaaaaatgctcatcatcactggccatcagagaaatgcaaatcaaaaccacaatgagatatcatctcacaccagttagaatggcgatcattaaaaagtcaggaagcaacaggtgctggagaggatgtggagaaataggaacacttttacactgttggtgggactgtaaactagtttaaccattgtggaagtcagtgtggcgattcctcagggatctagaactagaaatgccatatgacccagccatcccattactgggtatatacccaaaggattataaattatgctgctataaagacacatgcacaggtatgtttattgcggcactattcacaataacaaagacttggaaccaacccaagtgtccaacaacgatagactggattaagaaaatgtggcacatatacaccatggaatactatgcagccataaaaaatgatgagttcatgtcctttgtaaggacatgaatgaagctggaaaccatcattctgagcaaactatcgcaagaccaaacatcacatgttctcactcataggtgggaattgaacaatgagaacacatggacacaggaaggggaacatcacacaccagggcctgttgtggggtgggggaaggggggagggatagcattaggagatatatctaatgctaaatgacgagttaatgggtgcagcacaccaacatggcacacgtatacatatgtaacaaacctgcacgttgtgcacatgtaccctaaaatttaaagtatataaaaaaaagtgtaatcccccatattggaggtggggccttgtgagaggtgattggatcatgggggtggatttttcatgaatagtttagtaccatcccttttggtactgtcctcatgatagsaagtgagttttcatgaaatctaaagtgtgtagcacctcccacctcccttttttgctttgrcttttgccatgtgagtgaaagctcctgttttgccttctgccgtgattgcatcacgcttcctgtacagcctgcagaactaggagccaattaaacctcttttcttataaattacctagtctcaggtatttctttatagcaatgcaagaacagcctaatatacttccccacatgaagtgaaaggaaagaccagaaaccagattttcactacatcatgttcatatgcatgcacaaacacacttgcatgcatgcatgcacacacacacagaaatctctaactaataatccaaaattatcccctgccttccaggctaaaataaaagattttctgaaaacttcatcccttggcatgtttcagctgaaaagaagcctggcataggagcagttaactaaacagggtcccattatttaattccccatcattaccgcacaacatttttgttcaagtcactcttaattacattcatgatactctcacatgtaaagttcattgatgatttgattataacaattttatttaaaaattgccctttcctcttattgcccttacatttcagtatgagatttgaagggaacacacatccaaactgtatcagggagataataaaaatcagggtaatttgtaatccaagctgaaaatcagctttcctctatagtaatttattgatttgtaatatgatggaattacctaaatgatgatcaaattaaaaagtttataataacataaggtatttttttgatggctagatagaacaataaccgaggattctataagaggtcaggctttgttcaaataaattgaagataktgcctggtgataatagacaccatttcttagagcaggaaattccttttttttctttgaatattgaaataaggaaataaaaggactccatctgtcaatttaactttttctgtctgctctatttgtagtttaggtttgaaatgaaagtttcttattacttttattttaggcaaaccaatctatcttcttatttgtgttaatttgtgttagattttttcttgtataacatagatgacttttgcctgtttacatttrttccatcaacctgaattttcccataccctttctgtctttagtctccccctctgctggtactacacacagttactttaactactcrttatatagaagatgttttctggttcctattttctcccttcctctatcaatcaattgtctacaagcttttcagacagatgttattttgcactgatgacctgaattattaggtggttttaaatgtggcctctttaattttttttgttttctcttcaaaataacaggcatcttgggtcagaattgtgtaaagaaaggcagtgcggtaaatgcagtatttggaaaaccattattaaacaagctagggtggaatgattaattcagttttaaggaaaaagtgaggtattaaatttcaatatgctgtagtttgtgttgataagagaatttctaggtaggtattggtttagagtttctaaaaatactttttcctgtatcaaagacaaagtattttatatgtatattttaatggtaatttaaaatatttccaatcctttagcctcaccctgtgatcccactttcatcctgggctgtgctccctgcaatgtgatctgctctgttattttccatgatcgatttgattataaagatcagaggtktcttaacttgatggaaaaattcaatgaaaacctcaggattctgagctctccatggatccaggtgagatcaagagcttctcttcctgagatattatttttgttattttatcagacagtccaatttttttaattttttaaaattatactttaagttctgggatatgtgtgcagaatgggcaggtttgtcacatgggtatacatgtgccatrgtggtttgctgcacccattaacccgtcatctatattaggtatttctcctaatgctatccctccctttacccccaatcacccaacaggccctggtgtgtgatgttcccctccctgtgcccatgtgttctcattgttcacctcccacttaagagtgaaaacatgcagtgtttggttttctgttcctgtgttagtttgctgagaatgatggtttccagcttcatccatgtcccggccaaggacatgaactctctcagcatttgcttgtctgtaaaggattttatttccccttcacttatgaagcttagtttggctggatgtgaaatgctgggttgaggcagaagacagatgatttctgcatttccaactgaggtactgggttcatctcactaggcagtgtcaaacagtgggtacaggacagtgggtgcagcacaatgagcatgagccaaagcagggtgaggcattgcctcacccgggaagcacaaggggtcagggaattccctttcctagtcaaagaaaggggtgacagatggcacctggaaaatcgggtcactcccaccctaatatggtgcttttccaatgatcttagcaaatggcacaccaggagattatatcctttgcatagctcagagggtcctacacccatgaaacctcactcattgatagcacagcagtctgagatcaaactgcaagatggcaatgaggctgggggaggggggcctgccattactgaggcttgagtaggtaaacaaagtggccgggaagctggaactgggtggagcccaccgcagctcaaggaggcctgcctgcctctgtagactccacctctgggggcagggcatagccaaacaaaaggcagcagaaaactctgcagacttaaatgtccctgtctgacagctttgaagagagtagtggttctcccagcacacagctggagatctgagaacggacagactgcgtcttaagtgggtccctgaccccccagtagcctaactgggaggcacaccccagtaggggcagactgacacctcacatggctgggtactcctctgagacaaaacttccagaggaacgatcaggtagcaacatttgctgttcaccaatatctgctattctgcaacctctgctgctgatacctgggcaaacaggtctggagtggatctccagcaaactccaacagacctgcagctgagggtcttgactgttagaaggaaaactaacaaatagaaaggacatccacaccaaaaccccatctgtacgtcaccatcatcaaagaccaaaggtagataaaaccacaaagatggggaaaaaacagagccgaaaaactggaaactctaaaaatcagagtgcctctcctcccccaaaggaatgcagctcctcaccagcaacagaacaaagctggacagagaatgactttgacgagttgagagaagaagacttcagacgatcaaactactccaagctaaagcaggaagttcaaacccatggcaaagaagttaaaaaccttgaaaaaaaattagatgaatggctaactagaataaccaatgcagaaaagtccttaaaggacctgatggagctgaaaaccacggcccgagaattatgtgatgaatgcacaagcctcagtagccgatttgatcaactggaagaaagggtatcagtggtggaagatcaaattaatgaaatgaagtgagaagagaagtttagcaaaaaaagaataagaagaaatgaacaaagcctccaagaaatataggactatgtgaaaagaccaaatctatgtctgattggtgtacctgaaagtgacggggagaatggaaccaagttggaaaacactctgcacgatattatccaggagaacttccccaatctagcaaggcaggccaatattcaaattcaggaaatacagagaatgccacaaagatactcctcgggaagagcaactccaagacacataattgtcagattcaccgaagttgaaatgaaggaaaaaatgttaagggcagccagagagaaagcttgggttacccacaaagggaagcccatcagactaacagctgatctctcagcagaaactctacaagctagaagagaatgggggccaatattcaacattcttaaagaaaagaattttcaacccagaatttcatatccagccaaactaagcttcataagtgaaggagaaataaaatcatttatagacaagcaaatgctgagagattttgtcaccaccacgcctgccctacaagagctcctgaaggaagcactaaacatggaaaggaacaaacagtaccagccactgcaaaaacataccaaattgtaaagaccatcgaggctgggaagaaactgcatcaactaacgagcaaaataaccarctaacatcataatgacaggatcaaattcacacataacaatattaaccttaaatgtaaatgggttaaatgctccaattaaaagacacagactggcaaattggataaagagtcaagatccatcagtgtgctgtattcaggagaacaatctcatgtacagagacatacataggctcaaaataaagggatggaggaagatctaccaagcaaatggaaaacaaggaaaggcaggggttgcaatcctagtctctgataaaacagactttaaaccaacaaagatcaaaagagacaaacaaggccattacataatggtaaagggatcaattcaacaagaagagctaacgatcctaaatatatatgcacccaatacaggagcatccagattcataaagcaagtccttagagacctaygaagasacttagactcccacacaataataatgggagactttaacaccccactgtcaacattagacagatcaaggagacagaaggttaacaaggatatccaggaactgaactcagctctgcaccaagcagacctaatagacatctgcagaactctccaccccaaatcaacagaatatacattcttttcagcaccacaccacacttattccaaaattgaccacatagttggaagtaaagcactcctcagcaaatgtaagagaacagaaattataacaaactgtctctcagaccatggtgcaatcaaactagaactcaggattaagaaactcactcaaaacccctcaactacatggaaactgaacaaactgctcctgaatgactactggtacataatgaaatgaaggcagaaataaaaatgttctttgaaaccaatgagaacaaagacacaacataccagaatctctgggacatattcaaagcagtgtgtagagggaaatgtatagcactaaatgcccacaagagaaagcaggaaagatctaaaaatgacatgctaacatcacaatttaaaaaactagagaagcaagagcaaacacattcaaaagctagcagaaggcaagaaataactaagatcagagcagaactgaaggagatagagatgcaaaaaacccttcaaaaaatcaatgaatccaggagctggtttttttaaaagatcaacaaaattgatagaccactagcaagactaataaagaagaaaagagaagaatcagttagatgcaataaaaaatgataaaggggatatcaccaccaatcccacagaaacacaaactaccatcagagaatactacaaacacctctatgcaaatacactagaaaatctagaagaaaagaataaattcctcgacacatacaccctcccaaaaataaaccaggaagaagttgaatcyctgaatagaccaataacaggctctgraattgaggcaatagttaataacttaccaaccaaaaaaagttcaggaccagatggactcacagctgaattctatcataggtacaaggaggagctggtaccattccttctgaaactattccaatcaatagaaaaagagggaatcctccctaatgcatttggtgaggccagcatcatactgataccaaagcctggcagagacacaacaaaaaaagagaactttagaccaatatccctgatgaacatcgatgcaaaaatcctcaacaaaatactggcaaaccgaatccagcagcacatcaaaaagcttatccactatgatgaagtgggcttcatccctgggatgcaaggctggttcaacatacacaaatcaataaacgtaatccagcatataaatagaaccaaagacaaaaaccacatgattacctcaatagatgcagaaaaggcctttgacaaaattcaacaacccttcatgctaaaaactttcaataaattaggtattgatgggatgtatctgaaaataataagagctatctatgacaaacccaaagctgatcataccgaatgggcacaaactggaagcattccctttgaaaacaggcacaagacagggatgccctctctcatcactcctattcaactagtgttggaggttctggccagggcaatcaggcaggagaaggaaataaaaaatattcaattagtaaaggaggaagtaaaattttccctgtttgcagatgacatgattgtatatttagaaaaccccattgtctcagcccaaaatctccttaagctgacaagcaacttcagcaaggtctcaggatacaaaataaatgtgcaaaattcacaagcattcttatacaccaataacagagaaacagagagccaaatcatgagtgaactcccattcaaaattgcttcaaagagaataaaacacctaggaatccaacttccaagggatgtgaaggacctcttcaaggagaaccagaaaccactcctcaatgaaataaaagaggacacaaacaaatggaggaacatttcttgctcatggktaggaagaatcaatatcatgaagacggccatactgcccaaggtaatttatagattcaatgtcatttccatcaatctaccaatgactttctgcacagaattggaaaaaactactttaaagttcatatggaaccaaaaaagagcccgcattgccaagtcaatcctaagccgaaagaacaaagctggaggcatcacactacctgacttcaaactatactacaaggctacagtaagcaaaacagcatggtactgctaccaaaacagagatatagaccaatggaacagaacagagccctcagaaataatgccacatatctacaaccatctgatctttgacaaacctgacaaaaacaagcaatggggagaggattccctatttaataaatggtgctggtaaaactggctagccatatgtagaaagctgaaactggatgccttccttacaccttatakaacaattcaagatggattcaatacttaaatgttagacctaaaaccataaaaaccgtagaagaaaacctaggcaataccattcaggacagaggcatgggcaaggacttcatgtctggaataccaaaagcaatggcaacaaaagccaaatttgacaaatggatctaattaaactaaagagcttctgcacagcaaaacaaaccaccatcagagtgaacaggcaacctacagaatgggagaaaatttttgcaatctactcatctgacaaaaggctaatatccagaatctacaatgaactcaaactaatttacaagaaaaaaagaaccccatcaaaaagtgggcaaaggttatgaacagacacttctcaaaagaagacagttatgcagccaaaggacacatgaaaaaatgctcatcatcactggccatcagagaaatgcaaatcaaaccacaatgagataccatctcacaccarttagaatggtgatcattaaaaagtcaggaaacaacaggtgctggagaggatatggagaaataggtacagttttacactgttggtgggactgtaaactagttcaaccattgtggaagtcagtgtgatgattcctcagtgatctagaaatagaagtaccatttgacccagccttcccattactgggtatatacccaaaggattataaaacatgctactataaagacacatgcacacatatgtttattgtggcattattcacaatagcaaagacttggaaccacaccaaatatccaacaatgatagattggattaagaaaatatggcacatatacaccatggaatactatgcagccataaaaaatgatgagttcatgtcstttgtaaggacatggatgaagctggaaaccataattctcagcaaactatcgcaaggacaaaaaaccaaacactgcatgttctcacttataggtgggaattgaacagtgagaacacacggacacgggaaggggaacatcacacactggggcctgttgtggggcggggaaagggggagggatagcattaggagatacacctaatgttaaatgaagagttaatgggtgcagcacaccaacatggcacatgtatacatatgtaacaaacctgcacgttgtgcacatgtaccctaaaacttaaagtataataaaaaataattaaaaaaagaaattcctctccacctctaccacacagtctcagagtgtacacagttgttcccagtttcccatgattgggaaggactcaaacactatgatggcaggtcaactttctgtcatcttgtccaagggaaaagcacactaagctgggagtgaatgagcctgacctaaacagcagcagagagaatgaggtggagaggagaaggaagaggatagttaggagaagtctgaagcctatagcttagagagtgtcttcctcatgaaaaattgcactcactgggcagtggcattacagaaacaggcttaatttggattaatctttctgtaaatctgtattgagaattgtttcataaaacaatgtcactggtaaaaaaaaaataaaaaagaaattcttggttgaaaattcttttctttaaaaatgttgaatagtggcccccactctcttctggcttgtctggtgtctgcacagagatctgctgttagtctaatgggcttccctttgtgggcaacctaacctttctctctggctgccctcaatattttttccgtcatttcaaccttggtgcatatgatgattgtgtgtcttggggttgctattctcgaggagtatctttgtgatgttcctgtatttcctgaatttgaatgttggcctgtcttgctaggttggggaagttctcctggatagtatcctgaagcgtgttttccaacttggttccattctcccygtcactttcagatacaccaatcaaacatatgtttggtcttttcacttagtcccatatttcctggaggctttgttcgctccttttcattcttttttctctaatcttgtattctcactttatttcattaagttgatcttcaatgtctgttatcctttcttctgcttgatcaatttggctattgatagttgtgtatgcttcatgaagttcttgtgctttgtttttcaactccatcaggtcatttatgttcttcttgaaactggttattctagttagcaattcctctttttatcaaggttcttagttcccttgcattgagttagaacatactccttgagcttggaggagtttgttattacacatcttctgaagcctacttctgtcagtttgtcaaactcattctccatccagttttgttcccttgctgttgaggagttgtgatcctttggaggagaagaggcattctggtttttggaatttttagtctttttgtgctggtttttcctcatcttcatggatttatctacctttggtctttgctgttggtgaccttcggatggagtttttgcatggtcgtccattttgttgattttgatgttattgctttctgtttgttagttttcctcctaacagtcaggcccctcttctgcaggtctgctggagtttgctgggggtccactccagaccctgtttgcctgggtatcaccagcagcggctgcagaacagcaaagattgctgcctgctccttcctctggaagcttcatcctggtggggcaccagccagatgccacccagagttctcctgtatgacatatctgtcaaaccgtgctgggaggtgtctccctctcaggaggctcaggggtcagggacccacttgaggaggcagtctgtcccttagcagagcttgagggctaggctgggagatctgctgctctcttcagggccatcaggcagaaacgtttaagtctgctgaagctgggcccacagccaccccttcctccaggtgctctgtcctaggaagaggtggttttatctatagtcccctactggggctgctgcctttatttcacagatgccatgcccagagaggaggagtctagagagacagtctggctacaggggctttgtggtgctgcggtgggcactgcccagactcatcttcccagaggttttgtttacactgtgaggggaaaaccgcctactcacacctcagtaatggtggactcccctccctcccatcaagcttgagcatccgaggtcgacttcagactgctgtgctggcagtgagaatttcaagctagtggatcttagcttgctgggccccatgagggtgggatcctgtgagctagaccacttggctccctggcttcagccccctttccaggggagtgaatggttctgtctcactggaattcaggtgccactggggtatgaaaaaaagacttttgtagctagcttggtgtctggccaagtggccacccagttttgtgcttgaaacccagggcccttgtggtgtaggcatctgaaggaatctcctagtttgtgggttgcgacaggttgcgaagaccgtgggaaaattgtagtatctgggctggatagcactgtccctcatggcttcccttggctaggggagggagttccccaacccgttgtgcttcctgggtgagccaattccctaccctgcttctgtttgccatccgtgggctgcacccactgtctaactagtcccagtgagatgaaccgggcacctcagttggaaatgcagaaatcacgggccttctgcattggtctcgttgggaaccacagactggagctgttcttatttggccatcttgccccaatcccagtccagaactttgtatgtaccaagctgtgaagtgaatgtttgaaaactggaaattttggatactcttatatagtagctctggaaatcagagtctttcctctctttagggtgttttgttgcctgctatagttttttttttttttcttctgaaggctatagcttcctttagtgacttttcaaaactatttttgcaagtcatgtgtggtttctgaagtcttttctttagcgtatgttcagctaattttgacagaaattttcttgaatgtggagaggcaaaaaagagacatagaaaaaatatatgtatttatatatataaatagcagaagaaagatggaaggaagtaaggaaaggaaggaaggaggaaaggaatgaaggaagaaaggaaggaaggaaggtctttcagattggctggagcactccttgtcatagccttcacttactgcttaagttgagcctggatatcagccagaggtgaaagttcaggatcttctcacatttttctaactagcctgtcccgctctgggcatgttgataactttctaaatttcttagtatacataggcacttttgaacatcccattttccaaagaaactgtctcccagcttttattctcaggattttagtgctctactgtgtgccttaactataatcgtttgccctaggtagctttgggttgttcatttgtcttaggagatttttgagaaatgtccattgcttttccatcctgagtgagttttgaatcaggtgaaacaaagatgactgcctcgtgttagcccgtgttagtcctcagacaggtgagaaagagaaacataattttttgcaagtaaggtcttctgtggtccctctgtaaataggaaccagggccttccactgcgagcagggctgcccttgacaagatcactgccaagctgatgagggaggtggtacaagtgcaaataaacataccacaaagcttacatatgcatcatggaatactatgtagccataaaaaggaatgagattatgtcctttgcagggacacagatggagctggaagccattatcatcagcaaactaatgcaggagcagaaaaccaagcaccacatgttctcattcataagtgggagctgaacaaggagaacacatggacccagggaggggaacaacacacactagggcctgtccggggtgttggtggagggagagcattaggaaaaatagctaatgtgtgcggggcttaatacctaggtgaagagtttataggtgcagtaaaccaccatggcacacatttacctatgtaacaaacctgcacatcctgcacgtgcaccttggagcttaaaataaaaataaaaacccacaaagcttttctactgtttttaagttgccattttttttattcagttctcccttgtttgctataaacctttgactgatttccagagttctgttagagttgattctgacttttttgtttgaatttttgggtgtttttatggagagatgggcccatggaactgtctattgtgccaattttgcgggcattattctgtgaagtgagtggttgaacactacagcttgcccatatcttagcattgtggcattaacatctgggaaagatagatgatttctttattttacagatgagaaaagaaatgcctgaatatagagctggaattcaagcccrttagctggtggtttttcccaccaaacccccaaatccagtttctggcagtactttggtgactgcccaaaagcacacactcaatggaaatccaagtcccttgttgaaaagctggcattactcacaggcttttcctctaattcacacctagagacctcttcatcacattatttggcaaaaggggaggaggttttggagaacagatgctaccaggaagttctgaataggataggggtgtttgctgcttcagcaaggtaattaaggttaagatgacaaaatgattggattttggggtgtatgaaccattaaaaaattacagttttgsctgtgctgagctagcatgtcctgaactctgtctaaaggataattgtgtgattatctcaactactcacggaagtatcttaactactctggtgtatgggtacttatccataaaatgctgagttacattttatggtawctttktacccctcccagttataaaagagtgattctatttctgaggcttcctgctaggagtagaaatagcagggwatggctttgtgatctatttcatgttgttcaaatttccttaccctctgttcttatctgtaaaatgggaattaaagcaattcatggcattctatatttcaaggctatggagaagaattaatgtacaaaaatgagataattgacatgaagctattttaatattctgaaaataatatatgagtatagaaaattatcatmtttgatcccttgttcagaattttctaacttaaatctttctatcagtatagaggactactttgtacgtataatcaaatgctcctcttacagagggagataatttttaaaaattcactccagttttaaaccagcagttgacttatggcatatgtcttcaatacatgtgtttaatttaattaatttttaaaaatctttaaggtctgcaataatttccctgctctcatcgattatctcccaggaagtcataataaaatagctgaaaattttgcttacattaaaagttatgtattggagagaataaaagaacatcaagaatccctggacatgaacagtgctcgggactttattgattgtttcctgatcaaaatggaacaggtaaaatgttatttgtttgcctgcatcttgtggttcattgattagttctataacgattgcttaaatagtgaggcaagaaacacttcatgagcactttatgtacttaycatgtgtatagatctggatgaagcaccatggagaatttataattgaattgttaaacaattataatatgtgagcaccattgttaggtactaagaatttatctgagaaaagacagaatgcatgccttagatgaaagggaaatacaaataagatagaaaatgcaaaatatagcatcataaattgaaggtggacatggtcatatcacacagcatatgggagagtgaggtgaaagggtttaacctaagtgggcctcctgcatgtcctgatgtttggtgtaaatgttaaaatatttacaatgaataacggggcagtcaattttttggtgtgcagaacagtgtgatgacaggttcagaggtgtgtggtggcaaagagatggaaaagggaggccttaactgaatggaaccaaaagtaaatccggacaaatatggaattggaggtgtctgtaagctgcagacctgaatgctggcatggagagttttgatgtgatcaggtatatgtgtgagccctaacaagagtgggatgcgtataattattagagaaaataatcctaggaattgtgtagaaggatatgtacaatgagaatggaggtcaaaaacttgctacaagacatttcatatatttgaagttcagcttgctgaaagtgtgggctacagaaacagattctgaaataaaatcaagttgtccattttgtcatattgccaaaaatctatggatattagtttcagttagaggatcagataggagccaaatgataggacctgtgtgggaaatttcagtaatgagagcagacattctctttgataactttaactgaggagggaaagattcagatggtgaatttgaatagtggtagggtcaatatggaaactgtgaggaaggtaatatagatgcttcaggacactaaggtgcaaagtactctttgaactgagaagaggcccaatccagaacaaactgaaaagagttaactctagagaataaaatctttcctctgaagccaccattattttattcaaccgctttacagcactaggtggaaatgcagaatcagtcagtaggtgaaaatgggacagagtcaaagatgctgatgaaggtgacttccatgaaattgcccatggaatgttagcaggactgctcgaataatgtgttctagatggagtgaagtgaagaagatgagatactttgaggaaactggagaagggaagaaacaaattatttgtactctccaccttctctactgctaggtcaattgttctgaggtctaattaatttaagaatctcattaaaatatggacactgccasaaaaatgacactatatgagttctccatttttgtacacatttaggggggtttccttaatgctatgaattgtctccattaattccaggttaaggagaattgtaaggtctatggtgtttcagtgaccagtggctatgtcctcattactatatttaaaaagtgcattgttcctttgacctcactataatatttagaatctagcttattttatttttcacagcatttttattgagtttaattcacatattgtaccctcatacattttaaatacaattcaacagttttagtatttttcacagagctgtgcagccaccaccacaaccaatttcagaacatttccatcatcctgaaaagacaaccatatgcttaacagtcaccctgtattggggtggctctagtcaacactaatatactgtctgtctctataggtttgctattgtagacatttcatgtaaatgaaattacacagtatgtggtctttgtttgtctgacttctgtcacttagcacaatgttttcaaggttcattgacatagcatgtatcagtacctcattcctttatgtggtcaaataatatttgggtgtggctatatcatattttatatttccattcattagttgttggttttgattgtttctgttttggctgttatgaataatgctggtatggacatttgtgtacaagtttttgtgyatagataagtttttatttctcttgggtatatacttggctgcagaattgctggattatacagcaactgtatgcttaatctttggagaaaccgtggctggatcaaagacctaaatgtaagagctaaaaatataaaactctcagaagaaaacctaggcatgaaatttgctgcaccatttcgtattctcactacaatgttttgaggattccactttctccacaaccttgctaatgtttcttatctttttgattccagccatcccagtggggttgaggtggttccatgtggtttggtttgcattttcctgacatcaaataattttctcttgtgcttactggtcatttgtgtatctctttggataaaagtatattcagaccttttgtccgtttttaaattaggttattatatttttaaaattattgagatggaaaagtttttatatattctagataaaagtcccatatcagatgttattaaagatattttctcccattttgtcaagtgtctttcactttcttaacagtgtcttttgaaatacaagtttttagtttttgtgaaatccaatttatttatttatttgcatggtttcttgcaatttttttgtcacgtttaagaaatgatttcttagtccaatatcacaaagattcaccccaagttttcttcaaatggttttataattttaactattacatttaggtctaagatccactctgagtcaatttttgattatagtgtgaggtatgggtacaacttcattctttgcatgtgcattcagttgtcctagtaccatttgttgaaaagactattcattccccattgagtgatygtggtacatttgttgaaattcagttgactacaaacaygaggatttatttttagactctaaattctatttcattgatctatatagctttctttatgccagtatgacagtactttttttttttgagacagggtctcgctctggttgcctaggctatagtgcaatggtgtgatcttggcctctacctcccgggctcaggtgattctcccacctcagcctcctgaatagctgggattacaggcatgtgccactatggccagataatttattgtatttttagcagagacagcctttcgctattttgcacaggctggcctccaactgctggcctcaagcagtccacccaccctggcctcccagattgctgggatcacaggagtgaaccacgcacctgggtgatggtagcttttatgtaagttttgaaattggaaagtgtcagttctccagttttgttctttcccaagattgttttggttcttagctattttggttgtgtagagttccccatgaattttatggtaatcttgtccatttctattaaaaaggtaacagatattttgatatggatcactttgaatctgtagatcaatttgggaagtaatgccattttaacgatattaagtcttccaatagatgaacatgggatgtctttccatttatttagatcttctttaatttctttcaacaatgttttgtgtcagctagcttaattttgataggctatttgtacataaccactgatttttcaaattcacttaaacagaaggaaatattagtattggtttataagtgctctactctccttcctggctttggtgtaattttgagttgataagcttagaaaactgtgttaagttgatgttaccaatgggcatgatgacctttgtctagcaagtacatctgttgagaggactaggtttgtcttactgtggttgattacataatattaggcatgccacaggtcacatggagattataacagccttattaaattaatgctgttctagaggattgaataggaagaaatctttttttgtatgttaattactccctatagtcaataatttagactgtcccattgttatggtcaattttgtgttacatatttccctcatcttaaaccagccttagttgccttgtgaagtgctttgttcttccactctccattttattattaatggcataaactgcaattactttttcaccaactgaatataagaactcagttcattcagtcccttgtcctaagcatctccattgcccttactctctccttcatcctgtataggtggttaatgtccaaactctctgtcttcatgtctgtmgtgtctcttcaatttctatattcttattcattcctgtgcttgttyactagatcaagttgactattacctcacatctggaatataataatggctggccccatcttgtcttgtcaatctgttctctttctccataatcttggatatgttaccatgttatcttttgcacatttccgagttcataatgagtctgcaggcaatattgagtgtgactaaattcttttttttttctcagacagagtcttactctgtcacccaggctggaatgcattggcatgattgtggctcactttagctcgaccttctggactcaagtgatcctcccacctcagcctccccagtagttgggactgcaggtgcacatcaccatgcccagataattaaaaatttgtttttatagagatagggtctcactgtgtttgcccaggctggagtggacctcctgaactcaagtattcctcctgcctcagcttccgacagtgctgggatttaaggcatgagccactgtgcccagtctaaattacctataattccttatacaatgtaaatgccatgtaartggttgttatactgtattttttagggaataatgacaagaaaaagaagtctgtacatgtccaatatgaacacttttttttttctgaattttattcttttttgttttagaggcagaatcttgccccattgcccaggctgttgtgaagtggtatgaccatagctcactgcagccttgaactcctgggctcaagcaattcttccacctcagcctcctaagtatatgggacaacaggtgcatgccaccatgcccaactaattttttttttttttttttttgtagagatagggtctttccaggttgcctaggctagtcttgaacttctgggctcaagcgatcctcccatcttggcctcccaaagtgctgggattacaggcatgagccacctcacctggcctctttttccaatttttttttttttttatttaaggttggttgaatcaatggatgtggaatccatggataggaaggtggattgtactctattattagctatattcaactggctgtgcaatttattattttttaaaaaagagatcagatttactcctccattctaacaggctttataccctttgactatcatctccccctttccccccgcccccaagccctctggcaatcagcattctactctcttctatgagttcggttgttttagattccacatataagtgagaatatatagtatttgttttcctgttcctgacctgactttacttagcataatgttctccagttccatccctgttatcacaaataacagaatttcttcatttttaaggctgaatagtattctattgtgtatatataccacattttctttatccatttatctgttgatgggcacttaggctgattctatatattagctattgggaatagtgctgcaatttacatgggagtgcagacattgctttgacatactgatttcaaatcttttgagtaaatgcccataagccgaatcactggatcatgttgtaattctatttttagttttttgaggaaccttttactgttttccataatggttgcactaacttacattcccatcaacagtacacaagtgttcccctttttccacatcttcaccaacacttgttttttctctctttgataatagccattctaacagatgtgaggtgatagctcattgtgtttttaatttgtaactttttaatgattagtgttgttaagcatctttttatgtatctcttaatcatttgtatgtcttctttttagaaatattcattcaggctatttgcccatttcttaattggattatttgttttctttctatagagttgtttaagttccacatatatgtgcatgcatgtctgtgtgtatatagtttttaattttaattttaattttaaaagaagtatagaaatttaatatgtttttcttccaatgttatkttttctcatatttttttctttttttaattatactttaagttctagggtacatgtgcacaatgtgcaggtttgttacatatgtatacatgtgccatgtaggtgtgctgcacccattaactcatcatttacattaggtatatctcttaatgctatccctccccgctccccccaccccacaatagtcccccgtgtgtgatgttccccttcctgtgtccatgtgttctcattgttcaaatcccacctatgagtgagaacatgcggtgtttggttttttgtctttgtgatagtttgctgagaatgatggcttccagcttcatccatgtccctacaagggatacgaactcatccttttttatggctgcatatattccatggtgtatatgtgccacattttcttaatccagtctatcactgatggacatttgggttggttccaagtctttgttattgtgaataatgccacaataaacatacgtgtgcatgtgtctttatggcagcatgatttataatcctttgggtatatacccagtaatgggatggctgggtccaatgatatttctagttctagatccttgaggaattgccacactgtcttccacagtggttgaactagtttaaagtcccaccaacagtgtgtaaaagtgttcctatttctccacatcctctccagcacctgtttcctgactttttaatgatcgccattctaactggtgtgagatggtatctcattgtggttttgatttgcatttctctgatgaccagtgatgatgaacattttttcatgtgtctgttggctgcataaatgtcttcttttgagaagtgtctgttcatatacttcacccactttgtgatggggttgttttttttcttgtaaatttgtttgagttctttgtagattctggatattagccctttgtcagatgagtagattgcaaaaattttctctcattctttaggttgcctattcactctgatggtagtttcttttgctgtgcagaagctctttagtttaattagatcccatttgtcaattttgtcttttgttgccattgcttttggtgttttagacatgaagtccttgcccatgcctatgtcctgaatggtattgcctaggttttcttctagggtttttatggttttagatctgacatttatgtctttaatcmatgttgaattaatttttgtataagatgtaaggaagggatccagtttcagctttctacatatggctagccagttttcccagtaccatttattaaatagggaatcctttcctcatttcttgtttttgtcaggtttgtcaaagatcagatggttgtagatgtgcggtattatttctgatggctctgttctgttccattggtctatatctctgtgtcagtaccagtaccatgctgttttggttactgtagccttgtagtatagtttgaagtcaggtagcatgatgcctccagctttgttcttttgactcaggattgacttggcaatgtgggctcttttttggttccatatgaactttaaagtagttttttccaattctgtgaagaaagtcattggtagcttgatggggatggcattgaatctataaattaccttgggaagtatggccattttcacaaaattgtttcttcctatccgtaagcatggaatgttcttccatttgtttgtgtcctcttttatttcattgagcagtggtttgtagttcttcttgaagaggtccttcatrtcccttggaagttggattcctgggtattttattctctttgaagcaattgtgaatgggagttcactcatgatttggcactctgtttgtctgttattggtgtataagaatacttgtgatttttgcacacttattttgtatcctgagactttgctgaagtttcttatcagctttttggagattttgggctgaggcaatggggttttctaaatatacaatcatgtcatctacaaacaggaacaatttgacttcctcttttcctaattgaataccctttatttctttctcctgcctgattactctggccagaacttccaacagtatgttgaatagaagtggtgagagagggcatccctgtcttgtgccagttttcaaagggaatgcttccagtttgtgcccattcagtatgatattggctttgggtttgtcataaatagctcttattattttgagatgtgtcccatcaataccgaatttattgagagtttttagcatgaaggtttttgaattttgtcaaaggccttttctgcatgtagtattgagataatcatgtggtttttgtctttggttctgtttatatgctggattacatttattgatttgcatatattgaaccagccttgcatcccagggatgaagccaacttgatcatggtagataagctttttaatgtgctgctggaatcagtttgtcagtattttattgaggatttttgtatcgatgtgcatcaggaattttggtctaaaattctctttttctgttgtgtctctgtcaggctttggtattacgatgatgctggcctcatcaaatgcattagggaggattccctctttttctattgattggaatagtttcagaaggaatggtaccacctcctccttgtacctctggtagaatttggctgtgaatccatctggtcctggactttttttttgttggtaggctcttaattattgcctgaatttcagagcctgtgattggtctattcagggattcagcttcttcctggtttagtcttgggagagtgtatgtgtcgagaaatttatccatttcttctagattttctaatttatttgcgtagaggtgtttatagtatgctctgatggtagtttgcatttctgtgggatcagtggtgatatcccctttaacattttttattgcatctatttgatttttctctcttttcttctttattagtcttgctagtggtctatcaattttgttgatcttttcaaaaaaccagctcctggattcattgattttttgaagggtttttgtgtctctatctccttcagttctgctctgatcttagttatttcttgccttctgctagcttttgaatgggtttgctcttgcttctctagttcttttaattgtgatgttagggtgtcaattttagatctttcctcctttctcttgtgggcatttagtgctatacatttccctctacacactgctttaaatgtgtcccagagattctggtatgttgtgtctttgttctcattggtttcaagaacatctttatttctgccttcatttcattatgtacccagtagtcattcaggagcaggttgttcagtttgcatgtaattgagtggttttgggtgagtttcttaattgtagttctagtttgattgtactgtggtctgagagacagtttgttataatttctgtttttttacatttgctgaggagtgctttaattccaactatgtggtcagttttggaatacgtgcgatatggtgctgagaasaatgtaaattctgttgatttggggtggagagttctgtagatgtctattagatctgcttggtgcagagctgagttcaattcctggatatccttgttaactttctgtctccttgatctgtctaatgttgacagtggggtgttaaagtctcccattattgttgtgtaggagtctaattatcttcgtaggtctctaaggacttgctttatgaatctgggtgctcctgtattgggtgcatatatatttaggatagttagctcttcttgttgaattgatccctttaccattatgtaatggccttgtttgtgtctttcgatctttgttggtttaaagtctgttttatcagagactaggattgcaacccctgcctttttttgttttccatttgcttggtagatcttcctccttccctttattttgagtctgtgtgtgtctctgtatgtgagacaggtctcctgaatacagcacactgaggagtcttgactctttatccagtttgctagtctgtgtcttttaatcagtgcatttagtccatttatatttaaggttaatattgttatgtgtgaatttcatcctgtcattatgatgttagctggttattttgctcattagtttatgcagtttcttcctagcatcaatggtctttacaatttagcatgtttttgcagtggctggtagcrgtttttgctttccatgtttagtgcttccttctggtgctcttgtagggcaggcatggtggtgacaraatctctcagggtttgcttgtctgtaaaggattttatttctccttcacttatgaagtttagtttggctgkatatgaaattctgggttgaaaattcttttctttaagaatgttgaatatcggcccccactctcttctggcttgtattgcccagatcaatgtcctgtagtttttcctcaatcttgtcttctagtagtttacagtatctggtgttatgtttaagtctttaatccatgttgagttgcttgagtatatggtgtgagatcagtgttcaattttattctttagcatttggatatccagttttctcaccatttatttaagagactgtcccctttccattgcatattcttggtacctttgtctaaaatcaattgtagttgcatgggttcttttccagctctctgttatattctrttggttgatgtgtccatttttatgccagtaccatgctgttttaattactattaatttgtagtatagcttgaaatcaggtaatgtgatgcctccagctttcttctttctgctaattattgccttggctatttgggtatttttgtggttctatatgaattttttggggatgacttttcctatttctaagagagataacattggaattttgatagggatttcaatgaaaccataaatttctttagatagtatggacattttaacaatatcaactcttccaatccatgcatatggtatcycttttttatttgtgtcttcttcatttttttaattaatattttatattttttggtgactttcacttttttggttaaatgtactcctaaatactttatttctttgatgctattgtaaatgggtttatttttaaaatttctttttcatatcatttgttgttaatgtgttgaaacactattaatttttgtgtgttgattttgtatcctgcaactttactgaatttaattatcagttctaagagttttttggtgatgtgtttaaggttttctgtatgtaagatcatgccatcagcaaacagagacaattttacttcttttcttctttggatgtctttcatttatttttcttgtctcattgctctggctagtacttctcatactatgttgaattgaagtactgagagtgggcatccatatctttttcctgatcttatgggaaaatccttcaactttccactattgaatatgaggttagccatgcacttgtcatatatggacttgtgttgaggctagttattagctccactatcaggagcagcaatttgcaggacatgctaacaagtctcatccaggcagaaacttggacttttgagtttcatccctttctctgccatgatcccagaggattaaacctctggaagtgcttgtgcactaatataatactggtactttttccagtggtctagagagagactcctgtatacttagtcctctctgctcccagaattggtaagttaagtagatagctgtggggaamcttagagttagggtgttaatgtgtggtctaaatcctcctttccacagggagaagctggatgttggggattcattctcaattgtatggtgtagtgcctgggtgaggttggtgctgtagctttttcttcccagtctatgtggatattttctttgttgctcagtacatagaagtctctcaacttgtttctgactttctctcacagggaattgatctgtgaatagatatttatttggtgtatccttgggtggaagaagagactggagcctcctattctgcaatgtccctattgtgacactgagaattgcaaacccttgattcttgcttataatgtatttatgtctctaatttacttatttctatttctatcaattaagattgtatatatacaaataagaaaaaaaattaacatggcttaaacaaataatgtgtttatttatttcacatacagggtgtcatgttgggcagtgcagaactagtactgtagctctgaagcatcctagaactaggtgcctgccatttttgatccccacgcttacaacatgaaccttcatcttgattatttttttttttgagacaggatctctctttgtcatccaagctggagtgcagtggcatgaacatgcttcactgcagccttgacctcctgggctcatgtgtttctctgtgtcagcctcccatgtagctgggaccacagatatgtgcaattcacctggttaattttttgatttttatttttttttttgagaggagtttcactctgtcacccaggatagagtgcagtggtgtgatctcggctcactgcaacctccgtctcctgggttcaagtgattcttatgcctcagccttccgagtagctgagattacaggcgcatkccatcacgcccggctaatttttgtgtttttagtagagatgagatttcaccatgttgcccaggctggtctcgaactcctgacctcaggtgactgcctgtcttggcctcccaaagtgctgggattacaggcatgtgccaccatgcctggccaagtttttgattttttttttagagacagggggtctcacttgttgcccaggctggtgtcaaactccagaactcaagtgatcctcctgccttggcatcccaaagtgttgggattacaggcatgagccaccacagatggacttgttatattcttaaatattcatgttccaaggtgatatctatatcacctctaccttcatatatgtgttttgagtaaaaaggagagaaagtgccatcaacaggtacctgcttatatgtcatagacaagaaatatgtttcatggccaacacagctccaaaagatattcagaaatagaatttttaggcaagcaatggataagtaggaatgggaaatgaactattttacattctctgccacaccgtgcaattgttgtagttttaatactgcactctgtacagtttccaaacttccttatctttagaacaacctgatatattttggattttttgtaatttaatatgctggcaaactaccaaataattaaattatgaaataattttttaggaaaagcacaatcaacagtctgaatttactgttgaaagcttgatagccactgtaactgatatgtttggggctggaayagagacaacgagcaccactctgagatatggactcctgctcctgctgaagtacccagaggtcacaggtatgatgataccataggtgagcagggtgattttcagaaaagatgttgggaagacactgctattgtcctcaatcttgtttctcttagagaagcttcattattgaaatttctgtgccattggctctaagttgtctaaatatgatgaagggataagaatgagacaaatttgcacaatagggaagagggactgagagaggtgaagacagtgtgatcagtagcaaaagtaataaagccctggattttagtgactaaatacttttaataaagtgtctagatttcatgggagacgatttgtagcaggcacaggcatgatgaattggcctaggattgtatgttggttttctaaagaacagaccactttgttgcagtttcttttttgaaatgagtagaaattttatttcactaaaagccatgtctacaaaattccattttccagcagaacagaccactttgagtaatagatatgctctttctttctttctttctttttttttgagacagagtctcactgtgtcacccaggctggagtgcagtggtgcaatcttggctcactgcaacctccgcctcccgggttcaagtgattctcctgcctcagcctcctgagtagctgggattacaggtgtacccaccacacctggctaattattttgtatttttagtagagacggggtttcaccatgttggtcaggctaggctcaaactcctgatctcaaatgatctgcccaccttggcctcccaaagttcttggattacaggcatatgccactgtgcccagccaggtatgcttctatagatcttcccttattctgaaaatgtagtgttttaatgctgggacagtaaagacagaaactctttttatttttaatttttattattggcaattcttttgtggttggtttgatgccattttttaatgttttggtaaatttctatttttatagacttaggggtacaagtgcaattgtgttcatgaatatattccctagtggtgaagtctgggctttcagtgtacccttcacctgaatagtgtacattgttcccaataggtagcatttcatccctcacctccctcccacctttccaccttttggactctccagtgtctattattccactctgtatgtctctgtgtacccattgtttagctcccatttataagtgagaacatgtggtttttgactttctattttgagcatttgcacttaggataatggcttctagttccatccatgttgccacaaaagacacgatttcgttcttttacatggctgagtagtagtgcatggtgtgtgtgtgtgtgtgacacaccatagaatactagatgcagatttttaaatcccacacataacaattttaatccattcatctgttgatggatgcttgggttgattttatgaatttgccttggtgaatagtgctgcagtaaacatatgaatgcagatgtcttttcgataaaatgatttcttttattttggatagatacccagtagtgggattgctggatcaaagggtagttctatttttgattctttgggaaatactatttattgaagtgtatagtggatattctagaaatgtcatgagatagcctgagaaaatctgtatagtctgggaagtattttaaacacttaggtgtataataaaggtgtatgatatttaagcagaaaatgtgcctgaggaattttatgattatcaaaatctgcatctagaaaaatggtacttgtcaatattttttcttagggtcaatagttttatcttttacaagcaacttttttttttcttcaacttttatatttatctatgagcagattctggctctgcatarcatattagccacacacttgtttttctggggtcagaatcacactgaagtgatgataaacatattacaaatgagaattactcctgttaaagttggagtataaccatcaagtctttaacaaacttctcagacacagagagcagatagaaggatgataaccaatttggcagagagattgaagttgcaacctaagggtcataagaatttctgttgctatagtccccataaggctgagtattcaaaagaaccaagacccaaagaacatagagggagaatgaggcagaaaacagaaaattctccctgcctagtttccctccacaactccatttgtcaactaattgtttttctccacagaaaagggaggttcactctctagagaaactgaacctaagaggctcactcatggacaacagacagagactgggaaagagtgaggggttaagtaagagtccacttgaattctaaggcctttagcgcctttttctatcttgttcctaaaatacagcagccaggtgtaaactccagaggacaagtagcaccagtggaaagacctccatttttcaccatttagatagaaaattcttaccaaatgtccagcaaagtgaatgaaatggaaaatattcatccaagacaccagaccatggggaattttagaacatcagagttaaagggaaagtcataaaaacattcagagataaattaggtcmcctgtgaaggatcaggaatcagaatggcattagaattctcaagagcagctgtcatcttgtgtatttgtagataaagaatattttcagatctgcatttggcaaaaaatttttgccctttgtgtttattttcttagaaagatactagagaatattttccatccaaatgtctgaaaccaattcaggggaaatcatgggctgcagggatcaggagatctcatgtaggaggatggaagtgtcagggaggctgctggataccaggtctagaaaacaaatgctttagaatggaccaggtggatcatggaggtgtgagggaagacattaagggcaaagaaaagttgattgattatttgattatttttagtgtttagaaaattattagtaagagtttgaaacatttctgagcatttgcagtaattctaaattggcatatgaaaattagaattgaaatggacacacaagtccaagaatatacaaaaaagagacataattacagctgtcccacttgtggtcaatgtttatgaaataataatggtgtgaacatgagtattaatataataaaaatgtgatataaatacattggggaaactagagtgggggaagtgtgaatgtgtgtgcatgtttctgtttgtgggtgtgtgtctatttgttatggggtgatgatggagatataagtcctcatctttcttaccatgaggttttagaaattttcaaagataaattaaaaaataaaaagagagtcagtatttagaaatatgaatataaacttcagaagaaacttctagaatgtttcaacatagtcacctttgtggagtgtgaggatgagagagaatatcatttcaagtttcaaataaacatatgcacacaatacacaaatccatccatacatatagatctgttagtagaattaaagttttaaaacattatatgttattctgatacaacattaatttgatttttttctttcttcaagaacagtaatttcttgagtttataatgtactaaatatttatattttgaagtattttatcatttatatttgtactgattatcttgtatgctaatatgtaggtggttacagatttatcttaatacttagcttgtaggagagttggatgtatctataatgtagtaatttcttccctaagtctaggtgtactttcagtcctataagtttataatgatgttgggaccccttccttatgcttcttgtaacctgaattgctacaacaaatgtgccattttcctccttttccatcatttcttacttgtgtcttatcagctaaagtccaggaagagattgaatgtgtagttggcagaaaccggagcccctgtatgcaggacaggagtcacatgccctacacagatgctgtggtgcacgagatccagagatacattgacctcctccccaccaacctgccccatgcagtgacctgtgatgttaaattcaaaaactacctcatccccaaggtaagcttgtttctcctacactacatctccatgctcttcaagtccccaaattcatagtatagtcccaatcctctaacaacacatgatgagagaagtgtaaaattcatacgtggggcagctttctggactctgctgtttccattccagtttgggcctatgaaggtttataacaggtctcagtatctagcagtgtatgtcttccaaatttgttctgcttctttagtattttttttttgtggctattctcaggtgtttacatttccaagtaagtgttgaaagtatcattttgtcaatttcccaaaacactrtgctgggatttttatcatgatgacattaaatctttagatcaatttagaaataattgatgtcctgacaggttgaatctttcaattcatggatatgattatgctctttatttatttgggctttcttctattgtgtcagtaatgttttgtcttcagttcagtggctttctcatgtattacrttttttttctgaaatgatatttctatgtaattgtaagttgtgtatttaatatataatataaaatatatataatatgaaataaatatatataatattaaaaatatattttcaaaacagagtcttgctatgttgcacagattgatcttctgggctcaagcaatcctccacctcttcctcctgagtagctgggattagagatgtgtgccactgcacctggcttttaaataatatactttaaaaaaaatgccttttccatttctttgtttctggtacatggaaatataattgactttattattttgatgaccttacatcaagcaaatttacttggcattgctaattttttgtttgtaaatttatttgtaatttctatgtattctgtgttctcttttaatatttattttatttcttatttttcaattcttataactcagttttctctttattgttttatttcactggttaggatttccaggacagcgttgaataaatcatgatggtgggcatccttgtttcatatatgatgttcaggatgggtggagatttaacatctcaccagtgagaatgatgttttatgtatattttcataagtaaaaaatcagattagagaaggttgccttctacttttgatgactttttttggtcttgaatgtgtatacaatttgatcaaatggagtctctgcatcaatcgatatggccatatattttgtcctgtctatagatataatatatatattagttaaaatacacacaaatgtgcacacagagacatacacagctgggttttatttgctatgattttcaggrtgtttgaacttatatttacaagagacattggtttgcaatttttcttcctcaaaattttcttgtcagatttctgatattgaggaaatgttggcttcrtaaaataaggaagataatgttctgtattgtggttgtttttataatcttttctcccttctctattctttttgtgctcacttagttctgtctttggagtgactcataaattttggttaagtgccagttatgatgtatgaaaaaatgcagaatgtcagatgaggttcatcttcttccagaaagggttcatccctcccatgctaggcagacagaattatgcaacaccttctaccttcattcagaattagatatcaacacagtcaaaaaaaattttttttcaattttttttttattatactttaagttctgggatacatgtgcagaatgtgcagttttgttacataggtatacacgtgccatggtggttcgctgcacccatcaacctgtcacctacattaggtatttctcctaatgttatccctcccctagccccaacatcccccacaggccctggtgtgtgatgttaccctccctgtgtccttattgttcaactcccacttataagtgagaacatgcggtgtttggttttctgatcttgtgatagtttgctgagaatgatggtttccagcttcatcmatgtccctgcaaaggacatgaagtcatcattttttatggttgcayagtattccatggtgtatatgtgtcatattttcttaatctagtctatcattgatggacwtttgggttggttccaagtctttgctattgtgaatagtgccacaataaacatacgaaacacagtcaaaaattgactgtagccatcaaaaattgactgtaacctctctgagttcccccatgcctgcaagcctgagtaatttttgtctcarcatcttttccagtgccttctaacacatggtttctgtgtttattgagactttttagttgctattctgcaagctgctccattccacttgaagcgagtacatattgccattataaagaaataaaataatgaaaatttaactttgagaggaaaaaggattggagtttgataaggttgaaatcactattgccatcttatagggaagagggaattctgaatgtctgtattgtgccatatggaatccactagccacaggtacctattgagcaccggaagtgtaatgaatgcaactgaggaaatgaatttaaaattttatttacttttcattactttaaatttaaatacaaatagccatggatcattcatggctaccgtgctacagaacacatatctgattgtttaattttctgtaatacagggttagaaatatctcattctcaattatgtaatattaaaagcctgagtagttaaaaaccatttaaggtgggtgtaatttcatttggctaaacatttacttgcgtggagtgaatgtatttattttccttatttatcatactttgtataaatattaatgttttgctaaagaaaaggccaggtgtggagattcccatttgtaatcccagctctttgggaggccaaagtggaaggatcatttgcacccaggagctggaggccagcctgagcaacatagtgaaactctatctctacaaaaaataaaaaaattagctgggtgtagtggcatgtgcctgtagtcccagctacttgggaggctgaagtgggaggattgctggtgtccaagaggttgasgctgctgtgagctatggtcgtaccactgtactccagcctgggtgacagagcaaggccctgtctcaaaaaaaacaaaaaaaaaagaggaaagaaaagaaatatcatgtattcaattatatggtatctccccactctccacattattgggagtgttagaaaatctgtagcaactattatgtagcataatatctttctagaatgaatatatgtgtgtgtaggtatayagtatacatataatatatggaaatgtgcatacatctacattttaatctatacatttatctgcatttatctatcatctatctacctatgtaatctaatctgtcacatttaacacctaagtacttcagtatataattcccaaaaacaaggactttctcctacataataataataacattcacactcaaggaattattatcaatacattaatattatctaatatcttataactacattttcccagttatactaaaatatctcttatagcttttttttgatggacttcctgtagtccagtcaaggaacaagcttttaatttggttatcttgttttgttaatccttcttcatcacgaacagttttttttagtttgtttcactttaatacactgacagtttttaaaagtcctgtccccttgttatgtaaaatgttgctcagtctggttttgttagaatttttttttgacaattagattccagttatgtgtttttggcaagaaagttacataggtgatgttatatacgtgccattgcatcatatgtgcggtccacattttgtaagcctgtatctgctaggtctctccattgttggggttctgtttttcatatgcagttaataaaaagatggcatggtactttaagatcctgtgaatattactttcccaaataatttacccagtagttttaaagttaattgatgatccttgcccgaatctatggtcctacctgaatggctgcaaaaatgatgatttttctaaatttatccttccttctgtgttttttaggttggattcatctctgatgaagagttcccccacgtgttttaactaaaagaaacatatagcatttctgtgatcaacccctcaataaattttagtgtacttgttgatatcatctcagaagtcatttttaattagatcagacctccattttaaaaaaccytatgaacagattccaaattctcctcacttttttttttttaacaaaagttttattggagatagaaccaccatgtacacagggaaaagagcacaaaaattcaactgatacagaacaacaactgaaagtcacaattacccaatgtagtttgcaattacttttcagtttcttaaacagctcccctcaacttgtttttttaacagtcttgctaatttttcagctgaaacagcatcaagttttccaaaaattaagagcctcgggaggggacccgctttcaagatactgaaggtgacatcaagagtctcctcctaacaggaccaactctatctaaaagttgcttacgagtaacttgaatcttgtgtaatagtctgcatctcacagaccatcatggatgagttagaacactgttgttgatggtccartatgaagagagggcaaccaaatagctgtattcgcttgtcagctgagctcatataaagaagtcagtgaggagctgagaaaatataggcaatggctgctcaataagaattwtaagttccgaataccacatataggtagacaccagtgtgcaagttgatgcaactagaaagaaacagatgactttttaaaatacctggccacaggtctttgagaactcaagaaaataatcaacagtagacacaagagtcaaaaatcttctcaggttgaagattaggacatgggtaatcttcctaacagctccaacaggcaaggaaatatgctgtggcaaaaagcattaagtagttctgatttttaaaaaacaaaaacaaaattttctgcttctcctcccttcaaagcttcaaggaaatagaaacaaggaaacaaaacaaaaacraaaaaaaccagtgatggtaaagagaagccttttgcttgaattatcaattcgaaaaacagtaattttgccattttgtatatataaacaatcttgggacattcttctgaaaactaggtgtccagtggctaagagaactcaatttcaagcacttctgaaaggaacaccagcatgacccagaatctcaaattcccaaacaggggctgcgtgggaaaaatgagggaggacttttgtatctagggttttagcaagttaaaatgaagatgacaggaaaggcttatttatcaacaaagagaagagttgggatgcttctaaaaaaactttggtagagaaaataggaatgctaaatcctaggaagcctgtaacaatctacaactggtccaagttgaagacaaaactgtccaaacaacatttaaatctaaagtatgttgaaaactagttgagaagtttttgctcctgtaacaatttacaaaacacgttcattttggtctcttttgcagttttcttattgtattcatttttaatataaagagttggatttttctcttctatgatgttcctctagtacaactgatcattaattttctattttagctatttttataagtacttgttaatcagcacagttaacttggggctaagtcatatatacacatcccatactcataaatgaaaatttttaggatgtgaatatacaagatattatgtaagcaactgtccccctacttgaaaacttgtttccaaataatgttttttaaaaacatccctttcagtgtaacagaacattacctagtaaaatatcaatagctatgacaattcatttctcttttcaagggaaatcacaaaacaggtgaacaaccaagtcaagggtggtttttctgtttgataaatacatccagaactctgtacagtaaataaagtttgcatgcagtttaagtatctttaaatgacattttaagtaaataaaccttttgcttcataattagtggtgtataagaaccctccccactttttaatagccacagggatctctttcccagttccaaagaggaattaatgaagaccaggtatgtttagaggcttctatttaaaaactgtcttctggaagtcctagccagagcaatcaggcaagaggaagaaagaaaacgtattcaaataggaaaagaataaatcgaaatatctctcttcactgatgatatgattctacacctagaaaactctgaagactcttccaaaagggcctctggaagggataaatgaccagtaaagtttcaggatacaaaataaatgcacaaaaatcaatagcatttttrtatatcaataatgttcaagctgagagccaaatcaagaacgcaatcccatttacaatagccacaaaatattaaatccctaggaatacatctaaccaaggaagtgaaagatctctttaaggaaaactgcaaaacactactgaaagaaatcatagatgacaaaaacaaatggaaaagcattccattctcatggattggaagaatcaatactgttaaaatggccatactgggccaggtgcggtggctcatgcccataatcccagcactttgggaggccaaggccagcggatcacaaggtcatgagatcaagaacatcctggctaacatggtgaaaccccatctctactaaaaatacaaaaagttagccaggcaaggtggcaagtgcctgtagtcccagctacttgggaggctgaggcaggagaatggcgtgaacccggaaggtggagyttgcagtgagcagagatcacactattgtactccagcctgggtgacagagtgagactctgtctcaaaaaaaaaataaaataaaaaaataaaggccatactgcccaaagcaatctactgattcaatgctattcctatccgactaccagtgtctcttctaaaatttatatggaaacaaaaaagcctgaatagccaaaacaaacctaagcaaaaagaacaaagctggagtcgtcacgctaccagacttcaaactatgctataaggctacagtaaccaaaatagcgtagtactggtacaaaaacagacacacagaccaatggaacagaatagagaacccagaaataaagcagcatacctacagccatctaatcttaaacaatgctgacaaaaaacaggcaatgggaaaagactccctattcaataaatgatgctgggatggcaggctagccatatgcagaatgaaactggaccccatcctttcaccatatataaatatgcactcaagatggattaaagttttaaatgtaagacatcaaactataagaattgcaaaagaaatacctaggaaacaccatcctgggcattggccttgggaaagaattcatgactaagtcctcaaaagcaatcacaatgaaaaaaaattgatatgttacttaaaattgataatttagttacaaattaaactaaagagcttctgcatawcaaaagtaactattaacaaagtaaacagacaacctacagaatgggaggaaatatttgcaaactatgcatctgacaaaggtctaatatcctataaggtaattaaacaattgaacaaacagaaaacaaataatgccattaaaaagtaaaatacatgaacagacactgctcaaaagacatacaagtggccaataaacatatgaaaaaatgtttcacatcactaaacatcagagaaatgcaaatcaaaaccaaaatgggataccatctcacatcagtcagaatggctatgattaagaagtcaaaaaacaatgcatgatggcaaggctgtggagaaaagggaacacttataggctcttggtgggaatgtaaattagtccagctactgtggaaagcagtttggaggtttctcaaagaacttaaaagagaactacaatttgatccagcaatcccattactggatatatttccaaaagaaaataaatcattctactaaaaagacatgtgaacttgtatattcattacaacactattcacaatggcaaaggattggaatcatcccaaatgcccatccacagtggactggataaagaaaaggtggtacaaatacaccaggaaaccctatgcagccataaaaaagaatgaaatcttgtcctttgtagcaacatagatgcagctggagtgaattaacgcaggaacagaaaaccaaatattgtacgttctcacaaggaggagttaaacatcagtactcatggacataaagatggcaacaataggcactggggactactagatgggggctgaaggggaggaagggttgaaaaactacctgttggatactgtgctctctactcgggtgatggaattatttgtaccctaaacctcagcatcacacaatatacccatgtaacagtcctgcaaacaacaacaaaaaaggtaatccatgtgtgaggtgtgtgaaaactgaagtgatgaaatacagcagcaagtggggatgtacaccagggtccaagcttgatgataaaccgggattcagaaggctgcccccgagtactcaaatgctcaggacttcaagtgcaattaattggaggggacttcagcaaagtcactgccacttgccttaaagtcatactgcttcttactaggtctgtctgggtgggaatgtaacttctttggacctcaattttcttatctattgataaaagagattggactaggtgatttccatcacttcttcccactctttgacttctttataacttagtttgtctgttttgctattttcagggcaygaccataataacatccctgacttctgtgctgcacaatgacaaagaattccccaacccagagatgtttgaccctggccactttctggataagagtggcaactttaagaaaagtgactacttcatgcctttctcagcaggtaatagatattcatttccatctgtccttcagggcacatgatacctttttgggatcagttgactcttacatgatgccacctctgaggtttggctgaattgctttgcagatcattagcaccattccctatgcccatgcgatttccctgctgatgaacatccccrttattgggccaggttagtggggctttggggagttgatccagtttttcaaactgaaaaagctagaatgtaggttaatttaattctgcctctagatacatcactgagctacccaagagctcttcttaatgggtgaaacttatttagacatttctcatctgccatgagaaaagtatctaattccacaactttgaatatcttccctgtggtgtccctagctccctagactgagctctggagatacaagtatctgagagcagagaatgggctcttaagaggctcactcctgatttagagaagtagacaagtaaacagatcattgtaatctagtaggaggaaggctgccagaggggaaagcgcaggatgttggggagctcagtgggggaatctgcctgcttcctgctcattcataggccataccacttccaagaggaaggaaacttaagctgcctcattgcagcaggaaacaggacaagaagagaaggcaaggcacttttacagaggtaatggaccatagtagcaggacattttctgtagatctagggggtcagaacctaccaacaaatttcagggtcaggaaaaccctgggaatgtggaaggatagtctgcaataattccagagcaccttgatctccctccactcatgatcatacatcttggatattcaatctctacagctaaagtgtgtggtgagtctgtggacatagagttcccttcattttttcctctggcttttgatccctgctttggatctggcactgtatacactgagatgtcaagaactaaggccttcttttaaggatttcacgttttagcaagatagaaaagtaaatacacagataatagaattcccggtgatctatgctccagtggaagcatgaatatgatgaggaaacctagagagggtgagtttctattgactagggatcacagaaatcataaagaggaaatgacatggggcatagcttctgaaggaagcataggagtagagctttttaggcagatgtgacagcaagagataaagcttgaaactttgtggtgtgttggaaattgatgaagaatggatatgcctagagctgagagtggaggagatgaagaatggaaggagtgatatagaacatcagactgggaacagaatgtgaagagtcaggtcaagccatttggcctttatcccataggacagatgggtgttgtttaaagttgtaaaatgagagactgacakgtttagacatgtacttttgaaagtacactaggaaaaaaaatctttggctaaacattgtgccagaagtacaaaggggaacacactatatgagccttctcttttcagcccatcttccctgtgaatgcatttctagaaaaagactgatggaaacttgtagtgtcaaaagagcagttataacgtgggaacacttagtgaagtgcatggcatagagctgatactccataaatatttgttgagtgaagggtgcctagtaaaataagatattaagtagataggaagtgtattcattttygtttttctgtgtatccagccatccttccagtcattctgccttygatccatccatctatttaatcatttatcaaatagttactgcatactctttgtgactgttcatgacctaatgttcaaggaacaaatcccctatgtctcttattttcaggaaaacggatgtgtatgggagagggcctggccckcatggagctgtttttattcctgaccaccattttgcagaactttaacctgaaatctcaggttgacccaaaggatattgacatcacccccattgccaatgcatttggtcgtgtgccacccttgtaccagctctgcttcattcctgtctgaagaagggcagatagtttggctgctcctgtgytgtcacctgcaattctcccttatcagggccattggcctctcccttctctctrtgagggatattttctctgacttgtcaatccacatcttcccattccctcaagatccaatgaacatccaacctccattaaagagagtttcttgggtcacttcctaaatatatctgctattctccatactctgtatcacttgtattgaccaccacatatgctaatacctatctactgctgagttgtcagtatgttatcactakaaaacaaagaaaaatgattaataaatgacaattcagagccatttattctctgcatgctctagataaaaatgattattatttactgggtcagttcttagatttctttcttttgagtaaaatgaaagtaagaaatgaaagaaaatagaatgtgaagaggctgtgctggccctcatagtgttaagcacaaaaagggagaaaggtaagagggtaggaaagctgttttagctaaatgccacctagagttattggaggtctgaatttggaaaaaaaaactatgtccaggagcagctgtaacctgtagggaaatactggaacaatcatccataagagggatgaacattaagtgtttgaattcatgctctgcttttgtgttactgtaaacacaagatcaagatttggataatctttttcctttgtgtttccaacttagatcatgtctaaatatatgctttcatatggctaatcatgtgttaatgactgttatttttctcttccaaacaagagcaaaatctccagaaatcctcaccaggctttattttttttctattttgcactgcatacttttattttactgaacataaatgcaatggtaattagatgctatgatcctgaaattattagccttatgtcaactctaaagcttaaacaagtgaacaaatcatacacatcaaattctagtcatcttttttccttccttctgtcttgaagtgtatgaaatgagaagtgacacattaaccttttcccagctcatctccaagagaaagtcctttatacttatcatgcatttgtaagataactcatgtgtatagttttataaacacacacgcacatatgtctgcataggtgtatatttacatataatatatacacatgtatatatgagattgatagtggttctttaatataatgagttcatattacacatattattatattatacaacttgctcttttttttaacttttattttaggaggtacacatgcaggtttgttatataggtaaactcatgtcacgggttttttgtacagattatgtcatcacccaggtactaagcctagtactcaatagtgatttttttttgctcctctccctcctcccaccctccaccctcatgctgtccctagtgtctgttgttcccttctttttactcatgagttctcatcaattagctcccacttataagcaagaacatgtggtatttagttttctgtttctgttagtttgctaatgataatggcctccagatccttcaattttcctgcaaaagacatgttttgtaataaacaatatgccaggaaaacttccaaggtagtagaaacctgacaagtcatttcattgggcagattacggaagaaaatatgaaatggctattaaaagtattaaaatagcttaaaaataaaaagtatacattaaagctacattacttgtagtattagcagtaaaacagacatttccttattgaagtaatagataatatagagcaactttttcaccaacactactatcccatgactgtgttgagcttaaagcagggagtgagcagtggttgtattagcaatgttgcccgaagttaccctccaggtggattaaagattctctaagttaagtgaaaatcataggcattaatagtgataagagtcttatgatatggagtctttttctagtgttgtgggaaatgctgtcaatagcatgaagccatgaagccatcaacttctcatcctggtttgcagtttgaatgtctctggttatgggcattgggaggtttggtaaattttctgtgtgctccacacatcaggaatgagactcatcccttaaaattaatctagtttcagattatagggtttcaggaacagatcagttcccagttttactaatttcatagaagaaaatgggattagagaaatctagaagaattcaggatctagtctagtctgtagatagataacaagaactagaaaacaatgcacaggtctacaatccagtaacagatgtaacttttctctacaaacatactttttctctctacattgatcacagaggaatctcagatttgttgtttatttcttttttttaacttttaggttcaaggtacatgtgcaggtttggtatgcaggttaatttcatgtcacaggagtttagtatacagattattatttcatcacccaggtaataagcatagtacttgataggcagtttttcgattttcaccctccatcgtcaagtaggccccagggtctcttgttcccttctttgtgcccatgtgttctccatgtttagctcccacttataagtgagaacatgcactacttggttttctgttcctgtgttagttctcttagaataatggccgccagctccatccatgttcctgcaaaggatgtgatcttgttcttttttatgtctgtgtagtattcctcagtgtatatgtacacattttctttatccagtataccattgatgggcatttaagttgattccatgttcttgctattgtgaatattgctgcaatgaacatgtgcatgcatacatatgtctttatggtagaacaatttatattcctttgggtagtatatacccagtaatgggatggctgagttgagtggtaattgtgttttaagttctttgataaatcacccaagtgctttccaaagtggctgaactaatttagattcccaccaggagtctataagcattcctttttctctgcagtcttgctagcatctgttattttttgagtttttattatgatagccactctgactggtgtgagatggtatgtcattgtggttttgattggcacttctctaatggttagtgatgttgggcatttttaagtgttcattggctgtatgtatgacttcttttgaaaagtgtctgttcatgttctttgcccactttttaatgggattgttaattttttgctttttaatttgtttaaattcctcatgggttctggatattagacctttgttgggtgcatagtttgcaaatattttctcccattctgtaggctgtctctttactttgttggtagtttcttttgctgtggagaagctctttagtttatttaggtctcatttgtcaatgtttgcatttgttgcaatcacttttggcatctttatcatgaaatctttgccaggccttatgtccagaatggtatttcctagattatcctccgaggtgtttacagttttaggttttatatataagtctttaattcatcttgacttttgtatatggtgaaaggaagggatccgctttcagtcatctgcatatggcttgccaattatttcagcaccatttattgaagagggagtccttttcccattgcttgtttttgttgactttgttgaagatcagatggatgtaggtgtgtagcattatttatgggctctgtatgttgttccattggcctatgtgtctgtttttgtaccagtaccatgctgttttggttattgtagccttatggtatagtttgaagtcaggtaatgtgatgccttcatctttgttctttttgcttaggattgccttggctattccggctcttttttggtttcatataaatttagcatagtttttttctaattctgagaagaatgtcattgatagtttatagaaatagcattgaatctataaattgtgttgagtagtatggccattttaataacattgattcttccaatccattagcatggaatgtttttccatttgcttctgtcatctctgatttatttcatcaatgttttgtggttttctttgtagcactctttcacttccctggttagctgtattcctagatattttattctttttgtggctgttgtgaatgggattgtgttcttgatttggctctcagcttggatgttgttggtatatagaaatgctatgaattgttgtacataaatcttatttcccaaaactttgctgaaattgtttatcagatcaaggagcttttgggtacagactttgggttttctaggcctagaatcatatcatctgcagtgatagattgacttcctgtcttccaatttgggtgagttttatttctttctcttgcctgattgctctgtctaggaattccaataccatgtttaataggagtggtaagagagggcaaccttgccttggtcccgtttttaagggaaatacttctagcttttgctcattcagtatatgtggctgtgggtttgtcactgaccactcttattcttttctttattcctcctttgtctttctctctttctttttaaattattcttgtttattggataagatagctcttactattttgacatatgtttcttaaaagcctgctttgttgaggggtttttaacatgaagggatgtaggattttatcaaaggccttttctgcatatattgagataatcacatagtttttgtttttaattccgtttatgtgatgaatcacgtttactgattcgtgtacattaaaccaatcttacataccagagataaagcctaattgactgtaatggattagctgtttaatgtgctgctggattctgtttgctggaattttgatgaggatttttgcatcaatgttcatcaaagatactgacctgaagtttttttttttttttttttttttggtgtgtttgtgtctgccaagttttaatattgggaaaatgttggccttaaagaatgggttactgaggtatccctcctcctcattttttgggaatcatttccatagtgatagttcctgttcttttatgcatctggttgaattcagctattgatccatctggtcctgggcttttttttttttttttttttccctggttgataggctttgtattgctaattcaattttggaactcattattggtttgttcaaggatttgatttcttcctggttcaatcttgggaggttgtatgtttccagaaatttgcctgtttcttctacgtttcccagcttgtatgcaaagagtgtttatggtagtctctgatgacttttgtattcttgtgggtttggtggtaatgtcccctttttcacttcttgttgtgtttatttggatgttgtctttttattagtgtagctagcagtctattgatcttatttatcctttcaaaaaacaaactggattcattggtcctttatatggtttttcatgtcttgacttccttcagttcagctctgattttggttatttcttgtcttctgctagctttggggttggtttgctcattgttttactggttcctctaggtgtgatgttaggttttaatttgagatctttctaattttgttttgatttccaacttttattttaaattcaggggtacttgtgcaggttatgcagctttgtcacatacttaaatgtctgccatggtggggtagctgcacagatcattccattgcctaggtttaagcccaacatccattagccattcttcctgatgctttccctcctcccactcccaaccctctgacgggtcccagtgtgtgtttttcccttcatgtgtccaggtattctcatcattcagctctgtcttataagtgagaacacgaggtatttgattttctgttcctgtgttagtttgctgaagataatggcttccagttccatccatgtccctgcaaaggacataatcttgttcctttttatggctgcatagtattccattgtgtatatgtaccatattttctttatccaggctatcattgttggacatttaggttgattagatgtatttgctactgtgaatagtgctgcaataaacatacacatgcatgtatcttttatttatttatttatttttgagatggactgtcactctgttgcccagctggagtgcagtggcatgatctcggctcactgcaacctccacctcatgggttcaagcaattcttctgccctagcctcctgagtagctggtattacaggcatgcataaccatgcctggctaatttttctgtttttagtagagacagtttcaccatgttggccaggctggtctcaaatttctgacctcaggtgatccacctgcctcccaaagtgttggaattacaggcg

SEQ ID NO: 17784 - DNA, 27074 bp, Homo sapiens
agtaaaagcatgagctctggagtcaaacagaccagttgaacaggcttctagctctgctacgtactgagtgaatgacatgggcaagtgactcagtctctcacctcattttcccatctgtaaaacactgataatgatgcttatctcactgagtgtttataaggattaaatgaaataaggtttgcagattattcagggtagttaacactagctgctatgaaaaaaacttcacaaaatctcagtggcttgagagggtttactcctcacccaatcaataggctgatgcaaactgggtgtcttttctgcacagctgccctccaagaggtgattcaggggcccaagctccctctattcccttggagtcctccactggacacctccagatggctggcagaatagcaaagacagagttagcagccaggcctggaagtggcacccatcaactcaactttacagtgcttaaaagccagccacatattctacttaactgcaagggggactgggaaatatagttgccccatgtgcccaggaagaggaactggtattactaagcatctggccattctctgccacaacatgtgaagtatttcacatagtgcccgataggtcataaaaactcaataaatattaatagaagatatggccaggtgtggtggctcacgcctgtaatcctagcactttgggaggctaaggcaggaggatcgtttgagcctaggagttccaaaccagcctgggcaacatggtgaaatgtcatctctaccaaaaaaaataaaataaaataaattacctgggcatggtggcctgcacctgtagtcccagctactcaggaggctgaggtgggaggatcacttgagcctgggaagtagaggctgcagtgagccaagatcaagccactgcactccagcctgggtgacagagtgaaaccttgtctcaataaataaataaataaataaaaattaagaaaaaatttaaaaagagaagatcctttaatgattgcctcctatcatatgtctctctactggtgtgaataccagaatacacagaactttagggtggacttttcagaacactgaaaacaaaacaaaataaacatgtggattccgtgtttctttttcttccttttcaagtatagtaatcacatgcctgacgtaactcctattctgggtgctctccatgaggcagcaggatacattggaatagcctgcattcaaatcctggctctgccctgagctaggtattaacctatgttagccactgtggttttctcatcttaaaacaagagtgccagtttacccactttccagggttcttaaaaaatgccatattccctaatctccaagtaaacacttccttctgtctggaataccctccctatccactcttcattagctacctcctattcctccctcaagtctcaacttagatgtcacctccttcaggaagttttccttatcttctatcccaagtgtggtttagtgcctctgtcttttgtccagtcagcctgtacttgccttcccagagcacttaccactgtgtattaaaatctctgttcactttctgcctctgcccagattgcttcttggggaaagggacttagttttgatcaccattttattcctagcatcattatagcatctggcccacaacgagtgtgcagtaaatattgtcatatgaacgaattaaaaattttgatcctccttcaaaatggtaacgcgtaagactcttatacgtcaacaaaaaataaaagtaaagacaaggtcaggaactggccaggtgcgttggctcacgcctgtaatcccagcactttgggaggctgaggcagatggatcacttgaagtcaggagtttgagaccagcctggccaacatggtgaaaccccgtatctacctaaaaatacaaaaatttcgccaggcgtggtggtgggtgcctgtaatcccagctacttggaaggctaagacatgagaatcacttgaacctgagagatggaggttgcagtgagccgagattgtgccgctgcactccagcctgggcaacagagagagacgctgtcttaaaaaaaaaaaaaaaaaaaaaaaattgccgggcgcggtggctcacccctgtaatcccagcactttgggaggccgatgcggccatatcacgaggtcaggagattgagaccatcctggctaacacggtaaaaccccgtctctactaaaaaaatacaaaaaattagccgggcgtggtggcggatgcctgtagtcccagctactcgggaggtgaggcagcagaatggcatgaacccggaaggcagagcttgcagtgagccaagatcgggccactgcactccagcctgggtgacagagcaagactctgtctcaaaaaaaaaaaaaaaaagttctggaagaaacatcacagtgtctttctcttttaaaaggtcggggtaactaagtagttgtttcagaaggcagctacaccccttgggtcatgacagggtactcctgagcaatttaccatcttaatttctcacttgagcaacagagagtataaaaaaaatcttcacacattaaaaaagcctggggcttgccctctccactcatctgggggtgtggcaacaagagctgtctcctgagggtggcccaggctgatgatgtgtcctggtaggcctgcagatatcactctcccccatccatgtagctgaggcacccctgccttcgctgactatcgtcaagagtgaggtctttctagtcccaatgtagactcttagatacaggatgggatctcccaactcccacccccagccaacctggcacactttcagtccaggccactgggcagagagatttccgctctgaaaatattgaaatagggtttatatctccacaaaccatggggataatgcctcactaactcctagaccacgcacagtgctggtgtcacacacctaagttaggggccctttctcaaaagctgcagtaaataaggccctccatgtgggcattgggcactgccagggaaacctcccaggagcaggtgatagttacaggaggcagtcaaatgcctaggcagatagggcgggtccctggtgaaaccccacctccaagttgaagacaacttaaaacctgaaagccaagctgcaagttaaatcttcagaccagattgagaacctgtcttcccatttggcacgctttcctctgattgatccccacccttcacctactttacatacacctaccctttcctaattggttttctacactgtcgtacccacctttgagtggtattttcactttaaccttttttgcatactcacaaaccaatcggcatgcactccctattctgagtccagaaaaagccctggatccagccacactgagaaaaaaaaacacccaactgtgggagcggggaaccacccccctccccatcccctctctgctgagagctggtccatcactcaataaaattattctctgcccatcctcacccttcaactgtcagcgaattctcattcttcttgaacacaggacaagagctcaggaacaaatgaaggtacaaactacaatacaggcagggtggggtatggccgggtgggtggggcagcaggcctggagtggggccttgctggccagaaatgtcctgagcccctcttctttggtttgtctgagaacaagggcagggcttgagggatgcacacacagtcccaaacacacatatgcacttggcaaacagacaacgttctccacaccacaatgaaatccaaatccacagactggccactgcaaatcatatatgactgcaagtgcacacacacacacacacacacacacacacacactttgaagcaggtgtcagcctccaagaaaaagtgatggacagtctgtctctcatatcctcacatatttggttcacctggagatggcctcagatgagccaagtgacacagaggtgcgagagactgaggatgtgctgaggtgttacccagcactccagtagtgctattacccaacacaaaaattggtctgaatatcagatttcaagcaagcaagggaaacccagaagagactgggagaagtccttatggaggctaaagcaactccatgttggatgctaatccacagttttggccgtgttggctttggagcctcccagaagacctctgagattcccaatttatcaattgctccttgtgtaagtgcaaacacttactgtaaatccggcccttaggtcaaacaaccttgatgttatcatacttcaactgtcctacacatcttttctgaatcacccttcccctgtggtctataagccctggtcctgggggtgaatcatggagacacaaacgtagcttctgtttataagtccttattaaatgtttttttcgaagaaactggatgtgtcagcctgtaacctgcaaaaggatctggctgctctctgcttgtagaaagaatggataataaaggaaaatctgctagctgccatgctagcaggggaagagcagcaaacaattccactcttcaattcatggggggaacgcaggggttttttaagaaaggatctgaaatgcagaaaaggcaagggggaggttaggaggtaccaggtggtgtgacttgctccagtggtcctctttaattatcgtcttatttggtggaggggctggtgcaatcgtggatcctgccaggttataaattagttactcttcagcagggtatatgttcaactcctgaagtaagcttttgttggagagagaattccggaggtgcctggtccctatcaggacgcagctcctgaggcatctaaggaaatatatgaccaggtaagagcatagcgtgtgcttaacaagcacgtaggtaaataaacgtgcgtaaggcatgggagtacagtatgggacaggaaagggagtggaggtcacagcacgtcctgaggctgtgttttaagatgagaggtaacatacatgcagtttgtctcaaaattatatcttgaggcccagaggaggaagagaaaaaaggaaagaagagaaactaagtttaaaacacggtttaaggctgggcgcggtggctcacccctgtaatcccagcactttgggaggctgaggcgggtggatcacctgaggtcaggagttcgagaccagcctggccaacatggtgaaaccccgtctctactaaaaatacaaaaattagcccaggcgtggtggcacatgcctgtaatgccagctactcggaaggctgaggcaggagaatcgcttgaacctgggagacgaaggttgcagtgatccgagatcacgccactgcattccagcttgggcgacagagcgagactgtaaaaaaaaaaaaatagataaaaaaattttaaaaatcgcggtttgaggctcagctgctgagctgctggttaaaagcctctttcttgggtctctcagcttcctgggactttgggggcaggtctgcataaactgcttagttgtggacccccctccaacaattaggtaggggactactcagtattcatccatcggtgtcctcagacccccagacggggaggccctggggcaacgccaagactcacaccggcgtcctggcgcctttgccctcaagggcctgcaactacctcctccccattcggagcggccgcggccacatccttaacgccaagccggcacgccaggcaaaagcggctcggacgccctcaccccaccttccgcactcagggccgaggctgtgcctggccacctgcttcccagcacatgcacacacgcgcgcgcgcacacacccacacacacgtacccacggccggccgggctacccggaccactttgatccgaaggcactggaggcccagagggaaggaaagggaggggtggccggagcccgctagcgccccaggacagcctcgggttgccccaggcggtagccctgtgggacagtggttccccgtccgcggcctcgggggcggggcgtctgtaggcctcgccccgctgacgtcagccctgcggggcgctggcggagcgggcggcggagctgtcagtcccagcccaagggtagctggaggcgcgcaggccggctccgctccggccccggacgatgcggcgcgcccaggatgctgccgtgcctcgtagtgctgctggcggcgctcctcagcctccgtcttggctcagacgctcatggtaaggctccgggacgcggcccttccctgccctgccctctccgcgcccgctccattaaagttctccatccagtggagagccctggctggctggccctctggcagagcggtgcccgggtgctcccttactctggcaaacctggatctcaggctcacctgttgtggaagtggaagaggctgaaattgacaggaactgacggattgggaaggatagagaagtatgcgcaaggccaaacccccaacccgcaaacctcatcatccacccacttctagatgagccgtaagtttagctctaggttttttgctgtttaggttcaaatgatgggacttcttgtccccttggggaataattttgatctcctgactctcccttctcttagtcgactcttcaactaacctctgtctgtccttctcccatctcaccttcatccctcactgatcaccccgatctgatcccccttgctccacctgtagcccccaactcactcccactgccccctgcctctctcctcctaacccagccagttcaggcttctaacccagttcaggctcctaacccagacagttctccggcaaggtttctgcaactaagaaaagtaaaccccagagacagaatgaaagagccgggagttggaaggaccaagagcagagacagagagcaaggaccgaaactgcttcttcatgacaccaaaatacaaagtaaaacatgcagtcagccattcacgtgatcgagagctgagtcggagatgtgcagcccaaataccacaacgactcgctgcatttttcactttccgtctaatgtttcgaaatcaaggcactgacgtgaagatcaaagacggtataagaaagaaagcaagagacagatgacagagtcctcccccccaaaaaataaataaaaaacaggtgcatgattagagagatgtagagaagttagaamactagggagcgggagcagagtcgctgtcaaatggagagaacttagaggatcaaggaggagagaaagggaaccaaccagccgttggccttgcacatacttcagtctgcttgatcaacaagactcttaaagtagaaatgtttgttgcattcttacaaagaagacaatgccttcagcagtgtttcccatggtgaatggtgtgtactgggggtaaagggagagtagagctaggaattggtattgagtatctctcctcggagctacaggtgccagctcttgtggggatgtcctcagccatgtgtagagccagagctgatttattccatctgtccttgcccagccagaggttggacatctggctataggcaaagccctcccagaaactagggaatgaggcaagcacttagcttggggagcccaggagacctatgaagagaaggaggcagatgtcagcaagcaggctgtctgtgtacttagtgaggtggctttgagctggagcctgggccaagccagggtggggatcaggtgtgtggatggggccaagcctaggaatagtgctagagcagggacagggattgggcagagccagggactaacacatctgagagctcattgccaacttgcttagccctcggcccctgccttcttccctggtaggcatcagactcagcttggctcttctcagcccccactgcagcttctgatcacagagagcacagggcagtgatttagggagacacactagctctagaatcagacacatgtggattcatgtgcccactctgccccttacgggctccrctggcctcgggcgagtcatagcctctctgaacctccctttcttctttggtaaaattggggtcatcaatgcctgccccccctcccagctgtggtactgacactcttctccccagggacagagctgcccagccctccgtctgtgtggtttgaagcagaatttttccaccacatcctccactggacacccatcccaaatcagtctgaaagtacctgctatgaagtggcrstcctgaggtgaggaaaagggaagagggagggggagggaggagtgaatccccgccttgtcctctactctcctagcatgggaagatacctgccttgttaatgaagtgagtgcctgagggcccctaacacatagccagcagttgacaagtactgactgagactcccttgctgagcaatgtgccgggagctctgggtgaaaaggccagagcctttgctcactccagagtaagaaaagccttgtgccaaggcttttctcttttttgttttgttttgttttgtttcgttgagacagcttctcgctctgtcacccaggctggagtgcagtggcgcaatctcagctcactgcagcctctgcctcctgggttcaagcaattctcccatctcagcctcccaagtagctgggattacaggggtccaccaccatgcctggctaatgtttgcatttttagtagagacgggttttcaccatgttggccaggctggtctcgaactcctgacttcaggtgatccacccgcctcagcctcccaaagggctgggattactggcgtgagccaccacctccggcctccaaggcttttctatcttactggaaaaggagaagcatccacagtacagccagacaacaggggaacactaatgactgtaaaggcagtggggagaagggagagaccaggctgtgctgtaggagccagaaagaatttctggaagagctgggcctactcgtattcctatctaaaaatctgctagaccacatggaaattggtacggggtcccaagaccaagggagacccctcacaatgagctgccgtggactagaggatatagcctgagggctgtcccagtttctcccaatgtgggagctctcttcctggcctcttgcgtctcccttaaaggaggtaggattgagcacaagctcgtttccagtgcctaacctggtatctcctcaggtatggaatagagtcctggaactccatctccaactgtagccagaccctgtcctatgaccttaccgcagtgaccttggacctgtaccacagcaatggctaccgggccagagtgcgggctgtggayggcagccggcactccaactggaccgtcaccaacacccgcttctctgtggatgaaggtgcttttcctcccttgacttagaacatggctctgaagtcccttccagccaggaactctagtctagagcttttctgtctattaccatagctcaccatgtctgccagcctccctggccggagaactagttgcccaaacagggcaggactttggagaatgttagataaaaatagcccaagttgtttgagatttaaaagggaactggagttgtttatcctacagaagagaggtcttggggtgggttgggrcagctgagtcaccaggtccaggcctgtgaacttgttttttcagggagggttcagggagaggaagcgaatccatgaacactcagcatagggcagcaagcagtaggcagaatttgggtgaacgccccgcttctttaggggtgaacacccaggggtcatccctttgaaatgggaagtgctactaaagagaagttatggatccctctctggagaggtaagaggaaaggataagcccccaactcagtgggatttttcatcccaccagttgggattgagaaagttttgtgtgcatggagacctcgctctgtaggattcagagttagagccgatggtctaggaggtcattggcttccaaatgcctgcccacaggccactgctcagctggtgcagaaacgtttcccagcaagtgtgtttaaaatatctatttccagggcccagcctcagaaattcagaccaactgtgtcttgaatgggcccagggcatctgtatttttttttttttaacattttgttcttctttgtattttgatttgagcaaggcaattataaaaagacatttttgaggaaatcaccatatttgtatatgaaatggtttttagggcatattactaggtatttgtttgttacatgtgataacagcatggtagttatatttacaaaggtgtgatatgtgagagatacatacttacgtaattaggaattaagtaatacagtgcttgggatttttctttaaaatgctaaagtaaatttcatggggggatattgatgaccctcccctgccaccaattacttcaaaattggcctagtgtttgcaattactaaagctgggactttggaaatcattatattctcttctacttttctgtctattggaaatttctacataaaaatataatcaatgcaatttatcacattaaccatttaaaaaagaaaacaacatttaaaaagaaactaagcaaagttaaagtagaaagaaaatgtcctaacctgtagaaaggtatctatctacacatatctaccataaatattatgcttaacagtaaagtgttgggctgggctcggtggctcacggctgtaatcccagcactttgggaggccaaggtgggtggatcacctgaggtcaggagtttgagaccagcctggctgacaaggtgaaaccccatctcttctaaaaatacaaaaattagccgggcgtggtggcgtgcacctgtagtctcagctactcagggaggctgaggcaggagaatcacttgaactcaggaggcagaggttgcagtgagccaagatcaagccattgcactccagtctgggtgacagagcgagactctgtctcaaaaaaacaaacaaataaacaaaaaacagtaaagtgttgaaaacgttttataaaaaagtttttcttttaattgacaagtaataattctacatgtttatgaggtacagtgttatgtatacataatacatgtataccttgtggaatgatcaaatcaaggtaattagaatatctatcacctcaaatatttagcatttctttgtgccaaaaacatttaaaatattatctttcagctattttgaaatatacagtccattattattactacagtcaccttgccgtgcaataggcaccagaacttattcctcctgtctcactgtaacttggtacccctctccttgttccctatccacttctcccacctgcctccttccagcttctggtaaccrcttctactctctacttctatgaattgaattctaaaagaattctacttagattctatacataagtgagatcttatggcatttatctctttgcacctggcttatttcgctcatgatgtcctctaggtccatctgtgttgtcccaaatgagagtttccttttttttcaatttgagacaaagtcttgctctgtcacccaggctgcagtgcaatgtcttgatctcatctcacttcaacctccgcctcccgagttcaagagattctcttgcttcagcctcctkagtagctgggattacaggcacgtgccaccatgcccggctaatttttgtatttttaatagagatggggtttcaccatgttggccaggctggtctcggactcctgacctcaaatgatccacccgcctaagcctcccaaagtgctaggattacaggcgtgagccactgggccgggcctcagtttcctatttttcaaggctgaataggattctgttgtatatacataccacatttaaaaaacccattcatccattggtgggcatttccatatcttggctgttatgaataatactgcaatgaacgggggatacaggtatctcttcaatacactaatttcaatatctttcgatatatacccagtagtgggaattgctggatcacatggtagctctatttttagattttcgaggaacatccatactgttttccataatggctgagaaattcaccaccagcgacrtgcaagggtttcccttttcaccacatccttgccaatgcttgttacttccatcttttggataatagccaatctaacaggtgtggagtggtatctcattgtggttttaatttgcatttctctgatgattagagatgttgaccattttttcatgtatctgttggtcatttgtatgtcttcttttaactgtctattcaagtcctttacccattttaaaaacaggtttatttgttttcttgttattaagtagtatgagttccttrtatattttggatatgaaccccttattcaatgaacatttgtaaatattttccacccattcatagattgtgtcttcactctagtggttgtttcttttgctgtgcagaagctctttagtgtgatgcaatcccatttgtctatttttgcttttgttgcctgtgctttagggatcgtatccaagaaatctttgcccagaccaaagtcttagaactttgccccaggttttcttctggtggtttttatagtttcaggtgttacatttgtctttaatccattttgtgttgattgttgcgtaagaggtgagacaaagatctattttcattgttctgtttgtgaatatccagttttcccaacaccatttgttgaagagactgttcttttcccattgtgtgttcttggcccctttgttgaaaatcaattgtgggtttatttctgggctgtccatcatattccattggttgatgcrtctgattttagggtatatgtatttttaatgtgctccccaagaagtccttacattctgctgcattgacaaaccygtggccaagttttaggyctaggttctaattaagcttaattctggaggcaaagtctcggsggggacacccaggccctcctcagccctcaagtctcatggtattcccccccaccccaactccatttagtgactctgacagttggcagtgtgaacctagagatccacaatggcttcatcctcgggaagattcagctacccaggcccaagatggcccccgcraatgacacatatgaargcatcttcagtcacttccgagagtatgagattgccattcgcaaggtgccrggaaacttcacggtatggggttccccaaggccccagggccagaactcccttggcttccctgtcccctgggctggaagcacccttgtgtgccattgggaactttgcttatggactaaagggagggtctgggatggtgggtgggcagaggagggagtagaaaccacctcagccctcagagctatgctcttgtgagatgctcctcaaaggaattgcctactagggcaattgggcaccccagagcccttgtagatgaagcaataaggctctgagaggctgtgtaacctaccagagggcgcccctgttatgggagagctggcatctgcaaaatccaccctctctcctctccaccactgttgattccagccccttctgggaagatcttcagcatctataaaacaccgctttttcttttaaaatacaaaataaaattgtggtcattacagagatcatgtgctgcattggtaattgtggggtttgtcatcttagacaaaggatactgaagggggttggctgaaatcacctctaaaggcccaccagctctcagtgtccgtgtgccatgaaataaaaggattttgttaattgctatcatttttgtttcagttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcrtctccctcaccaggcagtgtgagtcagctgggctgctctcagcatggggagggagactgggagggcctggtgcaatccaaaacgcgtgcacctgggatgctggtgccagccactgtgttaggtgctgcttcayatagctctgcatccttaataggagagaggtcctactgtcctcattttagagatgagggaactgaggctcagtattagcaacttcctagggttgcacagctaggacttggtggcagaaccaggtctcttggatctagggtcctcccactggagcacagcggtgtttcccaacaacatccccctcccccggggccatcttcagtgagctgtgctagttcctgttgttacagtcttctgctgttcttcctcagagccagggatacaaagggcttctccttacttcccctactctgctctgctcctcgccagagctgctaaagtcagcaaatactgctccaggctgtcagtcaggtgccggggctgtagggggagggagataatagaggacatggaggccacggtyttgcctaggaggatcttgcatcctggctggggagatagagtgtgcacagaggagactgtaacaagcaactcttattggacagcagatgagatgtccagtgcccaatgaaacatgccaacagtaagtgctctgggagggcccagtccagtgtgggcagagtctggcaaaggtgaaagtgactcctgctagatctgcaacaaatttcagtttgtgaaggacactcaacagctcagtgtcatttaagtctcaatgcagaggaaggcactaagtgggtatcaggcagtcttaagagtttttcatacattcattcactgatacatgaaatagttccaaatctcagctttacaacttttgaggtatatgactttgggcaaattacttaacttctatgtgcttcaggatcctaatatgtaaaaatggggctgatgatagtatttacctcctataagtataaaagttaaaagaatctgatggtattggtacatggtcagtgctgtgtacttcacaactaccttatgaggtcagtggctctgacagagtaattaatttgtccacaattgcacagctagtaagtggtgaagctgggacttgaacccagatctagcagcccccggagcctcgattcttacctgctgtaccatcctgcctcactgttctgtttgctgtgatgggagtcatgtgcagagagctggaagcagttagcgcatctcctgagggaatccttcagggcatggtttggaaggccaggtagggattcgcagaaacctagacacatctagagttgtggcctgtagtttgccttgggccactcactgaatggttcctgacagtgggcaatggatttcatgggaccagagtcctatgtccagaatcaccgtgccccatggtgacaggccacaaacacatctctctgggcctgcagatttcaccgtgaccaacrtcatcatcttctttgcctttgtcctgctgctctccggagccctcgcctactgcctggccctccagctgtatgtgcggcgccgaaagaagctacccagtgtcctggtgagtcttgcaaggaggtcactgccccgtccttcccagccacacccgagcttccaggagggcagggagctcttttcctcccagccagtccattgccttagcttgcctctgctctcagccctgatgtgattgggagataccttcatcaagcgctgtggggacagagggaggaagtgagcatgaagcccagtaccgagaatgttgccatccagtagctcagatgagacacatggaatcacaaatctcaatgaccacgagccattttgatatgatctactagtagttggccatggactagcccctgtgcattgcatctctgattatgaggcacagttattatccccatttcataagtgaggaaactgaggcacagagagattgttacacacagagggccacacagccaggaagagtcagggagggaacccactttcctactgctrttagccatgggtgttccacaagagagaaagaaggaaaggccagaagtgctggtcctcgggctgctgccagagtgggccagaggagagaggacactggggggcggtggggatgctgcgccactggagaggggatgctggcrggggacagggaggggctcatggaggaggccaagccctcctcccctcccagggtgtgtcctcttgctacattgtactgacaaatgatacatttgtggcaagccagtctccaaaactcagcttgcaaagattgggcagcattttccaaacctcggcctggtctctggcctggagttcaggycgcattgaagattgcccaccatagcctccatagctggcactattgcatgatggctgagggatcagctgggaaggaaccagctccgtctgcaaggcaggggccccacaactggaaggggaatctccagagcgatcctgggatctctagggaaaacaagacgagagacaagtgcagtggcacaatctcagctcacttgcagcctcaccctcycaggttccagtgattctcctgccttagcctcccgagtagctgggattacaggcatctgccaccatgcctggctaatttttgtatttttagtagagacggggtgttgaccaggctggtctcgaactcctgacctccggtgatatgcccacctcggcctcccaaagtgctaggattataggcatgagccaccgcaccctgccccttctgtacttttggatcacagaactgacttgtccttgagggttttttctcttcaggataaatatagctcaatcccttcatctgatgatcgtagtcattaccacatgaataaattataatgcacagagcactgacacattcattagtttgttctcattcattagcttgtttgatttgatctttcaacagttcatcaaggtaagtattattggacaaggaagggatttcaaatcaggacagttgaggatgaattccagatgtgttctttactgttgtgccactttgtgcaagtcatttaacttctctgagcttcagttttctcctctaggaaatagaggtaataatacttctcttacagaattattggagggtaaagttcaattcaacatatatttattgagcaccttctatgtaccacactttgttctaagcactgtagacacattacaacataaggaggcaggtactgtcattatttccatgttacagatgaggaactaaagcacagagagggtaagtaatttggtcagggtgacaaagctgataagagtcagagctgggatttgaacccaggaagtctggctctagaggacacatcctaaatcaccaagcaatgtgataggaatagggactcaaccaataagagctgcatttgaatcatcatgtaccaaggaaatgagggcagatgtgcaacagtgagtcagtgagtcagtcggcagaccttaggagggcctactgtgtgccagctcagtttagactctggagacagggtagtaaacaacactagacagttcctgccctcaaggagtttgtgttcttttgggaatgtggagtaagtgagtgtgtgtatggtgagagacgaaaacaaacaagtaaaataattctaggaacaaagtgctaggaagaagtaacagggttaatgtggagagagtggcaggagtactgctttaggcaaggtattcaggaaggctttgctgaagaagtgacatctgagctgagacctaagccatgtacaggacacagccatataaagtgccgaragcatttcaagcaggagggagagtgtgtgcaaaggccctgaggcagcacggtgcttgatgtgttctgggacagaaagaacaccagtgtggctagggcagaggggttatgtggcttccttgaaacccttggcaattaacagagagcagccccttcactgtgagttccacacttgtgccactgccccacgctgcagccaccatgttcgcgtgagtcactactcggggaatagaaaacttaatttggtgtcttacatccagaattttagaaaatgaagtaggcaggagggcatagactgggatacaatagaataagaactgcagaaatatcgtggcacagctcataatgatgagtattattttgtgaaactggtttcagttatttacatacgggttatatatacaagtcattatgcaacttatttctgattttgagtcatagtcaaaaaagtttgaaacatgcttctagatgggtctagcctgctttcaggtttgaaaagcactgtggatggagccacctgagagttttcaccatgctcagcagaccttggttctgcctgttactccatctgggcctgagaatacaagtttcttgtgtatctggcctgagccaaactgggaattgcattaggaggaaagctggattcgaaaacaaaacagaatacattccagtgtaatttagactgtagtctcctccatcgagctctcctcctgggcctggccttccccggcagcactgggatgggtgctggaaggtgactcctgcttctctcactctgccctctcttccccagctcttcaagaagcccagccccttcatcttcatcagccagcgtccctccccagagacccaagrcaccatccacccgcttgatgaggaggcctttttgaaggtgtccccagagctgaagaacttggacctgcacggcagcacagacagtggctttggcagcacyaagccatccctgcagactgaagagccccagttcctcctccctgaccctcacccccaggctgacagaacrctgggaaacrgggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctyggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggcccctggggcagaagttaggcacgaggcagtctgggcacttttctgcaagtccactggggctggcccyagccaggccctgcagggctggtcagggtgtctggggcaggaggaggccaactcactgaactagtgcagggtatgtgggtggcactgacctgttctgttgactggggccctgcagactctggcagagctgagaagggcagggaccttctccctcctaggaactctttcctgtatcataaaggattatttgctcaggggaaccatggggctttctggagttgtggtgaggccaccaggctgaagtcagctcagacccagacctccctgcttaggccactcgagcatcagagcttccagcaggaggaagggctgtaggaatggaagcttcagggccttgctgctggggtcatttttaggggaaaaaggaggatatgatggtcacatggggaacctcccctcatcgggcctctggggcaggaagcttgtcactggaagatcttaaggtatatattttctggacactcaaacacatcataatggattcactgaggggagacaaagggagccgagaccctggatggggcttccagctcagaacccatccctctggtgggtacctctggcacccatctgcaaatatctccctctctccaacaaatggagtagcatccccctggggcacttgctgaggccaagccactcacatcctcactttgctgccccaccatcttgctgacaacttccagagaagccatggttttttgtattggtcataactcagccctttgggcggcctctgggcttgggcaccagctcatgccagccccagagggtcagggttggaggcctgtgcttgtgtttgctgctaatgtccagctacagacccagaggataagmcactgggcactgggctggggtccctgccttgttggtgttcagctgtgtgattttggactagccacttgtcagagggcctcaatctcccatctgtgaaataaggactccacctttaggggaccctccatgtttgctgggtattagccaagctggtcctgggagaatgcagatactgtccgtggactaccaagctggcttgtttcttatgccagaggctaacagatccaatgggagtccatggtgtcatgccaagacagtatcagacacagccccagaagggggcattatgggccctgcctccccataggccatttggactctgccttcaaacaaaggcagttcagtccacaggcatggaagctgtgaggggacaggcctgtgcgtgccatccagagtcatctcagccctgcctttctctggagcattctgaaaacagatattctggcccagggaatccagccatgacccccacccctctgccaaagtactcttaggtgccagtctggtaactgaactccctctggaggcaggcttgagggaggattcctcagggttcccttgaaagctytatttatttattttgttcatttatttattggagaggcagcattgcacagtgaaagaattctggatatctcaggagccccgaaattctagctctgactttgctgtttccagtggtatgaccttggagaagtcacttatcctcttggagcctcagtttcctcatctgcagaataatgactgacttgtctaattcrtagggatgtgaggttctgctgaggaaatgggtatgaatgtgccttgaacacaaagctctgtcaataagtgatacatgttttttattccaataaattgtcaagaccacaggaatcgtgtgaaactagtcagattgctgatggcacattggctcatggaggactcggttgttgataatgaggagggtaataatgtgtgggatgtgtgatgtcactttaaggaaacagggctgaggactcaggcttaaatctgacagacccagggagtcctcatgctacctgtattgtgaccttgggcccattacttatcctctccaagttttaatttccccacctgtcacgtggagttgacaactccccatgaggatgttgtgaggtgtaaatgaaattgcacataaaaagtttaacatggtgccaggcatgtggtactatgtgccactagctgtcattggctgttgaggctgtaaagaaaaatggacagcttttcttggaaacaagtgaaaatgaaagcgataaggagtgtgcagcgggactctttcagaagacagaaaaggaagaggtggaaagcacaatgcaacgttttggatgtgagttctgacaatgtggagagaagaacctggaaacccctcctttccaggaagacagcaaaccgggcctccctggagctctgttcccagagccctgtccctggctccccttgcccaggaggcatgtcccagtggtggttctcctaagtgcggaagccatctgcactctattctagaagcagcctgctccctccatgaaaaaccccatgtgggtttgaatttctccccatgctcagcccagtgggtagaacaaacccaggcccgcggcctgagcttcctgggtgtgcttttctcttcgtcctacctgaatcccctagaaggtgactggggacacctcacctcttttcccctgtgtcatctccaatcttgcctcaccccgttcattctgagaaaataactagttctgaggaagtgctgatcctatcatcttcagagaacttgactaatatcacgccatttcagacctgctcaggcttttgccctagagccctccttgtcaatattggaaagaaaagtagtgttggtcactttctcctggaaatgaggtgttagcgatggcttattccccatggaaaaggcccctaaggtctaaatataaagattcagagagtaaaaggaattacattcaaggaactgcagccagtttggttggatacgacagatcaaagagcagcttgcaggacagaaggaagtcagaagacgcagcccttggtgcaggccctgcctgctccgtttctgtggaatgagtaggagtttgcgctggttcatctctgctttgaggctgctctgtaaccactcaccacagacaggcccttgggagaaactgagcgagtccttccaagcagccggggctgatgagacacttgcagatttcttgggaatttggattacagcccccaacagaaggccccagctgttcttcaactgagcaatctccttcaagggcttttccaagctgaggaatgcgtaatgctgtctttgtgtgagctaatggaacttcctcttagtacagagagggggtaaatgggccaccattgagtgaagaggaaattcaataaactgtgttttcccaactttgtaaatagctatagtcagggtgtgccttgtctacccagcatatattcatcccccggcctcagtgttcacactttcacagaagacacacagtccctaggaagctgggtcccacccccagagcccatgctgctctgctgggtggaaggtctctgagccccacatgggaacagcacagcaagggaagctgtaggctgtgaccacctgggaccactgacaggtctgctgcctaagtggcaggtctgggcagtcagggctgatttgatcaagcctcaacctagaggaccctagatactaggaagcttgactcattcatttcctgttgtgctcatgggttaaaaaagcaaacccacagttttgggtttgaagtaaaccccaatttaaaattaaatgcattgttattaatgacacacagcacattttcccactatcatctcgatcctaacttcacttaatttcccataaacctccaaaaagggttgtgggacccaataaacactctgccgaagaaggactgggtaggataaaacttgtgttttaagaatatggctctatccaaagcatcagacatgaatcagaaaggatggggcaggaggcaaagagacctggctggagacttttattgtagtcagcatttcattttgtcaaaaaacattacgaagcacttgttatgtgttggacatggtgtgcagccctgggtacagagtggtgaaccaaacaagtgtggcttcatggagcctgtcatctggttatgaagataaacaccaagcaaataaacacaacaaacgtattactacaatcagtgataagtgatgtgaaagaaactagtattccacatgaaggatgaggcaggaggcagagaaacagggtaggaggctgtcttaggctgggctactataacaaaacaccatggactgggtggcttaaacaacagacatttatctctcacagttctggaggtggggaagtgcaggatcaaggtgccagctgagtgagttccctgggagggctctcttcctggcttggagacggcctccttcttgctgtggccttacacggtggagataaagaactctggtctctcttccactttcttacaagggcactaatcccatcatggaggccccatcctcatgacctcatctaaaccaattacctcccagaggctttacctccaaataccgtcacattgggagtgacagcttcaacatgaatttggggaagacaaaaatattcagttcataagagaggcttatacaatagtctaatcaaatgacagtattgagcaggggcagtgggaacagagagaaagggacagactcaaagacattttaaaggaagcattatcaagatggggcaacaggctggagtgaaagaaggaggtctcagaagtgctagtcacacttgaacccgatgatgagaaaagcgaaatatggacatggaagggagacagaggtgtggagggagaggggagatgatgagttctggcttaataatgacaagtcatccaagaaaaggtctttcagcaattggcaaggctggcctggatctgtgaggctcagggttagggattcccatgtgagagtgaatgagctcatagcccttagtgtgaaggtaaggacgccggcttggagaagatccccaaacccctgcagccaatacagttagaatattcacgcgatgacttcctgccttgaggaaaagcaggctgccatcccttcaactcatcgagtcacaggagccacggctgtgtttggcatctgtcttgcagagcccagccaggagcctcactggggctccttggtcaatcacagcccatcatcaagggtgcagctgagggctccctttagtaagttgtctaatctgtagagctgagaggctcagggaggggtacagactagtacatgatctgcaaaggcctgggtgtagggtgccacacctgtctacctctacccacatggggcagaagggcgtggtggagattaagacctcacagtgaccctggagagaacaggaacattcttcagaatcctactatctggtcaccccagccctggaagtgacccttgccctccacctccccacatcccctctacctgtcccctaaggcagagtttctcagaagattgcctctatcagaattacatgggagtatttgtcttcctaagctgctccccaaggcccagaatttctgaataccggttcccaaggacctgctagggaaacaacttatagcgaccacattgcaggtgattccagcacacactgagtcacctctttaaggaacaacttgttgattcgctgcttgttctattaaaatcagtcctttttctcctcactgccccctacttgttatcacccagtccacacctttaagtgttatctggatgctggtggcttccaaatgtccaaacagggtttctctccagaactctatccagctgcctcatcagcagctccgtccagcatacatctcaaaattatagtgtctacaacagagctcatgattcccctgacactccttcctcccctagtcttccccacctgataaatggcaccacctttcccctagttcaggccaaaaatccaggagtcagccctttctgccccatcaaactccttagtaagtcctatcagctctaccttccagatagatggtgaatccaatcacttgtcaccacctcccactgtcatctggtcaaattcatcttcacctctcccctggaccaccatgaggctctgtcctgctcctctgcatccactcctgctccctcagtctaatctccataccgcagtcctcctgatgcagtgcacagagctgcatgggctcccccagaactggaggagctgggcagtaagcagatggcaggcagtgggcactgcagacgagactttgtcaggccaggaggacgggaggcaccgactgtatgggctgtcatggggatgtgcacaggggtcgatggcgtgtggagagcgggcatttggcccagctggcgctttctgggaggcctccttggggaagacaagacaaaggttctgaaaacttactggccagcaccaccttctctcccatccttcacaatcaactttttgaaagaattgaaagactcactgactccacttccaactgcttctgcagcactgacagctccagggacaccccgcacatggtatgctataatatgcgaatggccggatggactgccgcagcaagcttgttggtctggaaatgctccaaaggcaaagaggaagaggcaacagccccagggagtagaaagaatgctcagccactttctgttctctccacatgaaactgtcatgtcagttctgggcctcagtcttctcatctgtgaaatggacacagtagtcttcaagttgacttctttaattagtgccctgggcacattgctacccctgagtgtgctacatgcagtactgactgtaggctcctgggcagcaaaaacccctctgatttctctctgtgtcctttgcacccaatcaatgcctaacacatcgcaatgggtgctcaatactcaataaattttgatgaataaatgagtgcatggatgaatgaatttcttccattcgtggtaaggaacttgaagaagcatagtatccaaacatgagaaggcaacagtggtgatggtagcttgtggctgaacagatacttgggaggcatttagactgagcctaaagaaaagcagcctgtatatatctattattttaaattttatcttcaggcttgtcatcttcctagctgagtcatatcatgctggatcccttccctgcaattttcaccctacaactcttgggtgttgtaggaactcagggctatagaccaaatgggaaggcaaggggatgtggtcaagagacaaggcaaaggaccatgaaaacattcaacatgcattcactctttgggcaaacattcattgagcctctgtcatgggcaggccctctggaaatacaaaaggcatcagacatgatccttctccttcttggctcagttgtgtagtacatacacacacacacgcacacgcacacacacacaggggtgtctccacccacctccttctccactccccacccccacccagcactgtggaactgattagagtccatctggagggagaagtaggttcttgggggccaaagatgtcagagtagctgccagtttggactgaggctagaagtgggtgaaaaaggattattccgagttacctgagctctgaaatagcctcccagctggaagggacctcagagtcctcaggtccaatggcagccttatacaaacaaacacagcatcaggggctcagagagcttgcgctcaccagctacaaggggaggaaatgggactagaatagaagatgtaacttctttttttttttgagactgagactcgctctgttgccaggctggagtgcagtggtgcaatcttggctcactgcaacctc

SEQ ID NO: 17785 - DNA, 21636 bp, Homo sapiens
taatttagaagcactttaccaaaaagtacattttaacattaccttgcttctgggctatagcttatgactactataaatgagaggtatagtggcatgctctctacaccaggcattgcatcttagaaggtaagaatgataatgaggcccctcctatacatgagaacacggaggatgggagatgttaaataacttggttaagatctacagctcataaatagaagttgaccctagggctattagatgccaaagtccacactgataaaccgggcagaaagaaagaggcttttagacaaagaaaaaataaaataacatgtaatagttgattagtgctctaagttgtattacacaaaatgtgctgatagtccaaaaatataactaagaagagttggataaactgaaagtgtccatgaacttctaaggcttggaaatgggatggccaaaacccaagcacagaattgtctgccttctatgtcagagatttttacagtacctactctgtcatttaaaattatattgtttcccagacttcacactgacaggattttataacattatgcacatttaaaatattacttataatagaattgttacattcatttattttgagatgattttacctttgtaattctattttccaagtacacatttaagtcaacaatttggttcctataaattatatccactctgtctacaattccccatccaacttgggtggttggtaattacaactcagtcactataagaacaacttcctcttaccaaaatttttacaaatttgtggagtgtgtccagccagaaatcaacaaaaaaatatatattattacaaccactgaccattttcgcttcaaaattttaatgttatttttgtataatttacgtcaaagaaaatgtactccttttaagaatacaagttgataactaatgatacatggctattctagtataataatatcctagtgaataggcaaaccgattttgtcaccccagaaagttttgtcacgcccattgttatcaatctccttccacttcctcctcagataagtagtcatcgaatttctatcactgtacgttagtttttcctaatctagaactttatataattggaatcacagggtatgtgttccttcctatatggcttctttcactcataattgaaacatatttttttcatccatgttattgcatatattagtaatttttccctttcatgactgaatagcatttcagtgtacatgtatagcacaaattgttattttatgctctggaattggatatttatttgtttccagtttttgacatcttcatttttgaggaaacagtgggcccttgcaatctagtggctcagtgtttagctttccatgacatgagactcaaggcttatggttctacattcccagatatatggtctagtcatggcttctgtttctgggatgtcactctgacatgcttcaactcagtggttcatggctctggctgtgggcgaaaccctcatgtgaaatactttagttaatagaaaaaaaattgaatcatttaaaagtacatgatgggaagataagtaatacacaggcaatttctgctttcttccatgctacaaatcctcccagtggcaaggagcacaagtttgtgctgccatcggattaagtcattggcaaagtaaagataaaacaccatgagaggttgggcatggtggctcacatctataatcccagcactttgggaggccaaggtggccagattacgaggtcaggagtttgagaccagtctggtgaacatagtgaaaccccatctctagtaaaaatacaaaaaattagccaggtgtggtggtgcctgtaattccagctacttgggaggctgaggcaggagaatcacatgaacccgggaggcggagatggcaccattgcactccagtggggtgacagtgcgagactctgtcaaaaaataaaaaataaaaaaaaaaaacgatgtcctcctacacagtgagttctagtcaaacccaaacacatttaacccttcacctagagcacagaaaataaaactggtagcccacatgtcaaaaggtggatgtttttctaactctgggtctttaatctccaaaaatattaaggtaacaaatcaggagaatttttggtaaagaatttgataaacgtaacataccgtgtgcattttgcaattagcccacctttcatcaaatagatttataaaataaattagccacattgagtttgtttctgggataagcaattgaacatgtgattgcaaaggcagagaccttttctggccttccctggctcctctgtctaaagttcatgagtcctgcaatattttgtctcctactttgccaattttttttttatcattctcatcacttgctacatttgaacagtctgaatattccagttacatattacataccaggtgtattagtctgttctcatgctgctaataaagacatacccaagactgggtatttataaagaaaaaaagaggtttaatgggctcatagttccacatggctggggaagcctcacaatcatggtggaaggcaaaagaggagcaaggacacatcttccatggaagcagacaaaaaggcatgtgcaggggaactcccctttatgaagccatcagatctcatgagactttttcactatcatgagaacaacatgggaaaaacccacctccatgattcaattacctcccaccaggtgcctcccatgacaccaggggattattacaatttaaggtgaggttttggtggggacacagagccaaactctgtcattctgcccctggcctctcctaaatgtcatgtgctcacatttcaaaaccaatcctgccttccaactgttcctcaaagtcttcactcattccagcattaacccaaaagtccaagtccaaagtcttctctaagacaaggcaagtcccttccacctatgagcctgtaaaatcaaaagcaagttagttacttcctagatacaacggggatacaggcattgggtaaatacacccattccaaatgggagaaattggccaaaggaaggggctacattccccatgcgagtccaatatccagtagggcagccaaatcttaaagcttcaaaatgatctttgactccatgtctcatatctcggtcatgctgatgcaagagtcggggtcccatggccttgggcagctccaccctcgtggctttgcagtgtacagcatccctcctagctgctttcatgggttggcattgagtgcctgagtattccaggtgcatggtgcaagccgtttgtggatctaccattttaggatctggaggatggtggcccttttctcatggctccactaggcagtgccccagtgaggactctgtgtgggagctcacaccccacatttcccttctgcattgccctagtagaagttcttcatgagggtcccacccctgcagcaaacttctgcctggacatacaagcatttccatacatcctctgaaatctagacagaggttcccaaacctcaattcttgacttctgtgcccctacaggctccacaccacatggaagctgccaaggcttggggcttgcaccctttgaagtcacagcccaagctatttcttggccccttttagccatggcttcagtggcccgggaagaagggcactaagcctttaggctgcatacagcagaagggccctcggcttacctcatgaaaacatttttttccctcttaggtctccagtcctgtgataggaggggctgcctggaaggtctctgacatactctggagacatattccccattgtcttggagattaatgtcttagagattaacatttggctcctcgttacttctgcaaatttctacagttggcttgaatttctccttagaaagtgggttttgctttcccagcacatcatctggctgcgaatgtttcaaacttttatgctctgcttcccttttaaacataagttccaattccaaaccatatctttgcaaatacataaaaatgaatgcttttaacagcacccaaatcacttctggaatgctttgctgcttagaaatttcttctgccagatgccctaaatcatctctctcaagttcaaagttccacagatctctagggcaggggcaagatgccaccactctcttcactaaaacgcagcaacagtcacttttattccacttcccaacaagttcctatcttcattcgagatgagcagcatttagtcaaagccattcaacaagtctctagaaagttccagattctattttcctatctttctctaagccctaagaactgttccaacctctgcattttacccagttccaacatcgcttccacatttttggagatctttacagcagcactccattactcagtataaatttactgcattagtcatttctcacactgctaataaagacatactcaaggctgggtaattatatagaacaaaaaagatatttaatagactcacagttccacatggctggggaggcctcagaatcatagcaaaaggcaaaagaggagcaaggacacgtcttacatgggtgcaggcaagagggtatgagcagaggaattcccttttataaaaccatcggatctcatgagacattcattatcaagagaacagcatggaaaaaaaacagcacccatgattcaattacatcccaccagatacctcccataacacatgaggattattacaattcaaggtgagatttgagtagggaaacagagacagaccatatcaccagccttcatgtttgtctttccctcttgaatgtgagaccaaaggggaaaggaccatgatatgttttgactgaacctctggcacctagagcaatgtcgtccgtatatgtttgctaaatgaatgactagatgcactgcttgaggattctaacaaaagataaacttagctaaataatctgcaaataatcatccttgattatttttctaaccttaaacatttgtattaattataataatatcactcattatttgcttaccatttgccaggctatgttccatgcattttccacattttctctcacttaatgctcaaaactgtgtaggtacatactattaataaaattatttcacatacagaggaaccaatgcatagggaagttcattatcttgccaaggaagggaagtttaaaatgctaagttcgacattctcattccagagcctatgctctgggcctctacaatgcaatttccctcaaaaataaaccctccaggatgggtgggtggctcatgcctgtaatcctagcaatttgggagaccaaggtgggcacattgcttgagcctgggagctgaagacaagcctaggaaacacaaggagaccctgtctttacaagagatacaaatattagctggccatggtggcatgtgccagtaattgcagctactcgggaggctgagttggaagaatcatctgagcctgggaagtggaggctgcagtgagccaaggtcaaataactgcattccggcctgcacgacagaatgataccctgtatcagaaaaaaaaaaaaaaaaaaaaacagaaagaaaaaagcaatgtgaaaagaaggacattaaataagaaaagctttaattctggtgaaaaatgtttctatttcttaaagcaaaaatgtttcacagggacatacattacccacaactttcccaagagctatgaggtggggtcaggggaacagtggttcacatactccaaaggttgtgttacttttctccgtcaagctttctaatgattgagaaactcttcactgtgtgaatttaattgtacacatactttttcaatcctgtcttactctccaagccccattcccctcctaccctgatctatccaagggctggtgaagaaaatttcccatggatacactacctgatgcaggctacagttctgattctttaatgggaagaaaaataaagacatgcatatgcatgcacagtgagtatttcccaatacatgtacaggccctgccaaaaaggaaggcgaagcatactttcagtttcagtcacacaagaagggaggagagaaaagccatggccggtgagtcttttactgttccaagaacaggtccctgggaagaaagagttttggaaggggctggctcttctggaagccataattagcatctgtggaagtttacttgagtagaagcaaggaaaaggggrgagagggaggagagaaggaactagaagattcttgcagactttagaaaggaaaggcaagcccagaaaggaactgaggctttaggggaagcctgatgtcattttgcaatcttaattaaactcttacttacatgttgaaagtctgacagagggtacagaattggcacaggaggagtactagcagcagtggttcctaaatgaaatgggctatttctgcttcattactttattaaccagagttaaataaacatgcgacataagaggatgatctctgctttccagggactgatgtggaaatggtaaactcagtcttcaggtcactccatgcacatgtatggagactattgagggaaacaagtaggacagcaatacagtaagaagagggattacccaacygtgaggagggggacatttcactgatgaaatctaaatgaggtcactttctgktgattacatgagaggaatatgaggctgttttcatgatgtgagaaatccttgtgctcyaaacagacaaggtcctgaaggagaagagaaagctgtttatccrttccatgggtgaaggtacaataaatggcttactggatgaattattacagacaagggtgctgaacmaggaagagatggagaaagtaaaaygtgaaaatgctacagttatggataagacycgagctttgattgactccgttattccgaaaggggcacaggcatgccaaatttgcatcacatacatttgtgaagaagacagttacctggcagggacgctgggactytcagcaggtaagggtcagtgactyacacycaagttcacctagggcctgtcttcgtgcctaacatttgatttctttactagtcatgttaattggaagaaaactttcttatttctggcttcagggccatatttctgtagcagggtccctattgcatgtcccttgactctcctttgattcttttccttaatcctcagtggcactcttctgattaaagctcatttcctgttctgagtatgtggtagctcctttactgaagctcttgagaaccatctgaaaagcttcatgctgtgttttccagtgttcctggcaaggcaaaatatttacctgtggatttatttttgctgagtgcaaggggtctgtaggcacttatgkagttgtaaagtcacatgaagctttaaggtttataatcaaayactttttataacttttctccaaaattttaccctcccaaaagaataaaatatatttcaatgatggcgatacactcagagaacacattgaacgtatagaaaagtgaagatttctaatgggctcattcctccagttgcctccttgtattttctttsagtaagatcacctggttgcctgttaccaggctgtgggtcatgctgtgaggcctggaaatcctccacttgcaaccctcytcaggcccaatacagggctcaggaactgagctggccaaatctcatgaccacttggacctaccacgtggtgaggatgagagttctggtggattcccagtcattgatgtctgtggcacttcctaaagccacttcagagggagatgttctttgaaagcaaaagccttctgttctaagggttagggaaagcttatgcctgtctaagcagacattgcagatgtttctgttttcatctatgtgtaataaacacgtatttttctaccaatgcctctttcattttctacctcccaccactctctaaattaaagaacatcttkaacattatttaatgtcagtcagtcagtcagtgttatgggagaaatttttagtggggagtgttttacagattggggtaaagttttccagagatgataagtgactacttcaataccctttatcttttcatagatcaaacatctggaaattaccttaatatgcaagactctcaaggagtactttcttcctttccaggtaatgctgtttttaaaggaagagcattctttgacccacatcttccttgacattaattttgtaggatcaaaygtgggtaaatgggctatggagaattctcatagattggtcatataattttctttttgtaatctattctgcttttgtagaaactgtttccacagcttcattatccacatttatattaaaaattctgaatctgtgtctcaaatcctgattacccaaataagtaccaaacttcattatttaagcctactgaaatattcactcccatctcccagagacaccttattctaaactttcccagagctgaaaatgctatacttccacaccctgcttctcttccggttttgtgtaacttggttattggtgccaccgtcaccagttgttcaaaccaggaacttgaaactcatatgggacccttccttctcatgcacctctaacattcaacccatggccaagttttatgcaggcttttctcaaatttggaaccatctctctatttctacttctattattttattaaagaacccctattcccatagtgcactcttaaacttatatctgaaagcaawgtagaggctaggaatgcaaattatttatcaagttcagatattactctactgaatttattaaggttgggtatcatgaatattttcttaaatgtttcacagcatgggatattcaatatataaagaaatactgtattctctactatgaaaaaatagctcaaaaataacctaactacttctagtttttttctattgttttcacacttctttatgaagaaatccaacattttatccaacaaatgattattctataattttttccaatatatctattctaattmgttcttctccacatcagcacatttcatgctgcctttgtttatctaactgattgtataacmatttttcaaatttgtttttaaaattaaatattattttttgccttaatagcttctaaaagatcctccacacatctagaaaacttatttctattttaaaacaaaggttacrttaatttctttaacaaggacatcacattgttggattgtgttgaacctgtgatgaaataaaaggctcaaggattttctcacataaactctgtgaaaacatttcctcaagtgtctgtgcaatgaatgtttagtgctataaatccatctagtgtgtaccttgattttagcatttatcattatatcttcattctacttcatatattcaatattcatgtcctttcatatgtatacatagaaggaagagatcctgaaggacaggacaaagattcattaaaaaatattcctagtgcttactaccatgtatattaagtaaataaataaaaagataaacatgtattttaaaaaatattttagtagattaaattaagacctgatcccattaaattttatcctagggtttgaatattttgaaaaaagtttatattcttaactattttatctcacacattttttgttttctgagtgttttatcaggcatagactttaaattttccctttctatgttagtatctaaaatgcttgtagaaaggctgatcctgaaatatgaaagaagatacttgtaatgcatacctggaaatctcttgcttgaaatgtgctccattaggagcaaactcactcagctgtgttaatgatgtagatcaggattgtcctcctcagagtgcatttcctcttctgtggcttcatccataggtgaggctgtaacaaacacaaagtggaacaaacagggatgccactgttcatgatgttctttgtctcttgcagctcctcaggcagtgcaggacaacccagctatgcccacatsctcargcycagaagggaatgtcaagctttgctycctagaagaagctcaaaggatatggaaacaaaagtcggcagaggtgccatgctcagaacccaaggatagagtggggtgaaagaaacacttcargcagttctgaaatgcagtggcttattcttagagccaaccycattgagcagttctggagaatcatacttctgctccccttacataaaggatttctatatcctagaatcccaggtttatagaaagaggtccaaattggatccacttccggggtaaataacatcagtgatgacagctattgaatgcttattaagaatgggcattgttctaagcattttgcacatgataatatataatttttaaccttaaacacaacccattttagagatcaagaagctgagacgggattgttaaatatttttcccaaagaaaaacaatcagaaattggaacaatcagttttagaattcagtcatttttgcttcaaagcttgtgcatctttcaaaatcctacctatcaagaacaacgaagtcagaagctcagctgccatctgggcatttgcaatgtccatgcatactcttgaagcagcattcaattctgttcccccttttcaatgtatggttcatggggtttggtrtcttgataggactaaggaaggggaagctgtcataaaccaggaagggaaatatttaattggaaagaacaaggctgttcattcaaattgcatttcctacagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttyggtaagttctattatacaacagaaacaatggttatgcccttcgtataactraataatattagaaagcttggttgtaagaccaagaaatgtaatctcttgataatctaaartacaaacttgccatgagagagtgctggatactacatggtcctttgtaacataagagtcatgcagcacaagcctggtataactgaattgggaaatgttttattgactcagtaatgccactgtctctctacaagataactctggatgacttcctataacactttccttcacctttcttgaaactaagactaaatttttttttggcaccctgttgtttgtcacggaattccttaagaaactccttaagtatttatttattgactttccaaggtaccatgatagttaattacatagtcgaaaatcagtgatatggtgtctttcaggacatgactacagagctggaggcatttgcacaccgcccagagcacaagacctctgacagcacgttcctggtgttcatgtctcatggtattcgggaaggcatttgtgggaagaaacactctgagcaagtcccagatataytacaactcaatgcaatctttaacatgttgaataccaagaactgcccaagtttgaaggacaaaccgaaggtgatcatcatccaggcctgccgtggtggtgagtrctgatgcctttgagaacaccagacaatcaaatactatcctactctgtatgcatccaagaatttttggtttcttttggtttgtcttttaatgtcaaagaacacatactgtcagtattcaagaatgcagcttctgtgaattgaatggctggttggtagatatttattccatatttaagcttgagattttgatgtttggaaatttttacaatttgtttgatggttagaaaagataaacattgttgaaaagattgtaactgaaatgcatgtgtctatttgcatgtgaattaatgatagagcaaacacattaataaatatcattgaacagaggctaggaggaaaacatcttctcagccattggtagtagtaacaaatcaaactgtgtctttccagacagccctggtgtggtgtggtttaargattcagtaggagtttctggaaacctatctttaccaactacagaagagtttgaggatgatgctattargaaagcccacatagagaaggattttatcgctttctgctcttccacaccaggtaacaggtttctacacaggacatctttgttggkgctatcaatagaaaaagtgacaataacccactagaggtggtgattaacaactcaagaycaactcaagctttgttccaagttatacacagaattccctttatccaagagagcaattttgcatatctgttcaatgcattactaattaaagaattcatctatgtttcaaaatatttttggaactttgagcgatagcagagaattaaatggaagacggtatgtgctgtagtacattagaatctgactctgcatagaaaattctgccatgttgagatcattcattagtccaatttgcccagacatcaaatatttataggagaagagtaagagcaagattctgaaaagcagaacagcaagcgagrcactttggggccctaaattaaagtgggttttacctagaagcatgaagtgtgtgagacagaatatatttgaatttttctaaaygtaygctttggagtaagaatcttgctattattgactgacccagacatttagtattttgtaaaacagttccactagttcctcctcgggctttccttgaattgctgactaatatgtgaatataaatattatttttctaaggatttaataaattaatatatttgaaatattgggcacgacacaaaataaagcacacattaaaaaactgctattatttaaaatgtatatatttgataacttaattcagttacttttctaagcaaggtttaaataaaaattatttaaatcctttcattcaccacctttggcagtttcctgagaggacttgcattctyttggtcacctctggcccaaaggccctgyctctgctcaaatagttaagttttctaaaatrttttctaaaatgagatatcttctttcagaagaagcttggttctacattgggttgaacatgccctgatgtagaactcaataatttttttttcccaatgatcagaaacaatgacactacccaaaaacaccatatattttcagcctgagtacgtatagcagagtttaatattagacagaactgttcgttagtatcstttgatcccagccttccacatgacattcaccgctctctaagtagctctttgtaggcctctggcttctcattatcaatctggctgatttatgtgtctttcttttctttcactttccttactcctaccttctagatgactgtcagaaactccaattcagttatctataacttccatgttaaacctatctccacattctgctgtgccaatcccaaccacatcatagtgatctcctgaagaaaaataattatctacttccttaatttcacaaaacatttgcaragatatctgtctccacgatatctttcacttacttccttttactagaacaagtctcagttaaaggcttcatttagctgagatagctgggtttctaaatagaattttattatyaatatatactttatgaccwttakaactggctaaaatgtgtcattaaagaatgtgtctgtcattacatacagagctattgctgctgcttttctcttatgacttcctttgcataattttatgccttcattacttctgtgtctactatgtaataaattaatatttttctttaatatttctcttcttcataagaacttttttcctccaatatactgtgcttatttccttatctactcctcctagatttctacttttgttctgttttatgatttttatagttaactttttgtgtgtaaatatcttactgtcaatgttatttaatttcgattaatcttttatgaagtacataaattgagaatttgataatataattaccccatgtagactgagtattgcmtatcctgggttatctcaaacacttgcgtgacctcagatacctcttgtgtatggagttattaccatcccctgtatagctagctgagtctattaaatatcagaatgcataattaacttaaatcacagtcagtaataccactttgggaatgcacatttagatatttcrtttccaaatcccaatcactcccctctaccccattccgccttttccttatttgctactaaatttatgatttcaaacatccctcagctggagtataaatactagggtttcttctctttcttcaggcaagagccagtcttgagatttgaaatgtgctttatccatagataatgtttcttggagacatcccacaatgggctctgtttttattggaagactcattgaacatatgcaagaatatgcctgttcctgtgatgtggaggaaattttccgcaaggtaagatgctagtggatgctattttcactctacttccctgaatgcttggctattgcaattggaagcatagaaagcagatccagacaagtttatcttccaataatgctcttctttccaaaagagttttggagytctttggagagtggacaaacccaggagcctaatccaatctattaagacccacagccttgagaaaacaatcatttagtttcaccccgctcctgccctgcagagacaaatgaatggactctaatttacctgtgtctctcatggctattagatccagcagcagatttaaaatgccctgaggagggtcattcaatgcttacatacatatatggttatacttgttgcagatggaagtactttttgtttttgtcacttattttgctatatttgttgtagttttttggcatractcaagaaaktcttgaaaaaaaaaactcagcaaaaaaaagggctacagactttccttactcttttaggttcgattttcatttgagcagccagatggtagagcgcagatgcccaccactgaaagagtgactttgacaagatgtttctacctcttcccaggacattaaaataaggaaactgtatgaatgtctgtgggcaggtacatgtgtatggtcgggagtgtgggaaggttgaggaaagggtactgaaagtccatttkagtcaagaactcyaggtttacaggctgagaatccttaatccaaaaattygaattttgaaatgctctaaaatccaacactgtgtgagcgcccacatgatattcaaaggaaatgtttattgaaacatttcaaattataggtttttggattagggatgctaaaccagtaagtatacagctgaattccaatatacaaaaatatctgaaatttgaaatacttctggtagcatgcattttggataagggataatcaagccatatacagaaaatactgaagtaatgyctttcttctggtcagtgcagagcacgttgctcttctcccaaagtttttcatttagaccccttttgagattcatctgatattggcctagaagtggcygtaagactacaaaccctcacttttggatgtttctctccttcacctcagcagggtatatttaaacatagcatgtggtctttccttttaaaattgtgtatgttcccattggtggtataactttataacttgcatgtctttaacmaaattctttcctatgtttttttttttaattatttctttttctcataggaagtgaagagatccttctgtaaaggtttttggaattatgtctgctgaataataaacttttttgaaataataaatctggtagaaaaatgaaaacttgtccttatttttctcccacactgaagaaacagggactggaacttagagtgactaaggaatttagagtgtttgacttaatctgtcagacccaaactggctattggcacctttctttcccagaacttaaagtaaaataaaatataaaaatttaaaaaagaaaatcagacttacaaacatagcaatgttattaattactttcttgaacaaaaatttattttgtgccatttttaaaaaaagaaaaatcgtttgctgggctttctgctttggggatgtgatataagttacagcaggtatctgacttcaaataatttagagctcagcaggagagacgggggaagacagctagttatgacagcgacagtgtagtgtgataaagaacttttcccaaatcccacagtttgctactgacaaatccatgaacttgcatgtttctaccctttgcaaaagtatttaagacaaagtaagttttgaatcaaccctcagtagttcacagacttcttgaaaagataagacagccatccaaaatgaagcgcttggcagatggtgcctgacaccctgaagaaactctaggatgcatggtgtgcacagtgaagtcctggcatggtgcagagaaaacgagtttggggtgaaatcatgcactcagggatgttaagatttagggaggattcgaagaactaccccttacttgcaaatatgtttttttctaatatttaacagattaaatgagagttaatttctgacttcttaaacaccttcatagttgaacacattacagtctctctctctctctctttttttttttttttttaccttttattaactgtttctctgggcatatctcttctgtgttatcatgcatactctactacaacctgagactacatctgtgatcagtctttgctcagagaatatcaaaaaggagaagtgaattgccaccctaagtaaaaattaactgttaaagcagttttagtcagttgaagaacagcattccaggaagtagataagaggattccttcagaactgtctccaatcaaagcgtaagatgacagggagatggggaggagaagactccatcatgattcctcagcacagtttaaacaagaaatacatttattgaataaacaatcctttccttgtttctttttgctgttgttgttgactttgttgagtatcagttggttataggtgtgtggctttattttggggttctctattctgttccattgggctatgtgtctgttttttttgtacgaataccttgctgttgtggttactgtagacttctagcatagcttgaagtccagtaatgtgatgcatccatctttttgaaaagcagtttggagatttaccaaataactaaaaaaagaactatcatttgtccaagcatcccattactgactgaatcctcaaaggaaaatgtactgttctatcaaaaagacatgtgctttcaaatgtttgtcgcagcactattcactgtagccaaaataatagaatcaacccaggtgtccatcaatggtggattggatttaaaaaaatgtggtacacacctactatggaatgttacacagccataaaaatgaaaccctgccctttgcagcaacatggatgcaactggaggccattattctaagcaaattaatgcagaaacagaaaaccaaatatcacataatctcacttgtaagttctagctaaatattgtgtacacatggacataaagacgggaataacagacacagggaaataccagagggaggaatgaaggaagaaggcaagagccgaaaaactatgtactgggtgctattctcactacctaggtaataggttaaattgtactacaaacctctgcatcacctaatatactcttgtaacaaacctgcatatgtacccctgaaactcaaataaaaattgaaatgaaaaataaagaaacccaagatatacaaaatatttggttaattcttatgggaagatgcaaggaaactagttagattttactcattcaggacatgtgtttttagacgagcagaggtagaaaaactgacagatcagaagagagggatgaataaaagaagatgtggggctatggagagagaaaaggaaaaagaaaaccaggctgaggtttcaacccacaaaacaatgttttgtcatttgcattttttttccccagggaagaatctagagttcaagaatagaaagccaatttgcttactacagggcacttcccaatgatgaaactataggttcccagaagcaacttcccataatctgtaatcacttgtccccactccctgcaataaggaagtacctagtgtattttatctctgagtctgaggcactttccagtgctgtacaaagagacagaggctgttagctatggctggtgagtctgggcccttttctgactagcagctgggtactcaggtcttagaaaaatcttgatttattgctatgtgacaggcagaaataccaaaagggaaatcaaccaatagtgtgcatgctgaatctttctcttattggtggtatgtagtttgaatcctgagactctgtgtagagacactgaaggagagtatgttctctagatgttttcaagccagaaaaaggttaattcctttctttcagcttctggtaatcaaagagagagtaaggaaagacagagtaagttatttgtgtgagaaaactccggaaatttctaaatgcactctgaaatcttctctgcttcctcttgattccaaattaatcctccagactatgaaccttctccccacaatcagatctgagagcctctgtgttctcaacgtgttgtcatctcttatcttgaattatcttattggtctgtttaaagtgattgcatttttccacctttctatgtagtcctggtactaactcttataatgtaatatatcttaggttgctatcatagacttttaactgtcttcccactcccaaaaacttaacccttcagtccatactgcacactactttcaggccaactgtcttatacacagaagctaaaaaagcctatgagttggagtcctgggctacttaagcagctcgtattccagcaggtcatattgcgtctttggtttcattctcctcactggaaaaaggaagaaactggaatagatcagtgctttctaaaccttataacatatatgaataatctgcagtctttttttttctttaatttatttatttattattattatactttaagttttagggtacatgtgcacaatgtgcaggttagttacatatgtatacatgtgacatgctggtgggctgcacccactaactcgtcatctagcattaggtatatctcccaatgctatccctcccccctccccccaccccacaacaggctccagagtgtgatgttccccttcctgtgtccatgtgttctcattgttcagttcccacctatgagtgagaatatgcggtgtttggttttttgttcttgtgatagtttactgagaatgatgatttccaatttcatccatgtccctacaaaggacatgaactcatcattttttatggctgcataatattccatggtgtatatgtgccacattttcttaatccagtctatcattgttggacatttgggttggttccaagtctttgctattgtgaataatgccacaataaacatacgtgtgcatgtgtctttatagcagcatgatttatagtcctttgggtatatacccagtaaagggatggctgggtcaaatggtatttctagttctagatccctgtggaatcgccacactgacttccacaatggttgaactagtttacagtcccaccaacagtgtaaaagtgttcctatttttccacatcctctccagcacctgttgtttcctgactttttaatgattgccattctaactcgtgtgagatggtatctcattgtggttttgatttgcatttctctgatggccagtgatggtgagcactttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagacgagtaggttgcgaaaattttctcccattttgtaggttgcctgttcactctgacggtagtttcttttgctgtgtagaagctctttagtttaattagatcccatttgtcaattttggcttttgttgccattgcttttggtgttttagacatgaagtccttgcccatgcctatgtcctgaatggtaatgtctaggttttcttctagggtttttatggttttaggtctaacttttaagtctttaatccatcttgaattaatttttgtataaggtgtaaggaagggatccagtttcagctttctacatatggctagccagttttcccagcaccatttattaaatagggaatcctttccgcattgcttgtttgtctcaggtttgtcaaagatcagatagttgtagatatgcggcattatttctgagggctctgttctgttccattgatctatatctctgtgttggtaccagtaccatgctgttttggttactgtagctttgtagtatagtttgaagtcaggtagtgtgatgcctccagctttgttcttttggctcaggattgacgtggcaatgcgggctcttttttggttccatatgaactgtaaagtagttttttccaattctgtgaagaaagtcattggtagcttgatggcgatggcattgaatctgtaaattatcttgggcagtatggccatttttcacgatattgattcttcctacccatgagcatggaatgttcttccatttgtttgtaccctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttccacttttcctaattgaataccctttattttcttctcctgcctgatcgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagggttgttgaattttgtcaaagaacttttctgcatctattgagataatcacgtggtttttgtctttggttctgtttatatgctggattatatttattgatttgcgtatattgaaccagccttgcatcccagggatgaagcccccttgatcatggtggataagctttttgatgtgctgctagattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttagttggtaagcttttgattattgccacaatttcagatcctgttattggtccattcagagattcaacttcttcctggtttagtcttgggagagtgtatgtgtccagaaacttatccatttcttctagattttctagtttatttgcgtagaggtgtttgtagtattc

SEQ ID NO: 17786 - DNA, 83445 bp, Homo sapiens
tggattctttctaaaacaggtgacacgccccaactctcctcctcctctgctctgaggtagcctctgccccattacaaatgaagtaaaagtagagatgaggccaaagctggaagcagtgagtctgaaaggagaaatggaggagaataaggaagacgcaagttgggaaactgaaagaagagagaggggtcttcaaaaagagaagtttcctctgtcatgtttcatggtggacattggatgttgtaattctggggaatttttcataccaacatgtactcaggggtcatagcctctggttggcaagattgtgtttaaaacgtgcaaattccctctggcattattctgagacaagctttggggtcaaatatatgtggattcaaatctcaaaacactttccagctatgttaccataggcaaaccacttaactcctcagaacttcagtttccccatcttctgatctatctgatgtagtaaacactcacaaatattagtgtcctatgccccttattactgattccctactgggctcctagagactgtcctaggacttctcttttgcaaacaaatttaaaaatgaaaacctgacatttgatatgtacaaaagaatatagatggtggacatatgtctatatgttataaagcataatttaagaacaaaaactcaatttaagtcactcttttaaattcagaacattacagtgctgttgaagctacctgtgtacttttccacaagctcccacccctgctgttcaaggacttataaagtctttctaactgcccagtcccacccgactctatcctcactctgattgttagtagaggacacttctgtagatcacttgtagttttttagtctgattgaccagaagtaacatagaattaaggaagtcatgagcacttccagcctcagagagaaagatgccgagttcagtctgagggcctgtcacgttttttatcttcttttttttttttctaggtcttctgtggtgaagacctccttcactgtgacctgtaagcacgaggcaactgtttggggttttaaaacaagggcacagggaccgacatgatgaaaacaggttgcctcttcctttgagactggagagaaaggtgaaggatgggtcaggtcctgatctttctgattctgatagtggtcataggaatgaaaaagcacattgcaaacagatgaaagaaagggagacttgacagcatttgttggcttatttgacatgtccaggaatgggcccaaggcaacggtgaagagtaaaggtcacttgtagttttttattctaattgaccaggagtaacacagaactaaggaagtcacgagcacttccacctttggggaggaaggtactgagttcagtttggggcctgtcaagtcaagatggaaatcccctgcaagcaactagaaatatggagctccaaagagagtgtaggattgaagatagagatttgggcatcactcagggacaatcgttggagctatgtaaatgacaaaggctcaaggggcaagacacagaaagagaacataaggctgaaccttgagtgttaaaagaagtagctgtagctttgggtgtataggggcagtggaagaagataaggctggaatggcaccaggtccaggttataataggccttctcttccagggaaaggaactcggactttacttatagatagttggcagttactgaaggttttaaaacttggaagtggtacggtcagatgtgtgtttcagagagatgtactttactggtgcttaattactttcaaataaagaaattcataatccaaagaattattagagtggaggaagactggaggcagggagagtagttagaaggctgctgcagtagccctggtgtattaggccattcttgcattgctataatgaaatacctgagataggccatggtggctcaagcctgtaatccagcattttgggaggctgaggtgggaggactgcttgagctcacaagttcaagaccatcctgatctacatagcgattcttcgtctctactgaaagttaaaaaaaaaaaaaaatagctgggtgtaatggtgaacacctgtagttccagctacgtttgaggttgaggcaggaagactacttcagcacaggagttcagggttgcagtgagctgtgatcacaccactgcactccagcctaggggacagagtgaaaccctgtctcaaaaaaaaaaaaaagattaaaaattaaaaaaaaaaaaacccagagagtgggtaatttataaagaaaaaaggtttaattggcacacagttctgcaggatttacaggaagcatggtgctgacatctgctcagcttctcaggagacctcaggaagcttttactcgtggtggaaggcaaagcaggagcaggcacatcacatggcaaaagcaggagcaagagagagttgatgatgggggatgttgccatatacttttaaacacccagatctcacaagaactcactatcatgaagatagcaccaagccgctgagggacctgcccccatgatcaaaacacctcccaccaggcccatgtccagcattggcattaaaatccagcatgaaatttgagcaggatcaaagatccaaactattattacctggtgagaggtaatggtgtcctagactacagcaatgatagtggaatagagaggaaggggacaatattgaggctatttagaatacagatgcattgattcaataagggagatgaggtgaggaagattgaagaatctaggatggctgccatgtttctggttgggtgatgatagtgtatctaccatggtagagaataaatggagaggagcactcttgtgagcaaggtgacatgttcgactttaaatatgttgagtttgaaatggatatccgggtgggctggacatattgacacatgggtggtagttgaagctaaatggatggataacatttttggaaaaataataagtgcacaataaatgtctgttaatgatccataaatcattacagtccctttgctttctcttctgtggtgttcttcatgtttattttggagttccaccagagcctccaagctaagcttgtccaacccaccgcctgtgggctgcatgcagcccaggacagctttgaatgaggcccaacacaaatttgtaaactttcttaaaacatcatgagggttttttttgtgattttttttttttaaagctcatcagctactgttagtgttagtgtattttatgtgtggcccaagacaattcttcttcttccaatgtggcccagggaaaccaaaaaattggacacccctgcctaagtcctctctgtctgtgaatgtcaagactgtggcccccttaaggatcttttggatgtcctattttttgaaacttaaaggtcttataccagtcttgcaggctggccctcagaccacctcaccacagcccctcatccatattgacttaggaagagagggcattcggagtgtgaagaagaaaaactggaagactgtttctttttctttttattttgtgttttgttttgttttgtttttggagacagagtctagctctgtcccccaggctggagtgcagtggcgtgatctcggctcactgcaacctctgcctcccaggttcaagcgattcacatgcctcagtctcccaagtagctgggattacaggcgcgtgccaccaggcccggctaatttttgtatttttagtagagatgggtttttgccatgttggccaggctggtctcaaactcctgacctcaggtgatccacccaccttggcctcccaaagtgctgggattacaggcatgagccacctggcctggcctgtttctagtacattgtctggtttctatttctctcctctctatgagtagagttctcaaaagtgtaacctatacttgctgacagtttctcactttctagtggtaacttgtaatctggttcccaccttgctcactcttctgaaattgctctcaaatgtcactagagactttgtcactgccaaacccaatgcctcttctctctgtacttgttggcactgttagaacctcctccttaacagtctctccttccttagctccatgacatctcactttctttgtctccttcctgcctgtctggtggattctctttcactctttgggggtccttcttcttcccatcccctaaacataggtgttcctcactctctgtgccaggctctcatttctctgtgcagtctttgttgggatctaccctgttctcatagcttcaactcacactgccctggcagcaatgacctcctttctctctctggttctgacccctctccacagcttccagctctgaactcatcacttcctcttcccccacctcagtctcctcaccaggtgtgatcccccccaggctcccctatgcccgtgaatgacctcgcagttctgatcacctgacttgagactctagtatgatctctgaagcttccctcttttgctcaacatgtcaagttggcttcaaacttttttcattttcttttgatttttctgtactccaattcattttctgtgttccacttttcaccattgccacgctgatttgggctgtcatctcttcatgcttatattattgcaattattttctatcgtctacttgcctactatatccacttggttcaaactattttgtcacctcccgattaattttcctaaaatgccatagctttctcctactccatccttcccaagaaccttcaattgctctccgtagcctacagaaactctggcctgaccacaaatcagcacaactctgtgtttcttccggatgttccccttaacacaaacactgcctatggtgcctaacctttagtcccgtccttccagcttctccaatgaggctatttgaatggacatttacttatcttatggcttttagtggttaaactaagctacattcctagtttctttcctttttttacctgaatttatagcaattcaatatggtaacactggttattgattagcagttaaatgtttatgatgatcagaaatgaggaaataattatattctttttaaataaatgctgggggtgggggtgaattaaaacctctcaacacatagattcagaaaattaaagaaatctttggtgatgaaagggttgagaaccatcaccctgcactctaatctagtaaatgggacagtttgatgctgtttcccaagtgaacttgtattttcacgtctccccaggactctgctacgttgttccctctgccttaaatgcaacagagtcctggggaccatctctcagcacctgaatcttctgcttcctttgggaccctaatcagatgttacctctttcctcccacatctgctaggagccctctgagtagaatgacctctcccttttacagccttcagtacctcccgcacttcgctgagggttccggccttatctttccttacagagaaagccgctgcaggtgggcaccgtgtgctgcgcgtctctcacccagcaccgcacctgggacttaggagacggtgaacaacacgggaattgtgcccaaagatacagtcctgtggctcagggagcccaggcctactccgccccaatctcacttccaggcgccgccttcggcgctgcctgcagggccactgggccggtcctgaattcatttccacttcgttaactcggtcccagtcccgccccccggctccagctctcgtaacccatcgctgacaggaccgcctcccttttcttccttctcccttcccctgtcaccctgccagctcagctcctatcgtttcgcatatcgtctcttcatctctctttctccccgggtctgtctgggtctctgtctttggatatttctctctgcgcctgcagctgtctgggtctccgcttccttgccccgcacgccccgccccctgcccaagaccctccaatctcggcggctcgagcctggcgctccactctcccattggtctgttcggagccccccgcccccgcctgcccggcccccctccgggcccctccattcacacaaagtttggctccggcgctgcggagggagggggcggcccggcccggcccagctctgcccccggccggcccgaccccggccccggcccccggacaagcccttatctgatcccagctccgggtttaagagtcctggcccggcccgtcgcacagctctgctcctaactcctgcccgccccgtccgtccatctgtcccgctgccccgcggcccatccaaggggccactccacctcggacccaaggtaagaccctggccctgatgaaggagttctgccgccccggccgggtcctgtccccctaactctccagagacatcggggtcccagatcctcagtccctaccctgcctggcctcagcggtaccaccgtcttgttcccctgcctcccgccttgggcagtcccaaatggagcctcctgggaagggctccccacgaggaaactagccaggctggtcacctcagccctttcatctaaggaaggggctttcccgatgccccctcccactgggcagaccagcagttgcatccctgctcctctagttaatacagtgacaaccacacataaccaggcaccccatacacaggcacaacagacagtgcgccctcctccccatatggacaggttactcccatccccagcccctcccccactccccatacagtgacaatcacatagtgacacccatgatcgctagttcccacatggggagaaaaacagatactggcagcttaaaccggggagccaccaaagcctggtgtgctccagacccctgcccamccaatctcttccttctattctgagtggctcccattttaagacatccctcctcatggcccctcaccctcaccccagctgtttcgcactgggatttccagaaggaaaggagcagggccacttctgctagagtgagaagggcagattgggttctataaactcaccctccagatggagacgccccttcccattccatycctcctctcatcagaactaacccagggcacctgtgttagggaacagatgaaggatggaacttcctgatttgggggaggagagctgaacccaggaatgggtagaaggacaacactgggaaaaagtgagggtgggttctggtgtcttgaagtttaattccagtgagtgccccaggcagggtgaggcagatggggaagaagctggtgcagatttggaccccaaagaggccagtgcttaaagcctgcytctgttgcttaccaatacaaattctgactaaagatgtctggccagtctgctcttgctgtggtgtttgaattttttttctccccactgggactgctttaggctgcctgggtgggagggagataatgacaggagatttagggcccccatgtgagagatggccttgtttaagggtgctgaggagggcctggagtggttgtcatgaaattagccccaggaggggtgggcagccaccagtgagttcaatttagtttcatcctgaaactctctccctaatctccaaggatttttgaacatattcctggcatgatggtgggtaccatcctgtgccaagtggtagggcttgtaaatttctctgggggtagactgggtataggggaccaagtttggaaggaaccaggcatcctgactcatagctggttcttcagggaggaagaaacgagggaggagggggatggaaggcatcatgccagggagagggtccagggctggattgtggaggcaataggcacggcccaggcagtgccaactcctttccccgctgccttcccccagtcctttggtggtggtggcaagggaggaagggagggagagggtgttggggggtgatctgggctggtccagcctcccaaagcccttgccaacctgggtcctgaaaggagctgctgttttctgagccatccccccaccccccactcagagcctgagcagccaagttgtctcagcggatatcaaatggcaatgactccaccgatggagggtgggtggggagtgggagtggcaggggtagcagggttatggttccagcccctctgtggctctaatgcagaacccctctgctatcccttaccctgaggaaaaaataaatccatcttccccaacatctgacccacatccagtctatgggtgcatatgtttgtgtgaggggattaatgatctgcccgctggtatcccctacctcctccgtgtgccccattgaaccacattctagctccctcccacctgcatcactgtgcataagctcatttacagctccagcttggttggcttgagctacaaggaagtgactggcagaggacccggggaccttccttcccttgaccttccttgggaccagagaggctgggacacttggatcacggtgggctcagatgaagtcctctggagtcattctgtgattggcaggatagggggtttaaagctctagggggtgggtcatgcagaaagatctgtttcctcaaaggatactcctgagcctcctggtaaaactcttggtttctgcacacaagatggaaagataggccgagcctcctggcattggtggggaggaaaagagacattgggcaatggagtccctaagctttccagccacaggttatttaggacggaagaaaaaaacctccactctccctcccctcctcggcctagattcttctcttgcctgactggtcagtgctactgtccaggctgaggccaagctgtccaggatagcagtggggccctggaagggggcagagaaggaatcagccaaggcacatcgttgagatgaaactacagaaagattggagaggaaagggagatttaaaatctaagtgttttagcacccaatggtgggtggttggctgggcagctcctgggaatgggagtttgccatgtcacytcggtctctccagcaggctgagttcaatgcttttcttccctcatttgagtttagcctacatgtttgccaccattctttagggagagagtgcatctggtggcccctcttcctcccctcccccatcagaaccttgaaagggcaaagagaaagggattgtgggaaatgccctcccgtgggtgtttgccagcttggagcctggatttgaggtggtgggggaagggaggggctggctctggaatgtgagagagaagtaagaacagaactttgtggcatggagaaggaggttggagaagcaggagctagaagaggactgaatcagacctcaagcctccaacaaggtgcagcacagaaagggtatacatggccattgtgcaacttttccgatggcacaacacctggggaaaggattgtggctgcagctagaaggacttaggttagatctcaggaagcacatcctagaaaaggaaagacatttgaaatggagactgggaaggaaagagagaccactttctggaccaaaaaaaccaaccaaaacaaaacaaaaaccaccaacaaaatccccaaacacagaagcccatccttaaagcttccgagaggagtgatggagctcagagtgcagggattattgtgacaactgtcaggggcctcccctgggtggctgctgcacctctctcttgctgttccagggctactttccgctctgagagacagcaggcactatggttaagagcatggccttggagtctgactttgtgggattcggtcctggtttaccacttagtagctaaggaagtcccatcctcacaatagggctcataactgctgtgaggatgcacagtgactaccgtaaggggcttggaatggtccttagtctgtaaaaagtggagttgtgggccattgcttttctcccaccactctaatgttttctactgtgtcatctttccttgttcctgggctttgtcccagcccttctttgtgggttttgctttgttttgttttgagattctgtcctaggttttttcttcccacccttctggagtttgggaaggtagaagaattatcaagcagtttaagatgcatttccttccttgattccaataggctgggcatcacttgaggtggggtctccacacccacagcccctgctttccacaagtttttgccaagcagatgtcctgtcttcagattcaataaatgagaactgagtggttgagctttcaccaaatagtctctttccccattctcagcaacttctctttcagccaaagacttctgtcagagacttcttctgtcggtcaagacaacccccacatctcattcctgctcccatggtcctgcctatcgctcttgtattcttcatcctgcctctccctctcccrgcccaggtttgcccccacaacttctctcaggtttatatgcccttctcttcttgtgtctcctgattggcttgttcatcccatcagcctggatgcccacagcagcctccttaatgacctccctgactccagccccctctctcctcgactccttccctgttaccctataatgaaattatcactggaattgtcatcatgaagcatcagttttatcttgccctttctctacccagacacatctgttggcattggataaaaatttcccaatcacaggcttcaagagactttatgcctttctcccatcccctccagccccatatcttgtggaactgcactcttcagaccctgatcctggggagcatatcccaggcagtctctgagccatgctcctccccacactctggaccctcacaaaggccattccaagtctcacccctcccgcagatctctattctcctgtttccctctctgctctgccatcttgcttgttacttgcatctgcaacttggcccagggttctccatgcatggcgatgttggaggagacttgtctccctcattagccgggggtttcctctagggtgaggcctgtacctccgtcagattggcaaaggcatctcttctctctctggaccctctggcacccagcaaagggcctgcctcctaagacacagagtagctactgtccagtttgactctaggtaggaaacatttctgatcgcttattcttggggaaggagcctgactttggaggtttatgtgagcatcctgcagcagggtgtgtataggatcctattatctaattctataggagatctcaagagaaacccctctcctactaacgaccccatcctgtagacatggcttcaccctaagattacaagccctagaacccccaatttatagtcttctaagcattgttgctccacccacccccccaacacaaatgcaggtatgtaggccccagagagcctttctcccctcaccagggcagtctgactccagcctgaggccgggcttgtcagcagcatcgtctggaatgaaaaagggggataaaggtcagagtctagtctgaggcagccccattgtcctgagcatacctctgagcaggggcttgcaaggtggcagacawgtgaggtcacctcccaagtggggtataggtctgacctcttagcactgcattctccctggaccagcctcctcagctccacttctgatcccagttccaactgstagagccaggcacactccttctccacgtgtctaaacctcccggttgaccctgtgataaaaaagatatrggcaactggtaagaggagagggtgagtgtattagagtctagagcactggtttttaaactttttgacctcaggaccactttacattctaaaaagttactgaagactccaaagagctttggtttgtgtgggttctatctatgaacatttactgtgttagaaatgaacactgggacacatgaaataattattaatttttgcatgttaacaaaatgacgtatttttaatgaaaaacagctgtattaaagtaaacaaaaagttaataagaagagtgacattgtcttatattttcacaagtctttttaaacatctggcttaatcaaagacagttgctttctcatctgcttctgcatttagtgtgttgcaatatcataggtcatgtaccttctggaaaactctactgaacactgtgaaataatgaaagtgaaaagggcaaataatgtattgttagcattattatgaagataggtttgactttgtagagcctccgaaagggtctcaggaaccctccgaaagggtccagggaccatactttgagaactgctagtctagaggaaccttagaagacagtttcaaaaacctgggccaatttgaatatcctcgttgatttccttcagctgccatggtcttttgaatgttctcaccagggaggtagtatggggtagtggttcatcatgttaagttctgcctctgttctactactcactagctatgtggccatgggcaaattattaatatctctgtgcttcagttttctcatctataaaatgggactttaaaaagcacccacctttagagttgttgagaattaaatgacataataggaaagggctcagcgtagagctcaatgatgtgagctctcattaaattccggagccttgcccctgaatccactgcgcattgtcccgaaggcagggagctgcagaggagatccatccaatgctacacataggagctcrgcccagagagggaaagtgacctgtgcaagttcccagagagagttgacarggttgttgggccccgaacccaggagttctaaggcctagctccatctctgctctccccgccagaatttttttgtggagagtggaggagcaaggtcctaagacggggaaagaagcagactttacctttcttttccccagcaatctcaggtgagcccagggccagggcagtacagtgggaagccttgagggcagacagcagggagaacttccgatactgacagcaactgaaaagaggagaaagaaagctaggaagacattttcaagcccagagattgttctgtcttgccgtgtggggagcagttctgcaaagtgtccccggccttctcttcctggggctcgtaggaagtctgtgattgggcraccctgcttctcatgaggtgctcagtcccgctcactgccctcctctcagctctcccaccacccaaggcccaggagcccctccccagatcatgccttctggccctgccctttgtgctgaggcaccacaaggcacaacatggtgccttggaaaagccagttggtggtgctgagggcattaatgaggataggggtgcctgctggggttccctgggcaggagaagggaagcttctcctcacagattgtagaacaggaggaggcagatggggagttagacatatactgggaagagctagtcctggctcattggcccttcagtcaaattcccctgagctgggcttccagctccaccttcactagttcaggttgaattccctggaagagcacaggtggcaggcgactcttgtccctaacccctgcttcccctgtagtagcttcttcagcctccagaaccagagcaggtggagatctcaaagaaggtggcaccccaaggaagtagaaccccaaagaccccaaaccctgagcacatgcccttcctgctggggttggggaacttgctatgtattactctgtttttcttctcctgcccacaaaattcctttgcatagatggtaaaactgaggcaaaacgtgggaggacttagactgcccacccacttctttctagagcccagcctgggaccaaggggcttggcatcccgcagcccctcccgctccactcctaccagtccccgtggctttttccatttggaaagtcctttctggcgagtggcaggtttggaggccctagtctagtctcctcccctgtctcctgggcagtgcccccaggggagcccctgtgggccaagatctccttagtctcagtcctgggcccccctcaccctctaccagcagtcccccagctcccgcccctcggctgtgggacagggagagggctgaggggctggctctgcatactaatgtcctgcccattgtcaaagcccctttgtgccagggagctccattgaggcggctccggggcaggcacaatgggggctctgtcccctagttcccccaaacagtcacctgctttcagagccttccccaccacccccccttcgccccagtgtccggagggcccagagagcacgggggagtgggccctgggccaggggggatgggcaggaggtgactcccccactctctgggcaggctggggagatgggcatttgacagggcaggctgcagagggcacacagaggggagaggccctaggctcacaggggcaggggcagtctgtggaggagttggaatgcaggttctctgaggcctgagaaggggaaggggcactcagagcctgcccacttctcggttccgtatgcccagcctggacctgtggctgccacctctcctcctcccactacaggactccccggggctcatatatgcagagacacacaggcatacactcatctatgcggccccacacacggctcccaacacacacccaaacggatgtgcccagacacaacacactgaccccagcacacagatcgcacgtccacaacaccacctcctggcatatgcacctgcacacccaccctccctccaccccacccccctttcccttttgcaccccctccacggccgcaggcatctcagcaccatgtccctcccccccatgcccttgctgccctctgctgctctgacactggttataacaagtttgcacttgttgtgaccttaagaatgtggccctggggctaagaatgtcccgctgccccagactgcacctgcttatacgttaaccatggacacagcctcttgctgcactctaagcaatgctcccattcctgcctcaaccatggaagcagttaggtgggccaggccccccaccccagagctgagtcaagtaccctggactgagctctatgtgaataactaaagccccacctggcctcgctggcacaggtccagtgtgtccgtctttgcatttgcccagggcacatagatatttcctagcccttcctggccctgggaggtagatggaacagttatcattttcccagcaaggctctgagaggtaagatgatggtgtccaggcagctggtggcaagkctgggactagaatggaggtctctcaccgctagtttttttgtgtttttcccccaactatttgtctcttggtttcactcagatgaccccacccccaaccctatctacaattccaacagagctgtcttttagccacctttttttgggaaggagtgggggcatggtgaggggaaggggtggggagaagaaygggtctaggagccttaagtgggcttctgggtctagaaagaacctccgaaggtcactttgacccttgcactacccctaggcagagtgagcctacctcctttcacttcccaccctcctacyggccccactcctgctacgaactctggatcactggaaagtaaccccacagccttcttagctagggtttggagttggggatctctatcaattataagtccttcatgctgcctagcactggcctttccagttattatcctacgtctgcacgaggatctgtaggctgtatctacggctcacctgctattctggtccagagcatcttctagcagttgggagcagatgccctaaaaagggaagagaggaaggcccattgggatcccagagacttgagggctgactgcacagtggtgtgctggggcctgggagggtggatggggtcacagttgcagaaactctgttagatagagaactaagctgatattggtttgctcatcagcaaatattattgagtgctaatctccatgatgtttcctcccatcawaattgcatgggagaacctcagggcccttctactccttctcctttcccctcatctaaaatgcttcccctctggctactggattctccttaagccgcctcatccatctgtcttccttcatgcaggaacacacctcccccagcccttatactctggtgtgattcttttgctccaaatgttccctactggagaaagagaactgctcaatgtatgtaacttcagctttccctgctgtgctcgggcagttagttactataggagacagaggacagtgagacactcacctctgaatctagttctgtatctagtaagtgtcctcatgccatccctaccccatcctccttcttaagggaggaatgtggataaggaataagtaaaaagttgagagggggcagagagattgcctcccagagtcatggtgagctccctagactcctctgagtgagggtcagaggctgctcttcatgcagggaacaggagccccaagaaggaaagggagctgagaggacacctgtcagggaaacaggctcaattttctgaatatgaatgacaggtacagagtacctctgtgtctccagctccattaagggtacaaataggaagaaattgctcagatagcaacaggtaaattttgacttaactggaagaattccctgggcataaggggagggacagaaagaggtggagaactcattgccttgatgagaaggaaaagtccccctttagtcacctactgaacaaagcttgagtggcctggaagatagttccaatgactctcagagcccctgtggggtttccagcggcctcaaaggaatcccttgatcatttccacagaccccagtaagagcattgctgaatgtctcctcctygtggacctcactatttgctgcttattctaactcttcttgttgggccagcttctgcaggggtgagggagaccctgagacctactaggtgggaggcccagattgaagataatgggctgtggctgtggctgtggttggctggggaagagtttctgtggataatgctccaaggttggctccacagaaactggcacttttggaccccagggtgaggaaaaggatcttgtaggaagagataagttgagaygaagaagaagaccagggttgttgctctgattctgatgtaaaataacatgagctaccagctagcagtgtgatcttgggaaagttacccccctcttctaggccttggcttcctctttagtaaaatgtgggtattaaacgtgatgaccatagaggacttcccagcatgaatactctgtgacacagtccagtagcaagttgagaagcccagactttaagcagatttaagcaggcctgggttcaacttgcagtgcaccccttacgagcagtcctcctgggcaagttagttaacccatgtaagtctagtttccacccgttcatctgagggcaatgctattgcccccctagggaggctaggatgaagcacggcatggagcgtccagcacaatgcctggcgcaccgtaaagcctgaggtaggaagttcatggtactgtgggaacacagggggatagcagcctatgttgtgggtgggggcatccagaaaggctttccagagaaagtgacatctaagctgaagcctgaaggaggagtagaaattaagcaaagtgggaaaggaagagtgttccatggaagagaccccattatttgctaagaaaagcttggtctgttcaagaaccgagaggttttgtgtggctggggacatgatgcatgcgtgaagtgggtgggtacagatagagaacactgatgctagggaggtcagcagagaccaggtcataaaggactctgttccaccagtaattctagggacttcagagatagggtccctccacttcctctcctcttcttcctacttttcattcatcctttctcccaagactaatttctcttgtccttggtcacacgagcacaaggaagcattgggctcccctaggacgacctggccagtgcaggaagaagctttaagttcagagttgtctgcctctggacaagttttggcttaggcctgaagttttctgcctctgtcctttctcaccactagagagagatgtgccttccacagaagaccctggattttatcactgaggcactcctactaagcactcccacagtgggcctcagtttccccatctgcccctctcattgtagagagtagggagagtgttgacagggtggggctgagcacagcctgcagagaagagctagggaaactgactcagtgcccccaagtgtccaaacgttgaaacttcaatgggaagctcagaggaaggacttccgaaggatgaagtgggtggcacatggaaaagggggcctgaaggaggaaaagtgatgtagaacatcaatcctacaggctctttaaagtcaagaaatgccaggcactgagaaggacacaaagatgaacaaaatacagattaagaagcagtccagaaaaggttctctgtttgggaagatggggatggtccttcctggaaggcacagagctgatgaaacagcctctacaggagttggccctgggggtgctctcacaatggggagtagctcttctgcctcccctacccgccactacctcttgggccctccaccccctaggtccaagcctcccctcatttccagccaacaccacttcaagttcaaagacaggaaagtgtacagagaagggcccttcagctgggatctggtcagcctcccccgcccttctctcaggtggagaaccctgtcttggccctgggactccaaggaataggtctcatcataccctccctagtttctcaaactcttctggtagatcaggtgacaactcattagccttcagcccaagaacattatctccagggccctggccatcctaggccttgagaaggctgccagctgcctgatactcctgaggctgggggcagacaagagggcgagaggctgagggatagtaattaaggaacttggctctactcagcagtcttcagcacacacttgcccacctcttggcaggctgagagggttttggaggaattatagagaggtgggataaagaatagtgggttggaagtccccttcaattctggggctagagtaaatcttaccccacaactcacctggagaaaggagatcgaagggatggtgtaacttgagcatcatcaaggccactggggtgtggagaggcaacgtgagggaaaagcccacaggatttggagacatggggtctggctttgccattaaataaacgtcagcaagtgactttatgtctctgaaccttagtttctctgattcagtaatatttttcattcatctgcaaagtaggataataacatctttatttgcataagggccttacagatttcatatactttaaatcttgtaatcctgaccacatagtggaaggttttattgcctccttagatgaggaagctgagctctagagagattaagagattgactgaagttcccctagctagtaagtgacacagacaggatggcaaatagcgggaaaggagaatacayagggacctttgtgactcagacatgccaggataagaaataggtttcatttgttgggctaactccatttgattgaaaatgactctctgtatcaccatattgaggatgattctgaggctcagtcagataaaaagcactgtgatgaattagtgttatctgctaaggggtggtggggtgatgagtgatggctcacatgctgtatagttgacattcctagcccagaatcacccagagattctaattcctccctctttactaaccaattaggttaaatttaaaggtaacagcttacaaaggtgactaaaatacagtctgtgccttcaaagagctcacaatctctagaggagaacaaaggatgatgtggcaaatgtcccgggaacatagagggagagtaactatttctacctgggaggtggggaaggctccacagtggagagagcactggggaagggccttgaaggaggaaggggatttgaaagggaagacagcagtctggaggggagtcttggagcaggcagaggatgttctaggtagagcgagctgcccgagcaaagacagggagacagacaagtggagcacaggctatgtttcacgtggctagaatatgggctgcacagggaaaatattccaggggaggctgtgaacagtaaggtggagtcagacattgaaggattttgccaagaagtttgaattttatcacgaaagctgtgggaactttttgaagattttaaagccaagtgatggggtcagaatgtgtgcactgaggcagccgaggaccgagatgagcacagtgagcctgggtgcaagagaaccaggagaccattgcaacacttcaagtgaatgaactagggcagcctccatggacatgaagaggagtcatgaaggcagaaatgatggacctagttaccaatcagatgagggggaagagagaaagcaggggtaattctaaggcttgggcacctagtggagggtaattctgtgaacaagaaggaaaacacaaaagagactcttctgaggagacaggacgctgagtctgaacatgttaaaattggaatgctccaggtagcgggagcctgtaagtacttggacacccagggcagaggtgacrtggaatccacggaacgggggaaacagttgaggaagatggagtacagtgrtcaaggatgagagtcaagagtggatggattcctgagaaacaccaacagttaaggtgcagaggagagattacagcaagagagatgatccaaagtaaacacagaggtagagaaagaaccccgagaacatggtgtccgagagtaacagtgagactgtgcacacatgtagtgttcacaacccatgcagtgttctcacacatatgatcacatggaactctcccrtcacctctgtattattatgccccttttgcagataagggaaatagaaactcatgcatttaagtgatttgccccaaatcacaaaacctagawatggcagagctacttaatggctaatcaaggtagataaaatcagtggattcccaccacacctcaataaaagccaaaagagagtgttaagaacagaycggtcagtcatcagtctcaagtgtagcagagactgctggggtcaagggctgagaagacacccttggatttaatgatggaaggtcagctgtgacactggagagagcttcctgcttcctgttgctttaactgccccctgccccccctagactggctgtgtggggcaaatggagtaattctgaatttatacaagtgttttgtagacttcaaaaccccatattacagaggtgattgttactgttatttttactgttattaggtattgttagattgaaccctttgatattgccaatagggaacccatgtattaaatggatgatttcatagaattcaacctaatagtraaaggagtgagctggagtcggggaaggggctgtgaggttatgagacaggcaactgcgcaggcaagggtggccccaggggactggggagccccaccccctgatggttggggaggtcagtcttccgcatggggtggagagtggtaaatcgctggtgaagcttgaaatttgcaggagttccctttcacctccaccacttccacactccccatctgcaacctggtcagccccctctgcagagactaggggtgggggtacactctcgtgaggggctctgactgaaaaaatacttctggtacctaaactaggttgatcccctcaaccagcgtctttggagataagttggggatggattcttcctatggggaatctcggggcctaggccaggtgatgactgattggagatccaggcagagctgacacaggaaggagggtcctgaacagacttctcgtttatcaccttgactctccctaacctagctcggatcctcttgagattttccctagtgtccttcggaaccttttcagcatcgcatgtcttagcggtaacaacaggaataacaatagcaacaagagttatttctatagatgccattgcttccagctgactcttagcactgatactaattcttctggctgttcagttaagatgaggagggatgggttaacatctcccagtagatgttcttctgaggtgaggacccagatggggccaggctgggaggctactgggattgctggagctggggctgaggagacagtggtatagcctctgtcctcagttgaaccctgcctagtgccaagctcctcacaaaggaccagctcctgttgagccttgctggcccagacaatgattagcagcagataccgggatggggtgatgactcaggagggcgtgcaataggggtagtgtgaaaggttgagagggcaggtgcatcaaagaggcagcacccacttgtcacaggaaccaggaagtcctcctccctctccagccggcgaaacagggggtccccaagatgcyatcctgtgggcaggtctctacagaacattgtttctttcttgcaggggacagaaggcaccgcttggggattgaggtggaggaaggggcagtggtcctagtcagctcacattgacaggcaggggtggtgtctggccagagaatatctgatgtggccccatcttttgtccctccctctcttgactggaaaacacacaggcaggtcagaagggccatgcagaggttacagactcccaggaaatgctttgaaggcttttatcctttcttttgatcagactatgagaactttccaaacgttgacacaagagaagaaaagcctattcttccatgggccagggcctcgatgtcaggctggggctagaggatgggagggaaagggggaaggagaccagggagtgggagacagaggcaacagtgattcagctggagagtcaggccccaggmcacacacacacacacacacactgccctctttttccccacctcaggatttgtgtgcatctggctccatttctatttgtttattttccttggggcaagacaggaggyggattaatgaataaagacatcaagtttgaaaagaaccccaaatccagctccattcttcttccaaccttgagggcttacataaccatgcagtgcttttcttcctgcccttcctctcttacccctctccttcattttctcttccccaaccctcattaagaacacttggaagcccagaagtgcttctttttcatcccaatgcaactgatctccttctggaggacyctaaggtcgctattcaagttggaactggtatccaaaaamagataatatggttggtgagatgaggctgagtagctgtttgctctctccaccgaggccggggggaggagtgggaccagactgctgtggaggcaacttgggctagacatagagatttacagcaggaagtgaccctaatcatcctctaacgtagcacctcccagactgacctcgcaatgtgtcctgaaaggcagaggagagggaatttgtgccctagaatctacagggatgagctgtaagcggccacacactggacatccttgaaatctctttttgtctcaagccattcaaaatgtttattctacttcattgtacattgttggcataatattaaaacaacattttccctcaaaatctgagcaaaattgataacttcaggaaatatactaaatttagtcctgtggctttgagtgcctcctgacatactagtgtatgccctagtttgagaagtgtgaaactaataccaacccctattccacaatgaaggaaatacagatccgagaggctgagaggcttgactgaggtcacagctagtcagtggcagagttgagatcggcacccaagtctcttacttcccagtccagtgcatgttccaccaagcagtgctgtctcttagttctgagtggcttttacacatccttgagcctaattctctcactctatcttcagaatactgggcatggacagatacctagctcaactgtctaagataagtgtgggtgtggagaccagcctaatctcaggtgctgagacatagtgctcaaaacccctctactgcatacagggctctcccaacatggaagaggaaggagaaggataggacaggaagggaaggaagaaaagtactgcaaggattatgtaagccctcaaggttggaagaagaacagagctggatctggggttcttgagcatgatggacagatagtaggacagagagcaagctgagtccctatttctatccacctattcatttgtctttaccaaacagtgattggttcagaaagaccttcaaacctaagataattggattagttaatagctatagyaggcactgttcttattttccaggaatctgcctccctttctgatctcatttccagatccctcaatcaaaaggctcttttctacagggaagaagtagggagaagaataggaggcttttgggcttagaatatctctattaatatggacacataggctgtgtgatacagaagaagaatagaaggataaagtgtggtaaagaatttgaaggcgagagttatgattagatggatagcatactattaccaggatgagatacaggaagctggagaaaccataaggaaaagaagggacagccagagagatgtgtaggcaatacaaaggcaaagagggaggtgagaaggaggaacgggtcggggagacattttagtgacagccaggatgaaaagagaggacaagcagagaagcaccattgatagagatgagaagaccgttgggaggagagtccacatgaaggaagtggggagaataaagacaaatcatgcaaaactaggagaaacaatgggatcaagcagccatgaaggaagggcgtcgcctccaacccttggatacatcctgggcatcactgctggtgaattttgcatacctgtctggctcctgctaacctccactatgcttaaggtgtcatctctgcttgttgagtgttgagtttgctcagtgaagacaaataaactatagtattaatttgaagtaatggtggaaaggactttggaatccagccaggaagaggcataaatttcagctctgctaccaataaattgtgtcacctgggctctctgaacctcaatttcctcagcagtaattatgaagataataagatttgttttacagagttaaaaagatgaaatatgaagtgctggtctacagtaggcattcaatacatgatagttcccctccatctctccttccatgtccctgaaccaaacatttgcaagaggaaatactccacagtcaaaaaacagaaatcatctagtggctctaagaaagaatgaccagcaggctaggccagacaccgtagctcatgcctgtaatcccagcactttgggaggctgaggcaggtggatcatgatgtaaagaaatcgagaccatcctggccaacatggtggccagctggccagctggttatggtggctcatgcctgtaattccagctactcgggaggctgaggcagaagaatcgcttgaacccgggaggtggaggttgcagtgagctgagattgcatcactgcactccagcctggagacagagtgagactccacaaaaaaagaaaagaagagaaaagaaaagaccagaccagcaggctggagcaccatggaggaagccaaggctctgtacctgacccttgcaggagctgcagggcctgaccctggccctgcagctggccatgaaggaatccacaggggctggccacaaagcaggagggtgttgaggggtcacagcacatcactgttttcccagtgtgtcctattaagatctttcatgtgctcccaacgcttcaaccaaaatgaatggatccttatttccttatttcctgggtggccctggatttcctcatctttcccaaccctgttcccttgcactagatgtcagttttcccttcacaagctcttcttgtacttcactgatgccttttccatggcacttatcacttcctgcctgttttacagttttctcctttattagattgcaaggtcttcacggaaagaatctacatctgatccatctccataattccattgtcttgtttagaatttggcacccagtagttgctggaaaaraaaatgtttactgaggctgggcatgatgactcatgcttgtaatctctgcatttagggaggctgaggtgggaggatggcttgagcccaggagtttgagacaagcctgggcaacatagtgggatcccatctctacaaaaaaaaaaaaattagctgggtgtggtggtgtgcacctgtagtcccaggtactcaggaggatgaggtagtagaatcacttgagcccaggaggtcgaggctgcagtgagccatgatcacaccactgcactccagcctgggtgacagagtgagacccagtttcaataacaataacaaagtgtttattgtataaatgaacaaaaacacagctcatactgaatgtggtgggcaacattaatacagatgaaaacatttggtttgtttgcatacctattagtgttgataattagttatctcgggtttccatgtgtacaaggaaaaaagaaaacatcattaaaaaatcaagagaagatacagacaagaagggggaatgagaaggccccagagtgagaagtgctggaccagagtgaagttccatccattctacctaggacaagaacttccacatctccctggccctatgatgatggagtcagttagattggcccctatggctggagtgggttaggagtcccctcctacttttaattcaatcataaaatacttcttgagcacttactatgtgtcatacattgtgctaatctttaggataacatatatatatatatatatatatatatatatatatatatatawataaataaataaaatgctggatccttctttcaatgaccttatttgtagtagaatacaaatgatacaccatgtactaagagcggtgccattacgggtatagttggatatagatatacmtatatggaaactcagaaaagagaggcattacttaaggttgtaggaatcagagaaggcttcatggaagaggggttatttgaactggactctgaaagataagacttggataggtaaagacaaggaggaaggggagcccaggaagagagaagtgcaggatcatggaaggcagaaaagcatgggagtgcacagcagggagcagggagtggttggtttgcttgcaatatgcagtgtgccatagcagaaaagtggtcggagataaggctagaaagcaggttcagaagcagactgcggaaggccttatatgccagcctgggtttggcctgtctttgatagataatggggagacattaaaatgttttgagctagagaaagaactaagacaattatagtaaaatgaaaagtggatggatttgggagacgggacctgggcatgaatctaattccacagtttactgagtcacaccatctctctgagcctcagtttcctcattcgtaaaacaaggattataatcttaatatttcataggaatgccatgagaataaaatgtgaaagtgctttctaaagtactggataaatgttcattgattcctgatcagaggtgtatttgaggaagagaaacccaggagcaatgtaggatggatttgaggagagaaagaacagagacatgagatgagtaggaggctgatgcagtgattcagccacaaggcattaggacctgaaaaaagacaatggaatgaaggagaggaggcacaaataataaatccacagcacatggctttagataaatgttgagttgaggcaagaagagagtttgagatgatcctggctttgagtgtgggtaatgggtaggatgatggtccctttaactattttaggaaccaaaatagagcagcaagtaggagaagaaaggattttacaattggaagtgaatgcatttagtattcatatcccaaagctcctttcagtcaacttgctcttgcaacagagaaaacagacaaagcactttccctgtgggtgcagcttttcccctccccctgcacctgctgcccctgggagggggttgaagcatcttctctagtcacctaatttagcataatcaactccaatgctctgtagcaatttacaaagctcattctctccccagccccctgcaaatggaacagttggcccagaagagagcagggactgatatcttgggcttttattttcttaccttctgaaaacagggtgtaggcatctgcagcattagcaaagcctgtgtaaacctgggtcccctcgcactctgaagtggctcctcctgaaggtctgtgtgaactaggtgtctcctgtgaggcagataaaaactgcagccctcagggkggccttggcccgtccagatcaggctttcagtcattcccttactctttcttaacaaactatactaggcactggggaaacagatgaaaggcagagtcagtggtcttaaattaggagcacaaagatggtaaacaatgataaacaaaccatctcaaagcactataatgcttcaaaataggaatatgtacaagagggccaggtgcagtggctcacacctgtaatcccagcactttgggaggcccaggtgggcagatcacttaagtccgggagtttgagaccagcctgggcaacagggtgaaaccccgtctctactaaaagtacaaaaattagctgggcatggtggcacatgcctatagtgccagctacttaggaggatgaggtgggaggactgcttgagtccaggaggcagaggttgtagcgagctgagattgcaccactgcactcctgcacttcagcctgggtaacagagtgagatcccatctggcggggggtgaggtgggggaaagagaatatgtacaagagcaagcatagtaaagtaaacccattctgggcagggatgggagggacagagaagatgaattgtttttttgagagtcagggaaggcgtcaaagggagtaactaacagttgagtcgagttctgaaagataaggagatcatcaggtaggcacggagcagggcagtgcagaagcaggtccaaaggtagaaaggattgggtagtgaggctctgcgttggagttcagggggcctgtgaaagattgtcaagggtaaagtcagaagtaggcagagaccaaatcatgaatggtgtgctgagaggctacagagaaaacagataaagcactttccctgctggtgcagcttttctctttcccctgtacctgctgtccctgggaggaggttgaagcactctttctagtcagaagtgtatttgaggaagagaaacccaggagcgaagtagcaaaaagcaaaggggagccacagatcaagttattgagagtcacaagaacaacagtgtccttactcaagaaaggccctgataaatccatgtattatcctggagaataaatgactctcaagtagaacaaatgactctcaagtaaaataaatgagtgcacaggcaaaaaaagacagcttcaggaagaacttccgggggtagcagtaagtgggagtggtacttgctgagggaacgtgctgatcatcactgtagctatgactggctttgttttagggaaaggatcactagttcagtcttagaggagaaagaaggtgaatatctctgtttctgtctctttcgccactcaggctggtcttcaggattctgtctctggtatttggccggctgggactgttttggggaaatagcaccctctagaggaaagagtatgttttattttgcgggggtgccccggggtggtggggtgcgcaacagatgatttccagagctttggctcgattccttccccaggggcctggccagcttkggggtggagtgtagctgattgtttatccgcttctgactctggccaccgcagagaacaaagctgcctggctgtgggaggtgkcacaacagctgggagcagcagataacagctggaggtggcagatacaaaggctggcaaccacaggcactacagctggaggtggcaatcacaacagccagaggcaacaaagaggctagcagtggccgaaatctccagtacccttgagtctagagccttaaccctgggatgtgtggtcttacatacagcgtaccatagtggcacctkctgagagcatgaggtccaagagaatgaacctggggcacacaaaagcagttgctacaattaaaaagttctggaccaggagctgggagacctggattctggttccaactttaccactaatctacttggggcaaagctctctgagccttagcttctatggtgtctttcttacctacctcatggtgtgaggatcaaactatatattttataaattttaaagtgagaaggaattatagactaatattttgggaatgataagcaaggcttttcttgggccctaagagcttccattctccaagatatgtagaatctcccctcaacataaacaaagctaggacttcagtaaaggatccctgaatgtcaccatagaaagtgcaggggtagaagtggggtggagaaggcagacatcctsacccaccatgggtatagacagaatcttcaagacagtctttcaatctcccatccaaagcttttatctccgccataggatctctgcaaagtgcttgtccaaagtgccttcctgattgttacaatgctctttataatatcaacttgcaatctttatccctgcagtatgaactccctgattgttcctcttggagctcaaaggacaagtccaagcctttgatcacgtgatagtccttcaaaccaaatatttgcacacattcattatatctttctgattgtctcttctcctgaatcaacttccctatttccttcaatcatttctcatgtggtctggttctgaatcctctcatatcctgagtgttccttgatgctggatactgcaggtgtgggatgaacagagcagagtagaatcaactacttttttgttctagggacttcagttcaactgaaggagcttaagattagtttgcttttttggcaatcaaaacacatgaataactcatattggattattttctgctaatatgtttaatttttttatattgtactgctttgctaaatcacatcttctcaatccagaacttgctcaggtaatttttggacccaagtacataatccagcacttaacatttttgttagacttggcctacttatttgactccttttggatcctaattctgccccagctcttgcatttgctatctgtcccagctttctgtcaggcacacaattgatggccatagcattctatagttttgaatgaagttcatgttaagaaaattgaatagggcaaggccaaagatgaagctctctggtgtatcaatagaaaatgaattccaggctatcatggtcccctcaccagtaccactgatttttaaagtcaccgaattagattagcattctcttcatttttctttatcttatccccaggtcataatgagagatcttgtcaaaaatctcctgaagtttaggtacacgttctctgttgcacttcttcgatttgtcaatttagtagccttatcataaaagaaaattaggttattattgtttttgagacagggtctcattctgttgcccaggctgcagtgcagtggcatgattatagctctctgcagcctccaactcctgagctcaagtgatcctcctgcctcagcctccaagtagctgggagtacaggtgtgtgctaccatatccagctaatttttaaaaatttttgctgatatggtgtcttgctgtttcccaggatggttttgaacttctgatctcaagtgatcctcctgcctcagcctcccaaagtgctgggatacaggtatgagccaccacactcagccaaaattaggccattttgatgtgacttgttcttagtaaatccacactgggtcctattgataacttcctttcccccatcctacctaagtactcgtaatcttaatattccattctagaatcttgcctaggatcaatatcttacctgtttgtagtttgtgaaaggtacttcatttttctttttgaaaattaaaactatgttcattcatctctaattttacagcacttcttctgttctcattcctcaaaatcttataggagtttacatcttttttttcaagagtttgaggatcaaatgagaaggtattctaatgtgtgaattctaaaatggtatatagatacaggcagtatggttgttatgttattattactactactgagtactaaatagggctttgtttaggcttgaaatacaaattcttcaaacttcagagttgcagagcttcctttttgttccaaagcagccaaggatataggggagtgaatgacatccaggtctggttgaacagtcttgcatgaacggaagttccaaatggcctgtgacacagggctggtaaattgggcatccttgttgcctctgaacattctcagggttctcatccattggtgatctccaattcagtgcctacctggttgggcatatggtcaggcccaaaagatttgaagttttccagggacaaggccatggggaaaatagagatggggggtggggtgggcagtgtgaagaatcataaaatgcaatggttcagactttttcgaatggagaatgtaatgagcctctccaagaagggctaaactccccagagatcaccctgctccacagaagatctggctatcagatccagggtccaagggctcaagtgattaaaattctttmtgtgctggaaaagtacaagttactgcttgggcragggtgccaggcaccttgtattaagtgaattgtctcctatttcagtggcttgccccactttctgctatcagaacaaatagcaatactgaatttgagcctgtgcagacatagctgctagttaatatacacccctagctcttctacttcattccgtcaaaacaattttgccacccacaatctggcatttctgccagtccttcagaaaatgtcccagtgcttccaggaagttttaacatgttgtttctcctccaccactgcytatttcyttttgttcaagtcccatctgtactcttcctaacactgccctagactctaactcagaccaaatttccccagatgatgcaaacagatgatgatgatgatgataaaaaatgaaatggtctgggtgcttagggagcatcttgaagggtaaaagaatgggtagtttctgctattctctgaaccagatgagtatcttagtatcaccagtgggtattggcttgggggtagagcagagaatgaagaaattaaggtgtgtgtgtgtgtgtgtgtgtgtgtgtgtgtgtgtgtgtgtgtgtgttaagggggattggcctggaaggatttcaacaggatagcttgtcttgcttcatagccattcataagggtggggatggatcctatttcaaaattagagctcttcggaggactggttttgtggtgaaggctctcattagtctcaccctcaccttcaaggaatgtgaagctactactctttcttttctgcctctcttccgctaagaattacaaatatcagactgtgttgcaattatttgcttactaaataggcatctttctcactaggctgtgagttcttggagagcagaatgatgtcattttattttattttattttatttactttttttttttttttgagacggagtctcgctgtgtcacccaggctggagtgcagtggcgcgatgtcggctcactgcaacctctgtctcccgggttcaagcgattctcctgcctcagcctcctgagtagctgggactacaggcgcatgccaccatgcccagctaatttttgtatttttagtagagacagggttttgccttgttggccaggctggtcttgaactcctgacctcaggcgatccacccgcctcggcccctgcacagtgcctggcacatagcaagtgctcaataaatatttggtaagacaagaacacataagcgacattcaaatgaatgtyaattcctccctcccatggggtgagggttaggagtcagctggatttctacgataacctccattatgctgtcttgctccctccagatgacgtcagttgccaaggtgtattacagtcagaccactcagacagaaagccggcccctaatgggcccagggatacgacggcggagagtcctgacaaaagatggtcgcagcaacgtgagaatggagcacattgccgacaagcgcttcctctacctcaaggacctgtggacaaccttcattgacatgcagtggcgctacaagcttctgctcttctctgcgacctttgcaggcacatggttcctctttggcgtggtgtggtatctggtagctgtggcacatggggacctgctggagctggaccccccggccaaccacaccccctgtgtggtacaggtgcacacactcactggagccttcctcttctcccttgaatcccaaaccaccattggctatggcttccgctacatcagtgaggaatgtccactggccattgtgcttcttattgcccagctggtgctcaccaccatcctggaaatcttcatcacaggtaccttcctggcgaagattgcccggcccaagaagcgggctgagaccattcgtttcagccagcatgcagttgtggcctcccacaatggcaagccctgcctcatgatccgagttgccaatatgcgcaaaagcctcctcattggctgccrggtgacaggaaaactgcttcagacccaccaaaccaaggaaggggagaacatccggctcaaccaggtcaatgtgactttccaagtagacacagcctctgacagccccttccttattctaccccttaccttctatcatgtggtagatgagaccagtcccttgaaagatctccctcttyrcagtggtgagggtgactttgagctggtgctgatcctaagtgggacagtggagtccaccagtgccacctgtcaggtgcgcacttcctacctgccagaggagatcctttggggctacgagttcacacctgccatctcactgtcagccagtggtaaatacatagctgactttagcctttttgaccaagttgtgaaagtggcctctcctagtggcctccgtgacagcactgtacgctacggagaccctgaaaagctcaagttggaggagtcattaagggagcaagctgagaaggagggcagtgcccttagtgtgcgcatcagcaatgtctgatgacctgttcccactcccccattcctctggtctcttttcctctcttccaatgccctggtaaggaatactacccgggtttactggagatcccccgaagcacccatcctccactccctcttctttaacccagtggcctgttggtagcttaggccaactggagtccaggttcgcctcccactgtcccctttccacttccccagcttctgccccaatacacatacctcccttaagccaggatgggggaaagagtgggattaggctgaagtggcttagaaggcctcagccatgcttggatactcacattaggaggaccatgtggttggaaggatagactgccccctacctcccaccaccaccatgaagtttggtgacttgaggctggagctccctctgttacctttccatctagcaagttcccaaaggcaagactctctctgatggtcactttgtggtctgtgctttcagaaatacaggaatctgatatcaacatatcctagggtttctaccaatctctgttgaaagaagccagggtttgccactgtgaagcttgatttctgctggtgacttctgaccataagctagaaccatggtcgccactgttttccctctgtagtttctcaagtgaacactctcaggatacccagttccctcatagcctctgttctcagagaattggagttggcccaagaaacataaacatataaccacccatatctatcctggattctgaactcttcaatttggagtgactaacacaagttgttatctaaacctttaaacctatcttccaggcagcccagagaagatctgtttccctgtgtcctgtgaatggaaggacccaagccaatatgttcctttgaaaagagtccagtacccaggccccatggaaaggtctgaaaataatattccagattacactgtacctggcttctcttcttcctttcctgctcagcctagatccttcttccttaaccccaactctttgggagaagggagggaaaatgcaagggccttcctctcttaacacggatgctcaagtaaaactagattcacagggcacagattccccagaaagttaacacaatcccaccatgagggatgggtaaattctcagatttccaaactgctgtacagagcctctgagaattggtgatgctttgttaaggtttgggcaggagcagaactctgtggctggcagccactattctcagttacacctcccagtgcccttctgaaaagtgccagctatttcattaggcaatgctggaaggaaatgaaattataccttctgatcaaataaccatggcttccctcagccattcctgagacttggtataaaatgaagaaatcagtgtcatctctactctcctctgccatgaggccattttcagacaagttaaaaagtagactttaagagatcaaactcagcctattccttgttccctggtggggtctgtggtaagggtcagggaagggcatataggcaccagagctttatccaaagccccaaatccctagagtgctttctggtctcactttggtaccaaggaagcctcacatagtggtactgcatagtcccactataagtcaagttgcagtttaaggtggtctcagccaattgttacaagctacagaatatatacatgcatctatgtacagagccttgcagagaaacacaaaattttgaggctagacccatgatcaccaccaactataattgcacaaggtcttgttatattgatctctcctcgaactcaactaacgatatcttgaaaacaaagacccttcggtgtccatctacagtaaaccccaccattaccttctagttggcataaaaacaagaaccacaaaaacttgaaaaatctgaaacagagaacagaaggccaagagccagcttctgcgttctcaactttattcaacattagacttaccttatttctttcagtgtgtagggacaagatgtactgctgtgtgtgtgtgtgtgtgtgtgtgtgtgtgtgtgtgtgtgtgtgtgtgtctataccttcctatccattggcaagttaacctccatctggttkatttggccatgctatgctttcttcccattcccctgctgtctattctaagcccccagactcaagcctctagactcttggatgaaacagtgagaagaaaacattttctgacttacccttttggaatctcctccattattacccaggctttgctttaagttgcactttaaatcacactgtcctattaatgcgatctggcatcttctcccacaagccccctacagggaacaactaccccctaccttaactctaaatggttctttagactatagtctgtctcctctgacctgaaatcctcttttaggcaataggccgagctttagaagcagccaggtctggtgagaaatgggcccccataccaactgtggacttggaatatcagcagagtagtaggcacagttgtaaaaaggggagatttcggtaggcacaggtgtaaaaaggggagatttcagaagacgggcgaaacaactgatgggggaagatacctggggtgagaagatgagaaagaaatgatgctgagggacctagtgaaatcaatgaaactcttgagtcttgcttaggctcgcaaacaagaagtggggaggcttgggaaattaggatatgacatatatgaaaggtttatctaagaagaaagaaacagagataatatatatatagaaagatgtatatagatgtatatatgcccaaatatattgaatgtacagaaaggaaatattcagagactttagcattgggggcagatatcttggcctggttatggggtaggacacccagattttcagacttacaatcagtggtcctggtttcaacatggaagtgagatagctgatgaaggatttcaagtctggaaatgggaaagggaggggtagaagttccttttcagaaataaagaggcattcatgaaggcttttgttgaatcctatgctactgataggaccaggaagagaggaactcggaggacaatagggaggggaagtcttggaaaatctaccacttacactgtgtgtccccatccccagcagcgtcctgccactgtagcgcctttttaaaataaataaaataaaataaagcaccattttgtttccctttcatgaagtacactgtatttccgtcttccacaggggtgggagctgctattgctctagcccctgaaatcaaactcaggagctgaacactttggtgtatgggaggcactaatgggaagcctcaaccctggaatccaaatgccaggactaatagctgttaggctgaagatctcccaaggtcaaggcccagccttttgtgtggctgcaagcagcccaaagagaaagccatggattccagaagagttccaatcctggcatttgggcatggagggtgatgctttggttttgatgcttctgaatgaaaatgaggagtggggttaccagctgctctaggggatggtgaagttccatgagaggcttccgaaatctctgcaatgtgcttcaccccattattcccccaacccctgtcagcctaataaaatcatccagtagtttccctataaggtctgagcagagaaagaaagccagttatactattgctacaagtccaggacactgtgccctctccatggctgctgccctggtcctttattcttgctagctaacctagttcacttgtacagtaacacactacctttgctggaaagttagcatgggtctccaggctcagtaatggccaactctactgatgcagaagtatttagggatgttttttccattcattgcactaaagactaaaccaggtcaaatttatctaggaaaaaaaaggtgtgtaagatttgttttgtttttgtctgttaaaaataagctactaaataaaatggatgactctttggttgtcactctagcttcttttaaaaagctaaaccaagactgtcaaggtctgaactcatagacctacctacccatgagtgtggagggttgaattcggctgtgctggaagaacttctgactgcatggccaagccccttctgtttttctctcatgctttagcgagttcctttcacattcggttttcatgggacaatactgaaaaaaactttaagacccagaagtatgaaaattggctcagcttaatccataaaagtcaagttgctttggatcctgggcattgtcccttttggccagtgatcacaagcccaatttcccttccatgctaccatgtagtcttgttgccagttttccttatatatcctcaaggttctttgtaagcttattcctttaatcaccaggcatttcttccctcaaatctcaaataaatggatttctcttctacccttgtctgtcagyagcctgagaaaggtctggttgttaatatccaggcctgaattttctctgatgagaggcaaaagaccctatgatcactgactcttgttccccagaagtggaaggagagagagaggaggagggagaaaattgggtctcttaccatgatcaataaatacttaagtacaacatttaggaaatactaggaatgaatcctaagacatatgagacatataagatataggacatgtattgttcctaaaaggcctaaaaggttgaagaaacctataaacttgttagaaaacagaaataaaacaagtagcatataacaaatataatgaaaagcaatagcaggtaccatgtactaatgccagatataacattagcagaatgttccaaaaagagtgagatctctgtgggaaacatttcacagggacaggaactaggcaagggatggtatcaatctaacatgtttggttagaatacattaaggttcaagaaaaatcagcaaacgctgagtccctattatgtggaaggtatcattcagctgacaaagaaatataagacatgatgcatgaatcaagggatgtacaatcatggcactttccacctgctattccttctgtggaactctccccactgcttgccaacttccaattttcttgttttttttttttttgagacggagtcttgctctgtagcccagactggagtgcagtggcacgatctcagcttactgcaacctccacctctcgggttcaagcgactctcctgcctcagcctcctgagtagctgggactccaggcacacgccaacacgcatggctaacttttgtaattttagtagagacagggtttcaccatattggtaaggctggtctcgaacccctgacctcaggtgattcacccatctcagcctcccaaagtgctgggattacaggcgtgagccactgtgcctggccaaccttcttaactcttacactatgcccatstgagatcaaataaatccccttaaaagctagagcacttaccacagctgcatttgtatattatttgtcaatttatttgactaatgtctgtgtagcttactagacttcaagtgtcacatgaatgggattcatgtcaagtgtttggtcacgagtacagcccagcacctcatatagtgcccgacatgtatgatgtttgataaattagcaggagggaaagaaagcaaagagagaaagaaatggcctaaagtatgcagtggagcttgtatatcttgttaaataactataaaagagttagataacgagcatgacataattactattaaaaaagagaacagacaataaacatcactgttttgaggagggagagactatttcacttgttaaggtctaggaagaggagttgagagttgggttcaacattgaaaaaccaaatagcatttaagtaagtaaagagaaacaggtctctttgtaggaagtacagcatgaagaaagtgtcatgagaagaaagcacaaggcatattttgggaacagtaaacctaaaacagaggcattataggtgaataggatggaaagctaaggtaaagccagaaaatagggggactgaatatcaggctaaagtgttcattatttttttctttaggcagtcaggaaccactgaagatgtttgatggaggaaagaatctaagtaaagtactattaattaatatcaatctggtagtagaattgagacataagacattaaatcagttaagagatttttaaagcttgagggaaaggcaattgtcacagatcctggtatagtatagtataggtgttcgctacgtattatttgagttgttgaaggtctgaactaaggtgcaggatgctgggcatggaaagaattagaaatagattccaaagaaatgacaaagcaagacatatgaacaaaatctagtgaaaaagaaagtgattaaagtagtcaagkttctagcaggaaacagatggtatactcaaagggccagtggacatgttttaatgaagaaattatttgcaaaggtatgggcaagtttaataaatcaacaagatatggtgatgtacccaggcactcgcaaagtaggacgcctttaccagccttaaacctgaagggacagttactggaaccatgagacttgtacccaaaggagagagctatagcttcaacaggagccatggctttaggtgaggaattccagacactgccaaagatctgctagtgcctcccactggtctattctaatgggaagccagagaacaagggagattgagtgatgctacccatacagcctaacctcttggaacacagaacagggcaaaaaagatgaatagtggatatggaagggtaatgagagtatatgcagcatagtgaacaaggacaaggttcctgctagggaaactaaagttgagcgatccatgtttgtgctttccttagtcattggctctaaaaggatagaaatctaggagcagatagtgaaagggggaattaagaaggattgtaagtaacagtccgagaggtaatgaacagttgagcatttgaaaaaaatgtaactctttcagaaagaggtgagaaaatacaatccctaaacccaatgcaaaaagttcaatatggggtcctcggaccctgtgatgtatctcttccacccagaaatagtaactaaagttggacctctctgtccaatttgttttacagattccagtctcttcttcgttcccacaactgctatctacatctcactcctttgacttcagtgacatgcttagttttttttttattttatttttttattagttgtttccttatctgcctaaatttggtgcctcccatctctctactaggacagccatgtagggacagattgactgaaacctttctgctatactactgaaaccaatccagccacaaggacccttacttagttaatcctcagacacctacctcccatattttctatcttagggaactaagcctcacttatctattatttgcagaagaaaagaataaatcagaggtagaaagagtcacagtgagagagaatatccagaatatccagatgagagatcaataagagaaaacataggaaaattagaatttgtgatcaacattttattggcaagtcagccacataatgattaagatattctaggtcagacagactgggttttgagttctagcactgccactagttagctatgtgacttgggaaaattacttaatctccataagccttggttttcttcatttgtaaaggtgggaatatctaccttacatgaaaagtacttagcataatgcctggtacattgcaaatgagtcctcaacaaatccagctattataaataatagtaatcatcatcatcataatcatcattatatgagtggtgatgtgctgccactatatatatggctaatatactgcaaaaaaatggttagaattatcaatctaaggcatgtaatgataccaaggcatataaaaggacatagagctatcacaatatgaatatggaatatataagattaacacagttcatctccaagggataaatgtgaagtgtaggatggatgagcagcaggtagttctgggagctgcatgttcagactgcatgaagtcacctccttttccttattctagtctagaagacttcccctaggaagcaggcttattctataaaatccaattagtcagtatttactaagcatttaccatgtgcctaagactacaataaattacacataattgaaaaaaattaaggataagatataatttctacccccaagaaccctataatctcttgtgagggctatgaatacaatctaaaataaagtatcaaattctacaatgcggactatgtaagtgcactaagtaaccacggaaagggaagagctaatgggttacagtccttggcaagaaattcatggaagtagggttggagtggggtggggggagcaggggaccttgacatacataaaggatatttaaaagggaaaataactgggagttgggagcaatccaaagatgccactctagaaatattctggtaggaggaacctctaaaatcaattcaactttactgaatggctactagtactgtgttagatgttgaggtagagaaaagaacaagataatctctgataccgaagaattgaaagtgtcctgatggaaaactaggagagcaaaacaaacaaaaacagttattacaaagcagtgtgacaaatgctgtaacaaaggaatgaccagggagttctggagcactgggagaacttttagtagcatggcagggtcttctgtgtgagtgattttctggaacttagatcccgtccgccccagtctacctatcctcggacaggggaggggactggcatctaagtcattcattctgcgtgatgaggaagtgagtgggagctgggagctaacacttgcactgatgcctgaagggttgagtaggtatttgccagagtgattggagagcggatggcaactttgacagaagaaatagcaaatacagagatactgaggcataaggggctgacaagttaaggaattttgtgacgctttcctgtcttctttcccatcaccttcacctagggttgccggataaaatacaagctgcccacttaaatctgaatctctgattaccaactagtaatttaaaaatataagtatgcctccaatattgcatggaacatacacactcagcccccttcaactcatcctgtcctgtccggggcccacaaatccccggtgaataccggcgagctagtggagtaaagcatgagaaggcttatcttcctttcactcctacatttttcactctcggatctccagcccaggactgaaggatgtagcgcgcagcccgcagctcgctgctcgtcggagggttttcctctgaggactggaaatggggcgcgggaagagggcggggggcggcgggctgtcacttacaaagaaatctcactccactccataaaatcctcaagccagtgccggatttcccggcaagcggacgtctcccctcccacggaccggaaatcccgcctccgctggaagaagaagcggaagcgagaccgtccatccagaggaaggcaagtttttggctcgggcggctgagaagaccgcgcggggctggagacaggtagcagtacgggggcggggcttcatgccggatgtgrtagtctgcagtcgtttcggttggcagcctggcgggtgggagatgcggcggccacctgctgcaaagaaccgaagggaaggttagaagtacgaaggcagtttggagctggggctaagcagctgtcgcacggtcagatcatgggctccaccaagcactggggcgaatggctcctgaacttgaaggtggctccagccggcgtctttggtgtggcctttctagccagagtcgccctggttttctatggcgtcttccaggaccggaccctgcacgtgaggtatacggacatcgactaccaggtcttcaccgacgccgcgcgcttcgtcacggaggggcgctcgccttacctgagagccacgtaccgttacaccccgctgctgggttggctcctcactcccaacatctacctcagcgagctctttggaaagtttctcttcatcagctgcgacctcctcaccgctttcctcttataccgcctgctgctgctgaaggggctggggcgccgccaggcttgtggctactgtgtcttttggcttcttaaccccctgcctatggcagtatccagccgcggtaatgcggactctattgtcgcctccctggtcctgatggtcctctacttgataaagaaaagactcgtcgcgtgtgcagctgtattctatggtttcgcggtgcatatgaagatatatccagtgacttacatccttcccataaccctccacctkcttccagatcgcgacaatgacaaaagcctccgtcaattccggtacactttccaggcttgtttgtacgagctcctgaaaaggctgtgtaatcgggctgtgctgctgtttgtagcagttgctggactcacgttttttgccctgagctttggtttttactatgagtacggctgggaatttttggaacacacctacttttatcacctgactaggcgggatatccgtcacaacttttctccgtacttctacatgctgtatttgactgcagagagcaagtggagtttttccctgggaattgctgcattcctgccacagctcatcttgctttcagctgtgtctttcgcctattacagagacctcgttttttgttgttttcttcatacgtccatttttgtgacttttaacaaagtctgcacctcccagtactttctttggtacctctgcttactgcctcttgtgatgccactagtcagaatgccttggaaaagagctgtagttctcctaatgttatggttwatagggcaggccatgtggctggctcctgcctatgttctagagtttcaaggaaagaacacctttctgtttatttggttagctggtttgttctttcttcttatcaattgttccatcctgattcaaattatttcccattacaaagaagaacccctgacagagagaatcaaatatgactagtgtatgttccacaccctctgctactgtgttacattctgattgtcttgtatggaccagaagagagctttgggacattttttctgaacattctaagcattctagtgaaagttcccatgttccaacagaacttaaaagcaatgtttgccttatatataaaagggacacaataattgaggtccaccttctaggaaatcctaggactcgtttatttgggacatggtgggaataaaggtcacatattggaaaatggaaaggctgatgaaactatcagatactaaaacattcttaaaatagaggaatatagttagagacatcaggtttaagccagtatttgttcctgttttacaatgcttctgtcttaagctgtgtcttaacttttaacacccatcttttctttctaaagctttcctgacagctgtgaaaatccaaaaaatattcttaaactgtgtatggtggcccttgcctgtagtctcagcactttgggaggctgaggtgggagggtcgcttgagttcaggagttctagacccacctggggcaagatggtgagacctagtctcaaaaaaaaaaaaaaaaattagccaggtgttgtggtgcacccctgtagtcatagctgcatgggaggctgaggtgggagaattgcttgagcccagagcaagaccctgtctcaaaaaaaaaaaaaaaaaaaaaaaaggaaaggacaactttttagatagaaaagtattaaataatactaagatgcttagtagtattattttagagagttttaaacttctatattaaatgtggggtcttacaagataatccaaagactttgggaggccaaggcgggcagatcacgaggtcaggagattgagaccatcctggctaacacggtgaaacccctctctactaaaaatacaaaaaattagccgggcgtggtgggtgcctgtagtcccagctactcctcgggaggctgaggcaggagaatggcgtgaactccggaggtggagcctgtagtgagccgagatggcaccactgcgctccagcctgggcgacagagcaagactccatatcaaaaaaaaaaaaaaaaaaaagataatccaaagaatttaaattgtaatcatgtttcatgtatttgttttattacttacttttatagcacttagtcccagtggtattagactgctatttggtttcatacaaaaaggattaaatttaaattcattcatgtttagacttgagttattacatttttaaaactatcatcttgcctttaatgtttgtggtcctacacaaactattagtacatttcagtatcctcttacccctttgtttttaagtttttgattgctaaagcaagacttttttcttctagaatttaagtcaaccaagtgttatctatgttgtaaaaatggataatagtagattttaggtgataaaacaacttgttagtaagacatttcctagcttaaaaaaaaaaatcaaaaattccatgatagaaatgcagacctgtgagggaaactcctgaaaagcataagaagcatcccagagagccatgggttttctagaccagagaatttagagggagattgtggaactgaggcttaggtggtcagatcgtttcccttatcactgtaatatttctgggggaaaaatgctttctgagttgtttaaacaagcatccttacattttttttttaattaaacagcctgtctaggcttgggattccctaatactacagtagcagtatatgaatatgattttgtgattgtgttttttaaaagataagtaatttgatgaactgttcttttgcagtcagaaaacactcacaaaaagacaaaaaaagttccacagtattatatttcatgtcagttcaggcctaaaatcctttgcaaataagatgtttataggctggtcacaattaacaatgttattattggcagcacttcttggatggataccttttgggacctttcattagaaagagggaaagaatggggtggttttgtatgggctcctgtttggggtaaaaatagcagagtcagttgctgaggacaatgaccttccttataacatttagtttcatacccatattaggtcttgtcttgaggaccctttatatgtgcttgtttactagtggccttccagccatagcattcttacctttttttcctattctaagaattaaaaaaaaaaattatagagccagcaagggaggaggcaggaaacagaaatcgaatttcatcattccagtatagttgtccctttttttgtatttstgacttggttttataattatatttacttactaattattgttttttaacattctttattgtggcttactcttcatacttagaattgaaattgttggacatcacatgtatattcacattataaatacatcattcttccactgttagacctttagattgcttccagtttttaatattctaaataagactttcaacattttctgtgttttagctcattctcttaggacattcttagaagttagaaacatttctgctgggatcgttggagggaacttcaaactttggaatctttcctgcaagaaattctttaccaaagaaaggcaggtgtttcttaaagggatgcaaaagatattttgcactttgtatgttccaaaacatttagtaagttaactaaaaaaatgagttaatttggtttcttgggggattttaattttttaatttgttttctggttatgtaaaaaaaatgttttttttttgcttcttatcacaatccttttgtttcctttttaatcctttaataacaccttcaaattttataagactttggcttatttcctatataattctttttttcttataccacctcttaagattgatatgttcatttgcaggtaagcattaattattagataaagaggkatgattctcaagattgtgtgtgttctgaacagagggaactacatgacattttcttctgtaattgcctttgtaacgtctttagaatgtggttcctaaatattcctggataaattctcttgataggcccattggaaaggctaatactcccacccagtgctttgttccttcctggcaaaagaattcctaaaaccactgattttagttactgacttctcaccatctggactcttacaagatgtttcagaagttgtgtagaacttgtctttcagttgacttgtggctgaatttactgttacttctctaatatcagttgttttctgcattaccaccctctcccctaaccatctgtactatgaatrgaaaaggaaaaagatggaaaaattatacctaggattgtccctaaatgcaacctcttggttccccccacccctcatgttttattataaacgattttaagagctgggcatggtggttcatgcctataatcccaatgctttgggaagctgaggcaggaggatcacttgaggacaggagtttgagaccagcctggacaacatagtgagacccccatctgtacaaaaaaaaaagtgctacttgggaagctgaagtgggaggaccacttgagcccaggaattcgaggaggttatagtgaactatgattgtgccactgcactccagcctgggtgacagagcaacaccttgcctctaaaacaaacagctccaactattttatttttttatttttctgagacaagatgttgctttgtcacccaggctggagtgcagtagtataaacatggctcactgcagccgaactcccaggctcaagtgatccttcctcctcagcctcccaagtagctgggaccacaggtatttgccaccatgcctggctaatctttattttttgtagagacgaggtcttgctatgttgcaagagggagatcacttaagtgatcttccctcattggcttcccaaagtgttgggattccaggcgtgagccactgcaccccgcctgacctaactattttaaacactactcatattgccatcatctaaattcaacaacaatttgccatatttgctttatgtatatgtataattatatatttataaaattttttgaaccatgtgaagttgcaaacatcattgaacttcaccactaaatatatcagcatgcatctcctaaaaatcaggtattttcttacaaaaccataattctgctatctattatgatttaacattctgtcattttcaaatttcttcaggtgttttttgttacatcttaaagaacagacrttcttggatctcaaagattccgaggaaggaaagaacatggtggataatccataattaagaagtttgaatcttttcctagtcttaaaaacaaagtgagaactaaaggggtttaccttccatcaaagttgaacaaattaattcttttgtgtgtcatactttctgtctctctccctaaaaacatgggggtggtaatctctttgttttatctggtaggttttccagataaaagattatacaggtttggaatcttaatatcyaacccccaactccaagccctgccccaacaacaacagctaattattttacatcttgatgatggtaaatttttcatgattaaccaattttgggcacctattccgccatatatggttttatttaattttcacagcaacacttcaaagttgatattcatattctaaatttatagatgaaygaagaggctcaaagattaaacaacttgctaataagtgatttttacccatgctttttccattatattatgttttggatttttccagagtacccaaacccagcagatgcatactgctccaaaataaatggaactcaatactggctctgtcaastgtctcttgccaatcaattgtccttctaatcttttgaggggcagttctctcagttgtaccaagtcactgtcatccccaaacttttcaatgattccaggcctttaacaactcccctccacctccaaaccctctctcaccaaattgtgtaatttctttgtttactgctggcttcatcatgcacttttccttcatagcctattttaagaagttgayttgctgaactgctttttagccaagctatttgtaaatcaagctacacaaagtatgtggccataatttccaaaaggcaaatgatcattgttcaattgctgttgctctgcagtgtgcattcatgcagttaaaaattgtactgcattgatagtacggcatcagagaatagatcacttaggttcaaatcccagtgcatgatcctgagcaagattatcatatctagatacattagtttttatctgtgaaatgggaatgatagcacaatcttcatagaattgttggtaaggattaagtgagttgatatgctcaaagtgtgcatgctggcatagaacaagtcactgtttacaagcctttaaagaaggagctgttctggcactgtaaacttgaaccttttttccccaaatctaatggatataggcaaggaaattatatttatataaaataaatgtttgactacctttgatcataaactttattctcatcttgacctgttcctttgaaaagataataaatactgatatgtgaaaaatgtatggacagattattcagatgtctggttgaggctttacagttttgtatatttctgtcagacattaagctgactctaagcagtggaggtttggtttatgcccctaaattacacagcacttcttttctccattgtatcgaggggtcattcaggggttgctgttctggagatggaagcacatgtctcctgcctgggtcagaagcgtcacaatagcacaagcatttattcagcactggcctaggagaaccattcatttagtcaaaacaagcatttatattcattatcctgaacaaaaaccagactaaatgagaacatttatagctgctcaggcactctgctaattgctatgtctgctagacaaagtgaaatgacacttacagtgactatttaaaaataatttggagcatgaatatttgaagctcagttctttttacaaaggaaatgtataacctttgctcttcattttttttggcagttatttatagatccaggccctgtgtcaagttctgtaatagatgaatagacagtttatgctcttggagagttaacagtaaaaacagaaacagaaacayaccccactgataaagtgttatataacaccccattaagttccacaatgatgtgatttgtgaaatggaggggcagtagggcaaggtagaggatatttttatttgtatgttacagataagaaaactgaactcagaaacaagtgactttccaaggccaaatagctggttaatggcaggattggggtgggaccccagatyttctgattctaatcttttttttttgcaagtcctttttagtgctatacaatgacaggtgattacagtggaaaacctcacttatttagcaaatgtcattcacttagcaaactacttagcaaaatgccatgagtatcttctgtgtgccagtcattgttctaggcatcgtagatgcagtgagtgagagagggaggcaaagaccctatctttatggatcttacattttcatggggaggcaaagaataagcaagtacaggattgtgatgatgatatatcataaagaaaaataagacaagctaaggaagtagagagtgatggcagtgcggagagtggagtaggtgcttctttagatgaactggttaggaagatactgtgatgagagggcacttgaacaaagacctgggaagtgaatgcatgaccttcatgcaaccatggtgcagggaggtaagggaagagcatttcactcagcatccctccctgctgagtgaaagcagtgcggagatcctgagttaggaatgagcttggcaggtttaaagaacagtaaggcaagtattactagttggagtgagcaaggagcaaccagaatctaattcacattatccagcagaacgacatgaatgctagttgaaaaatacagttaacattagcatttttactggcttataatgcaataactttgagcccaacctatttttttcctctggcttctgagcacatgttaatatgtaaggaagatgaaacatatatgtaaacaacttatattttagtaatgatacaaaatactttcacaaattttgtgatgtgggaattttttaaaattccattttcacagatgagacccctaaagctcagagtatatgcactttgcccaaggtcagagttagtatgtgaggcaggaatagaccctagatcttctggagctaaatgtactactcatttctctgtactacccttatcatttagctatggtgaacagaagatgaaccactggattctagaaagcagggagttcaggaacaacgttgtccaaccaatgattcattcatctagtaaatacttaggagcctactttgtgccaagcactcagctagcctgggggtataaggatggttaagactagagtcctgcctttaaggaactcaccagtgccataggagactggtggaaagaggattataactcagttataaatcagtagctagagtaaaatacacctaaagtagttcactaatacattaattggacaaaactagtgcagaacctgatatatactaggtactgagatgtttgttatcttacctgtttttctttaacattggtaagtactgggggctttctttgaaactttcctgcttaaaatcagtcagtgattgacaggctcctttgcacagtgtgaatggcaggggctgtgaaaaagaagagaaaacagtttctcagtgcctgtcatttctaaatgccatcagtatccacctaattttctaagctagaatcttataatcacctcctattccttcttctccttcacttgttaccygccccacatctaatcagtcactaaattctgtcagttctaccttttaatgaccctggagcctgctggcatcttgccattgtcatttccagtactacatttcaggccctcattatctcccatctggaatcgatagctcctgactggtcttgttgcttttcatctctctcgcccttcattccacctctcatttatcctccccagtgctgcgagagtgtgctttccaaagcagatctgatcctgccaccattctgaaaaaaagcatcctgggggactatgtgacctgcagaaagacgtccaaattccttagcatcctccatcttgcaccaatttcccctactcagcctcactctagcctactggataatgcagtttcctgaagttaccacactattaagcctttgcccatgctgggtttkgtgtgtgtgtgtgtgtgtgtgtgtrttttgagacagagtctcactctgtcgcccaggatggagtgcagtggcatacactcggctcactacaacctctgcctcccaggctcaagttgattctcatgcctcagcctcctaagtagctgagattacaggcacgcggcaccatgcccagctaatttttttgtatttttagtagagatgggggtttcgcgatgttggccaggctggtcttgaactcctgacctcaagtgatctgcctgccttggcatcccaaaatgctgggattacaggcatgagccactgcgcccagcctgcctatgctgttttttctgcctagtgtgcatatttctctcctggccttcagatgacctgtcactcgtttttcaggacccaactcataggacmcttcctctttcaagaggaatgccagatgagcttttggagagagaaggttagccattaagggggaaaaaaagaaagatagggccagagttgtaacatttggtaaactctgttaatggacttgatatgttatggttatttgtgcatttgtctctttctctyagatttactgttttgtgtttatatccttagtatacagcataagtgctcaataaatgtttgttaaataagtgaagtaggtatggggagggaacaactgtttattgagcacctattgtaagcctatatgcttttcacacatcatctcatttaaacctcaaaacaatttttttgatttaagtattatttgctaataagaaacagtcgcagaggacataaatacttacctctctccccacccacaaaggttatgggtttgtgaggaatggaactaaagttggaacctaggtctgtctgactccaaaactttcctctcttgtgtgattctcagacagggacaattttgtcccccctttctggggacatttgkcaatgtctggagatattcttggttattataatggggatgttactggcgtctagtgggtacaggtcaggtgtgctgctaggcatcttccaatgcacagaaaagccccacaacaaagaattatctggccctgaatgccagtagtgccaaggttcagtgtcttcatctgtttgagctgctgtaataaaatagcatagactggatagtttataaataacagaaattcatttctcacagttctggaggccaggaagtccgagatcaaggtgccagcagatttgatgtctggtgagggatacttcctggttcatagatagccatcttctgtttttgtcttcacatgatggaacgggtaagaaaactcaccagtctcttttgtaagggcgctaatccccttcaggaagactctaccctcatgacctagtcacttcccaaagtctccaccttctaataccactaccttgggggttagttttatttcctttccttccctttccctttccttttctctttaaagcagttgttaacatttaatgaacctcctgttatgtgacttcaagccaccaggagaaagctccccccactgaatcttctcctgagctcttctgctgaagaatttggccttcacgatgacaggctggtttgggaacttttcccttcccagaactctatagtagcccgatggcaccacatcagtgatgggagctgttccaggcttgtttttagcagcattcacctgtgtctgcttcctgaccaaagcccacaatttgtcaaggttgacagctgggtagaagctcaggttcctctttaggtggtaatgcctcataccaactttcctaaagtaacctgggtgacatttgctgaagtcgatcctgtggtgatgcatgccgccagcattgccacggccacctgggtgctttcagtgcttgctgatgcggcagaggctgtggctcacctggctccaaaatttctgggtcctgtggtgactacatttcctcagtctggatggctgtgtggaaaaagaagcttagtggtaaggcctaaggaagaaggagcaggggcgatgcttgccagcctgagatgggcctgtaggcctgtgggccaaggacctgccatctggagcatttggcaaagttgaggggcccatgtgtcttcgagacccgaatctcasgctgaacagggcyccgccctggacccacctgagctgcactgccctgctgacggtcaggtgcggcctggaggtcccgatcaaggttgagggtgggtggctgagggcaatgggagtagagcttagggtccctgctaacaaggaagtggaggcaagaaarggatcctagttttcaacatttgaaattttggaggacacagacwttcaktctattacattgagaaatcctgctctattccatgttgactctaatgaaaagcaattcatcagacaaaataaatgcatccatgacyccatggggagtcagattgggcttaagagaagtcctaggggcttggggccrttcatgagccactggcattggtaggatagaaagactattctgtctagtccctgacctgcctttgatcgtatggttcttactctactgcatccacccggtccttctgtctcttctccacctttccttttcttcagtagactctaatttagcttggggaaggcaacccagaaagctccarcattttctaacctcttttctaattagaagatagagttagcatataagaagctgcaagtttcaacttgacaatatctctagaactgagaacarggccaaaaatgtcaccctctgaaattgacagtaaaatagatgagattattcactgtgataatcttcccagaaaataacccacctaagaaattcttggtaagtgtgctgctaagccttggctgtttcctaatctcagccagggtccaagaatgcctccctgtaaagaaaagcatttaaaacgtaacttgtgcattaaactagtaatctaggaaattataaagtgtttgccttggggaagtgttctaatgggggacacttttaatgggtcttaagtgtaactgcctataattgttggggatgctttgtgtttttgtttttctatctctcaacataacaaatattaggagagaggaaccaggtttattttactggtgtctggcagcaaaggcayggatgagtcactgctagtgaagggtaggaattagtggtgtgtgtgtatgggggtggcggatggtcacagaagtcttttccttggtaaagtggttttaatcagaagcccataaaccttggttgtgtgcaaaatgtgtgtgtatttgtgtgcattttttctgtaaaatgtgtctgtagcattcaaagggttctcwgacctccaaaaagtaaaacccctgccttggtgattagaacatagctacyagggacaatgaaatagaagataacccaggaaaggcaagggaagtgagtgcctcgtaggagagaaagggttcattttgagctcacatttattgattgtgcatgcagaaggcctctttacatacataaataaggttcctaattttataacaaatattgggagcccagcatgcagtggaaggatgaactgtgagaaaacatcaaggcagaacaaatccagcctggtggatgctggagaaaagtacaaagggtgatgagaggacttggaaagaatgcagtgtggggagagaaagggggagagagagagagagagaatatgtgtgtgtgcacacgcatgcatgtgcacgcatgaatatgaggtggggaagatgaatattaagttgttctacatatgtcaatatccatgctgagtttagattccacagatgccctggggtagccaatactaagagaatggttctgtaaagctgagttctaggaagctaaccagacaattaagaagggattcttctaacgttcttttcaattttaagttacagaaaccaactttagctaaaggacttaaaggatactggacaatccataaatccctaggaaagaactgaacaaggaagtctggggaggcaagagattggacagtttggggacttccacagcaggtgaccaactccagtgacctcgtttccagatctctatatttgggttttaaattaacaagagaggagttagctgttgggacttgtaccagagaaggggaaatcatgagccaaggaatcaccttggttgttgaccaaagtcattatcatattggtttagagcaggtgtcctatcttgaaaagtgtgcgagactaatacccaagtcttctgattgccacttacacgcagcatgctctcaaggcacattcacaatttcttaatattttaaaaactaattaatagggtttgggtaggaatagagtgggggactttcaggcaaagggaacaaaaagtgcagtggccttcaggtaggatgaacttggcatcccagaaatagaaaaggctcttgtggctagagaattatctgcaaggagtaaagagtagaagaagggcattcagaggcttgattgcatcatggtgagaagttcagaggtttttttttttgtttgcttgtttattttcctatgtgcagccgaaagccactgaagagatttaagcagatatgaattacattttttgaaaaacactccagctgctcaatggagaatggattctgtgaaggcttgaataagagtgacagtactagagatggtaagaagtgggttgattcagcatgcatttttgtatcttggggagagaactggcagaacttgttgacggatttggtgtcagggaaaagaaaagggaaatccaaagtgggtgctaggcttttggcttgggcaactagatggatggtaatgttcttcactgaattatgaagactgatggaaggagtagttttagggaggaagacggtttggaatcgatcrtgtcaagtgtgagatgtcagcagtcttagtgaggaagtcagagggacagtcagatatatatttgggaatcaccagattataaatgttgcttaaagacaagggcctgrgtgagattgcttggggggcctaagaccgagctctgggcactgtaatattagataatctagctgggcarcaatgggcaaaggaaactggggagaagtcagttaagtcagagaaatgctgtattatttttaaagtgtgggattttttttttwattttttttgagacagagtctcactctgttgcccaggctggagtggagtgcagtgataccattatggctaacttcagccttgacctcctgggctcaagcgatcctcctgcctcagcctcccaagtggttaagaccacaggtgcatgctgccatgcctgtctaatttttgttttttgattttttgtagagatgaggtctcactttgttgcccaggctggtttcaaactcctaggctcaagctatcctcctgcttcagcctcccagagtgttaggattacaggtgtragccactgcacccggccaaagtttgggctcttaatttatagttctttatagatgtttgtaatttctctatatgatagtttattttggacacttgtgttgtttatgaatctattctcataktagtctagtaaatgttacacactttgcagctctagatttttccttgcttaaattgttggcaaaatctctctagttttatctttctgtgtgtttgaggggctgggagccatcccctgttaactgggcatggaaggaaggccaagtctgccattaagtctctttttgagcctgtatatatttgyataaggtccattaactatattaagtggtcatagataaaccagatacttataggcaactctaataaactacatgcagctttgtagattatttgcaataaaattttaattttaacaatcctttaattgttaaattaaagcctgcctaagctctcttgtagtattttgcatatgtctggggtggatctctttattggcttttggcatatgcgtttggtttaaagcagtccaagcaaaacataagtagaaaggtaggcttactgattatatatggtatatatatttacacacacacacacacagagtaaacagccataagaactatgtccagctctttctaatatagctaagtaactgtaacagtcagttagtccacctgaggaccccagctttattttttaagtaaaaataaaaatcttacttgttatcaaaacaatatgttccttatagtaaaacagaagcaaaatttttaaataggaaatttggaacacaataatcataactccaccatccagggataaccactgttaatatctaaggttgtattcttccagatcattgtatatatactgtagagtttggagtcatactattcattttaatttaaaataaacttaaaaaaaacttagcaatgtattgkgactatctttctttctttcttttctttttctttttttcttttttttttttttggagacaggatcttattctgtcacccaggctggagtgtagtggcacaatcatagctcactgcagcctcaacctcctgggctcaggtgttcctcccacctcagcgtgtcaggcagctgggattacaggtgtgcgccaccatacccagctaagttttgtttttgtttttgtttttttgttttttgttttttttgagagatggcatttcaccatgttgccaaggggggtctcacactcctgggctcaagtaatctgcctgtctcagcctcccaaagtgctgggattacatgagtgagccactgcacccagtccctatctttccttccttcctccctccctctctccctccctctctctctctctctttctttctttcgacagagtctcactctgtcacttaggctggagtgcagtggcccgatttctgctcactggaacctccacctcccgggttcaagtgattctcctgcctcagccccctgagtagctgagatcacaggcatacaccaccatgcccagctaatttttgtatttttagtggagatggggtttcaccatgttggccaggctggtctcaaactcctggcctcaagtgatccacctgccttggcatcccaaagtgctgggattataggcgtgagccaacgtgcccagctgggcccctatcttttaataataataaatattcttcaagactttctacagactttaaatgacygccaagaatttcacagtatgaatgtacgaatttagctatttatcagtgttcgcattgtttctggtttttgtttttgtttttgtgttctgctagtgtgtcaataatgccatcctggctggctgtggtggctcacgcttgtaatcccagcgctttgggaggctgagacaagaggattgcttgaggtcagaagtttgagaccagcctgggaaacatacggataccttgtctctattaaaaaacaaaaattagccaggcatgctggtgtgtacctgtagtcgcagctacttgggagactgagcctgggagataaggctgcagtgagctatgattgtaccactgcactccagcctgggtgacagagtgagacaatgcttcaaaaaaaaaatgatatccttgcaattaaatccttgtatacagtatattcctatttccttagtctaaactttgagaagtagacttgctgagtcaaagagttctgacgcatattgccaaatttttctacrggctgaattaatgtccacttctaccaaaaataaatgcctttgttaacactgggtctcaaaaacaatttcaaaaatgtttgtcaaatcaatagggaaaatggtatctcatcagtggtttaatttgtatttatttgattacttgtgaggttgaatgtttttgtcttacacttgttagctattggcatttctaatttaatgacttgcttttctatatcctgtactcaatattctctgaagatgcttgttattgatttgtaggaccagtatctctataaatggatattgagtctatgtgttttaaatattttttctagtctgccattggccttttattttttgatctgaaatggttaaaaaatatatgtaatttaggccagtttttctttttgtgatttctctgttgctatttttaaaatgttgttattgtagacattattttttgatacatatttgtatgtatttatagggtacaagtgctattttgatacatgcatggaatgtgtagtgatcaagtcagggcatttaggatattcaccacctcaaacatttatcatttctttgtattgggaacatttcaagtcttctctcccagctattttgaaatatacaaggtattgttgttaactatagtcacctcactctgctatcaaactttacagctttttcctttcgtctaagtgtttgtttttactcattaatcaacctcttttcatcccccccatccacatacacacccttcccaccctctggtatctatcattctactctctaactccctgcgatcaaattttttagctctcacatatgagtgatttgtctttctgtgcttggtttatttcactcgacataatgacctctagttccatccatgttgctgcaaataataggatttcatcccgttttttatggccaaatagtattccattgtgtatatatacattttctttatccattttccccttgatggacacagtttgcttccatatctatgctattgtgaatagtcctacattaaatataggagtgcagatacccctttgatacactgatttcctttcctttggataaatacccagtagtggaattgctggattgcatggtaggtctactttaagtttttygagaaatcttcatactcttatcgtagtaactatgctaacttacattcccgccaacagtgtataacagttccccttctccacatccttgtcagcatttgtttttttccctgataatagctattctaactgggataaggtgatatctcattgtgattttgacttgcatttccctaattagtggtgttaagcatttaaaaaatatacttattgtgtatttgtatgtctccttttgagaaatgtctattccgattctttgcccacttttaatataattatttgtytttttttggtattgagttgagtttcttgtatattttagatattagtcccttgtcaaatgaatagtttgcaaatattttcttttgttatttttgagaaagcatttcccaacttgaaattatataaatactttcctatatatatattttctactgcttgtttagttccattttttgctttaaatcattaccctgtagactttatttggtataatacaagaagtagaaatttaatttaatttatttcaaatgattcactattcaaagattaatcaattttttataccatttcacattacttctgctatatttgcagattaattataaagggaagcactgatcaaaagttgcacactggaggcccatggccatatctagcctatgaatatatttagttcagaatatttttgaattagttatctgcatctaaaaatcagaaagttttatacaagaatctgtttttacaaattctccttaaaaatcagaatatctggcaactctagactcacagtctcccttgacaaaaatgtgcaggagctgggaggcaattgcttcccatcatcaggaaaggtccccaccagtgtactttattcatttttgttgtctgcctaatccctgaaggcatttcaggatgctattaagttttgtatatttattttgcaattggacacattacacgaattctctaattagtactaactgttttgtggctaattttcttggggtttcaagtaattatatcatcatgcaaaaaattataattttatcttctctttccaaaatatatactttctaattctttcttctcgccttattacagttgcctaaaaatttctcacattttgaataatcgttatgactgttaattttaactttaatttttaacatgaggagattgagagatgcctaaatggctggtttgtttctgggtgtgtctgtttccaggagagattggtgggtgagtcagtggactgagagaagaagacttgccctcgatgggggcaggcattgtccaactggttgggggcctggttggaacaaacaggagaaagacagcagattctctgtctctgctgtctttcctctggagtgggaggcttttcctcctcttgcccttggacatcaggctccaggttctttggcttttggactctgggacttgyaccagtgacctcccagggctctcaggcctttggccccagactgggggctgcacggtcagcttccctggttctgagttccctggttctctttagcttacaggtggctggtcgtgggactttgcctctgtggtcatgtgagcagccaattccctcataaatcccctctcatatcctactggctctgtttctctgaagaaccttgactaacacaaggctcataatagcaggcatctttatacggtacctaattttaatgggaatgccccttgtgcttgacttttaggtatgaagtaagcatttttttattgtgtcaaggaagtatactttttatagttctctgatgttttgattttgtattaatatcagtaatatatgtggaatttcatcagaccaaatgactcttcaatatctattgatattatcctgtgacttctctaaatttaatacattataataagagatttttctaagggtttatatgcttcacatagtttaagccatgtatgtatttttattatgaatcctaccaatgtctaacactacttaataaaccctaataatatmcttcttaatctaatttgctagaataaatccagataaatattattttattaagtttgtctggcactcctcatattggccccattatttctatatgtggtcattttcctccattttctcatccttacaatgggaggcttatgcctgtccagcatgggaatgggtaagtgttctctcagagattatgcatccctgtgaaagcctttcagtcttggcacaggaaataagtttatattttgttgaccttaaccaccttagaagtgtcttggtgtatgagaagtaagaagagaggtggccataggtaggcagcctcatctctggctgaagggctcctcctgggattgtcacagcagctgaagcccaccggggcaggcagcagtacccctccagccagcatggcggccctccccaagagcaaacctcatcagaacctctgctccattctccatgccttctgtgctgtgaacaagtcttgagcatccctgggaccacccggccctccttgagagctccagcacctgtttccttctcaaggtggtggtggagtttgaatttgacactgccctcaacaaaatgacagtcttatgatcgtcactcatctctggtcccgtcacaccaaggagtggagtgtttgtcctcttcttttgcataggtcatttcagctgcaagttacgaagggagagtgttaaatgcattgactcagattgtcatgctgaattggaaacactggctattccacttgtattgactctcaagttgaaaagtgggccttttgtgcattcagcatgcctcccagagcctagcaaggagggtagagatggataggcagcttcttttttccaatccatacttgagaaaatttcagctgcatcagcaggttacaagggaaactacctgaatgccacctgggatttatagccacctgggggataagcatttgtttctaatgtggaataagataatcttttcctcctagcctctggacaatagaaagggagtctgaccatttgccaaacacattgtggaaggggaaagtacgtagaactggagattggacaatgtccttaatactcttcctttacagaaattctgtgactagtgttttatttgactagagatggagggctccatctctctaatcttgaagtcctgagatatgtgcctgcttgttcaatgtcacctaaggctttttaktcagtgttgaaggatggggctgtcttatgatcacacagatatgttttattgtcttaagggcctgacaaatcagggataccttctagttaaattcctctttaagggcctgaagtctccttaktactcagcatgcagttcagatgtttccctttctcctgggaaacaaataggattctcaaattgtgactttgttaattgttcttaagcaaattgcattaaaatttatatgcacctttccaagagaagataaattacacatgttaaaggaaggagaagaaaagacacagtgattatgaaattcctcagagaaaggttctttgttctttgcgtgcctcataatctatctgtcagagcagacctgtccattcagcaggtctaagatggcagtgagttatgattgggggactcaagcttatcatcctcattctcgggaatataattgaaaggtcagaatacttcccctttgagagttatccagctttgcccaggggcttggctgtggtccatgggtctttaacttgaggacagggggaaggtagggtagggaacgtggtcttagatttctcagatatttgaaaataactttatcttcggtcaaaatctggaaactgtacacattacaatcaagtgtttcttggactttctagggtagaggaaaaatgggacaatgaaataactcttttattcttttatgtctgttggagtcttgaaactctcatcactttgccccgatatcattcagtcgggcccaacctgagcaagagaacatctctgatttgataagcttctaaagtagtgtacatattgcattttgaccacaataagacagattatgcagagtgctatgagacagagacaggcctaaagaacttcactttctttttcttttcttttttttctaacataaaaggctgggcaattattcaggcattgcccatgccactcctgamcttgtgcaattgtccagaaagtccctgagcccagagctgggtgcaggctgtgcctacagcaaagtccttgggggtaaccggtagcctgtgggrgaggggtactgttatgacctccttttacaactttcgcaagggcaggcaatctggatcagtggagttagctaatcataacttcctcagttattttataactctgtgcctcagtttcctcttctctaaaatgatgataaaaatagaatgtactttttagagatgtgaaaattaaatgaggtaaaactgttaggagagtttcagggctagagtaagtgcttaatcaatcattatttatgacattattaccttatttggatcattgaggagtaaatttctctctattcttgaatagaaatgcttaataatcaaacaatttggtttctaagtgaagatgagcttttagtgggaaatttacagatatcttatgcctccccttcttgcctatacaaagcctgtattcttggttgggacaccaagagccttataaactttgcttaagcacaacagagaatattcacaaagtctcttaatctcatccaattcccatgagaaggarcactgttacatagtgatgacagtggatctcaactgcatcatgaattcttcccaagagactcctgaaacatttattttatggtaaagatgccttccagcaagattgactataaaaagaattttctctctctcattgacttgttttataaaatcagagatatgatctcatggaagaaaatcttccaattgatttgacaaaaatgcttagttaargaatgagtagatgatgtgtttgttttattccacaactaaattgtaagttcttaaagggaagggagctagattcctatttttgtagattacaaagattcagtacatcggactgacctggtggctcatgcctgtaatcctagctacttgggaggtcaaagtgggaagattgcttgagcccaggagtttgaggctgcaatgagctgtgatcrtgccattgcactccagcctgggcgacagagtgagaccctgtctgtaaaacaaaacaaaactaaacaagaatagatttagtacaggaccctaaaatgtgcggggtacagtaaatgttgacatgggctgaccaggtccgaatagtagaaacagaatatttttgaaacttttaagaagaaaattcgcttatgaaaagataataatagatgtgcctagatgtgggagtgaagacagtagccacactcacttgactctgcctttcctagagggccctgagggtgtcctttagtgttttgagggcctctgagagggcgtgaccctgtttgattgaagatgaggctcctgagaccaagtgacttaaccaagtctataccaagttatttatggtaaaatcaggactaggactcagacctttaactgaacwtggagattccaagatctcccttctgctttctctgtatgaaaggaatttttcttattttgatttatacctgagactagtataattccacatcaaccagctcctgttaaatttcctgtgaaaggaagttggatgcaatatcacaattgaccaatagatgtcactatatgccatattattgtgcatgtggccrcctgtctgaaatttgcttgaatttcttaattggggtggggtctgcagacttctgggaatcactggatctgtttgggagacacaaaagaactatgagaattttaaaaattgtatcttaagcttgataaaagttttatcaaatcaagagttattcgacctgctataaaggcaaaactcttacttgaaatcttttttgataggaaaaaagggatgtttttcaagttgagytccctggatragaagtggagttagtggggctgtgaggagcccctaacttctattcaattggcaaaacctccccttccacttcatagagaggagtctgagggattgaagggcatgagatttgaagttcaacacaactgggtctgagttctggttcattcattagctgtctgatcttgagtatgttatttaacctcgtctagccccacttccctcagctgtaacataatgacactgatcatatggtgttgtaaggatgaaatgagacgatatgtgaaaacacaaagattaactgtcattattaactatgaccatttcactttacgaaggcatttttataactaaaaatgcttggaaagtactaactagtccaagtttccattttaaaaatgggacttaagaggccaagttatttggttctctgattatgttttacaatttcataatacaagtatttatgtaaaacaagacatgcctgttctaaatcttttacaggtgtgtccctccccacttggggaaatgtgatatgtccctattcaaatttatcaaactgatgaaatacaaaataacccttcactttgtaatttagcaggctaaataatccagtttatttgaaacttttatctttatttttttctgtttataaaagtattctagaataagtgtgcaaaatttcagcaaatgatgtgtttaagtaatgatttgattgatgtagttaaaatataatttaataattaaatatggatgttttcataacttttcaaccacacagttttaatgttttgatttagtcgattcatttattaggyaaatattttcattgggaacattcatattcaccgaatacatgtataggctgctaagtgaaggctttaatggagtgggaattcatgaatacttgaccttatgatgtcggttgctctgataaattgttagctgaaagaataattcaaagtgttgtgggtctacactttgaagtagaggttgaaggcctctactgctgctgccgacagagggcgcaggcaggtttgtgcatcttctgagcaggtggggtgctgtgagttacatctgggccaactacccattcaggaggcacaccatctggggccatgatacttactggtacccatgaaaatgttttaattttaagttcttttgaaatacaaagaaaaaataaatataagaataatgaatataataaggaatccagcttacattacattttgcctgggaaacagccagactccatctctacaaaaataaaaattaaaaattaaaaaaaaaaattagccaggtgtgatggcaggcacctgtaatcccagatacatgggaggctgaggcaggagaattgcttgagcacaggagttcaaggctgcagtgagctatgatggcaccaatgcactccagcctgggtgacagagcgagatcctgtcmcaaaaaaaaaaaaaaaaaaaaaaaaaaattatggaggtgaggctctctaaggccagagtagctaaggcccatgaaaattataatgtgacctgagctacacttccaaaaaatgtggagtcctaagtttactgtaaggggagagggggatgagggagaaagttggaggaagagggagttgctgaaggcaaactcggcctcgggcctgggacacacgataacccagagagtagggtgaaggtttagctcacctgggctctgactgactatatgggaggtgacctgggagtgtaggaattattttaagttacaaaactgtttgtacaaagacctttctgacctcatagctgccaagctcctagacttttacctgcttcccaaatcttcaaaaacaggccgttttattcgcctcgcttgcagtctgtaaaatgtcttgctgcctataaaatgtcataggtctggattggaaaacacagggtgggcaggctgcatgattcctccccatctaggcctagggagagctatgtttcaggctaagtagtagtgcgggtcgacttttccctccttggaaagttaccattggaggaactctgagacttccaagcaggtatctctgcctgaacatgaggggagaaaagagatcaccctctgggaaaagagcaggcttgctggtaactcagaggacactttctgacaggcaagagaagaaagctaggtttccagtctgtggcttttctctctccagtgacagtgtgttctggcactcccagatatgattgcctggttgcttagggatggcgcctggacccttggcctggcgtctttgagggcttccttctgggaagagagagggcaagtgaagcaggctagaacacggccatctggtggcactgggcagtcgaccagcatcccctgccatccagtgaaacacctgtgagactcatggggtgggatgggaagatggggttggggaggctctgccctcaagagctttggtgccatgcacccatccagccccagagagaggggcagcagtggrgcaggggcagaagtctaacagtcactcctgacagctggggccaacagtgagcctggagagaccttggctgtggaggggggatggaggtggcaggtgtgcctctcaactgagggaataatggggatgcatgtgtacagatacggtctggcttttctggggccaacaccactcctacctgcctcttggcgaacaggctgcatccatcatgttagtctcttaggattaggtgatggctttggttatttaactcctggggtgccttgtgccctgaggacaccatgctgatcttgctctctggctggtgggtgggtccctttactggctgactctggkggggcagcaggggagatgttactctatcattcctatgctgatttatggcttcatcttttagtccttatggagtcaggtcaggggacacaaagatgagtaatatatggtctctgccttcaaggagctcaaagtctgttgggagagaaaaaaaaaaagaaaaaagactactggcacgcagtgacaaatgctgggctaaggcctgcccaggaaggggacagctgctgggagaggtgtgtgcaggggcagggtgggcctcaagacagggaaggtgggattccaagggaacacaggaatcggccaagtgggaagtcagggaggaacatgtaaagctctggtgccatcaaaacccagaggcactcaggactgccggcccttgaaaaggcaagagcttaggggacaggatggggaatggaaagaaagaagaatggagagaggcagggcttctggttatgaccaagagccaggcatccccctactaaaggaaggattggagaggaactgcaagatttcctcaggggagagacaagaccagacttgaattatacaaagattgagtctgggagaggtggggagatgagagctggaagcaaggaggcctgttagaaggcaattatgagtaggaaatgataagaacctaagatcactggcagtcagtgcagattacaggcttgtggctcccaggtgcatggtggtgagtgggtggtggggtgcaaggatgggaggagcttcccaactcctcctgctcttgcgcctccagccccaaggagatgagagagctggtccaggtcttgttctaggaaggtgcccctgctgggttctggttgaggcgatttgcccagggtggagcctttcgcctctgcacaggctgctcctccttcccttcccagcacacttcccttycctatgccttgtggtcaactcctgcttgttctttaaggtacaggtcaggtgttacctccttcagagagacttttgtggcctattcctgccccataccttgggtcaggagcctcattgttgtggcatgtggttactgtgcttgcagtaaaggcctctgtcatcgtgcactaaaagggcccaataacttgccgtcttttcccactacactgagctccatgagtgcaaggtttatcctgatgtattatgtattaaatgcatatttaccaacagcctgcttggtaagccaggaacagagctaggcatttgggatataagagtgaggggaaaaacaggcactaatcatgcaaccatgaaatttagagcctataagcaaagactcatgctatsatgaggacaaacacaatgttataagagctcctagtaggtacccattaggcagggttctccagagaaacagaacaaagaggatgtgtgagtgtgtgtgtgtgtgtgtgtgtgtatacacatatgtagatatagggagagaaatttatgataaggaaatggctctcatgactatggagactggcaagtccaaatctacaatatagttctattctgaaggccagcacctggagacccaggaaagccaaggttccagctccagtatgaaggctgtcttttggagaattccctctcgctcaggatagccagtctttttattcgattgaggccttcaactgattggatgagatgcacccacattatggaggtcaccctgccttacccaaagtgtattgatttaaatgctaatctcatccaaaaacacccttcaagcctgggtgcagtggcgcatgcctgtaatcccagcattttgggaggctgaggtgggcagattgcttgagctcagaagttcaagaccagtctgaccaacatggcaaaaccccatcctacaaaaaatagaaaaaaaagccaagagtagtggtatatgcctgtagtccaagctacttgggaggctaaggtgggaggatcatttgagcccagaggtcaaggctgcggtcagtcaagattataccactgcacacaagccaggaaagggtgagaccctctcttaaaaaaaaaattaaaaaaataaatacatgaaaaccaaaaacacccttcaagttgacacaaaaaattagcaattgcagtactcgggcctaatctaggcagtcaggaaaccctcctttgagagaggagcaataatgctgagatctgaagaagagccaagggcacatggaagatgtgagggtgagggggaagaagggaggccatgtcaggtggagaaaacagcctgtgcaaaggtcctgtgtcaggagggaacactgcattctgggggatctgaaagaaggccaatatagccagaagggaaagaataagggagcttggtatgagatgattctggatagatgggaagatggcagatcctgcagggtcttgtaggccacagtaagaggtgtggtccatatcgcaagagcattgggaagctatgaaaattttgttaatgaataacgtgatcaaatttgcatgattgcatgttgaagttccctctggtggcaatgagaatcgggtgtatataggcaagagttgccatggggtggctggttgtattattcaggattctccagagaaacagagccaataggacacatatagatgcatgagaggagatttattatgagaattagctcgtgtgactatagaggccaaaaaattccatgatatgctgtttgcaagctggagaaccaggtaagccagtggtgtaattcagttcaagtccagaggcctgagaaccaggagagccgatggtgtaayggtccaagaccaaaagtctgagaactggagcttggggttggggatggggtggggaactgctggtgtcaagtcctagagtctaaaggcctgaggaccaggagctccaatttccaaaggcagcagcagatagatgtcccagcccaagaagagagagtaaactgtagcactcccttaaattttgaaaagtgatgcctccttcaccttatcctcattcagaccttggcccagagagtcccagagccaggaaaatctatgtccagtgtcccagataggaaggcatgcagctctccctagcaaatggaagttccccagaaagattgggggaacactgggaagatggrgctgtctgcaacgtcagcatttcttcacataaatgaaatgactccacattcaaggccaggaaagaaggaatatagtgtatgccccacctcatctctgtcacagagacctgatgaacagaaaaaccatgatatgagcgtgcttagaaaccacagttatgctaccaatatcttttaataatgtttgtttaataaaaacaaaatgttattgttatcattattaactattacactctattttcatatttttctgtttagtaggtagatttttttctaacaggctttgtaatctcttggattatgtttttctttagctattaatgaaattaatttgggttccttgaacacagccatcatttcacaaatgttctgcctagatgacagagaaaagtctgcctagaatggaaaaaaagtattaataatccacaaaaggaataatccgcattatcatttggattaattgagaattgattggaatcatcttgagtcaggtaacttcactgaattagtaaaactggcataaaactcttccagggcgaagagctttatcaacaaagttaggtgctgtatctgcctattcctctggccactagtttctgcctcctttgaaggtaggaaggtttcacatgatcatcatttatgaattgaatactttccatgcagaaggtattgcatataaaatcagcttctggctctgagttatttgcactttttcttcagagacaggcacrgttggtggtgagctagattcatgagcccttggattagtatccaggttggcacacactgtgctgatgctctagctggaccctaacattgatgaggtcagtgcttagaccattcaaaagtctgcacacttctcctatcactgacatgtcctccacattattttctgttcttggactttcttcttctcagtcacccatcaatcctgattcctcaggcttcagcctttttcatccagttgggcagagctgccaaggatgtgcagttatattctatggctctcctccttaagggaatattatgctaaatgttccctcccccaccgccctgttcaaagaggaggagcaccccaatgagaacttcatggcatctgtgaattctttgtgcagtatcttccattgattaatcagacttcctagtgtatttcagactgattctcttctaaattcacaataaattgatgacttaactaattatatttgcaaagactctatttccaaagaaagacacattctgaggttccatgctgacatgaattttgggggtgatgctattcaacttactacactctgtaaccagtgatgtacatcacttacatatttgatctcaacctaggagtctattgtcccttacatattttatgtagacgaatgactgacataaatatttttggaaaactaaacatcaaggttgatagattttatcagattttatctgtggttaaaattcatgagccatgaatctggtcaaatgtctatgagtttgattgaatactcctgaaaggcaaaccacggtataaatccaggaaatacatagtataaatccaggataggcttcatccgtgttttgaacctaagtgttagtgttgtgaattatttaatagttgctttttattttctctttgcctgttgacatctttaaaatatacattttaggctttaattatacctatttataaatttgccttttcttctaagttgattggtgagaactgagggcaaaggaagctaagattaagtgaatagtatttacatttgaaaaatacaraacgaaagaatgattttttattatatctgattacttaaaaacataatttttataatataaaattgatgtgtactcattgtggatgctttgaaaaaaaatagcccaaagagaaaataaaatgctcttgtagtcccagtcatcagaatgaagtgttgttaatattttcaaagtatgctttttcagtcctttttctaattgtatgcacatgtaaacatgaagtgtgaagaaaatgagacctatatttatacacatgtactcacaggattgtagctgctcctgcctttaagaggatggtagaattcatctcaagaaagatttttaaaaattataaacattcttaatggtcttgataaagcatgaatggtgaacacctctccctctttttcagggcatggaaagaggaggtgggactaacagagcagtgaatcactccacacaaaacagcaaaacaggagggaactgagttatttgttggcagctcaagatactggagaagatgacgggccaggaagttgaaagaaggtgagaggttgaggagagaagaggggagctggggagaagctctggccacgtgaaaaccggtagagcctccagaagactgcagccaaggaggaattccttgtggcaaggaatgtctgatgttgaatgttagatggttttctgcrctgtgctgggatgatacaacttgactcaactcttcagttgattgttccctactaacagcaccctggggttagtgttgctttggttgaaaggaagcatgaaaaagttcttctatgatttcattttttttaatccaactctttaatccatttagaatttattttgatataaagaatgaggtggaacattagcttaatttttctcctgaagtttagccaatgatctgaccatcttttaaatgattttaaatgccaccttgatattatgttaaattatactaaatgctcaagtatactttggtctatgcttgtctggaagagacattccaatgttccctctctcttttagctttagtaataaactttcaaattcatctggactcatgggtcttctaaatcattactatgtctcccaacttcttttgctgctagctatggctgttgatatagaagcaggaatattgtatgtaactttcaggatggtcctgaataagaggggccatgctccttttcaccccttttcctcctttctgacaactgtgatgtaaataaaaagaactctggcagccatcttggaccatgacgtagaagttgcttgttgaatgttattgcaaaatagaagtagtcttggtctcccaagagcccttgatgactttctgtcacctgtagattgcttatctttagacttataatgagagaaaaataaactttgatggggctcaggacacaccaccccaaaatatcactgtaggagaccacaatatgccatcccaaaatatgcctctttgctgtattggtcattttaagttggttatttttgagaaactgcagacataggagtagctctgaaaagttgcccttttgcaggagaaatttacatcaatgaaggaaacctcaatttttaagggtgttttcctctctgcaccaagaagagaaggaggactaaatcactagagactcttatcaatggaaaagacatagacttaaatccacataacaaacctcgtcctcgttttgtggcgcttttcctggccatctgctcttaacctggcttttacccacactcttctttctttgtttcagagaaaaatgacatttacgcctgaagtttacatgcttttttttttttttttttgagatctactctagagatttattcatttctctgggttttcttttatgtatatatgaggcatacatgttaagaaacttctatttttctcttgttaatctgtcttttgttacaggggggtcccagttaagaactgtgaagtgtagagagaaaattattttttcttcccctacaacttctatctgatttgagtcctttttatatagattttttttagtgatcattgcaggtgaacctaatcctaaatgatggactttgtgttaggtttcactgctctatctgcatattcatctaacaaggttatgcaatttgactttaacattgtaacacatcttaatatgatacaatacaggtacttctctttcttctttttcaatattttcttggctattctcatctgtcatttttcttgtagaccttattataattatgttaatttgtaaacaaaaaaaatcccttttggattttgattgaaattgcattacacttacaaattaatataaaagcactgggccgggcgcagtggctcatgcctataatcccagcactttgggaggccaaggtgggcggatcacgaggtcaggagatcgagaccatcctggctaacacggtgaaaccccgtctctactaaaaatacaaaaaattagccaggcgtggtggcggccgcctgtagtcccagctacgcgggaggctgaggcaggagaatggcgtgaaccccggggggcggagcctgcagtgagccgagatcacgccactgcactccagcctgggtgaaagagcaagactccgtctcaaaaaaaaaaaaaaagcgctgaaatctttatagtattgagtctttagtatccagaaataggatatgtctctctcaaaccttttttatattcctcaaataggtttatattttcttttatatgagttttatatgatttttatacttaatattggatatcttttttattgtttatgttgcaaattgaatttattcacataaattattactctaagatatagttgatttttgcaaattcatattgttaagagggcagaaaaaaatagattaagaaaaattcagctacttctacctcctagggcaatgtcataacttatttctggagtccatagtcctcctatgtcttaagcaaatgctttagtgggcctttttggttgagaaagtcacagcctggtatttggtctggcaagagcaaagagacccagatgactgtatcataaagtattttaagtggttgcaggaggctgggagagtgggtgagggaccaagaacaggaaggtgagaagagtgtgaggaatgtgtagagagggagtagaagaagaactagaaagaaggtggtggagatgctagtgtagactggcacctaaggagggacacagctaatgaaaaagaacctgtattgagcaatggaaaatgcatttcttgacagggatgtcttatattcagtgttgttgcctctgctactctgcaataaatatactctttattttcccagttgctttggggaaaagcctactgtctgtaaaaggagtggggcagtgttcagcatggggctaagagatgcaggaagaataaaactgtaatgagaggcaagtgaagagcaaagaccaagaatccattgaaatttagaagttacagcaagaggtaaccaggagaagtataaaatcccctgataatcctgctcaattggaaaaatgccaggttttctacatgggatggaggatcaagctattctgtttgaattaaagagaaaggcaattcaagaaggctgaatgacttgaagatactctggaggcagaaatctaagttacaactatacttcattacattatgttgttactagttttattttttgattgctattgagaatgaatatacaaatagaccatgttcagaccacatatgacagcagaaatctgacccacaacttttgcagcaaccagcccaggaagtcagagcaggacctctgcagcggtcagcccagatatcagtacttagtcaatgatggcccgctccctcaatttttgccccggcttccaattcaagaccaacaaaagaaagccaaatatgctctccaattgatcacacgggatgcttctagttagcctacctcctgctttctcacgccaaatatctatcagagtgtcttagttctggctgctttatcaaagtaccatactgcatgggttataaacaacagaaatttatttctcacagttttggaggcaggaagtctgagattagggtgccagcatgattgagttctggtgaggaccctcttttgggttgcggactgctgatatcttgttgtatcctcacttggcagaaagagggtgagagaggtctctggcctcttataagggaaccaatcctgttcatgagggctccatcatcatgacctgattacttcttgatatggtttggctgggtcaccacccaaatctcatctggaattcccacatgttgtgggagggaccaggtaggaggttattgaatcataggggcaggtccttcccgtgctattctcgtgatagtgaataagtcttacaagatctgatggtttttaaaaagggaattttctctgcacaagctctcttctcttgtctgccaccatgtgagatgtgcctttcaccttctgccatgattctgaggcctccccagccatgtggaattgtaaggccaataagcctcttttttttttttttttaaattgtccagtctcgggtatgtctttttcagcagcatgaaaatggactaatatagtaaattggtacctgtagagtggagcactgctgaaaagatacccgaaaatgtggatgcaactttggaactgggtaacaggcagaggttggaacagtttggaggctcagaagacaggaaaatgtgggaaagtttggaattccgtggagacttgctgaatggctttggccaaaatgctaataatgatacagacaatgaaatctaggctgaggtggttttacatggagataaggaacttgctgggaactggagccaaggtgactcttgttatgctttagcaaagagactggcttagcctccaagcctacatctttctcctgtgctggatgcttcttgccttgaacattggactccaagttcttcagctttgggactggctttcttgctcctcagcttgcagacagcctattgtgggaccttgtgatcgtgtgagttaatactacttaataaactccatatatatatatatatatatatatatatatatatatatatatgagtataaagggatatatgtcctattagttctgtccctctagagaaccctgactaatacacttctcaaagtttccacctccagatgccatcacattaggattaggggtgggtttcaatatatgattttgtgtgtgtgtgtgtgtgtgtgtgtgtgtatgtggcagggggccaaacattcagtacattgcacagagcatatctgaaatcttcccttcctttttcctctgctctaatgctttcctactccctgcctgcctgtgactctgctcaatgcaagtgatggtggctgaccacccactaaaaatagcaagctcagaataaatagcctctgcttgttttctttgagtggcatttgtttatttctacaatattcttgggttttaaagataggcaattatgtcaactgcaactaagactttcctcctttctttcttttatttgaaatgggggtctcactttgtcacccaggctgaagtgcagtggcacaattatggctcactgcagcctcagtctctggggctcaagtgatcctcctgcctcagccttctaagtaactgggactacaggcatgcaccaccatgcccagctaatttaaaaattttttttttttttttgtagagacaaggtctcacttcattgcccaggctggtatcaaactccagggctcaagcagttctcccgtcttagcctctcaaagtgctgggattacaggcatgagccactggcacctggccaagaccttcctcttttctgatagctgtacacttattacatttctgattctgatagctgtacatttatatttctattatattatgatagctgcatatttgtatttctattatattatgatagctgtaaatttctctgcaatgaaacagaaatgtacgtctatcaaaaatagaaatttacagctatcataacattatataatagtgacaatggcaaccatctttactgtactttttattgatagtgtctctacagtttttcttttaaatataatattgcctattgatttgagatgaatatttcttctcccattaaataagtatattttcattctagtttatttagttttcttttttaatatcaaaaaaagtatgtttttagtgtctattgagttaatctttttcttcttatgggtaatattatattaatagttattctaattttggtacttgcattcttataaaaataaacctacttgatcacagtgcattattcttttatcacactggtgcatttaattggataatattttattcaggatttttgcatctatattcataagtcaggttggcctgtaattttctctttttggtgctattttagtcatatttctgacttgaaatctatttcatctactattaatattgtagagtctactttttttttggatagcattaacaactggctgttggtttgaaatatatattttttgtcatattaaggagctatctacctagacctatttacctagatctatctttggaggatgcaattatttgccaatgttttccaatatattccatgtttgttagtcttttcagacctacattctctcgagttagttttgattacttatatattttccataaatttaccattttattaagattttcaaacaagttagtatagagttttatgtagaaatattttaaaattttaatctataggcatgattataatctttagttttaatctgaggctataatgtgtcattcctaatatggcccatttttgttttctttcttccccctccataggtgtaggatattttctttctttctttcttttctttcttttttttcttttgagacggagtttcactcttgttgcccaggctggagtgcagtggtgtgatctccgctcactgcaacctctgcctcccgggttcaagtgattctcctgcttcagcctcctgagtagctgggattacaggcatgcgctaccacgcccagctaattttgtattttt

SEQ ID NO: 17787 - DNA, 19663 bp, Homo sapiens
ggaagatgtatgagaaagtgggctgggccgagagtagaggctcaacccaggcttggaaaagggtcaaaatatgtgccggtttccctgtgcgccacatggacttctccctcctgagccattccccagggctctctccatccatttgtccagcagggactgagcccccgctgaatgcttaaccttggatttctcaaagattaagtcctcttcccacctcttccccattgtgagcaggaccagatttacacctttagtggctgtgattactgaaaatacggtgcccctcccatctgttgtccaaagtaaaacaacactaaaccctgaaatgacttcataaaaagaacaatagagaactgatttttttttcccaagctggctactttgaggattttttccaaatatcaaaaacaatattttattttatttatttattttgagacacagtctccggagtctcgctctgtcgcccaggttggagtgcagtagcgcgatctcagctcaccgcaacctctgcctcctgggttcaagtgattctcctgcctcagtctcctgagtagctgggattacaggcatgcaccaccatgcccagcttatttttgtgtttttagtagagacggggtttcaccatgttggccaggctggtcttcaactcccgatcataggtgatccaactgcctctgcctcctaaagtgctgggattacaggtgtgagccaccgcacccggtcaaaatcaatattttaaatgtgtattttgggactgcgcctgctttgctgggaccccaagcatattcttacctgccagtgggcaacccagtgtcaaaggaaccggtcccaggcccattctctttcacctccattttcacatctctccctgcacagcaccatcccttcttgtagacaagaacttctcaccttaaataaaactccacttgaggctgggcacggtggcttacgcatgtaatctcagcacttcgggaggccgaggcgggtggactgcttgaggccaggagtttaagactagcctgggcaacgtggcgaaaccctgtctctacaaaaaaacaaaaattagctgagcttgatggagcacacctgtagtcccagatactcagaaggctgaggtcgaaggatggcttgaacccagaggcggaggctgcagtgagcctagatcacatcattgcactccagcctgggtgacagagtgagaccctgactcaaaaaaaaaaccccaaaaaacaaaaaaacctccacttgactgttctctgccctaccagctacctcactcttattttccttttttatctccaacttttctttcctacagatttcagccaaataactcacatctgttccctctgttggttcctaaacataactcctccagcctggcttctgggcaatcacccctccctgcccctagactgctgcccccatggacttcctttttgcgagagccagtgacctgatcttagcacgggattgggagtcagaaggcctaggcagctggtcactcaccagctgtgtgaccgtgagmaacttaaagcacttctctgagccatgggtatgaacgttaatttgcaaagttgagatgagagcattagagtaatagaatcataatagctaaactgtgtgtgtgtgtgtgtgtgtacctgctaagagccaggcactgtgctgagaatttgccatgtataatcacatttaatccccactacaacacctccaaatgaggtctgcttctttccccactttacaaatgagaaaagggaggcacagagaggtaaagtgatttgcctaaagtcccacagcccataaatgataggtagtagaatatgaacccaggaggtctgattccaaaatttatgccctatggcttccttactgacggtgctcagtacagataagtgggaggtgtgacttggtgttaatagggactctaagagtcagtgtgggaattgccattcccctgaagctagggatggcaggtgtgtttgtgggttgggggtggggtacttgagtgatgctctcccctgaggcaatgtcttgcaggatacacacctttctacttcatctcagatttcagtgtctcctccacatcctgccagagcctctctggcctggctgcccctcccctctytggcaggtttgggagaaagaggcttggagttcccccatcctagatagcgggacagattcctcatctcgtgaggctgaccctgatctgggggcctgttattaataatggcctgcagggctgtgtcatccagctagtgattcaggactccagggtcagcaccctccccatcctgatggagctacctcagtgaggggcttagagtctaagctatgactctacgtgagggtatatgctgttctctgcctgcactcccagggtcttggctaaactctattgtggtattaaaaagagaggctgggggaagtggggaaggggatgtggtaaccagaaccacttcctgccactgcagtgttgaaagccaagctctgtccaagttccccttgatgggggttggggagccaggaggtaaaggaggaagttgatgggagttgggggggatgttaaaaaaaggaggattcttatttggattgactccaggaatcaagatctgggtttcctggctgctctctccctgctcccatttggtaaaaaacagcggctgtcctgaaggtggtcctaattagcatagcagtgaacacttattatcatgtgccaggcactttatatttgctaacactttgagccttacaaccaccccatgaaggaagcactattattactccaattttacagatggggaaactgaggcactgaaatgttgtgtcagttgcccttgtcacacagcaagtcagtggcagagctgagatttgaacttaggcagcctggctccagagtgcaggctcttgctctgtgaccactctgagcctcagtttcctcattgcatgatgagggtaattggaatacataaatccactttcctttcttgatgcctgattctctggtaattaattattcattcaatttctccccatgctgaactctcagatccatgaacaatgagacaaaggctatcttggtcactacttgtattcccaattcttagcataatgattggcctagaaaaactcaactagaatgtgttgagtaaatggtctttaaaaggtctgaagatcatcaacaatggtttgagtatctgataaaagttttagaccctttacatagaaaaatcaacatataccagtagctgggggtgagtctgcccctcccactcacccagggtacatttggcaatgtttggtaacatttctggttgtcacaactggcagggggaggtgctactggcatccagtgggtaggggtcagggacgctgctaaacatcctacaatgcacacgacagccccaagtgccaatagtgctaagtttgagctatgtgacatacatacatagatatgtattgtatgtcatgtttggtaccattgatggcaagtggggggtagttaacggattttcctaaaagcccgtgtctgccacccagatgaagatcctccagattggaagatctgttcctctaaactcatattactctatgacctcacattcccgagtctagaatctagttcctcctgggtcccctgtcctagcctctgattccctaaatgcctgggcctcctctcttaccttcagtgggtagcaggggaccagaggagaagcatccaggttttatgtgctgcccctgtcaccgcatccacctacccacttctatacctgggtcatcacagttccctgtaaatggtaataaagatgaaaagcttcagagccaggcagttctgggcttgaacactagttctgtggattaactcgctctgtgatcacaggcaaattccttaactctctgagccttagtttccccctctgaaaacaggagggatactcattaaacttaccttacaggtggtgaggatgaaacgagaggcttatagagaacttattacggtgcttgacacagtaaatctcaaaaaatgcattattattattatggttcagaggtaaagtgacttgyccaaggtcacatagctggaaaatggcagagccgggatggaaatccaggacttcgtgactgcaaagcagatgttcattggttagtgaactttagaacttcaacttttctgtaaaggaagttaattatctccatctcacagtctcatttattagataagcatataaaatgcctggcacatagtaggccctttaaatacagcttattgggccgggcgccatggctcatgcccgtaatcctagcactttgggaggccaggtgggcagatcacttgagtcagaagttcgaaaccagcctggtcaacgtagtgaaaccccatctctactaaaaatacaaaaaatttagccaggcgtggtggcgcacgcctataataccagctactcgggaggctgaggcaggagaattgcttgaacccgggaggcagatgttgcagtgagccgagatcacgccactgcactccagcctgggtgacagagtgatactacaccccccaaaaataaaataaaataaataaatacaactttttgagttgttagcaggtttttcccaaatagggctttgaagaaggtgaatatagaccctgcccgatgccggctggctaggaagaaaggagtgagggaggctgctggtgtgggaggcttgggagggaggcttggcataagtgtgataattggggctggagatttggctgcatggagcagggctggagaactgaaagggctcctatagattattttcccccatatcctgccccaatttgcagttgaagaatcctaagctgacaaaggggaaggcatttactccaggttacactgcagcttagagcccaataacctggtttggtgattccaagttagaatcatggtcttttggcagggtctcgctctgttgcccaggctggagtgcagtgacataatcatggctcactgtatccttgaccttctttctgggctcaagcaatcctcccacctcggcctcccaaagtgctaagattacaggaatgagccaccatacctggccctgaatcttgggtcttggccttagtaattaaaaccaatcaccaccatccgttgcggacttacaacctacagtgttctaaacattttatatgtttgatctcatttaatcctcacatcaatttagggacaaagagccccccaccccccgtttttttttttacagctgaggaaacacttcaaagtggtaagacatttgcccgaggtcctgaaggaagagagtaaagccatgtctgctgttttctagaggctgctactgtcccctttactgccctgaagattcagcctgcggaagacagggggttgccccagtggaattccccagccttgcctagcagagcccattccttccgcccccagatgaagcagggagaggaagctgagtcaaagaaggctgtcagggagggaaaaagaggacagagcctggagtgtggggaggggtttggggaggatatctgacctgggagggggtgttgcaaaaggccaaggatgggccagggggatcattagtttcagaaagaagtctcagggagtcttccatcactttcccttggctgaccactggaggctttcagaccaagggatgggggatccctccagcttcatccccctccctccctttcatacagttcccacaagctctgcagtttgcaaaaccctacccctcccctgagggcctgcggtttcctgcgggtctggggtcttgcctgacttggcagtggagactgcgggcagtggagagaggaggaggtggtgtaagccctttctcatgctggtgctgccacacacacacacacacacacacacacacacacacacacacacacaccctgacccctgagtcagcacttgcctgtcaaggaggggtggggtcacaggagcgcctccttaaagcccccacaacagcagctgcagtcagacacctctgccctcaccatgagcctctggcagcccctggtcctggtgctcctggtgctgggytgctgctttgctgyccccagacagcgccagtccacccttgtgctcttccctggagacctgagaaccaatctcaccgacaggcagctggcagaggtgggcaaacacctagtctagagttggggagggctgtccgtgagggtgttgagtgtcccagagaggatgcagggcctcagaggagatgctttaggggtgtgttggtggtgatgggcgtatctgaagaacagaggtgtccagggttaggcagtggggggtcttgtggaggctttgagcagtgatggccagaaatgggcaatggggctttcctaggtgggaaatgggaaatggtttggggtgggggaggcattggagggttctggggtaagcataggctgggagtgaacaggggcaaaccttatgcagctgtggggtagaaatgggctagaggcatccaggggtgagaaggagctgaggatgtctaaggaggggagatccctgggtggtcagaaagcactggtgtctggaaagcatttaatgctttattaaatgytagtccctgctgggcatgacggctcacacttgtaatcccagcactttgggaggctgaggtggtaggatcgctgaagctcaggagtttgagcccagcctaggcaacatagtaagatcctgtctctacaaaaaaattaaagaaatagccaggcacagtgatgtgcacctgtagttccagctatgcagaaggctgagatgggaggatcgcttgagtccrggaggtccaggctgcagtgggctgataccgtctctccgaaaaagaaaaagaaaaaagactccctccatgagtgtctggagggagtcctttggccccagctgggcagagaaaggggtcagagatctggcatgtgtgtgtcccttcatccacaggaatacctgtaccgctatggttacactcgggtggcagagatgcgtggagagtcgaaatctctggggcctgcgctgctgcttctccagaagcaactgtccctgcccragaccggtgagctggatagcgccacgctgaaggccatgcgaaccccacggtgcggggtcccagacctgggcagattccaaacctttgagggcgacctcaagtggcaccaccacaacatcacctattggtgagccggggccgtgggggcagcggggtggggcggggaggccaggtctggctcttgggccagcggtgaacatgtcctgtcttggacgcgtccctgggtttcactatttaatgtgtggcccctggggagtgtccccacctctgagcctctgtttctccttcagggaaatggctcttgcaatccaagtcctcctgccagggccattgtgagggtctaagtagacaaamaaaaaaaaaaaaacaaaaaaaaaaacagtctggaagcaatttatagatgagagcgtggacggcagagagcattgtgtatgttgaagtctctgcgatatggggtgtccctgctgccccgctccagcctttcacttctgacctccttcctctggctcttacgctacaggatccaaaactactcggaagacttgccgcgggcggtgattgacgacgcctttgcccgcgccttcgcactgtggagcgcggtgacgccgctcaccttcactcgcgtgtasagccgggacgcagacatcgtcatccagtttggtgtcgcgggtgagaacgtgaggagggaaaatccaagagacctgggcggggtcagggaagggaggaccacggagagcgtggaggcagcagtggccccggcttcctcttgcctgcccgcgctgccctggcttatacggcccctcctgccagacagtgcacagggccagggcgccaggctgggagagcttcgcgcaggcgggatttcagcccgcacttatttcggagcccttgccttgggcagcgcacartytgcgcagcagtactcggctaaccctcttcctctcgacctgtttcttcagagcacggagacgggtatcccttcgacgggaaggacgggytcctggcacacgcctttcctcctggccccggcattcagggagacgcccatttcgacgatgacgagttgtggtccctgggcaagggcgtcggtkagattctgagtcctcctggcccctgattcccttcattctctcccactcatcacccgccgccctaactccggtcccccctcctcctgcagtggttccaactcggtttggaaacgcagatggcgcggcctgccacttccccttcatcttcgagggccrctcctactctgcctgcaccaccgacggtcgctccgacggcttgccctggtgcagtaccacggccaactacgacaccgacgaccggtttggcttctgccccagcgagagtgagtgagggggctcgccgagggctggggrcgcccaccacccytgatggtcctgggttctaattccagctctgccactagtgctgtgtggcctgcaattcaccctcccgcactctgggcccaattttctcatctgagaaatgatgagagatgggatgaactgcagaccatccatgggtcaaagaacaggacacacttgggggttataatgtgctgtctccgccttctccccctttcccacatcctcctcgccccaggactctacacccrggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgaggtacytccaccctgtctaccaggttcagccccgccctctcatcatgtattggcccccaaaacgcggctcttccctcccatcagtttgtctttccactctcattggtcctcaggacgaccgtgactccgcccacctacaccacatttccaccactatccctgacttccaatggccccgccccagccactraggttcggccttttctgcccagctggccgcctcttccttggtctggtgtcccaggcaccgcccacgggtctagcctcttctcaggagtgctctacagcgccccctaggccaccaagwttgtttagctccctgtcgggtcggcccctgactccttattggactcatccatctggctcatccaaggccttgggtctctccagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggtaggcrtggtcccgcggctccggggctggggttcccggcagtggtggtggtggggtggccagggctgggggctcggcccggcgctcacgtctcaggctccctctccctccaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtgaggcaggggcagggatgggaggaggaggggaaagggcgtggctgtgccacagtaccaaagaattgggggttggggatcgggggaggaacggggcgtgcaggagaggtgggacctcaacgtctgtctggaagcagagcctgggcccagtcgctgccatgtcagtgcttagaggtggtgataaagagactctagagagagataggtgtgacttcaaaagccagtctactctgggcatggtggctcacgcctctaatcccagggctttgggagacccaaggcgggaggattgcttaagcccaggagttccagaccagcctcggcaacatagccagactcccatctctacaaaaaataaatgagcaaggcgtgaaggcacatgtctgtagtcctagctactctggaggctgaggtgggaggatctcttgagcccaggagttcgaggctgtagtgagctatgattgcaccactgcattccatcctgggccatagaggatgtcgcttaaaacraaaaagaagaagaagaaagtcctgtggtttgggaagggaggctgagtgaggaggggcctgtgtgccagaggaggcttcactgagaagcttaggggagcagatgttctaggggtacagaggtatgcaggaataggaagagtctcaccccgtgtctctttttaggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggtgaggaggcggggttgtgtggatgcgggagggggctttgcggaggggctgcccgtcccttcccgcccactggccctgtgtccaaggcttagagcccgtcctttccctcctcgctttctcaggaagtactggcgattctctgagggcagggggagccggccgcagggccccttccttatcgccgacaagtggcccgcgctgccccgcaagctggactcggtctttgaggagcsgctctccaagaagcttttcttcttctctggttagttacctactttccctcccccgcccggtcaatccccatcagtcaaggaggctcaagagaccatcgataacycacgaaacgtcttgtgcgtttyagaaaaatacgccccctggcggacgcagtttagcaaacgtaggggcggctgagtttctgccccctcctctccacgccctcgcgtcgctctacccagcgcctctgcccctgggttgcagggactgcgggcacgcgggctaggaaaggcctcgccggaatctccctcctcgcgttctaggagtacgtgctccctctgcgcccccaaaccgacgtgaccctcctcccctgcagggcgccaggtgtgggtgtacacaggcgcgtcggtgctgggcccgaggcgtctggacaagctgggcctgggmgccgacgtggcccaggtgaccggggccctccggagtggcagggggaagatgctgctgttcagcgggcggcgcctctggaggtgagcgccgccgcggccgccggcagggggagcccgggcgccgtcggtccgtccgctagccggctcagcacctgtctcctccgcgcctgcccgcaggttcgacgtgaaggcgcagatggtggatccccggagcgccagcgaggtggaccggatgttccccggggtgcctttggacacgcacgacgtcttccagtaccraggtgagggctgaggaggatcccttcgtgagacaccacactaagctcctcttagtgagtggtcaaattctgagcgaggaagaaaaagcccttggaaatggaaacaaatgccccagcacagacaagatcccagcagaggcagaggccttctccaggtcatttaggaagtcagggatgcaaccaagaccaggacccagatttcctgcctccccggctggaagctctttctccttcagtacaggacggcaggtggtttgtatggaagctcagttattagacaacagtcatcaagtgccgataatgtgccaggcactgtgctacagggagagataagacaattcacagctctgtgactttgggcaagtcactgcttctctactcttcgagcctcagtttccccatctgtaatatggggactatagctggaattacacttgacttccctttcttaccagtcacatccaaacagttgacaaggtgaacaagatttcctgccaccaaaatctttttcgagtctgtcattttttttgccatcttctttataaacaccccagcccaaaccatactggctgtccaggacctttaacaaattccatgagattagagagggggtaggagtgaagggcaatggtcttgggagtgaccccagatgaattccarggtcaaagaaattaagaggatctgacactccacccccgtgttctcatctcttcccactcctcctgttatttactctgctccacccacactggctgctctttgaacagatcaaggtcattcctagcttacagcctttgtgccagttgttccctctgtctggaaagcttcccctccagattgtcactgggccatcccactgtcttccttcaggtttcagtgctaaggccattgcttcaatgaggccttctttgatgcttattatctatttacttgtttttattttctccatagctttctatattttctttttttttcttttttctttttttttttttttgagatggagtcttgctctgtcgcccaggctggagtgcagtggcacgatctcagctcactgcaacctccgcctcccgggttcaagcgattctcctgcctcagcctcccaagtagctgggattacaggtgcctgccaccacgcttggctaattttttgtattttttagtagagacggggtttcaccatcttggccaggctggtcttgaactcctgacctcgtgatccacccgcctcagcctcccaaagtgctgggattacaggcatgagccaccgcacccagccgctttctatattttcaaaaccaatctcatttatttatgtgtttgcttaattgtctcttgcctcactagagtgtaagcaccaagataattgagatcatgcctgcattttttctgcttatccccagtatcttgaacaaagcacatagtagatgctcagtaaatgatgaatgaacagatttgttcaatgaatgagcgttgaatgaattgttctgagcattaagatagttggtctattcatttgttaattcattcacaaaatgtgtatggtgtacctactgtgtgctaggctctgtggcagtgctttgggcactgaggtctgtgccctccagcatctcacagaacctcacagcatctcacaggttggggggatggaggtgatakgtgaaaaccttagaaagttctagaaatggcagaagagatggttgtcaagatcttgttcctatttctgtatatgtgggagaattagaatcactcctcttatgcctgcctgtctcctgcagagaaagcctatttctgycaggaccgcttctactggcgcgtgagttcccggagtgagttgaaccaggtggaccaagtrggctacgtgacctatgacatcctgcagtgccctgaggactagggytcccgtcctgctttggcagtgccatgtaaatccccmctgggaccaaccctggrgaaggagccagtttgccggatacaaactggtattctgttytggaggaaagggaggagtggaggtgggctgggccctctcttctcaccttygttttttgttggagtgtttctaataaacttggattctctaacctttagaagcagactttatttatatatgtatgcacgtatgtatgcatgtatgtatttaactgatagagtgcaaaaaaaaaaaaaaaaaggaaaaacaaataactgatagagtgctttctacgtgccagaaagtgttctaggccgggcacggtagctcactcctagcactttgggaggccgaggcaggcggatcacgaggtcaggagattgagaccaccctggctaacacgatgaaaccctgtctctactaaaaaaaaaatagaaaaaattagccgggcgtggtggcgggcgcctgtagtcccagctacttgggaggctgaggcaggagaatggcttgaacctgggaggtggagcttgcagtgagccgagatcacgccactgcactccagcctgggaggtggagcttgcagtgagccgagatcacgccactgcactccagcctgggtgactgagcaagactccgtctcaaaaaaaaaaaaaaatagtgttctaggcactttgtaaatgttaacatattcaatcattcctgttaggaaagtatgatgtgattatttctattttacagtcaaggaaatgatcaacctgtttattcattcatcaaacatttattgagcccctacatggagccaggccctgtactgggcaatggggatagagaaatgagttagactttagaatgcataagattccccttggaacttgcttaaaatgcaactccaggctccacctccagagagtctgacctatttacaagggtgattctatggctggtggcggtgggatcacacttggggagtgtgcagtgcatgatcttttattctacaataatggtgtgtgtgtgtgcacatgtgtgtgtgtctgtgttgtggttgaggtccaggaacgtttctcagtcaagatgacatctgaaccggaactgaatcagaaaggatgaacgagcttcttcctgtgcaagggacaatcttcttacagggtaatttaccaagaaccactaaacctaaaaatgtaactactttctgaccctcacatgtgtgcacaagacaacacatagaaggatgttgattgcagcattgtttgttagtgaaaaactggcaataacctagctgcccaggagtaagtcagtggataaataaaatatggatcatatacctgacgttagtagctatccacggtacagcactatgtgccaggcactgttctatgtgcattttgtgtgacaaaacaaccagaggagataggtactcctattactttgtatgtactattattactgccatcaccaatcccttgttttacagataaggaaactaaggcacagagagttatacaactcacccaaagtctcatagctagtgagtgataagagtgggatttgaatgtgggttcttggtgcaagtgcacgaagagaaaaagaagagaaaaagcagtgggtgtctggagaacttcaaatggctcagaactccagcatggggtagtagcaggtggctaagagggaatggagaggattccagaatggttaagatagcagtgctagtttgggctagatgagagaagtcctgaatgccaagctgaatatgaatttgaccttacaggttagcaaagggacttgactgaaagattggggcccgtgagtggagatgatgggtttgatcagggcccacgtgggaatttaagtaggagtccagaaaactgccctcctgagcttcctctttcatctgtttcttgctcaaatgacccactcccacttggcgtacaaacattccccgccatggcttgtttacaatctgtcttaacccctgcctcccactagatactagtctatttctctaccttcctatccctattcacaataaaacttcccaaaagcatggtctctactcactgtctccacttcctcaattcccattctctcctcagccatttccagcctggctcccaccccactacaccaccaaagtcaccctcttcaaagccatttatgaccttcttgtagccagatgtgacaggagctcctctctgctcatcccacaccaactctccccacattgacacagtggatcctgcccttcttcctgaaactctcggcctctggaaccttacttctgggtctcctcctacctcactgggtggattttcctcttctggtgacagaggcacccttgtgctcaatcgtgggaatcctctgctctgtgtatactcattccctgtgatgtctggtagcccacagccttaaatagcatctctctgctaaagaccgtgaaatttatgtttcctaccataacctcctctcccctgccccgagctccagactcatgttcaactgcctactctacatggctccttagctggcaaacagacctctcaacctaacgggtccaaactgactcctgggtttcaccttccaaacgtgctcctctgttgttaccactttaataagagacagcatcatccaccctcaatcaaactgaacacctaatcagtcctaaaatctaggaatcagttatttaaacttcttttctagtactgggtttctcagcctctacactattgacattttgggctggatactttgttgtgggggattgtcttacactgtacatctacactgtaccttctagcatgtttggtgtcttcctctaggaggtgacaggatccacggccagatgccaggcccattcagggtcagccctctctgctaaggaaggccccagtgtggggatggggtgcagcagggtaatgttgaactgtgactcatggccaggcagccctggtacaaacctagagggcccaagaggcctttagcccctagatgctggtactagcccctgctccagttgtgataaccaaaaatgtctctgaatattgccaaacattccctggtggtcaacattgctcccagttgagaaccattgccataatataataaatatacaaatgtatctatcataagtgtacatttgaagacattttcacaaatggaacacaagtgtgtaaccagcaccaggtcaagaaacaagaggctgggcatggtggctcatgcctataatcccagcactttggaaggccaaggcaggtggatcatctgagatcaggagttcaaaaccagcctggccaacatggtgaataactctctccactaaaaatacaaaaattagctgggcacggtcgtgggtaccttgtaatcccagctacttgggaggctgaggtaggagaatttcttgaactgggaggtggaggttgcagtgagccaagatcatgacactgtactctggcctgggcgacagagtgagattctgtctcaagagacaaaaaaaaaaaaaaaaaaaaagaaagaaacaaaacattatcagcaccctagaagcctgcttgcaatcactacctcttctccccaaggggtaccactatcattacttttttttttttctgtcacccaggctggagtgcagtcgcatgatctctgctcactgcaacctccgcctcccaggttcaagcaattctctgcctcagtctcccaaatacctaggattacaggcacccaccactacacatggttaatttttgtatttttagtagagatggggtttcaccatcttggccaggctggtcttgaactcgtgacctcatgatccaccagccttggcctcccaaagtgctgggattacaggtgtgagccaccgcgcccagtgccactatcattacttctaacagcttagatagactttgactattttttactgtatttaaatagtgttatagggtatgtattcttttgtgtctggactcttttttatcaaggttctatttgtgagattcatccatattgttctgagaattgtagatggtattccattgtgtgaaggtactacgacttatttctctattttactgttgacaagcatttggtagattccaatttggggctattatgaacaatgcccctatgaacattcatggtaaatgtcttttggtgatcacaagtagtcatttctttcgggtatatacctaggagaaaaactgctgggttgaaggatatgtgtacgttcaccttcagtagatgtttccaaatagtttcccaaagtagtttttgcctaactacactcccaccagcagtgtgtgaattgccaggatttctccttgacttcactcttatggtcacgtgtcacatccgatccatcagtgggtcctgatggtttcactttcaaaacctaactggaatcagacaactgccaccactctagtctggctgtcatcaccccccagcttggggtctgcaggagcctcctaattagatttccagcttctactcttgccattctttagttgaaccttcgcccagcagccagaatgatcctgttaaattataaattggatcacatcattcccctgctcaaaaaatccaggatcctccccaaagccttcagaagaccacatgatctgcccttctctcctccctcatctccagtcactctcttctccactcactctcttccagacacaatggccttgctgtttcttggacagtcgggactccttctcactccaaggctctgcatttgctgtttcttcttctagagaactcttccccctagatctttgcatagctggcccttctcatcagtgaggtctcagctcaaataccacatcttctaggaggccttctcaggccacccctaaagtagtcctccctcttacccattatcccatggccctagttttaaacatacatccaatctcaaatgatctcatctatgcatttgctcacttataatctttttctccttattagaatttaagccacttgagggcaagaagccagtggatctcatccaccgacgtatccctcgcaccattgaccgaaacacaggagcgctatcgacatgtgccgaatgaatgaatgaatgaatgaatgagccccaggtgtttaggagaccctaacagaggtgcccccgttgtagggacgactctcacctgcagatggcctcctcaggcccttcgggtggcactggggagcccagggcctcccagcgaagtggccagattcaggaacccttcgcacagcgggcactaggaccctgcgcggcgccgcgtctcgcggggggcgggcgggcggagggggttgggggatccgctctttctccctcctagagcctggttgcagccacttgtgcgatcccggaccttgccgcggccgcctggctcctttccgcgccatgagccgcaggttcacggtcacctcgctgccccccgcagggcccgccagaagccctgacccagagtcccgccggcattcggtcgcagacccccgccacctcccgggggaagacgtcaaaggtagaggccgcagggggcggggcctgccagggccgggcgggacgagggggaggggccggggcggaccgtctgttgaagggggcagggccaagaccgggggcggggaggggtcccagccctaggcctgagaggggaatggagccaggactaggaaaccaaggggccggggccgcggaacgcaaagtgtggagggggaggggccaaacgcgaggtgggcgtggccacgagggaaaggggtggggccagggaaggggtttggacggaggcgaagggggcgggtctggtgatggaaaggccggggtcaaggtggagagtaggccgtagggcactaaaggggcggggacatctcgagtagggagcgggaccagagtgaggaggtggaactagggaaaaagggggctgtgtgttgaagggggatggtcaggagcccctaaaggggaggcggcgggactaggttggtttggggtcaggaaagggcgggactagtagggaatgagttgggccaggaggatgggagtggggcctgggaggggggtggggtcgagggcgggaggaaaactgagtcagggttgccgaggcaggtgccaggtcagcgggtcctcggtgcctggcggatcctccaatcctctagctccctggaggcttagcggacagcgactggggatcccgggaa

SEQ ID NO: 17788 - DNA, 166472 bp, Homo sapiens
caacatggtgaaaccctgtctctacttaaaaaaaaatagaaaaattagccgggcatgctaattacgtgcctgtaatctcagctactctggagcctgaggcaggagaattccttgaagccggaaggcagaggttgcagtgggccgagatcgcgccactgcactccagcctgggtggcagagcgagactctgtctcaaaacaacaacaaaaaaaccactcagtaactctcaaactgatagcttcaaacagctcacagttaaggaagctatgctgaatggtttggtggccactgaggtgtggatgtgattttatatccaagagcacaaaggcaaacatggcatcactggctataatgtttgaagaccagtcttaaacatctgattctctttcatttattttttgagtattcttggactatgtgtgatcagactgctttgtgtcaaaaaaaaaaaaagagtggtgaaagacaaagctggcaaggaaaacaatgactagatcatgaggtcttgttttttttgttttttttttgagatggagatggagtttcactcttgttgcccaggctggagtgcaatggcgcaatcttggctcaccgcaacctctgcctcctgggttcaagcgattctcctgcctcagcctcccgagtagctgggattacaggcatgtgccaccatgcccggttaattctgtatttttagcagagatggggtttctccactttggtcaggctggtctcgagctcccgacctcaggtgatccacctgcctcagcctcccaaagtgctgggattacaggtgtaagccactgcgcccgactgaaggtcttgtattttatcttgcagataaaaggatctatattttcaaaagactggcaggtggggaagcggtgggcaggaggtcaggcagtgggtatgtgagacaggaagaccaaggcttgggcagtggcagtaaaggtaggtagagggacttcatacaatggagaataaaggtgacttgataatctatctactgggatgggagtttaggtaattgagtggatggtgttgccattaacctaaatagggaatttaggaggaagagaaggtttgggtaggttgatgtaggggtttttcagtttgggacatgttacggagtatggctgtgtaatttcaggtaggagatgactagtaagagttggatatgtaataataacaacatctaaaatattttataatagtaattgtatgctatgcactgttcttagtgctttacatctgttaaattatttgactcctatagcaacgctctgaagtagataccactattttccccattgtaaagattaggaaactgtgcaacaggtgccttaacttacctaaggtcaggtggctaggaagttgtgcaactaggatatgggtcttgggtttgggggcataggaaatgttccaagaaaaagtgattggaatactgttccaggaaatgtgctgacaatgtgataggcattgtcaagacagacccaggctttgttttcacggagtttatagcctaatgagttgcatacatttgggggtagtaaaatatcatgcaagtgaaaatgagaagataagaaagccaagggtaaaatcttgaagatcactaattgtgcagtaaagagaagaaaaagtcacaggaaaaagatgtagaggaaagtacaattaaagtaaagaagaaagtccagagtgagtgaaggtttggaaactgttagaagagggagttttgaggagagagtgttgtctgaaaggtccagtaagataaggagtgaagatgtctagtggaattgatcactaacacatctttgatgtctttgatggccctagcaagagtagcttcttacaaagctaggtgggaacaaattgcggtggattaacaagcagtttaaaagcaggaccaaaaggaagagagactggagtaagggatataagttaggtgttctgcagcaatctaagctagataaaatactataattaaagtaaagcagtggtccaaacttgtaacactggaatactttcagagtgctagccaatcagagcaacagcagtgagaaggggagcattaaaggcacaaagacatttttagggaataatcaatatgacttggtgacaaaagaataatctaaaatgattcccccccttttttttttaaatagagatgggatctcactatgttgttgaggctagtctcaaattcctgggctcgagtgatcctccagccttggccttccaaattgctaggatttcaggcgtgagctgcagtgcccaggctaaaatgattccaggtttctgggatagtggtagtgccagtatcagagataagaagttaaatatattgagtttggcatgacagtgggacatccagcaggcagtttagtagaatttggaaattcacaatgtaatcgttgaaatgtttaccagcattggccttcggtctgtgcaacaagcattctcctctagtattacttgtctattacactgtataatatatgagcatttgcttaaaagctgaatttcccattactaaaacttgaggataacttttattatactggtaatatcaaaactgtattgttcctgaggaaataatgctattaaaataattacggctttcaagtggatgtttgagtgttcatgcagtgaccataatagttacattttttttacttaatagttacatagcaattattatattccaggtctattaactaatattagaagataattagttaaaattattagttaaattagttaaaagtaactaataacagatattaactaatttaaatgtaatcatcaaaacaatctgctgaggcaaatattttttcattgtcattttacaaaagaaatattgaggccaggtgcagtggctcacacctgtaatcctggcactttgagggggccaaggtgggcagatcacttgagcccaggagtctgaaaccagcctgagcaacatggtgaaaccccatctctacaaaaaatacaacaaattagcccggcgtggggcccccccatctgcagtcccagctacctgggaggctgaggggaaggatcacctcagccctggaggctgaggctacagtgagctgtggttgcaccactgcaccccagcctgggtgacaaagtgagttcctgtctaaaaaaaaaaaaaagaaaagaaaagaaaagaaatattgaggttagaaggcaaaaaaacttggcaaaagtcacacggtttatagatggcagagctaggagtgaaacccaggcagtctgtgatagtgtagatgcagaccttatactttaatatttcatcagttttccatacatttgcaaaatatcaataatgaattaagttaaaatagtagcccaaacttgtaacactggaataccattcattatcatgctggtatgtaatgccattcgtgcatgctggtatgtaatgccattcgtgcttgacaaataaaaaaaatacagtttttctttttttttgagacaaggtctgtctgtgttactcaggctggagtgcagtggtgtgatcacagctcaatgcaacctcaacctccagggttcaaacagtcctcccatctcggcctcccgagtacctgggactacaagtgcataccactgcactggctatttgatttttatttttaatyaattaattaattaatttttttgagacagagtcttgccctgtctcccaggctggagtgcagtggcgccatctcgactcactgcaacctccgcctcctaggttcaagtgattctcctgccttagcctcctgagtagctgggattacttgcttcagcctccagaatagctgggattacaggcacaggccaccacgcccggcttttttttttttcctagctctgtcgctcaggctggagtgcagtggcgcgacctcggctcactgcaagctctgcgtcccgggttcacgccattctcctgcctcagcctcccgagtagctgggactacaggcgcccgccatcacgcctggctaatttttgtatttttagcagagacggagtttcaccatgtcggccaggctggtctcaaactcctgacctcaagtgatctgcggaccttggcctcccaaagtgctgggattacagctgtgagccccgtggctggccaaaataaatacattttaaaaattaaaaaaaaaaaatacagtctttataaatgtaattttcagtaatcatcttagtaatgcaaaatatggctttggagttttttccagttgaattttaagggaaagtgccatttgcctctaatcactggaattcattataaaaatactgtgcaacagaaaacatgctataaggtggtttaagagctggaaaataaaaatatcatttgttgacagcactaccacaagagattagtaaaaagcacaggtgatatgagatgtaatgtctgcaggtaactatttcctaagactgaatattttaatgaaggaaaaaaaaaccattcgtgagattctgccatcctttgatgattccatgtatctcattataaatggatacaattatgatggttttgaaacgtccgtttttgagcctattaatgttgcagcaaaactagaatcattcatttctcaaactgagaattaaagaagactcttatggccaggctcggtggctcccacctgtaatcccagcactttgggaggctggcgggcggatcacctgaggttgggagttcgagaccagcctaaccaacatggtgagaccccgtctctattaaaaatacaaaaaatttgctgggcgtggtggtgcatgcctgtaatctcagcaacttgggaggctgaggcaggagaatcgcttgaacctgggaggcagaggttgcggtgagtcgagatcacaccattgcaccccagcctgggcaacgagagcgaaactccgtctcaaaaaaaaaaaaattctcttcacttatgttaatggtaataaatggtataaaatatacaggtaacagtataggaattccagtttattacagtatcaataacattaaggccgagcgcagtggctcacgcctgtaatcccagcacttgtgggaggccgaggcgggaggatcgcttgagttggaggttacagtgagctatgatcacaccactgcacttcagcctggcgagacagcggataccttgtctttagaaagcaaaacaaaacaatttacacacacacacacacacacacactctccctaattcggcttgagttggaggttacagtgagctatgatcacaccactgcacttcagcctggcgagacagcggagaccttgtctttagaaagcaaaacaaaacaatttacacatacacacacacacacacgcacacacacactctccctaattcggcctactcaagcacgataccaaatagatgaagaatatctaattaaatggccataaaaagttctagttcatgacatccaagtttaaagaatcaaaatgagttacgagaaaacaaacacaagctttaagaagttggggagaagatgtgcgtggattcgcttcaaagatgtgacagagagaaaagaggacattttctggactggagattcaagacagtctggttcaggttgcatgcttttgcaaaggctaaagccttagtctgtgacataaatttgtaaagagctcggaaaattacatctcggacatggtgtctttttttcctgctgcttgaaggtctttgcatttatgttcgcatcactggggcagctgccgctataattactgcttgttgggactttttgtttacttggtagctgtggtgcaccaagagaggcagaaaaagaagaaaaaaaacctctgttacttgtgactttaagaagtcgaaagcagccctgcttacatcttccacggaccattttagcccaagggaaggtcctcagcagctctaacacgtagcggagcactatctccgcgtaggagcgctcccgccccggggcgggaccaggacaaaccccgcctcccaagcccaatcccagctctccgccggcggacaggaagcggcggcaggcctagcagcacgggaaccgtcccmcgcgcgcatgcgcgcgcccctgaagcgcctgggggacgggtaggggcgggaggtaggggcgcggctccgcgtgccagttgggtgcccgcgcgtcacgtggtgaggaaggaggcggaggtctgagtttcgaaggagggggggagagaagagggaacgagcaagggaaggaaagcggggaaaggaggaaggaaacgaacgagggggagggaggtccctgttttggaggagctaggagcgttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggaggtgaggcacgactgcgagcgccgggggcgccgcgaccacggcggagcggcggccgggccgagcggagcccagtcgcgcctcgcggcgtgcgcgtcagtcagcccagccggccagcggcgccactctggcgggccgcgctccccgctccctattgtcccccgcgccccgaccgctttcccttcggtggcgggccgaggaggctcccaagcctccggcgaggccttccccgccccccaccgccctggcggccccgggaggcgggggtcgcctcccagagaagcgaagtcggggcatccgcgtcgcctggtgagagcggtggaacccaggctggtggctgcatccctccagtctgctcggcgggcgccggtgcaggcagccgcagcgaggctggcggtctcgccgtcctcgttcagcgctcatcctgctcaccattcctcccccagcccctgcccggtggcggattcygaagtcctctccgccgccgagacccgccgcgcagactcgtgggaagttgtgttgtttgcagctgggctcgtgtattgttctttacccggcgcgccggtcctgaccgaccccattctgcagaggggccgcccgtggagtggcagcagtcatcacccgcttatctgagactagtggcctcggttcttcctgtgtcctgtgtttggagagagatcacaggagggtgtgttggtgttcttgaaaacattctgtcgcccaggggaaagggtttggtcgggagaagggtaaaccatttggggatgttctttgatttgtaggctggattgggtctcttagagtagaagttcggtccctgggtgacccaacttgaagagtttcgttaaactttcaggtggagtagatgtacagtgtagttagtggattgtcaaaacagtgccccctcccccctgcacatgaaagtcaaatttgctaaaagcatgtcatttcttgtttcgggttttgaagacaacgatttttatttccggtgtgttctaggaccagctgcatcattttattcttgcttaaagtgctttattttaggtaagctttttgacttgccccagagtaaacttaaaaacctcaaggtgtgcctaaaagcaacgattgaaaaaatttgaggaatgctttggatgagtgtctgtagcctttgataatttagaaaatatctatttcatgtaatgtattgtttctgtttttttctttgccactttgacttatgactgcaggaccaagtgtatttctgtcctgtattctaccgagtccgagggtggtactgcgtaggcagacttctgttatagtttgtagtgttcatttttttgttacacgttttatttaatttttttcaatccaattcatcaagcaagacacacattatagattaagagctgataatagatgtttagttttaaaaaggattatgtgcgggagactctctgttagaggagcctttttcatctgacatttgttatttctgttctaaacgtggctttcaacaaatcgttttcctatcttttttcactttttgtgattaaattcaggagttaagacactgttctctataaggtaataaaaagtaagacaaacacatgaggcactttactgagtagtagtatactaaatgttcttttaaaaataatgaaaacagtaagaaactgatgtagtcttatatttgaagaaaaaacaattgaataacatgtttgtgggttaaaactcttatacaaaaattttctaaattcatatttccagagtcctttattgcattaagcattggttaaaaggctaatttttggtgtttttgttaagcagaactttttcaaaaaacataagacaagttttattagttttattttaaaattagtatcaagattctagcttttgggtacttggagatacttgtaattttattgtaactatggggtatttttatctactaatctgagctatttttggtcacttgtaagatctttgtatgatgatttgtagacttcagcacattgagattgaatgtatttgttttagcatatgagagaaaggagaaatttgtgtagattagaagttgtggtggaaatttaacttaaaatgtaaatcattttcaggtagttaataaatcctttttgttgcttccacctccccaatttgtcagtcactgttgtgtgtgaaatttttcttgctctgtatattactaggatgggaagctggaaggaataattaaagtgtttagaatcataaaacaaactttcctaatggtgtccatttccagcacagccccatcctatgttgtagttgtaggagcaaaccatgtttttttattttatttttaaaatttaactggtgtgtttgagagcacaaaaggcatttcagctgtagcagtaaattccataatgttttggtttgatgaaatcatgcccgaaatgaacttcagagtatgatatgtctcttacatttaaaaatctgatgtaagtgcttagctttgtacattactgctcaatagaaataagttttctggaaacttgaccagagctttaaaggtagtagagcttaagcagttaaactttctctgactctgagtcggaatctaccagcaaataagaatttaatgaaagagacagactaattttgtctttatccttaaggatctctgactcttcatctttttaaaacttcagtttgagtccagttaactccatcatcttttttaaaaaatgttttattttgtttatttattttaaaaagtagtgatggggtcttaatacgttgcccaggctggtctcaaactcctcgtccctagcgacccacctaccttggcttcccaaagtgctgggattgcaggcatgagccaccctgactggccaattccttgtcttaagacatttttcttaacaagaaaaatttacatattacatattactaggatgggaagccagaaggaagaattaaagtgtttagaatcataaaatgtaaactttcctgatggtgcccatttccggcacagtcccatcctatgttgtagttgtaggaaggtaccattgcctacattaatggtattttctgtgtgtatgtgtacagcctctcccagcaggcatggcaggcacttctctgatgtgcttttagtaacttgtttaagatcttcaaggatgtgtattatctgatctctttaaaatttttctaaggaccttaagggttgtagggcttggggcaaatggaacatttccatgatgccttttgtgtgtctaatactgtgttaggagtttcacttttcaacagttatgagagaggggtgataggcagttgaagaaacagacttggaaatataatttttctagcatcatccaccacttagtggtgaattggacattcgaactcaagctggtttgaccttaaaccctaataagctttttatccattgccccttcatgccttttttgaaagcggctttcatacattagctcaaaggtggcctctggactaaactaccttagagatatgttttattcacagtgtctttaagtttgagctaatgattaacattgaaaaattgggatatttctcagtgaaattcatggatttctggattttcggggaagacttggaaatccagatactagtgggctgtattcctattgtgcagagctgagcagtagggcagtagccaccctctttaaactgggtatgtgcttaccggttactgcagtccccatcattcctaatgatacacctggcctttttcactcatttttgttacctgcttgggtactgtgggtatgttgttcccatctctgccttagctttatcttgtatagatggctccaacttttaaaaaatgtttgactgtgaccccttatccaacttttaatatttttttgcaatgttttctctgtagtcttaaagatttgtttaaaaagaacatggtatacacaatactttttattcagcattaggttattagatgttttttaaaaaaacccgttttcataatagtagcagcttgaaggtctttaatatagaatgatcgttacagtctctccacatttctttatctaaatgggtaagtaagaaaccatttctttttctactgggatgagaaccacagaaaaaattagttgagggtcatattaataaaaaccaatttaagaataggatacaaacataaactctgcttttgaaattaaggtgatgaaatggaggaacaataacttcagcaattagctacattttcctaacattgttggcagatcagtggttcagatatgagatgatgtccatataacaaactctgggaatacacttttatttttttgagatggaatctcgctctgtcacccaggctggagtgcagtggcacgatcttggctcactgcaacctccgtctgccaggttcaagcgattcttctgcctcagcctccagagtagctaggactacaggtgcgcaccaccacgcctggctaatttttgtatttttactagagacggggtttcaccatattggccagactggtctcgaactcctgacttcaggtgatctgcccgccttggcctcccaaagtgctgggattacatgcatgagccactgcgccccgctgggaatacaattgtaaattttttgtgtttttgttgttgttgttgttggtcttggttagagatgaggtctcactaggttgcccaagctggtcttgaactcttggctttaagcaattctccaaccctggcctcccaaagtgctgggattacaggtgtaagccactgtgcctggccagttttgggtgtttttgatggaagtttttctaaaatgtggaaaatttactgtagacacatttactatctccttaaaatggactgaatttaaccttacatgattgaagtttaatatggagaacagttgttattctgggttctattgtagtttctgtttttaatttttccagaaatgactgaaatggcctggtagtttattatttttctaaatttattctagatgattgtggattttattcttggatctagttgtagcaatatttccaactttttggttaggtttctttgctttcttgtaaactttgaagatgttaccttctaattggttgtttctagtatgttttatgtaggaaaactaaataattatatttgagaaacatgcttgcatgtgaaatgaaataaataaattctaaatcttctgtggaatgaagtacatgggctttaggtagttttttctttctccctgccccccacccctacccctcacctttcaatatgtatagcttggctttgtagagtttagcattgaggttgcctggatcgtaactttctaaacagttggaatgatgtggtactaatgtgttttgctagttacagttagacagggaagaatggagagaaaaaactgatgaataaccaggcaggtacagcaaataaaatgtattctcattaggttgcagatagatcgtgtcctagagctaaatcatgagtactctggttttatactaatatactagattattggtattaaacatactstaaaatgtccaactgtaatattttctacaggaatagaaattgtgaattaagaaaaagtgttggccagacacagtggcttacgcctgtaatcccggcactttgggaggctgaggcaggcggatcacctgaaaggtcaggagttcgagacaagcctgcccaacatggcgaaaccccctctctactaaaaatacaaaaaattagcttggtgtggtggcaggcgcctgtaatcccagctactcaggaagctgaggcaggagaatcgcttgaacccgggaggtggaggttgcagtgagctgagatcgcaccactgcactctagcctgggcgacaagagtgaaactccgtctcaaaaaaaaaaaaaagtattttgtttaaaggaaagtcagtgaaaggtagatgacaggggcttatggtactgtgctggtttctagtaagtagctgtgttacagcaactgtgttaccattttggtgatttttacatttgtataaagttaaatttcttgtctgtctttaattgtattacattataatggttagaaaaaaatttgctaaagttggggcattgttttggaagggtctagcttaaaatatggtctatgtggagtaccagaaatgtagtttgtgtggagaaggttgtgggcaagggcagtcattggccactgctgccaacacaaagtttcagtgagaggcctatgtgagataaattgtggataggaaaggctgcagacagaaaaacacatagtgatttcaaatctgaacccccgccccccgccaccgaagcccaaaatcacaggggcaggccttccaaattgtaggaatgatttgcatttcatttggtttttacacgggcagctctatgtgacatgctggggtaaagaggcccaggtttttgttgttgttttgtttgtttttgagacaaggtctctttctgttgcccaggttgaagtacagtggtgtgatgtcagctcactgcagccttgacctctgcagctcaagcaattctccaacctcagcctctccatagctgggaccacaggcacacgccaccatgcctggttaattttttgatttttttgtagagatgaggtctcactatgttgcccaggctgtgttgttgttttctaaaggagtaattgatttaattaatgatcgttaatgctcttccaagcaaccctaaaaactctgcttgttctgaacaaaaatctagcagtggtaattctaagtagtctagctgttgatttttatattaggaaaaaggaagcaatgttaaggacaagtggaaaaactataataaccctaccacttggattcctgtaagggcagtgacgttgctgtccagcaatgtgaagattttgcgttagtattaggatagcctgacccagctagtttgcaggaaatagcggtgctgagaatatttctcagggaatgtagtctccctttgatgctgagtgaattcattttgaagctactacagatgctccttgactcatcataagttgaaaatatcgtaagtcgaaaatgtatgtaatgttggcaacagagatgatggttcartgtatgatttttcaactttgtgatggtgagaaagtgatacacgtgcagtagaaactgtaaccccatttaagttttaaggagctctcctccacttaatgtggggttatgtcacaacccatcataagattgaaaaatacgaatcatagtaagttggttaacatacatacagtccacttgtactactgcaagtaaacaatgtgagatgtatacagtgagaacattgctgtttagtcaccaggatttattatgtgtctatgactgttaggagtcgtgaagccacagtattaagtgagaagaaaagtaaaaaatactgagtttgttggagtaaatgaaatgccaaaatataaaaatatacttccaattatatattgtagttgcacctgaaatgaggatttgttaagcttgagggacatcagcaagcggggaaggctttctgaggtggaagagaatgacacataagatgcttgtaggtttacttgcctggaatcgatagtctgtgtcaggaaataaggagaattgctaactgggccatgataatcaggactgattattctaggccatgataactatgagatagaatattatggactgttgggtggagtccctgttgaggagttaggttatgattgacaaattgggtgattgagtcttggattagaatgatcgtagaaataagtaaggatagaacaagaaatgacatggaagaaaaactgataaaactgggcaaatgtttaacgtgaaagtaacaaaacttatagagggctcactctgttgaatttaaatattaggctgtttcattggagtgagtgtggttttataaaactttgaagacctcagtcgttgaagttgaaaatgtcttaagattttgagtctggatagaagcttataggttgggatgggtgtcagcgtctgggattttattttatttgcatgctaatacttgggaactggataaaactttgcatagatctttaatctctggctagttatttgggaagcagtgctttaggtagctggattatagaagtttagtgaatttggagtggagatagagattagtttaaagatatactaacacttttttttcttacttaagttggaattaggctattcagttcaaaaatatgattgacactcttgatttcatgtgaactatgaacttctgtttccaagacaaataggggaaaataatgcgatctttgcattttaggcaaatttgcatatgtgatttgtggagcagaatttgcttaccatctgtttttgcttgtattgatgatggcaggacacacgtgtgcatacatttgaactttgaatttagctttcaaaagaacacatagaattctctatgatttgatggggtattaatttactaccccttttcctaggaattaagtgggataatttgtaaaagtgctaaagactttaaagtactatataaatattattaaaattatgtcgtttccagacctgctttcatttggaatctattagttacaaaatacagatggataaaatctatttttagtagttggaatattagaacatcattaccaaacattagaaaatagaattaaagaaaatccgtaattcctccttcaacacaattttatcactttttaatattaatcatgtagtcttttaaaatgcctattacgaatttatagtatttgtgtagttctgtatacctttaaaaaactaatgtatagttaatggctgggtgtggtggctcatgtctgtgatcccagcactttgggaagctaagctcggaggattagtttaggccaggagtctgagaccagcctggttaacatagcaagaccctgtttctatgccaaaaataaataaataaatacaagaaaaatgtaaagtgtagttaaaacgcataagtatgcaaagcagacactgagatatgtataagtagtaaaaaatgaaatcatgtcattcctgtttataccatattttttctattttatagatattgctgttcttttttttttttcttccctagagacagagtctcgcgctgatgcccaggctggaatgcagtggtgcgatcttggctcactgcagcccctgccttctgggtttaagcgatttttgtgcctcagcctccgagtagctgggactacaggcacttgccaccaggcccttctcatttttgtatttttagtagagacggggtttcaccatgttggccaggctggcctcgaactctagacctcaagtgatcctccttcagcctcccaaagttttgggattacaggcatgagccaccatgccgagctttgatattgctgttctttatttcaagctttatagttaagttactgatctgtgtcttcactagaaagacaatgttaagagggaagtaactttattcttagtcttcatgttttaggacctagcacagtgtctcactcacattaggattttataatatgtgttattaagactacagaattgttaaatacattgcttaggaagtggactggacttctggatacatgttatgcacccgttttcattcagcagatattggcattagtgaagcagccttcatggtactggctgtcagctatattatggaaatagtctcattacatgaaactgaatgtcataatgatttttgttaaaattggaatattgctgtagtaaaattagaaagtgacctcctccaattagtacagcatattatcagaaccctcaaatgtgtattataaaggttaggtattctaatctagcataacggagaggacagttttgttgacagctttggagatggattggcactgatgcttataaattggttcggaaatcagaatttaattttggcaagaatttataaaatttaagaatttattttttkaaaatatttatttatttatttatttatttttttgagacggagtctcgctctgtcaccccggctggagtgcagtggtgctatctcggctcactgccagctccgcctcccaggttcatgccgttcttctgcctcagcctcccgagtagctgggactacaagcacctgccaccatgcctggctaatttttttttttttttttgtatttttggtagagacggggtttcaccatgttagccaggatggtctcaatctcctgacctcgtgattcacctgccttggcctcccaaagtgctgggattacaggcgtgagccaccgcgcccggcccaaaatttaagaatttataaattttcttggtagcccataaaattcacttgtatccatccagtagcagaaatctcttagtaactccatgatctctaggagcagtaggccatttagtagggaggagccctttttctttaatgtagagcaagctttggcatagtggttctcagctaggggcagtggcggatgttttgggatatcttatgggaaaagggtgagttaatgacaatgggtttaagatgaaatgcagggagtgggacagatgtatatcaaaagtgaggtggtggctgtgtgagtgtgaaagtgatgtaggcaggttgaaagtcatactctattactgtctgtacttgtgtcttattagaaattgtataaaagattcaatataacccacaggttcagaaaaaaagaataaaaawagattgtataaaagaatttcaaatcagcatagaaatcttacgtacacatttcaattttttgatttttaaattgtatttcataagttagtggtataaatttaatacattcaatagattttaatcattcgtgttttcagccctttgtatataatttataaaagagctacttagacttctgagccagcttgtgttatttttacttcttagagactagctgatttcaaaaagtgggtatgttgaaataggcttttaattgtagacactccctcctatcttgaactttaacttgtaactgttaggtgtagctgtttgcttctagaagatgatttgactgatttctagtgaaaaaataggtactggcttaagtttgaattcacattgtagaagtagcttttcaaagagtgcattaaaggcacttaaatatattgctggaatatagggcatgatagttcctggaagcctacctttgtcatacaggagaacagttttgttagtggtatttagtgcctgaagatctgagtgaatatgtattatcaaataaaggaagcattggtcaacacagtatgatgcctatgacatgtagttgatgactcagtaggaaggaaatatatttttatgttggggaaaaatgctgttggtacctcattttgaaattatgcaagtgaaaagtctgttgaaaacaagttgattacaagtaattttttttgaggaatgcaaatatgccatgcttagcttactcttatatcctctcatttattgtaattgagtttttctgtaaataggaagatctgtaatatcaaaacattattgcagattttcctctcccattcttaagattgtatagccaactttttgggtatagataggaaaaaacttgcttgttatatgatatttctgtctcacaccaaggtgatgatggtgacccactatcagagagttattctttgttttttctcctgatgttaatgaaattttcattccgtatttttttgcacaattctttaatttagtagattggaacagaagattgtaagttttgggttcaaggattgggaaggaagcttttgcttagaagggtacttgggaagtaagatgctacctacccatggaatatggaaaaaaatcacaatggctggcatttgttggggtacttaatgccaggcactgttgttagatcattttgtgtatcatatattaacttggtcttcacagcatctctatgagatacgtgttgttattttcattttataaatgagagaggaggatcagggagggttacttatccagagtcaggaaagtcaaatagtagttatcagttgagggaagccagatcttgcctttacatgtaggctaattttacccttaaagcgtaatttaggttctttgtacttacagtatttgaagaatttgccttttagtcagtcaggttctttatagaaggtattttattttttggatgtgaaaaaatgtttacatttgaggggagaaaagcagcttacagaaagaacacgcataaaaccatttcagttttgtcatagataaatatatatgtaatcatttttagagaacagataccaattttctgggtagtaagattcataatgcacttctgtgattaggaaaaataattttttaaaaggcggattggtaaataccagtatcctggcgactttgagaaaaattaagggaaataaaaatactgttctcaaattgtaaaaagggagagctctcctaagctctcctgtgacaaggaggccaagttatgttttttctatttcttagaacctgctggtcatttttctgccactcttgcatgtgattttttggtattacttagtcttcccccttaaaaaaaaactagagatggggtgttactgtgttgcccaggctggtcttgaactcccgagctaaagtgatcctcctaaacaatcactttcgacttcccaaagtgctaggattacataaaatttgataaaggatctgttttctctatctcgtagatccaatctagttattcttctggcagttttacatagaggcttttttcgatatactgtgtttctttttttaattcttgaaaatttttatactttctaaaagattgcaggtatgctagtagttaatatttgtatgcctttcacctgaatttatgaatggttacctttaccacatttactctctttttaataatatattatttttttccctctgtttcatttgaaaataagttgtactctaaatacttcagtatgcttgcatttcataaaagtaaggacattctgctacataactaaggagatttttttcttaagtgtggagatgttcaaatttcccatggggcttataagtattaggtgccatgtgactgtagtatatgctttgtagtatatgcttttcagatttcccatggggcttataagtattaagtaccatgtgactgtaatatatgctagctttttggcaactaaaactgagaacaagaaagttaaatgctgttggtgcgcttttctgtgtaggtgaaataaagtaacagaagagaaaggagaagacgttgactttgcagagtaactatcttgtagggtggagctgtttttatgtaggaataatagcacaataacatagccttgaggttactgcatcattatggcctcttctggtgaagatgttaataaggataagcctggcttaacaagaacatgttagagtaggaggaaaattaatcatccatcaaatagaaagatatttagcaagatataattacctagaaactgtccttagtggaagctgtcattttccattgatgtcagattagtaacattttattgtcctctaggttaaatgtattttattttcatcattgtcaggtagcatgtatttctccactgttaaagtctttatgtgaaaatgccttttgtaagtatgtataaaaccatttcagttttttcatagataaatatatatgtaatcattttagagaacagataccaacttgctgggtagtaagattcataacgcacttctgtgattaggaaaaataaatttttaaaaggcagattagtaaataccagttgaccctctgtgtctgtgaattttgtattcatggattaaaccaaccacgaatgaaaaaattcaaaaaatgaaattgagtctgtacttaacatgtacagacttttttcttgttattattccctacacaacacagtacaacaactatttatataggatttacattgtattgtgtattataagtagtctagagattatttaaaatatacatgggtatgtgcataggttgtatgcaaataccgcgtcattttgtcagggatttgagcatcartggatttggatatctgtgggaagtccttgaaccaaccccccagggataccaagggacaattttattttattctttatcaggagggataaaattaggaattaagattggcattctttgagtccttacttgttgttcgttttgtcctgcgtaggtaatatatctaatagtgatgaaagaacctggactgggagagtctagcaagtagtaaggatcaggatagagtaggtgataaggaatcggagtaaacgattaggcagcttggaactagggaatcaggaagatctataacaaggagagattcccagatacaaaggtgagtgggtcagaggccaagctgtgttcagatagagatgggtgaatagttaacatgtttcagtgagatttgatgataccacatgctctatctatactttctgagctcttgactgattgctaaagtttagaaataaatctcagttgataggtccagtctctgcatgtgggaacaggcaattttgtgatgtctgactgaggtagtaagcagtacaagggttgaagattagtcagggctcctgtggagtaaaccatgcccatttcaatcactagctgtggaaatcaagggtatatgtatatgtatatttttctgtctataagaagtatattcttctttagtattgcattgcttgttttccccatcttagaggtagacgtcagtttagtttttgaaaggtttttgccatgtgctgtattttgataattttttttcttttcagttttttttttttttaattttgagacagggtctcactttgtcacccaggctgcattgcagtggcacgatcttggctcactgcggcctctacttcccaggttcaagcgatcctcccacctcaaccccccaagtagctgggatgacaggtgcatgccaccgtgcccggctgatttttgtatttgttgtagagatggcgttttgccatcttgcccaggctgtcttttcagttttttgtcatatcagaaatatggtgacttaccttgtttatgatgaaggtaattcgactcatcgtagattaacatgaaatcattgaaatcaaagttgagttcttggcactgcctcctgtttgctatgtgacactgggtttgttacatatcactcaaacctcagttttctttaaaatgggctaatagttctcacttgattgggtggtttaaatgaaaaaaatgtagagcagtacagagcctggcagatagcaagtgcttgatacattttaattatcatgacatccaatttataagcattattgtttaatttagttaaacaagaaattgatgtaatcaggatattgttctgtacatggtaagatttcagggtacatttaagaaattaggatacttttaaaaataaaataggatatatagtttgggatttttaatttttcccctttaaatatgtgaaatgtgaaacttaaaaaatcatttaaaaatgtttgttagccagattttaatgtgaatttgaatatattggatttctaaaacaagaatgagaagcaacagccttagtgtaatattatttttatatatatatatawaatgtaatgaaaaactaaagatattctattaaagtcagggacaaagtgaacatgcctacacttgttattcagcatggtttggtactcctagttagtgtagtaagttaaaaaacagataaaattataaatagatgaataaaagatttaaatatgcaaagcagaaccaataaaaggccaagaaagaaaataaagaatatttttggaattttgcctgcaaaatttaggggctcatgaatcccctatagaggttatgcagtttctccctcagtatctatggggattggttccatgaatgctcaagtcccttatataaaaaggtatactatttgcatataacctgtgcacatccttccctgtactttatttttgttttaaagggttaaacaataaggcctttatctgcacaaatcagggtagaatgaggcaggcagttccaggattggctgattcggaaactggctagacaaatccatctcagctaccattgtccacaaaaaagggggacctctgraaatccacagcagaccccaacccaggtcttttgggcaggagctgggtcatttccacactgaaaccactctgagggaggggatgaagaaccaccaggttttgttcactcacctagttgtaggtaatctctacattgtggatagatggagcagttcaacttctggctgacagctcacattcagaggtcactgtcagctcttctcttttatgatcatgctattttgaacaatgagacaacatctgccatgcactcttaaggcctctgtccagtgtgaactctaatgcctaatgaggttaggccttgactgtatgcttttttacatccgctacacttctacatttataaggcctttctctgtgtgaactttcatgtgccaagcaaggtggaagtttctgcattcccatatttcctgcatacataaggccttgttccatcacgaattctcttatatgctgtaagataggaattgtggctgaagaattttccacatttacaacacttagaagtctcttttccagtgtgaactttctggtgctcaacaaatgtgtctttatagataaaaagacttgtcacatgatctgcactcataaggcctttctccactatgaattctctgctgctgaacaagataggatcttctaataaaggatttatcacattaagctcactctttttttttttttttttgagatggagtcttgctctgttgcccatgctggagtgcaacagcaagatctcggctcactgcaacctccgccttcctgggttcaagtgattttcctgcctcagccacccaagtagctgggactacaggtgtgtaccaccatgcctggctaatttttgtatttttagtagagacrgggtttcaccatgttggtcaggctggtctcgaacccctgacctcaggtgatctgccctcctcaacctcccaaagtgctggaattacaggcatgagccaccatgcctggctttaagctcattctttgtatgacctctttaaagtatgagggttggaggtggagccaaataatttcccgcaatcactgcatttataaggtatttctttgytgtgaattcttctttgtactgtaaagtaggagttgtgactaaaggttttctccacattcaccacactcctaaggctttactccgtcatggattttctgttgctgaacaagtttatctttgcagttgaaggctttcccacatcactgcacttgcagcccctttgtccagtgtgaaaggcctccctactctcagtactttggtgtggcttcttccccattgggaggggcctggtgcttgaaaacttcaaagctattcaagaagtattttccacccttcctgctagtgaaaaccttctttgacatgtagkatctgcagatcttcacaaacaccaggctcttttccttctagaagatttctgtctgctgcctctgaatctggtctaggttacagtgaaccagaagtctccaccccatgactcacatgtgtgtggttgctattcagagaatgttccccttgtccagctagatggaaaaacgtctttcaagaccaggccgcacatgtcatggggtgggctttctgacctgccttaggaattctcacctgtgacactcttaaagaaacaccctgcttggaaggtgcrtgttcatcctccactccataccagttaccttgggtggggtcacctcagggtgcttgttgccttctgagcctcactgcaaaatgccctctcatacttgaattttaatttttttatttttttgagacagggtctcactctctcactcaggctggagtgcagtggtgtgaatacggctaaccccagcctcgacttcgtgggctcaggtgattctcccacctcagcctcttgagcagctgggacwacaagtgtgtgccaccacacctggctagttttttgtattttttttgttgttgttgagacggggctttgctatgttgcccaggctggtctctaaytcctgggtttaagcgatctgcccgcctcggccccccaaagtgttaggattacwggtgtgagccactgcacctggcccctcccatatactttaaaccatctccagatttcttataatacttaatataatgccagcacttcatttgtgtggattcagcatagtactcagtgtacagcaaattcaggttttgtcttttggaactttgtggattttttttccccttcagtattttgaatccacagttggttgaattccactaatgcagaacccatgaatacagaggactgactctatcagtgagggttttccagagagacagaaccaataggatatacatatgtacagatagatacatgagagaggatttattaggggaattggcttacacgattatacakactgaaaagtcccatgataggcagtctgcaagctggagaccctaggatgctggtagtatggctcattttagtcttaatgtctgggaaccagggaagctgatattttaactctgtctgaggctgaaggccgcagaggctggagtcctgatgtcccgaggggaaagagagggagaattttcttttcctccacctttttgtttttttcctggcctttagccaattggatggtgcctgcccacagtgcaggtggatcttccccagtcagcccaccactccacccgccagtcttcactggaagcaccctcagagacacatccagaaataatgctttaccagctctctaggtcttccttaatctagtcaagttgacacctaaaattaactaacacagaggtttgtggatttcaggttagtattcctcttgtagaggaaaaaaaggtgaattataaccaaaggcagatgaaactaagtgtttaagtgacttaccaaagatttgatacctgttctgtaacattttgtaggatgaaactaagtgtttaagtgacttaccaaagatttaatacctgttctgtaacattttgtaatacttcgcttattcarctctgctgttgtgtgaaagcagagatagaaaatatgtaaatgaatgagcatagcagtgttgtaaaaacaggtggccagctggaactggcctttgggtaacagtttgccaacccttcttctacgttatttggaaactttttctactcagtatattgcctgagacatcagttgaggtattttttgcttaaatggtagcacccatggtgtacctatccctattaatgtattgttaaatgcttacattaaagcaagtgtgtagaaataaggatatacaggttgagtatccttatttgaaatacttggaaccaaaagtgttttggatctttaaattttccgattttgggaatatttgcattatgcttaygatttcctaatgtgaaaatctaaagtgcttcaatgagtttttttttttktttktttgtttgttttgtttttgtttttktttttktttttttttacagagcctcgttctgttgcttacgctggagtacagtggcacggtcttggctcgccgcagcctccgcctcctgggttcaagcggttcttctgcctcagccttccaagtagctgggattacaggggtgtgccaccactcctggctaattttgtatttttactagagacggtgtttcgccatgttggccaggctgtctcaaactcctgacctcaagtgatccgcctgccttggcctcccaaagtgctgggattacaagcgtgagcccctgcgcctggctgagcttttcttttcagcatcatgttggagctcaaaaaattttagattttggaacattttggatttcagatttttggatactcaacctgtatagctgctggtagaagtcacggaatttctgaatgaagaaaggttacagtgcttctcaaacttgaatgtgcatacagatcactctggggtagtctggggtagagcctgagtcatttgtggggtcagtagatctgctgggagcctaggattctgcattgctaacactttccccggagatacctatgctgttagtcgctgaaaaacagtttgaattaasaagattctgtgttcagaaaattgtaaaatgctagatacggaamaagatttaattggataaagacttaaacatccataaacacaatttccagtctcagtgatagtagttgaaagaacttgttagttgaacacatagtgagtagtaggcctccatattttcttttctttcttttttttaaaaaatagagacagggtctcgctatgttgcccaggctggtttcaaactcctgggctcaagcagttcttctgccttagcctcccaaagtgctgggattacatgtgtgagccactgcacatggctcatattttcttttattttagattcagtgttgaattggaccttctggtcttctaagaagttcttgaaaatggcttagttgctgttttctcaatggatattttgccttgatgttggtttcccccaatgttcttttaagacctgtggtcactggttgtcatttaatcttttatttccccatctcttactacttatgtcctattagcaaactacagttatgtaggaatattgaatcattacaggctgcttagtattggaagtaggtagaatgttaattcatttattttactgagaagataacttggaatattttgaattctctttttgatttgtctttgtttttgatcctggattttaaaaaattttgtaacttagggaaattttataacttttgtaactttataaattttatatcttagggaaaaagtaggaaggccagaaacccatatacctaccactttgctgcaacatttttcttttttcttttctttttttttaaaaaatagagatggaatctcgctatgttgcccaggctggtctcgaatgcctcaccttaagctgtcttctttggcctcccaaaatgctgggcttataggtgtgagccaccacacctggcctcaatatttttatttaaaaaaaaatctagtcagctttattgaggtatagtttacatacaataaaattcaacaattttttaagtgtacgaattcataaattttgagaagtatatttacttgtataactacctccataatcatagaacatttatatcaatccaaaaagctccctgggctatttgcagtcaactcaaaatactttctaatttccatttgatttcttctttgacccatgaactacttagaaatgtaaattcctaatatttggggattttctgcatatctgttattggcttaattctcctgtagtcagaaaacatactcttagattttagtcttttaaaatttgtggaaacgtgctttgtggcctaggattaaggtctatctttgtgactgttccatgtgcccttaaaaagaaatatattctatctatctagtcaagttctttgtgtttaagtttttaataatcttactgatttttttgtctgcttgttcagaaaggagtggtatgatttccaactctagttacagagtctrcttttttctgttctatcaactttttcttcacatactttgaagctttttttatgtacataaatacttaggcttgttgtgttttcttcttgaattaggaaatgtccctctttatccctcataattttttttgttttgttttgaagtttgttttttcagctattactgtagccactccagctttctttggattagggtttggatgttatatattttcccgtcctttttactttaactcatctttatttttgtgtctgttagcatatatttacattttccttttttaaaaaataacaaggctggcgtgtcatctcatgcctgtaatcccagaacttcgggaggccaagccagtaggattacttaataccaggtgtttgagaccagcctagacaacatagcgagtccccatttctacaaaaaataagaaagattagccaggctgggcgcggtggctcacacctgtaatcccagcactttgggaggccgaggtggttagatcacttgaggtcaggggtctgagaccaacctggccaacatggcaaaaccctgtctctgctaaaaatacaaaaattagctgggtgtggtggtgcatgcctgtaatcccagctactggggaggcttaggcaggagaatcacttgaacctgggaggcagaggttgcagtgagccgagattgcgccgttgcgctacggcctgggcaacgagcgaaacgctgtttttgggaaaaaaaaaaaaaaaaaaaaaaaaaaaaagattagtcaggcatggcatggtggtgcaccagtttccagttactcagaaggmtaaggtgactgggttgcttgaagctaggaggttgagggtacaatgagctatgatcacgtcaccacactccagcctgggcaatgagtgagaccctgtctcttaaaaatcaaaaagcgaaatgacagcttttgccttttaattgttatgttagatcatttactttcccttctgcttgctcttccccttccccttcgtcttctccttttccctctcccctcccctcccctcccctcctctcccctccccttcggagatggagatctctctctgttgtccaggttggaatgcagtggccgttcacaaatgtgatcatagtgcattgcagccccaaacttgggctcaagcagtcctcccacctcactctcctgagtagctgggaccacaggtgcacactaatgtactcagctggatcatttacttttaatgtaattattcatatggctgagttttaaactgtcatctttctatttgttttccatctgttcatagttcttgtccccctcttttcttgcatttttcgggagtaatatactttttttttttttttttttttttttgggagactgaggtctcgctctgtcgcccaggctggagtgtagtggcgcgatctcggctcactgcaacctctgcctcctgcgtttaagcgattctcatgccttagcctcctgagtagctgggattacatgcacctgccaccatgccccattaatttttgtatttttagtagagatggggtttcaccatgttggccaggctggtctcgaactcctcgcttcaagtgatccacccgccttggcctctcaatataaacttttaaaaatgattcaattttatctctgctattggctttatgatgatatacctgttgtattttttagaggttgttcagtgtacaatatctataacttatcactgtatactttcaaataatattacttcacttcatatggagtatatgtacactgtgtttctcctctgttttctgttgtgctgttattgttacacattttaattctgtgtgtcataaattccacagtagattgtgtgtttaaaaaatgtattcgcttaactttgaaagagattaaaaatgagaaaataaatcctttttattttcttatatattcattatttctgtcacttttattatttgcatcagtgtaggtttccatctggtattattccttctatctgaaaaactttatcatttctattaatggaggctactagtgatgcattgtaagctttgaagcccagaagggcttcgtttcacctcctcttctcaccttcatttgtgaaagttattttcactggctatagaatcttaggttgatagagttctttttttcttgtagtactttaaatatgtggctgcattttcttctgacttaacatagagtgtgctgtcagttttatctttgttcctctgtttataaaatgtgtcttttttttctggctcctttagtgcttccctacccacagatgattttaagaatttttttttctccctagtttttagtcattagcttatgacatgcctttatgtggtttttgtttatttatttatatttttaattttaatttttatttttgagacagggtctcactttgttgctgaggctgttgtgatcatagctcactgcaaccttggactcctgggctcaagcgaacctcctgcctcagcctcctgaatagctgggattacaggtgtgcaataaaaagtattcctggctaatttttactttttttttttttttttggtagagacaaggtcttgctatattgcccagctgatcttgaacttcttggccttgaacagtcctcctgccttagcctcccaaagtgctgggactgcaggcatgcactaccatgcctaattttcttttattttttatattcatataataaatacgatttatttatttatttattttgtttgagacagggtcttgctctgttgcccaggctggagtgtggtggcacgatcatagcttactgcagctttgacttcctgggcttcaagcaatcctcctacctcagcctctcgagtagctgggactgtaggcatgtgccactgtgcccagctagtttttatatttagtagagacagggtttggtcatgttgcccaggctcgtcttgaactcctgggctcaagcaatccacccgccttggcctcccaaagtgttgggattataggtatgaaccaccgtgcccaggctctgtggctaatttcactccactagtaaggtgttatttttctgaggactgtagcaatgctccatacattacaaggtctttcttctctagatggtagaaatatgaacattttccagccctgtgtgagctttgaggattgttttgcttccttctactggtggttcattttttctgaggcgggagtttattttctcacatgcttagatcagtagtcagccaaacccttagggaacccccacttgaggtggctggagctctctctctgttcagcttcctcctttctgacactctggcacatagattctaaatacctgatctccctgaactcagaggttgtctcaattaagtggaaacttcaggctcttggtttcttctccctgtcatttggcctggagactgcttacaggcagtaagctgggccagttgtagtagatctcacttcatttgtttctcttgtcacatcttttatctagttttctaattgtttatggtggtaggctaaattcagtctctattactcctgaagtagctagtgatttaataatttgcatatttttttcttttttaccctgcctcccaccctagaatctgtctagtgtgagttatggacatcgtgtcattttacccttaaatatttaaaatgaacctcccaaaatttagaaccttctccttataatmacaatgttgttgtactaaggaaaattaatatgaatttctttctttttttttttttgagacggagtcttgctctgttgcctaggctggagtgcaatggcacgatttcggctcactgyaacttctgcctcccgggttcaagcaattctcctgcctcagcctcccgagtggagacagggtttcaccatgttggccaggctggtcttgaactcctgaccttgggtgatccacctgcctcggcctcccatagtgctgggattacaggtgtgagccatcacgtctggccaatatgaatttcttaatrtaatctaagactgattctgctttgtctaggattgtttccaaatgtcgtttgttttcttctcaattggattctttttctattttccttttattgtttctttcatggtttttttctccagtgtgtttttacaatgttatgttcatggttgtgtgtctcttctctacccagwtattctttttgctatgatataaagtgggtgagtttattttttattttttattttttgaggtggaggctcactsttgttgcccaggctggagagcagtggcgtgaccttggctcactgcaacctccgtctcccgggttcaagagattctcctgccttagtctcccaagtagctgggattacaggcgtcagtcaccacggcaggctaatttttttttgtatttttagtagagactatgggtttcactatggtttcaccactctgttggccaggctggtctcaaactcctgacctcaggtgatctacccacctcagcttcccaaattgttgggattacaggcatgagccaccacacccggcttgtgatttcttttttcttttctttctgcctctgagaccagtgtattttttttccgccttccaatcttagtttgaggggctgattattttgtgttttattcacgtttctgcagtmacggggctgtgatcatatataatttttttgagaattccaggactcccattctcttgagatttttaaataagtgaattgtgtggcatctgagggctaggggcaacatcagaagtccagtgtgccatgctttcctacattttcattaaaatattatttcattccttggctgcctgtttgaaagattatattattaggttatgaccagtgttgtatttagcacactgtcttgaaaaaagaaaaaaaaaatcctctgatttggctgggtatggtggctcacacctgtaatcccagcactttgggaggctgaggcaggaggatcgcttgagcccaggagtttgagaccagcctggtcaacacagtgagaccctgtctctacaagaaatacaaaagttagccaggcatagtggtgcgtgcctgtagcctgagctactgggaaggctgatgtaggagaatcacctgagccctggaggtcaaggctacagtgagccttgatagtgctactgcactccagcctgggcaacaaagtcagaccttgtctcaaaaaaaaaaaaaaaaaaaaaaagttctcaaatttgtagccttttcaatgtcagtttccatggtggtgtaaatactcccttcatggctgatttcaagctacaaacataatgttacagagcatgaagttgggaagggaactgacactcatgagcatgtatcagccaaattgcttatctttttttatttgatttcagttcttttcttttttttttttttgagatagggtctctgtcatctaggctggagtgcactggccgttatcatagctcactgtggccttgaactcttgggattaagtgatactccctcagcctcttgggtagcttggattacaggtgcatgccatcattcctggctagtttttttgtattatttatttatttatttttacttattattattttttgtgacagagttttgctcttcttgcccaggctgaagtgcagtggtgcgatcttggctcactgcaccctccaccttccgggttcaagtgattctcctgcctcagcctcttgagtagctggtgttatagatgcatgccatcacgccaggctaagttttgttatttttagtggagacgggggtttcaccatgttggccaggctggccttgaactcttgacctcaggtgatccactcgcctcggccttccaaagtgctgggattacaggcatgagccaccgtgcccggcctattatttacatatatatatttattatttcagacagagttttgctcttgtcacccaggctggattgcaatggtgcggttttggctcaccgtaaccttcgcctcccgggttcaaacgattctcctgcctcagcctcccgagtagctgggattacaggcacctgccaccatgcccagctattttttgtatttttagcagaggtggggtttcaccatgttggccaggctagtcttgaactcctgacctcaagcgattcacccccctcagcctcccaaagtgctgggactacaggtgtgaactaccacacccggccacctggctaatttttaattttttgtagagacaggggcctttctatgttgcctaggctggtcttgaactcctggactcaagtgatcctcccactctggcctctcaaagtattgggattacaggtgtgagctactgcatctgacctgatttcagttcttgaagtttgttctatgtgtgtgtggggtgggggcagaggggcaggtaggctgctttatcctctacccatggcccccttatttccctcttcattaagtattagggaatagaaattatgtaattcaatttcatacattatcttaatataagtttttttcccacagtactgagattacacaaatactgatatttaggcataattaagataaacattcataggtcttatatagaagatgataatgagatggacttggtaactgtgtgtcccggggaagtgtttttagctttcccaattaaamcctatgaatcatgttctatctcaattacaaagattcagaaaatcattactcaggtcttttgccagtgaaagtgaatagtatgttgcttttataaaatttgtgtgtgggacagagaaaagatgactttgtttaataacwctcccagtagaatttcagctgtgtaaatcgttgagcttttgtcatgagtgcttcagaacagcaatagttattgttttaagttatcaaaagtgacagaatactttatctgaactgcgacttaaaaacttgactttttcctgatttaagcagcagagacagaaataaaaaccagcttgacgcctttggtgccgaaaaaggagtggaatccacagttctgcaaagccaagcttgtgctatggcaactcagaccacttaaatccaattcagtaatccagtggaaattttcaaaatgaaagaaattattcaaaagttctcattcttccccattattgatttcttcttttttgctaaactcaattatactacatttataagtatgtttaaaggatacagaagatgcattggtatatttgattccattatttagtcttgatttttaaaagttccatgctaggccgggcgtggtggctcatgcctgtaatcccagcactttgggaggctgaggtgggcggatcacgaggtcaggagatcgagactatcctgactaacatggtgaaaccccgtctctactaaaaatacaaaaaattagccgggcgtggtggcaggtgcctgtagtctccagttactcgggaggctgaggcgggagaatggcgtgaactcaggaagtggagcttgyrgtgagccgagattgtgccattgaactgcagtctgggtgacagagcgagactctgtctcaaaaaaaaaaaaaawaaaataaaataaaataaaataaaataaaataaaagtttcatgctagtgggttttattatctcttagacattggcttcactgaaatttctttgctacttgtgaagatagttttggactcattcttctcacctctcttgggaggagtgtgttcaagaggagaaggaagtaactcaatagtagtttaagttgaattgtccttttatgccgctctttgtgctcgtaagcattttgcatgcatttaaggtaggcattgttgtctccattttacagattaaaaaaccacctcctgagatttaaaaaagttaaataattacttagctcatgtggttatggctaggaagtgtcagaattcaacccagttttgttttttcttcctgaattcttggcttcagtgtgtgtatattggtctgaaaggcaaagtgtgggagaaggaagaaaaggaggaagggggaagagatgatgatgatggataatttattgaaccttgcctctttggtaggctctctaatattaattgtcacacatggtttaaatcatttaatctgtgagtcttaagagagagctactctagtttcttcattttatggacaggagactgaacctgagtagttttctattcgatctgggaaacaactaatgattgaaggtagtggtattcaaacccagatcatttttttttattctagtaaaaaatgcttaaggtaaaatgtactgtcttaaccacttctaagtatacacttcagtagtgttaagtatattcacattgttgtctaacaaatcttagaacttgaacccagataatctgacatcagagtttatgcccttaaccacatagtgcataaacagaaaatttagtgttggatcacagaatttagtgttggataatagatgaaccatttttagacaacttgttttataaaagaggacaatttagttaaaaattttacttgatttgtcaaagaatcacttttttttttcttctcttgaagatggagaaataaggattaaatttactttcctgcatgaaaggaaacaaggaaaccaggaaaaatacagaaagacaatttttttttttctttgagacggaatttcactttcgttgcccaggctggagtgcaatggcatgatctcggctcactacaacctctgcctcctgggttcaagtgattctcctgcctcagcctcctgagtagctaggtttatatgcagccaccaccacacccagctagtttttgtatttttagtagagatagggtttcaccatgttggtcaggctggtctcgaactcctgaccttaggcgatccacctgcctcggcctcccaaagtgctcggattacaggcgtgagccaccacgcccagcgaaacaatggtttttaaggcattggtcatcaggtagtgaaggaccctgagaggggaaacagtaaggttggcccttcgattgtgccagctttctgccttgagagatttatgggttgtggtactatgagagggaacctaggtagagtccarggaacttcctcagttgaagagatgaagctragggtcaggggagaccaaagtggctggagttcacagacagaatatcagggtgaagagagagctgcacagaggatccctgagatctgcagaggcttccactrtagtgttcagcagagctctaatcagcccatatgtggaaactacctgaggctaaagaatcatcccaaaagattagattgaacggtacctggtgctcagatagggctataagtagtgccttttcttaccaggtagactggaaaaactcagttcatggagcattgggtagactactgagataggtcttgcctcagtagtgggaaataattagccccagactgagcactcattctacataaatttgtccagagaattgaagaagaggtaatacttctcaacacattttttttttaccccaataccaaaacttgacaaagatagtacaagaaaagaaaactgtaagccggtatataccctgaacacagaaaacaaaattctaaacaaaattacagtaaattgaatctgacaacatgaccaagtagggtttatctcagtaatgcaaggttggcttaacgttcaaaaatcagtaaaatttaattcaccatattaatacattaaaaagaaaaaatatgatcatcttaatagctgcagaaagagcaggtacagaaataagcatttgttcccgatagttttttaactttttatttatttttatactttttatttatttttattttattttttatttttattagggatgaagtcttgctatgttgaccaggctggtctggaattcctggcctcaagcagtccttccatctcagcctcctaaaatgctgggattacaggagtgagcccctgcacctggtcctgatagtttttatcagcaaaatgtgaatagaagagaacttgctcagcttgataaaggacatctaaaacaaacctatggctaacatccaaacttgtgtgtgcsgttggaattaccctcacaataagttttaataatatatgtgttaatrttaatgcagaattcataatagtgctgggattagggagaagttgtttcatacatattcatagatacttgaataatcgtgttagaactagaaggggtcttcaagatgatactaattcagaatgttgttttttttttataggtcagtatgggaatcctttaaataaatatatcagacattatgaaggattatcttacaatgtggattcattacaccaaaaacaccagcgtgccaaaagagcagtctcacatgaagaccaatttttacgtctagatttccatgcccatggaaggtaagtaaatttattgctgactgtgtctgaagttcctctatattcaatctaagttaaagaggagatttatatccttaattttccttctctaatgcaaggtcttcatttggaaattccatttccactggaatttggtatatgcattaaaaaatgacttattttaaaatggattgcccttttatattgttgaggaaacagtcaaatttaaatgtttttgaatttatgaatcagatcttacattagtaaaagatatgtctttaaagaagattctgtgtacatagtttctgactactttttatatgttttatggtcaatatatctatctactggtgccagcagtgaaggtaactacttatatgccattgaatacatcatttactcagttttaccagttctaaaatgacagctggtagacagattacctgctgttttgttcagttctcaaacagaattgttaagtgataaaggggagtcaagggagagaggttaaaaaaaatcacttattgagtacctgttgtgttctagatgctttatatgcattttcttgtttaatcttctcaacatccagacagaggtaaatagctttttatatccgaggaaactaaggctcagagaagttaaataacttacacagcactgattttaccgagacctggctgaacaccccttattttttctctatctgttagggacacttacagaatcttggggatctttgtgaagccctctctgtcttatgtgtaattattaaatctattccttttgtactttttgtactgatgtaaccctgattgattactgtagtgttcacttcctaataagtttccccgcttctgctctgtttatcaataaagctattctactgctatgagatgacttttctctaaatacttcttttttcatgtcagcttattgatctaaagtcttcaattwatgattgttagccagattttcttaatttgacttttaagtttctctgtaaattaatcctagtctattattctaaacttactttgttttacttgccagcatcaagtgtgtatttcacccagaatgatcttctagtctgtgaatataccatgtaaactttgttctgtgtcatttgtcctaaatcctgatcatcttttaatgtacaattcaacttctgcctcttagacactttactttttaattccgtctaaactttaaagttacttatctgaatcattggcatcatttgtgccctcttcctttttgtgggtacttcttattaatttttccataaccgtgttttctgttcctcacagcaggcatcctggctactatttggtattatccattatattgcacatatggtacacgtgcttaaacattttaatggatgaaaaatcagataattaggaatgctgtgaaacttaaagtattttgtacatgaaaataaatgtgtcacttaaattaatgtattttccgtattacaaaagtaatgattattgttgaaaaaattacttttaagttataaaatcttctttatctgaaggagggaaaaagatttatttcagggtcttttcttctagataaacattttagtgtatttatgtactatgaaattacaagcaatcattagtcttactgtttttaatgagcatctcaaaatatacttagtattattaattatattaatctataccaaatatggtttgactgccaaaaggaaaagattttagctgcttttggcttaaatatctattcctattatataattagatttttgttagctgtgtcatgtaattcatattgaataaatggcaaaactaaatccctagctcctttgtgtgtgtgtcagtgagtgagagagagcagggaaagcgagagagtttgcatgagtgagtgggctgccatgtagttgtccaaaaaatgtttactgactgctagtgaaaagttacttagtatagactgtgggtgatagaaacataaatcaaacatagatctcataggagcagttagatgtgcctgttattgtataaggcacatgtgatgtgttacattacagataaaatgctatagatattcaaaggagggagaacttcttgctgaggcactaaaaaaggacctgaaaccrggaaatctcatgtaatgtggtctcatttatacaggtcattttagggtactttttttttttttttgagacagagtcttgctctgttgcctgggctggagtgtaatgatcctctcttggcttattgcaacctctgggttcaagtgattctcctgcctcagtctcccaagtagctgggactacaggtgtgcgccaccatgcccggctaatttttgtatttttagtagagacggggtttcaccatgttggccaggctggtctcgaactcctgatttcaagtgatccgctcacctcggtctcccaaagtgctgggattacaggcatgagccaccatacctggcccattttagggtgcttttaacacaaatctgcttaattaactatacaaacttactgtattttctgtaattcatccaatttcagatattttagtttattttcccaatttttatatattcactctgtctcagaatttctgccctaaaccgtggtcattttaattaccttttaaaatactttacttaaaaatgtaaagggctgatgatcttgttcctccctttccttgaaaataggcctacaaaatgactggagtagtataattacagatttcctgctaggtctttcttcctcttctatcgtctaacaaatattagtcttggtacactgtaactcctcctaacaggatttctatctgtatataaattatttattatttgttaataacattttgtattttatttttataaatttttattttttgtatttaatacgaatatgttttatttttatttttaggtagattggctcaacacataataaatataactttgaaatgactttgagttagagttacttgtagcccagcctataagatgtgtactatcttgtagcccagcctataaaattgtactgtcttatacattgtggctagaattgttttctgtatttcaccctttaaaaaatatcaagtagagtttattttttttattcacataataggctttagtcccctagaatctgatcagtatactttaacacataatagaatatattaaatactgtgcagttaacttagacataccaagaagaatatacttggaaggggttttgcttatacagttgtgacttacatttctgggtagtagcacagcttctgtgtgtgtgtgtgtgtgtgtgtgtgtgtgtgtgtatgtgtatgtataagtattaaagtaattttttgtggtttttatgtctaagcacatgaacacactttcagcatggcttccaagttttctgattaacagagtatattatatgccatgtttacagatgttactgttaaatgaagaaacgtttatatttttccaaaccaaaagtccattcttaagaattctatggccaggtgcggtggctcatgcctggaatcccagcactttgggaggctgaggcgggtggatcacgaggtcaagagatcgaggccatcatggccaacatggtgtaaccccgtctctactaaaaatacaaacaattagctgggcatgcgcctgtagtcccagctactcaagaggctgaggcatgacaatcgcttgaaccagggacacagaggttgcagtgagccgagatcacgccactgcagtccagcctggcgacagagcaagacttcatctcagaaaaaaaaaaaaaagaaaagaattctatgaaaagctgttgctcttgaaataaagcttaaagttgtttgaaaataaaagtaccatttgagtcagtgccatagtcgttraggaaacaactccagtaatacttactagaagattaaactgttttgataatagatattagggtaaaatacatctcttagcttggctgagaaattaagaatcagttttctragtttcagaaatcactgaataagttctgatgaattggattgctcacttagcaatgctgtatatatgtcagttatggcatttattttattataactttatttacatgcatatgtcctctactccttgtgaacttgaagtgcagagtgtgaatcttactcatctttttgatgtcgatgatggtcattttagttatattgagtgagtgaattgctggacatggtggctcatgtctgtaatcccagcactttgggaggctgaggtgaaaggatcacttgagcccagcagtttgagaccagtctgggcaacatggcaagatcctgactctacagaaagattagaagaaacttagcaaagtgtggtggtgcatgcctatagtcccagctacttgggaggctgaggtgggaggatcacttgagtctaggaaggttgaggctgccgtgagccatgattgtgccactgcgctccagcttgggcgacaagagtgagaccctgtctcaacaaacaaaacaccaccaacaaaacatttaagtacatagatactaggaaacagattttcttcttaaatattttatactctatgtcatcctcatcggtaattgttcttaatgactaagtagtaagcagatttgtcatattgtgggatgcaggatttttgttcgaaatttgttttctctcagtcctcgtgttcatgtgaaagtgcgtgatgtatcagggactgtcttgtaatttcccttctcttgttcttagataccatgttgtcctgccgttcctgtcttgttcttttttttgaggcggagtctcgctgtgtcacccaggctggagtgcagtggggggaacttggcttactgcaagctccctctcctgggttcatgccattgtcctgcctcagcctcctgagtagctgggactagaggcgcccaccaccgctcccggctaatttttttttttggtattttttagtagagacggggcttcaccatgtgagccaggatggtcttgatctcctgacctcatgatccgcccaccttggcctcccaaagtgctgggattacaggtgtgagccaccacgtctggccttttttttttttttgaaacagggccgggctctgttgcccaggctagggtagagtggtgagatcttatttcactgaaactcttgcctcctggactcaagccatcctctcacctcagcctcctgagtagctgggactacaggcacacaccaccatgcctagctaattttcatatttttttttggtagaaatggggttttgccatgttgcccaggttcccttggcctcccaaagctgggattacaggtgtgagccaccgtgcctggccattcctatcttaaccatcatgtactttagcatactataatttccagaaatttttcttacgtggtttttgtaaaatgcaggttaatattgtttatgttttgattctatataacatgttggaatatctctgtatcacctatattgatataggtgaaaataagaataaatatctgtcttagatttaacaaaggttattaatatagcatgagaaaaacttcattgcaagattgatcgcttttatagcttttagtatgattcttacgttgtatgtatatatatattttaacttatgccttttgtttgcacctgtcattgaagagaagcataagggatcactccactctttcttcttcctaatagagcttgtaggaattttctgaaacaccgtttcaaagtgataattaaaaaaataagtaaaatgaagtatctgagactcttacttaaaacgattgtctgttatgatatagtttatctttttggtaggaagtatatatacactattatattgaattatttttgtggttgtatgtatatgtacgtttaaaccttttcattcttcatatcttgttttccaaattatgtactttggggtaggcatcttgtctttattttctggtcttctcgccactttgctaacttgactgtctttgatagagttggtagcttacagccaccaactttgcatttgagtaggaagccacttagtaaagaattttgtgattttatatatgtattggagtagtcataaactggatggagaaaggagtagtgtggttaattcagactaattgactttccttctgacttgacatgaaatctagagatttcttctgagcctcagtttcctcattagtaaaaccttgaagtttagacaagataatatttaagctcctttatgctttaaaattctacaaaatatattagtatactaagtttaaaacattaaaacactagtcagtaataaaccatatttttctgcctgtgtatttatttgggtacctcagtccatacatcagaaatgatttttatgtaatatgtgatttgtatataatatagaagaaaccaaaaactttccttaagtgcaatataattgtttggagaatatacaactttatttttttctgaattgacaaggtaattcttcctgtagccttaagagtamatttccaaactgtttaaaacaaatgattagacatttggttggaagttttctttgtggtttgggatttgagttctccctactcctgaaatatgaaggtttcaagaatatggcccaggtaacctgtaaaaggcataaatattcccttcactggttcttgcctggagttgggttagtctggagatgtctgtgacttaatctctgttatatcatgagtcaggtagcagaaatctagggcacttttaaatctgtagacaaaccagcagactttgagaagcagaggtaagaatctagggaacacaaatgaatgcctgatcatagagaagagctagggaataaatttgaatggtgtaaaaatactattgttatagatgtttaaaaacaaaaatttaaaaaatactgatggtagttaaatctcttccaacaaaatttgagcaaaaattcccaaaggaaaataatatttatttagtacctacttcgtgtcaggtatagtgcaacatacgttagttaaagtacattttacattgctttttatctcagtattggattttctaggatatggtattctttattcttgcctgattccgctttatacggaaattaaaatcccaagaaagctgtttgtaaagaaatctgaagggataatggctacttgaattacttactgaagcataaggaaaaggaaaagctgatctgtgttcatgttatttttgtatgactaaaagtaactaatattgctgacaaaagggtatgtgaattttatatgactaaaggttattaggagctgatcattgctttgagtttagtgtcttagatataattttaatatgaaatatcaattttattttccacatttttttccaggctggggtgtagtggtgtgatcttggctcacgcaacctctgcctcctgggtttaagtgattctccagcctcagcctcccgagtagctgggactataggcgtgcaccaccacacccagctaaatttttgtatttttagtagagatggggtttcaccatgttggccgggatggtctcgatctcctaacatgatccgcctgccttggcctcctagagtgctgggattacaggcgtgagccactgcacctggcctattttacatgtttttaagcactaaccaggccttacctggaagagagggaatgagggtttttgttgttgttgttgttttaaaatataaactcaactttctccctcctcctttgaaaagggtatggaagtaagagcgtgaaagtatttttctggctgtttttaattctttggagaaattgtttcctctaaaaggtaatctaaaacaggcttatatctgatggcttatttagtggtgtattttttattttttatttattttttgaggtggagtcttgctctgtcacccaggctggagtgcagtggtgcaatcttgtctcactgcaacctctgccacctgggttcacgcaattctcctgcctcagcctacctagtagctggcattacaggtgtgcaccacgacacctggctaatttttgtatttttagtagagatgggggtttcactatgttggccaggctggtctcgaactcctgacctcagatgatctgcccaccttggcctcccaaagttctgggattacaggcgtgagtcaccgtgcctggccagtggtgtagtttttaatgccagagtttctagagttggtgacctagacagtgaatgtcagaaattacgtatatgcctagtagaaaagcctatatattgkttttcttaattatgttatatttcatgctaaaatgtttcatgttcagttggatcttttgtgagataagtaccctagctcagattttatctagattcatagtcaaccttggatttttctgttgttcaagtggttaagctccttataaggttgttgtggcgttttcttaaaggtgcagcaaggattttatgtgactaaaggttcttttaatgtttatcctatttcattatacctgaaaatcttttatagtaactgtgttgaatatgtttagtttattggtttgaatatgcttgtttggtgtgttttattaagcatcagggaaaccttgtattatagtgtaatagctttaaactgattaaaaattctttggtcatcatatatacagttccttttagatatagcttctgaatacttattcttcagttaattgtattataacctgtttaatttcttaaagtcattctgtacctctgcaggttgacatacatttttgatacttgtatgcaggaataaagttgttaatttgtgtgcatctctgaaatctgaaattataatcactttgcactagtaagtttccaaaatagtctatattgaaccaacaartcaaatataaacacaaggtctagcaaatcaagaatcttagttatcatggtgtgggacagatagttgtgttatatgccagtatcaattgccaggttggtattttattatttatttaggatggaatgaatgacagggtcttgctttgttgctcaggctggcctcaaacttctgagctcaagcagtcctcccacttcagcctcctgagtagctgggaccatagatgtgtgccattatgctcggctaatttttaattttttttgtagatagggcttcttgctgtgttgcccgggccggtctcgaactcttgggctcaagctatcctcctacctcagcytcccagaatgctgggattactggtgtgagccaccgggtgtggcctcaattattttttttttatctgtcaccaggaagatgttcagcattttgccatcctgggggctcccttatatatcctaagcaaggaattatagtttgatgtgacggaaagactgtttcagatttaaactctgattttgtgtgctcttgstcaagtccacttcatcagtttgttaaattagtaaatttaggtgattgttattttatacagttggtttacattagatacctgaacagtggaagtctccctctattcttaaatcctgtcattgttttattgttttgtttttgtttttgtttttttttgagaccgagtctcgctctgttgcccaggctggagtacagtggcgcgatcttcactcattgcaacctccacctcctgggttccagtgatccttgtgcctcagcctcctgagtagctgggatyataggtgctcaccaccacgcctggctaatttccrtatttttagtagagatggcatttcaccatattggccaggctggtcttgaattcctgacctcaagtgatccacctgcctcgggctcccaaagtgctaggattacaggtgtgagccactgcaccaggcccttaatgttttatacatagtagtttacttgccaattatttaattacatagttgtgcgaggttggaaagtgtttatagaaaacttttttcttttcagtagataaatcaacttattctgtaatcatgtataataggtgtaaccatgtgttctgtaattatgccatcatgacaggttctttccattggccctcctttacgtgagactcacgttgttgttctgtttgtcttcttacataggatgaagttactcattttaagttttagttttacttttatcttccttaggaactcttgtagatttgtgtttatgtatttttgcttattttgaggtaattcatttacttcagggccatcggttaagcctggaactgtgttttccttttcctttttcttgttcttgtttttttttttttagatggagtctcgctctgctgaccaagctggagtgcagtagcgtgatctcagctcactgcagcctccacctcccaggttcaagtgattctcctgcctcagcctcctgagcagctgggattacaggggcaygccaccacgccyggctaatttttgcatttttagtagagatgggggtttccccttgttccccaggctggtctcgaactcctgacytcaggtgatctactggccttagcctcycagagtgctgggattacaggcgtgagctactgtgcctggctgagcttttttyyccccccccaaagtttatagccctagaatttcttttcttttctttttctttttatcttttcttttcttttttttttttttttgagatggagtctcactctgtcacccaggctggagtgcaatggcgcgatctcagctcactgcaacctctgtgtcctgggttcaagcgattctcctgcctcagcctcctgagtagctgggattacatatgcacgccaccatgcctggctaatttatgtatttttagtagaggtggggtttccccatgttggccaggctggtctcaaactcttgacctcgtgatccacctgccttggcctcccaaagttctggaattacaggcatgagccaccgtaccyggccgagccctagaatttctgtggaagatgcctggtggggtgtacattggctgactctctaccctttcccccttcctcctctgcagacctgttcctttcccttccagttcctctcctcttcccctcctcctctccttttcctttcccttccctatgataacttgaaaaaatgacttttctattttaaaaagtatactagtggaagataattggctcaaaataatatttgttgttaatattggcaacttatcttaaaaaataatttgaatggagactctctcaagcatcttaattaggaaggtgaaagttaagaggaaatgagtatctggaaacatcagaaatgccttagttaagtacagttactcctagtaaccactaacccaggcctgtcataggcctgcttcattttagatatgatagaactctattcatgaacacactgcttgtctctgggactcctggattactctgatagtacctcgaagcaaggattttgccctcaaatttcctctctgtattggcaacgtacttcattagttggggctttatgtcccattatgacttcagttaaaaggatgcaccctgtattttgttttcttctgagtattagaaccatactgtctttagctaaaatagcaaccccttgggaaaaggcaacttctttttagtctacagtagtccatccttgtttgcagaggataggttctagattccccaatgaatgcctgaaactgtggatggtactaaaccctaaatatattaaattttcctttacataaatacctatgataaaggtcagtttacaaattaggtacagtaagggattaacaacaataacaaataacaaaagagaacaattatgataactactgtaagttatgtgaatgtggtctctctcaaaatatgttactgtcctgtactcacctattttcagaccacagttgactgtggataactgaaacaatgtgggtaagaggggactactctatattctaactattctaacctatagaaagtatttctgtatattaagatgtaggaggtacataaccttcctgaaaacttatggaatgacatcctaacataatttattttgttgctctgcaccaaaggtggttctggtatgtctattatttgtctggtttggatgtaaaatgcttttctaaagcttgagaaagaaaaaccagctattactacgacgtggtaaaactgcatattcagagcactaagactagggactcagtatctgtttggtgcattttaaaaatttgctatcatttgttaaactgattttgtcctcctataacttcactccattctttacaattttactacttagccaatgccaaaaaaagaatcataatagaaccgctataatcaagatgagaaacataatacttactgattcataaaatcaatacagtggttaaatctgagggtaggaaaacattcccagtggaaataatgttctttatacaggacatcttacctcctcaaggaaatctacagtttatttttgatgacggtgtagtatattataaaataataaaaactaaacttgctgaaagaaacatagtagtggacagagtttagccatagtcttgaaagtggctcaagcattaaaaatcaaagagagttttttgtggtaatattgtaaagcacaattttcagtgaaagccaaattaggttataatttttatttctatatcttacttgcatttgttcagttttcaaagacttgctggagactaatgatgttactttaagactactacaacactccgcatgtgttagcttgactttttccatcatatgcttgagaggcattcttgatacagtagaaagagcaatatgcggcaaccaaatactagagttctactcctaattttagtcttacgaccttgagtcataccctttgattaaaatattcatcgtgtctcctttgtactgttactctgagggtaagatgcagtaatatatgtaaaagtgctctgaaaactgcaagcctctatgctgtatacatttaagaagaatgttgtaatctcatcattatcttcacataccatcttcccaaccaaatcccttgagactttaaccattatgaaacatggccacacaatttgattttataccccagctttttggaatgcagtgatttttaaaaatttatttttattgtagtaaaatgaaaagctaccattttaaccatttttaagtggtaaagagcaagatttttgccctgtggtttcctctctgtattgccaaagttcattggttggggctttatgtcccattatggcatcagttaaaagaatgcattaaatggcattaagtacatgcacaacgttgtgcaaccgtcaccatatccatcatcacaaacagaaagtatgtactcattaaacagtgactccccatttttctctccctccagtccctggcaaccaactattctactatctgtcccagtgagtttgctattctaggtacctcatatatgtggaatcatggattatttatgactgacttatttcacttactgtattagtccattctcacattgctagaaagaactacctgaggatgtgagggcaatctggctgcaacatttgtcaccccattaatctccagcgttcattcgactgatctggctggctagatgggtgtccccttcctccctcactgctccatgtgcatccctcctgaagctgcatgcttggtcgaagaggacgaccatcctcgatagaggaggactggtctttggtcaagggtatatgggtagctgtgctcccctgctagaacctccaaacaagctatcaagaactacctgagactgggtaatttataaagaaaagaagtttagttgcctcatggttctgcaggctgtacaggaggcttggctggggaggcctcaggaaatgtacagtcatagcagaaggagaaggggaagcagggacaatctcgtgagaactcactcgctatcagaagaacagcaagggggaaatctgcccccatgatccaatcacttcccaccaactcttcccccaatactgggaattgcagttcaacatgagatttgggtggggacacagagccaaaccatgtcactyaccataatgtctgagttatttcactgacttatgtctgacttatttaacttatcatgatgttttcagggttcatccatgttgtagcaaaaatcagagtttggttgctttttagggctgaacaatattctattgtatgtatacatacatactttaaaaaaacctattcatctgtttgtgaacatttgggttgttttcattttttgtctgctgtgttgctatgaacattgatgtgcaactatctgagttcctgctttcagtttctttgggtatatacctacaagtggaattgttggatcatatggtatttctgtgtgttttttttttttttttttttgagggaataccaaattgttttcctggaatacagtgatcattataaggcaatatrtactgcagtttttctgactgttgagtcgaagtctaaacaattaaagaatctggttgttttcagatagctttttattgagggcttgttaaaaaactaaaaaggtagtatgtggttgggttgttcctgtcagctactttttattattatttcatgacatgttatccaacaggaatattgcaaagatttacattttataaaatgctaaaatagcataaagatgtggactgtcaaacagattgtagtagaattaaaattagaaagctataatccagtcgcttggttaacggaataaattatgtcaaattcctgattattcatttgtggttttactattttatggattgtgacaatctttaatttgttctggcttctttctactatttacctgccttctgggctctccctcattccttcttctgttcatgtatgttttagatacaagttaattttgatgttaatagaagcagtgaattttgatatgtgatttaaatttgatttttaaattatctgcactgctacttgactgcatatatacttgagaactgattttatatgtggttttaatccaatttaaatcaatactgggaatgttttgtatcttagacattattttgttttaaaaattattttaaaaaatttaaatacataatacttgtacatgtttctggggtacttgtgatattttgttacatgcatacaatgtgaaatgatcaattcatagcatttagggtgtccatcacctcaagtattcgttatttctatgtgttgggaacatttcaagtcctctttttttaaactattgtgaaatatacaatgtattgttgttaactgtagtcaccctactctgctatcaaacatttgcactttttacttcgatctaattgtatgtttgtacccattaacaacctctcttcatctcccctcaagccccacccactcacccttgctagccactggtatctatcattctgctgtctaccttcatgagatcaactttctaatctcacccataagagtgagaacatgggatgtttgtctttttgtgcttggcttagttcactcaacataatgacctctagttccattcatattgctgcaaatgataagatttccttttctttttcttttttttgagacagaatctcgctctgttgcccagtctggagtgcaatggtgcgatctcggctcactgcaacctccgcctccctggatcaagcgattcttctgcctcagcctcctgagtagctgggattagaggtgtgcgccgccacgcctggctaatttttgtatttttggtagagatggggttttgctgtgttggccaggctggtttcaaactcctgaccttgagagatccgcccacctcgtcctcccaaagtgctgggattataggcgtgagtcactgctccgggccttattattattatttttaatagtcaaattgtactccattgtgtatatatgctacattttctttaaacatttatccgttgattcacacttagttgattacatatcttggctattgtaaatagtcctgcactaaacatgggagtgcaggtatcctgttgacatactgatttcttttcctttggataaacacccagtagcaggattgccggatcatgtggtaattctatttttgttttcttgagmaatctctatgctgttttgcatagtggctgtactaatttacattcctatcaacagtatagaagagttactgttgcttcacattctcgycagcatttgttatttattatctttttaataacagccattctaactgcggtaagatgatatattgtggttttgatttgcatttccctgatggtaagtaatgttgagcattgttttttataccttttggccatttctatgtctttttcttctttattttttcatctcaaaggacacaaaccaacatttctgtgtcttcttttgagaaatgtctgttcatgtcctttgcccactttttaatgggatttttttttaaactattgagttccttgtatattctgggtatttgtcccttstcagatgaatagtttgcaaatattttcttctattcaacaggctatttctgtttttttttcttgattagcaagtggtcattgattttatttatcttttcaaaaaaacttggttttgtttatccttcctattgttttttgagtgtctgttttgttgaattctgccctgtttttttttttttgtttttttgtttttttttaagttggaattttgttctgtctcccaggttggartgcagtggcatgatcatagctcattgcaagcttgaactccagggctcaagcagtccttccacctcagcctcccaagtaactagaactacagggctctgggctgttttttttacatttttttagggatggggtcttgctatgttgctcatgctggtctcgaactcctagcctcaagtgatactcccatttccacctctcagggtgctgggctttcaggcactgagtcactgagtcaccttgattattataatttattttcttctactaattttgggttttgtttgttcttgctttactagttccttgaggtgcttcattatattgtttatttgaaatctttccatattttttgaggtaggcatttattgctgtaaatttccctgtaagcagtgcttttgttgtatcccatggattttggtatgtcgtgtttcaaattttcattcgtttcatttgttttttgatttcttccttaatttctttcttgatcagttgtctttcaggaggatgtttgtttaattttcatgtatttgtacagtttccaaagttcttgttcgtggtttctagttttattcttttgtrgtctgacttgatatgatttctatttaaaaaaatttgttgaaacgttttgtttcctaacatatggtctatcctcgagagtatttcatgtgctgatgagaagaatgttgtgtactctaactgttgtatgaaatctgtaaatgtcttttaggcctatttggtccaatgtgcagtttaaatccaatgattctttgttaattttatgtctagatctgtttaatgctgagagtggggtgttgaagtctaccaactattatggtattgcagttgatatctccctttagatctaataatatttgcattacgtaatgggtgctctgtagttgggtgcatatatatttagctactcctgcttgcttttggtttccatttgcatggaatatttttttccatctctttactttcagtctgtgtgtgtctttacaggtaagatgagtttcctgtaggcaacatatagctgagtcatgtttcttttatccatttagccaatctttatcttttaagtggaaagtttcatccttttacagttaaggttattactggtatgtgagcgcttattcctgccattttattaatttcttgttgttttgtatattttttggttttctttggcttttttgagatgggctctcactgtgttgctcaggctggagtgcagtggtgcaatcacacatggcttactgcagccttgacctcctgggctcaggtgatcctcccacctcagcccttcatagttgggactaaaggtgtacgccaccatgcttggctaatttttaaaattttttgtagagatagggttttgccacattgctcaggctggtctcaaactcctggyctcaaactcctggcctcaagygacctgcctgtttcggcctcccaaagtgctaggattacagatgtgagccactgtgcccagcctgtatattctttgttcctttctttttctcttattgtttatcattgtggtttggtggttttctttagtggtaacatttgacttcyttttctcatttgtgtatctgctctaccagttagctttatatttctgtgtgttttcatgatggtgatcatcatctttttgcttccagatgcagaattcctttgagcatttcttgtacarttggtctagttgtgtcaaattacctgtttttgcttgtgtagtaaggactttatttctccctcatttctgaaagaaagttttcctgggtgtaatcttggctgccaggtatttttttcttttagcactttgaatatatcatcccattttctcctggcctgtaaggattctgctgagaaatctgctgttagtctgataggagttcccttgtaaatgatgagatgcttttctgttattgtttttagaattctctctttgtctttgacttttcacagtttgactataatgtgccttggcagagaccttttcgagttgtatctatttgaaggtctctgaggttcctatatctgggtgtcaaaattgctttctagatttgggaagttttcagctcttattttgttaaataggttttttatcccttttgttttttctttgccttctggggcactgaaaatttgaatatttggtcactttatagtgtctacatgtcatgtatgctgtgtttattcttctttatttttatgttattggattatttcaaaatacctgtcttaaagttgtgaaattctttcttttgcttgatctagtgtattgatgaagcttttgaaataatttttgtatttcattcaatgaattctttacttccagtagttgcatttcgttcttttttatgatatctgtctatcttttttttttttttttgagacaaggtctcactctgttgcccaggctagagtacattgatgcgatcttggctcactgcaacctctgccttytgggctgaagcgatcctcccacctcaaccacctgagtagttgggactacaggttcacgccaatatgctgggctaattttttttttttttttttttagagatggggttttgccgtgttgcccaggctggtctcaaactcctgggttgaaacgatccacctgcctcagcctcccacagtgctgggattacagatgtgagcctagccctatgatatctgtctttggtaaatttctcattcgtattctaaattttatgatttcttagtattgkgtctgtatattgtacctcacttagctttttaaatattattttgaattctttttctgggatctcataaatttctttttcattggaatctattgctgcagaattatttaggtcatatttccttgctttatcatgtttcttgggtccttattgcgcatatggtataacagtcacttcttcccagttttttgaattcgctttctgaggcgagggctttttcctgaagatgtgtttatgatgttgattgggtagggcattttggcatgaatctgggtgcatgcagtggtgtagtctccgtataaattattcggctgtttacagcgttaatagtgtctgattttctcagtgatgtagggtttggtttgttagtggagtctgtggtgaggcttagctggggacaggttcaccaagtgggcctgtccttgggccttagggcaacatatgctggcactggtgttagcaggtccaggtgggctgattcttgggcctccaggtggcttacttgggtgttggtaggggcagtggttggccagttgggtgggcagattctcaggctcctgggcagcgtatgtggcatggttgatagtgggaaaaccctctgtttcccaggtggtctgtgctgataatggcagtggctgcaatgggctgggcaggccagtctccaggcctgcaggtggtgcatgtggttggggaccagctgtggtatgtaatggcagattgagtgggctaaatctcaggcccctaggagaagtgttcacatgttaacggtggtggagggggctgggtagacctgtcctcaggcccactagtaatgtgtgtgggtgttggctgtggtaggcaggggtggggtgatccccatggccccagtggagtgctcgagtggggccctgccactggggagggaagggttgctttcagtggcaccagacataaacattcagctgatgagtgggtctttgggccccaggtggcagctgtgggcagggtagtctgtcctcaggacacttgtaaaggtgtagtagctccactgcttggggcagcagggtcactgccaatagtttgtggtttagcaccagtggcagcagccagcaggagtggtggctttgggtggtgggagtcttacagtctaacttaggcctccttggggcacatgaaaatgcatagcagctctgctgctgggggcagtggggttgctgccagtggtttacactttggcttgggggcagcatgggatcacaacagtggctgtaggtggggatgtaagtggactccagggatatggagatgccggggctgtttggccccagggcagggtacagccttgttggggctgggctctcaaaacgtgctgtgctctagctgcttaggactaaggagtggaggggaccgttcatgagcagtatcatcgtgtggtccccaggcagctccctttgtcagtatgagatgattttcttattatgaaatcgatattggccaggtgcggtggctcacacatgtaatcccagcactttcccaggctgaagtgggtggatyacctgaggtcaggagttcgagactagcctggctaacatggtgaaaccgcatctgtacaaaagtacaaaaattagctggtcatgatggcagatgcctgtaatcccagctgctcaggaggctgaggcggaagaatcacttgaacctgggaggcggaggttgcggtgagccgagatcgctgcattgcactctagtctgggcgagagagagtgagactcatcttggraaaaaaaaaaaaagaaagaaagaaaaaaagaaatcagtatcaaggctgtaaggggcctacttcaagtgttcttaacttctgttttccttctaagttgtttatctagcttgtacttagacaccttaatagatacataaatatttctttgggtagggtgtatagcatacaatgtttttttttgttgttgtttttgagacagggtctcactctgtcacccagacttggagtgcagtggcgtgatcttggcccactgcaacctctgcctcccgggctcaggattctcccattttagcctctcgaagtgctgggagtagcgtgtgccactaccgcccggctaatttttgtatttttattttaatttttgaggtggagtctcactcttgttgcccaggctggagtgcagtggtgcaatcttggctcaccttaacctctgcctcctgggttcaagcgattctcctgccgcagcttcccaagtagctgggattacaggcatgtatcatcacaaccggctcattttgtaatttcagtagagatggggtttcaccatgttggtcaggctggtcttgaactcctgacctccggtgatccacccgcctcggcctcccaaagtgctgggataacaattgtgagccaccgcaccctgcttaatttttatatttgtaatagagacagggtttcaccacgttggccaggctgatcttgaactcctgacctcaaatatctatccgcctcagcctcccaaaatgttgggattaccaccaataccgtgccaggccagaatgttcgttcttttttttttagacaagtcttgctctgttggccaggtcttatattaaaacttaaatatctttttgtagcttttgccctcaatttttttttaccatatagaatactagtgctttcatttaacaggggtttcagggtgcaattttgctgaataataaattttaatgacgatgctgttttgagatagtgtttttatagtaactgtaaatgtgtaaatatgataatgatttttcaaaatagtgtgtacctttataaacataatttatgtatttacagtcacatatatggcctagaatttcctatcagtttgcaaaagtaattttatgaaaatacatgataggcagcaaaagttgaggcaggatacttgtttgttcaggagagtctatttttaagtttgtggagttctcatttagaagatgtgttgggctttgttgattacttaacagcagtagcttgggtccttaaggctttaagtagaaagcctggagttcttgtacctgggaagccctgggagttatttggcaagaggaatgtgagtacagcctcaaactaaaagggtgccaagactgacgtgaaatgaaggaaaagagaaaatagacaatgtttaaaaatgkacacagttttcaagctagtaaatgtatgctactgacccctacttacataaaatatattcatgttaggtatatagttagaggtgcattttggcaaatgtatatacttaggcaactgccattgaaatcaagataaagaatgtttctgtcgtatcacaaaattccctcattactttttactcttagtctccaccctaggcaactactgatttgcttcctgtcactactagatagattttgactgttccagaattacatatcaatggaattagactctgcattcttttgtgtcttaacaaaagtgcgtgttttcaatagttggcttttttttttttttaatttctgagtagtttgccattatatgaatacatctttctctttacttgttgatagacatttaggttatgttcagtttttggctattataaataaagctgctgctaacatttgtgttcagttatttgtgtggatatatgctttatgttttcttttttcttgagtagaattgctgggtcataagctttttttgtttgtttgtttgttttagatggggtttccctcagcctcccaaagtactgggattacaggcactagccaactcgcctggccttgtttgtttttgtttttgttttgaaagggagtgttgttctgtttcccaggctggagtgcagtgtcgtgatctcggctcactgcaacctcctcctcctgggttcaagcaattctcttgcctcagcctcccaaatcactgagattacaggcacctgccaccacacctggctaattgttgtatgtttagtacagacggggtttcaaacatgctggccaggctggtcttgaactcctcaccttcagtgatctgcctgtctcggcctcccagagtgctgggattrtaggcatgagccactgtgcctggcctggtttttatatgtttgactttgtaagaaagtgctaaacagttttccaaagtgatgttgtcattttccattcccatcagcagtgtgtgagttccaggtactcaacaccctactaatatttggagatgttattctagcaaagggtatgtgataatatattattctagttctgatttacatttctttgttgactaatgatgttatgtaggtttccatatgcttgtttgccacctrtgtatcttctttgtgaagtattttttcacattgttgtttgtctttcaatggttgtcttattattgatttgtaagaggtttttaaaaagatattccgaatataagttctttgtcagaccatatgtattgcaaawgttttctcccagactgtggcttgcctttttttttttttttaaagctatttctcagcggaagttttgaatttttaagaagcccttttaatgaaaaaawttttttcttttatgatttttgcttttgtttcttaaggtagcattgactaccaaggccatgacagttttcttctagatgtttccagttacagttttacatgtaagtctgtattgcaattcaatttaatttttctttatgatagaggtaagggtcaagggtaatatttttcacatggatataaattttttagcatcactttttgaaaaacctatcaattctttgaattgccatgatctatatatgttgagacctatttatatattcttaggtctttcatttcattgatctgtctatatttttatgccactgtttggttactgtagctttatggtacatgtgctaagcaaggtccatttacgaggcagaatccatacagtaaattgaagaatgaaattttagtataaagaattagctcttgagtcacccctgtgcagccttggtgccgtgtgcattttggacactcagcccaccttgctctctagtacttgtaagccttttcctttcaagatgcctgcagaggtgtaccatggagaaggggaggtggcgacttttgccttttaggcagaaattgcccaactcatgtctctcataatcaataccttctattccaacaaggagattttccttcaggagttgatctctaatgcttctgatgccttagacaagattcgctatgagagcctgacagacccttccaagttggacggtggtaaagaactgaaaattgacatcatccccamccctcgggaatgcatcctgactttggtcaacacaggcattggcatgaccaaggctgatctcataaataatttgggagccattgccaagtctggtactgaagcatttatggaggcttttcagtcttgtgcagaaatctccatgattgggcaatttggtgttggcttttattctgcctacctggtggcagagaaagtagccatcacaaagcacaatgacgaagaacagtattcctgggtatcttctgctgggagttccttcactttacatgttgaccatggtgagcccattgacagggataccaaagtgatccttcaccttaaagaagatcagacagagtacttagaagagaggtgggtcaaagaagtagtgaagaagcaccctcagttcataggctgtcttatcgccgtttatttggagaaggaaccagagaaggaaatcagtgatgatgaggaagagaaaggtgagaaagaagaggaagataaagatgataaagaaaagcccaagactgaagatgtgggttccgatgaggaggatgacactgataagaataataagaagaaaacaaagaagatcaaggagaaatacactgatcgggaagaactaaaccagaccaagccgatttggaccagaaaccctgatgacatcacccaggaagagtgtggagaattctacaagagcctcaccagtgcctgggaagaccacttggcagtcaagcaattccctgtagaaggtcatttggaattcagggcattgctrttcatccctcatsaggctccctttgaccttttttagaacaagaggaaaatgaacaactctgtgtccatcatgtgtggatcatggacagctttgatgatttgatgccagagtatgtcggctttgtccgtggtatggttgactcttaaggatctttccccaaacatctcccgggaaatgctccagcagagcaaaatcttggaagtcatttgcaaaaacattgttaagaaatgccggctgggcatggtggctcacgcctgtaatcctagcactttgggaggctgaggcgggcagatcacctgaggtcaggagttcaagaccagcctggtcaacatggtgaaagcccgtctctactaaaaatacaaaaattagctgggcacaacgcctgtaatcccagctacttgggaggctgaggcaggagaattgcttgaacctgggaggcggaagttgcagtgagccaagatcatgccactgcactaagcctgggcgacagaagaaggctctgtctcaaaaaaaaaaaaaaaaaaaaaaaaagaagaagaagtggcttgagcttagcttctctgggctggcagaagacaaggagaataacaagaaattagatgaggtattctctaaaatctcgtggcttggaatccatgaggactctattaactggcgacacctgtctgaactgctgtggtctcacaccttccagtctggagatgagatgacatctctgtcagagtatgtgtcttgcatgaaggaggcacagaagtccatctgtgacatcattggtgagtgcaaagagcaggtagccaactctgcttttgtggagcaagwgtggaagaagggcttcgaggtaatatatatgagtgagcccattgatgagtactgtgtgcagcagctcaaggaatttgatgggaagagcctgctgtcagttaccaaggagggtctggagctacctgaggatgaggaggagaagaagataatggaggagagcaasgtaaagtttgagaacctctgcaggctcatgaaagaaatcttagataagaaggttgagcgggtgacaatctccagtaggcttgtgtcttcaccctgccgcattgtgaccagcacctacagctagatagccaatatgaagtggatcatgaaagcgcaggcattttgggacaactctatgatgggttatatgatggctaaaaagcacctggagatcaaccccaaccaccccattgtggagacactacagcagaaggctgaggcagacaagaacaacgaggctgtcagtgacccggtggtgctgctgtttgaaaccacactgctctcttctggcttctcccttgaggatcctcaracctatccagctgcatctaccacatgatcaagctaggttagctattgatgaagatgaagtggcaacagaggaactcagtgctgctgytcctgatgtgatgtgttcctgaggatgtgtttcacatggaagaagtagattaagagtttatacctgcaaaccttgtgcccttgcatagtgtccccatggctcccactgcagctttgagtggtcctgtcccacctggckctctctgctgatatctagtattttttctcttctgtccttgtgtctaaggcaggaaacaagggcatcaagccccattccctctctactttgacagcagaattggatgttgtatatcctgtttttttgttgttgtttattttgttctgaaagtatgtaaaataaagaatatgctgtttttatacagtaaaacaacacaaaagattaccatttctggggattagcaactaaaagaggattatttttcttggcttgttgtggtatctgtaacatcatacttaatgttacagagttgcataaaagtggcaagtgtgaatatctttaccttcttcccaatcttaggrgagaagcattcagtctttcatctttaagtatgatgttaactggagtttgtagwtgcattttatcgggttaaggaagttcctgtctcttcctagtttgctgagaattttatcatgagtrggtgctgaaatttgttagatgctttttctgtacctaatgagatgattttgtggcttttctcccctttgaatgcggtgaattacattgatgattttagaatgttaagccagcctcttattacttcatttgcttatgatgtattgtcctttttatttattgctttgttcagttttctagtttttggttggatttttttgtttatgttcataaggaatatcagtcttttttttttttttkkggggggggtctgtctttggttttggaatcagagtgagccacataaaatgagttgagtactcttccctcctgttttcttaaaatagttttataggacatcaggggaaccatctggccctggtatttttcttgtggaaaggccttaaatcatgaattcattttcttcagtagataggggcttattcagattttctatattttgtgatagttttcataatttgtaccttttaaggagtttattttatctaagtaattgaatttattttcattatgctcataatattactttatcactcaatgtctgcagtactggaatgatgttttcttttttattcttcattgacaatgtattttttaatgatcttttttattggctgtagaatttggattgacattgtttttctttcagcattaaaaaagttactccaataatttctagcttgcattattattattattatttttgtggagacagagtcttgctctgtggcccacgttggagtgcagtggcatgatctcagctcactgcaacctctgcctcctgggttcaagcaattctcctgcctcatcctactgagtagctgggactacagatgcacaccaccatgcccggctaattttttgtattttagtagagacaggctttcaccatgttgcccaggctggtctcgaactcctaagctaaggcaatctgcccaccttggcctcccaaagtgctaggattacaggcgtgagccaccacgcccggcctgcttgcattatttctaatgttaaatcagcagtcactctgcatataatcagtctctttgatggattttaagattttctctttaacgctgattttcagcagtgactgtggtgtgttttgtgggtttttctttgtgtgtatctttcttggtgtttgttgagttacttagacttgtgtttatagttttatcagtttggaagttttttatcattttatcaaatttttttttctgtctcctctcgcttctttatttatttactgtttgataggttactgaggctctgggttttttttttttaaactctttatctctctgtacatcaagttagatagtttttgttaccctgtcttcaagttcgctgatattctttcttgcagtatctcatctgctcttaagtcagtccagtgagagagagagatatatatatatatatatataattttttttttcattttagaaattatattttccaattctggaagtttcctcccctctcattcctttccctctctcctctcttccctgtccctccccttccctcccctctttcgacagtttttggtttctccttattgtgcttatattttccccataattctttaacatatttacaatatatagacactaaatcactaaatccttgtctgctaattccgttatcattcattctcactttttttgggggggactaattttcttcttctttgtcacatttctttatagttagtggtttggtttttttaccccttgttttttttaatagtttgtggtttttaattggatatttcacattttgattaatatttagtgtctttttgtcgttgtttgttttttttaaaattagagatggagtcttgctacattgcccaggctgattgaaaactcctgggctcaagcaatcttcccaccttgccctcccaaaatactgggactacaggtgtgagccactgtgcccacctgtgtctggatttttaaaaaacttttaatttaaaaataattgtagagtcacaggagcttctactgggaagtcctggacatctttcccccagtctccctcagtgttcacaatttatataactatattacaacatcaaaaccaagattgatattggtacaatgcatagagtttatttgggtttcatcagttttacatgtacgtgcatgtgtgtgtgcctgtgcataattctgtgcaattttgtcacatgggtagtcttgtgtaattatccctacaatcaaagatactcaatggtagcatcaccagactcccttgtgctatccctttatggccacattcatcccctcccccatctataatcctaaacaaccattaattggttctccatctccataattagattatttcatgattgtcgcatgaatcgtattatgcaagtagtatctttgagattgacttttccactcagcataatttttttgaagtttgtacaaattgttgtgtttatcaatagtttgttcctttttattactaaattctatcctattgtatggatataccacagtttaactgttcgtattttttttttaaaaagtatggagttttgtttgttagatagttgagtaacttgtggatcagcttgacccttttgagccttttttttttttatgattaattaagcagaaattttatttccaagctcttcaaagactgttacaaacacaaataatgtatccttctaaaaaagtgtcccaaattaaatcagattcacatcatcaaagtaaaacccttgtgaagttaagaattcttttaggttgtaatgtttttatgttagtttttaatcatttacaatgttctgtgggtcacattttaaacatttttaaatatatgaaattctgtatttctttaagtacagccacagctacaaagtagaggaacgtaagaatacaaagaccaaatctgcttcatttatatacacgatggggcagcctaatgcacatcataacattaacttttccaaacaagtttgctaagaatctgctcccataattagtgttaaaaataaaacaatcttcccatttagaaaaatcaagacatcagttgattagtaaagcctattcttcctcccagcaatttgtactttctggtcttcatttaggaattgtaaattcatgagaaaagaacaaattttttatggtataaatatcttccaggaacaacagtttacaagtattcgattgtttaaataaacaaaactattttccttcctaaaatgtaaacatccagtaaatgaaacatacatgatattccaggtatagaaatcttagtaactcacttatgaaagaggtgcattttggtatgtttggtggtaaggtttttgtttatcttatgtataaaagtacttgcacaaaaaaacaagctattactatttaaaactctattccttcacccagtttcctcactcaagtagaaactcatgaatttctgtgattttggctataggacggggccacaggaaagggctgaaatatctctaaaagttagggaaaagtgttttcttgagacttgaaggcagtcattcatcactttgtgcttgaaggcattcctcagcaaacttctctcttagagtcttcagagtaaagcacaggatctgggttcccagaaggggttacttccagctagaacacccaccagcagggcatccttgcaggcattctgcatacagtactgttgaagctctgcggctgcctgagagacattgatcctctccacgccagcctccaacttgagctgctccaccaggcactgcagggcgctcgcgctagccccagaggacrtggtggcggygctgggctccgagggcccagccttgtttttaagctttattaggataggtttgaagtagcctttattctaggaatagtttgttcctatttccaaggagtggcttttctgggttctctattaaatgacaacaaagtctgtcttctgtgcttgatcacaacttcgatgtatccctgtctcttgtaagatccagtaattggtcaactaacagctccttaatagttgtttttgggcccacctttgtggagtctctctttatgcatccacgatagtattgagccacagactacaggtgaacgcctgtgcagatttctggagttctttctcattgttgcaccttccttttttcttaaatcatagtccttcactgcttgttgtctattgtctgaaagcagttgtttcatttatgtaactgaaaaactgtatttttgaggtgggtaggcaagtccagtaatggtttctccaccattgtggcaacaaaactttttgtttatttctaagttagtaatttgaaagtcaaaattgattcatctgtccaaagagcagtagtttttgttttgtgtcttaagatgttattttaacttacattttattttttgaataagaaatatgctcgtatgttttaaaatttaaatgccacaaaagatatacaatgaggtatccttccctcccttatttcccagtcacccactttccattcttggggacaaccattgttactagtttattgtgtatctgtcaagaaatttgatgcacattcttataatgtgtatcttactcagaaattctctacacagaaatgtggagatatgtatatatacatatatatatatatatatatatatatatatatatatattctccttcatattcttgtttttaaaaaaaggtaacgtactatattcttttttgtatcttatttatttatttatttatttattggagatggagtgttgttctgtcacctaggctgcagtgcagtggcgtgatctcggctcactgcaagctctgcctcccccgggttcacgccattctcctgccttagcctcccaagtagctgggactacaggcacccgtcaccacgcccggctaattttttgtatttttagtagagatggggtttcactgtgttagccaggatggtctcgatctcctgacctcatgatctgcctgcgtcggcctccccaaatgctgggattacaggcgtgagccactgcacttggtctttttttttttttttttttacttaatataacttagaggtctatgatttgattacatgtaaatattttatatatttttttcagctttgtagtatacagttatatgggtatacccataaatacgattatgtaccataagcaaattaactagttctgttgttactaatcatgtactatttcaaatagtgctaaggtgaataatctttctgggctattttccaacaccagcaaccaattctcttgattctccagacaccaagtgggtgttcaacaattcagcgtaattcagttctcacagtaaatatctggagctagtgcagaccccacagcttaagggcccattcctacaacactgctttccacttcagacaccatttgtaagtcctgcgccacctgtacttcggaccacctgctataaattgggggttccctcaacctcctcctaaggttagataatttgttaacctggctgacagaactcaggaaaacagtttacttactcttgctggtttattataaaggatacaactcatgatcacctaagtggaagagatgcgtaggaatgtgggaggcagcacagagtttctgtgcgctctctgggttcactaccctccaatcaactcagtgtgttcaaccctggaagctgatcagatctcattgttcaagagtttctatagagcttaatctcctgtctctcccacctcactttctggggtggagtcagtggctagggctgaaattccattgctcttattatttgatctttctggtgaccagctctattccaaggtcatctaggggccccactctaagtcacctcattagcataaactcagatgtgagtgaaacagactcattatgaatgagtgaagagacacctatcactgaggatattccaagggttttaggagcactgtgccaggaactggggacaaaggtcaaatagatttggccctctatatctgtggattcagtcagccttggattgaaaataattcgcatggttgcatctgtactgaacatgtacactttcttccttgtcattattccctaaacaatacagtataagaactatttacatagaatttatactgtgtgaggtattataagtaattttgagatgatttaaagtgtacaggaggatgtatatatacaaatactctacaaatacatttgttatatacaaatactgtaccattttgtataagggacttgagcatttttagattttggtatccttgggggtcctgtaaccaatcccccgtggatactgagggatgactttatatttccttctcttttttttttttttttttttttttgagatggagcctcactttgtcacccaggctggagtgcagtggcatgatcttggctcactgtagcctccacctcccagattcaagcagttctcttacctcagcctccccagtagctgggactagaggtgcaagccaccatgcctggctagtttttgtatttttagtagagacggttttgctgtgttggccaggctggtcttgaactcctgacctcagatgatccacctgcctcagcctcccaaagttctgggattacaggcatgagccactgcacctggcttaactttatatttcttattatgccacattctttgtagtatggaagtaatttcacttacatkcaagtatatgtaagatacatttctagaaatggaattcttgtatcaaaggctatgtacatttgtaatttggattttttaaaccagttttcccaccatagagattgtaccaacttattcatgtcacaaatgtgtgaagtgactgtatgtttccccatacaactttatgttacaaatttttattaagtaatttaaaaaacaaggttcttatagtactctgcaaaacatgtatatgtaaaaaaaaagacgtaatactttgttgtaattgtcaaaaaaattaagtagaaattctattatgttcacaattataaaagacttgatatacttttaacagagttgagtaatgttagctaatttgttgccattttatcatatatctccaatgtgccaggtactgttatgactttatatacgttataaaatctctaatatttaaagtaattttacaaggtgtatagaatttatattacctttatttcacagacaggaacctgagctagtaaattctaggcttaagatttgattccaattcgattctaaactctagatttttgtcatatctttaattaattttactttagtattttgatctttcccttttttgtgtagaggactaaaattcctctgatttcagccattatcctggtctttcggcattcccaaattgaattaaggaagatttctataatttgcaagaattagaagccccagggtaaaacaaagagcatacacacttgtctttctgagaagagatgttaaataccccatatagatgctgctttcttctgtattttcttatttaacttgtagaaagtaagggagaatagcaaaatagcagaattactagagagagaagacaggcagtggtagataatagtaattgggtcaggaagcctgttttaatctccaagtaacttatttgctgtttgaatatcttgttttaccatgtaagaatcagtctataggcatttatttttaacatcctagacagttactgtttaattttatctcatttagagtcctaccacagctactaagttgacttttagagcagaatatgtctttaaaaatcttggtcagcgtatttcacaaatagacaaatttcataacagtccacattttgtagactttttaaaataaaaaataattgtttaaaatttggatctttttaatttcagttgttcccccttcccatcccattttacagacatttcaacctacgaatgaagagggacacttcccttttcagtgatgaatttaaagtagaaacatcaaataaagtacttgattatgatacctctcatatttacactggacatatttatggtaagttggaccttaacagaacccttttcttccatttttttttttctacacaaagatactcattttgaagtgtaagcaaatatttcagaaaaggttataaatccagaggaggttgaattcatatgaagggtaatggtctttgagaaatgaagtaatgtttggacctatctttacatgtatgtttaatagtgaattatgaaatatctggcttctgaaaggggtgaaattttgactcagtacctctaaactgttagagttttcaaaagttttaacgacttctgtaattttctgattttccaagtaagaaattaatagtaactttgctgtgttttataagaaaacaggaaaagtctaaaaggaaacagtaaagatgatcttagccaaaaataatgtgacagagtcatctgtaggaaaatcctcccaaggcccttcttcctcagaatctatttgctttattcacaattctaacaaatttctcttgctgcatcaaattgaaaatgcatgttggggggcatcagtggcacacttaacccaatagaaagttacatctactagtagtgttgaaagaacagaacaactatagaagtcataaaaaagcttaaaaaatgaaaatcttctgggggtgttggagagaggcaaaatgtcattgttttataactgtacattagtaagtactcaagatgattctcacttaagacagtgttaaactgtttgagattatttctacacgagtgatttctactgaaaatagtaacatgaaaaattaaatgcttaaagaattttttctcatttttcgattgtgccagataaatgaggcatttctatacttaaactttctcatttgtagaataaacctaatcattaaattctttagcttttttgtactcttacaattctgtaaccaaaatgaagcgtttttcatcagtagattttcaatgtcagactttagtgttatattgtcttcttgattatttatctttctgggcaaataacttagtagttcctgccctttttcgctaggtgatgagatcaagaaaagtccgaggccgtaaatgagattgcagataaaaatcatgttatttaggccaggcatggtagcagttacacctgtaatcccagtgctttgggaggctgaggcaggaggattgcttgagacctggagtttgagaccagcctgggcagtatagtgagaccttgtctctaaaaaacataaaaatttagttgtggtggcacacctgtagtttcagttagatgggaggctgacgtgggaggattgctgagcccaggaggttgaggctacagtgagttatgattgtgccactgcactatagcctgggggacagagaggggccctgtctatttaagaaaacaaaacaaaacaaaaaactccaaatatcagygtcttgggctcttacctccagtctatgattaattcagaggcaactaattaatgttattctacaacttagaaattgtggaagkcctgatttttattttaatcagagaatcgtaatgggtaaattcaaggtttaaagccctctccctctactttcaccctttatgtcatttgattttggtgctcaccttttcgttgtgattatattaagaaccaaaagtaccttttttcctattatttcctttcactggagaagtgtaattgatgggatagtattacaaatctttgtccaatatctttaaaagtactgttggtatacttttgttcaaagtgcccatgaaatatttgacactgttctatttaaaaatgtgtttataggctgggcgtggtgactcacgcctgtaatcccagcactttaggaggccgaggcaggtggattgtttgagcccaggagttccagaccagcctaggaaacatagcaagtccctgtctctaccaaaaatacaaaaattagctggaggtggcggtgcacgcttgtagtcccagctactagggaggcggaggtgggaggagtgcctgagcccaggaggttgaggctgcacagagccatgagctcgtcactgcactccagcccgggtgacagagcaagaccttgtctcaaaagcaaaacaaaacaaaacacaaaacaaacccctaagcatagcgcagaagccaaaaggcctggcccatgcacaatatatcggatggaaaaggagcttttttcttgtggtacctgtagcaaaattttcaaaagatgctttggatgtctttattctgaaagtgtgtattttatcagtgggtttgcttgcttcttttaagttaatttaacaattaattgttttgttttgttttgagacaaggtcttgctcttgtcacccaggctggagttcagtggtgccatgtcagctcacagcaacctccgcctccagggttcaagtgattcttctgcctcagcctcctgagtagctggacttacagacatgtgccaccaggcccagctaatgttttctgtgtttttagtagagacagggtttcgctatgttagctaggctggtctcgaactcctggcctcgagtgatctgcccacctcggccccccaragtgctgggattataggtgtgaaccacactgtgctgggccaatttacaattattgatgactactgcatacatgctaggcactcagctaggtgcaaggaatgtggttggtaacaaggcagatactctatttttcattgctgttattagtaattgtatatattttaactaaatactagttgctgttcacatctcacattctgcttgatatattttatgtgaaaatttccatagtaaatttatattcaagatttaaccatatatatgtgtatatatgtatgcatgtgtgtatatatatacacacatatatacatatatatgaatgaatttaacattcatgtgcaaattaaattgtcaagaatttgttgctttcattaataggtgaagaaggaagttttagccatgggtctgttattgatggaagatttgaaggattcatccagactcgtggtggcacattttatgttgagccagcagagagatatattaaagaccgaactctgccatttcactctgtcatttatcatgaagatgatattagtaagtacttaagttttatcaagtagcctttttcaaaaggcatatgatagttaaaactgtgtggagacaaatgaagcattagctgttttctttcctgagttactaatcaggctagaacatagtttttactagcaattgctatttaaggaatagtagatatatgtaatgaggcaatttccttgtcagtccattgccagtactactttgctgatatgacataactaattctgtttgaactgtgtgagtcaaccaaatctgacggaactggaaatcgtatattttgacatcagccagtctgtgtaatgctaatacctttgtgtgtatgacctattgaaggtagaagagcatcattactacttacataaatttcagtgtggatatttgtgtagtgtttaaggaatattttaggtatttttgtaatttttaagtccattgagtatttctttttagaatcttaaggtaatgacttgacttcaagagtccacgtttatcatggattttgttctctaccatctttatatgatgatatttttctaagaatagaaaatgtatttagactttaccttttaattctattgtccgtatatccacagttatccagttattgggaatgcttctttgaagtaccacagaaataaatttctctaatttatatagctcttgaatacccatttattattttttgactgtaattagactagtctctcaatttttgcctgctttcctaacttggcagcttcttcctacatacgttttcctttgtatagacagaaatttattgtcaatgattttattcttacccctagtaatacactgacaagcattaaccattttgactttttgctccatcagctctgacagtttttgtacttcatctgtccaactgcttgttatctctgctgctagattgctatagaaaataacatatgtatactaggtaggatgcatttatgatttttagctacttgttaaatcataagctcattaatgctacttccctgtattttcattcaccactatttgattccttttccagttttaactcctggtatttcaaactctacctttcttttcaagctctaagctatcatcctccttcataagtaggaatatgaattcctttgctttcgtttctttctgctgacaaaattattatttacctggtttgtgtcttgctttgtagctttcttagtaatttaacctttttttgcagggttacctcccctatcagggtatgtaagttcttcaggtatagtttctgtttcttttgctcctgtaatattgcaagtatcatttgtctgtgcagcaggcttttcataaatacttaatgaaatactggaatatttttctagaatgttttatcaaaatcaaagaaaaccttttgaggaatgaaggagaggaaaagcgtaatctgccagattattttttcctttctatcatattgtaattatactttctccattgctttctacttgctatcagtgccctctactgtatttgttctgcctgttttgacttctgttattgtgcctctctcatgttttccttcttctgttatctacttgtgtgtagtttaagaatattcttttttcccacttttctttctttcttgtaatataattgtattttttgcatattgcatccaacagtaatttccaaatatcttaataggtgtcaatctttttttttccccaaagatgatgagttagcttggaggatgaatgacactggatgttacttgattttttgttctttttggcatttaaatgctttatcattgatatcagcttttattttatacttgtttaagtaaatatatgtttgtggtaaggagaactttttaacattctttttattattacatatcagtagtggggttagaatttaaaagcagcaatctttaaggtgattttatttgtagcttctcaggtaattgaaattgtaggatatgaggatgggagtacggaaggagttcccttaaacagagtttttaatgtttgcaaatttagacaattacttgtgaaaaactayctaaaaatctgtcaagtgaaccatggtttaagacaagaaaacattcatgtattagtcttttattctaaatagttgctatatttatattctagaccgtggttcgcaaattctctgcagagggacagagagtaaatatttttggctttgagagctgtatgttttattgcagctactcagctctgccattgtagcacgagaacagccaaagaaacacataaataaataagcatgggtgctttttttaaagaaattattatttatttatctatttttttggagacagagccttgccctgttgcccagtctggagttcagtggtgtgatcatacctcactacagcctcaacctcctgggctcaagtgaacctcctacctcagctctgtgagtagctgggactccaggtataagccactgctcccagctagcatggctgtttttaataaaacttcatagacacttaaatattaatttcatatatatttcatatgacataaaatatcattcttttgattttttctttaaccatttaaaaatgtggaagctacccttagttttcatgtcaaacaaaaacagatgggagggctcactaaatttaataattactttaattggttctttaaattctctgtgtagaatatgacaggttctagaagtagtagtagtagcagcagtagtaagaataattattatggcttaatatatacctgacagtgtataaaaatctttacttgcattattgaattgaattctcaaaataacgttatgagatactggcacacctattattcccactttataggtgaaggcttaaactgaggcttagaaaacttatgtcacttgattgtggacctcctgttctttaccctgtgctcttctgcttcactcatggaagaaagctgtaaattctcactgcctttacttcaaggatttctggggcttttctgaaatctgtaagcctctctaaaatcatacatttgcatctattgctgttttaagccaaactctctccttaatatatttagcagtgtttattttataactaaatggcaaaggatgccctttaatgtgtattattatttttatataattggtttaagtactaataatttattttcagaagtaaagtactgcattattgtatcactgtgaatgttcttaattggatttggtatcgttgtatatgttatccttaccaaaaagaagcaaatggtaggggaggcatactaaccttggatataccttttgatgagaatttggctaccctcttcttaatactgtttttgcaactgaaggcataaatgtatagaaccatcatgaaaaatgatactgctattctccagaaccttggggaatggcttctgagactgtaccagaacacagggatagttttcactgaaaatacttaataatttctctagatgtgatagtgataaatatatattgttatcagcttaaaatgcatacttatttaattctgtacttagtaaaaaacactctctcctaggacatggtagtgtgaacagttaatgacaaggtaagaataccacttagtcctctgccccttagcacagtttattttaaagaaactgagaaaaacattgttccataaactagaatagtattgttattaacatgaacaggttttaggaatatctgactatatgactgcttgcaataattcccttacaccttttttgtgtactacctatccaagagctaaaggtctgagtaatttttttattctatacttatagagaaatacttaatctccaaattaaaaaatatattttaattgtatatgaagagctgcagaataatttatttgggtttattgctttcatttcaaatttattatttattttcctttgtggggtatagaaaagcccagagaggttgaatttgcctatacctccgtcgcccaggctggagtgcagtggtgccatctcagctcactgcaacctccgccttctgggttcaggtgattctcctgcctcagcctcctgtgaatagctgggactacaggcatgtgccatcacgcccagctaatttttgtatttttagtagagacggggtttcaccatgttggccaggatggtctcgatctcttgatctcttgacctcgtgatccgcccgcctcggcctcccaragtgttgggattacaggcgtgagccactgtgcccggcctgaatttgtctataccttatagtagtagggcacccctactttagaatgtgtgttagccatacctatacttatttcttctttctcttgtgcttcaatgggaagacctcctatttcttgttctgaaaaattaagattgttaaactttattttaccatttcaagatggaggcctcttcattcatgtagaagcttcctcatttgtggaaatgtcaggatgttgcatctaaaacttttaaaatgtcaattagttccatattgtgtttttgaagttgttttctgtcactgttagtgacagggagagacaaaaggaaggaatacaagagggaagaataattgaattggtaagtattgataatagctagcattgtttgtatcattcacatataacaggaaaactgttttagaaagcattctggctatacttaggtccagtctggagattggaaatctgcataagcatattgagttgtgacaaactatgtagccaactggaaaagttgagatgtggagtgctctgattgtttgacttctgaactcccacagtgcatacaagtgtattggttaatctctctactatatgttttgaatttgtatgctttactaagcattgatgttagatactgaacttatttaagcacagtgatagtatttgaaagaaatataaaaatttagtggtattgttgactctgtcttttccttttttctgagttaatctcttgggaagtataaattaatttttctaaacaactcacaggcacagaagccgaaaagttgagaaggccacagatatgggagttattttaagaataatatttaattagaaatgtaggatactaaattggaaagttaaaaaaaaatcacaaaaaaagaggcagtggctgggtatggtggctcacgcctgtaatcccagcactttgggaggctgaggcaggcggatcacgaggtcaggagatcaagaccatcctggctaaacagtgaaaccccgtctctactaaaaatacaaaaagttagccgggcgtggtggcaggcgcctgtagtcccagctactcgagaggctgaggcaggagaatggcgtgaacccgggagtcggagcttgcagtgagccgagatcatgccactgcactccagcctgggcgacagagtgagactctgtctcagaaaaaaaaaaagagagagaaagagacagtgaggggcttaattctttttagcagaatctggaaaaaatatgcttagacttttcatattatgcatattatgcatttcatattacgtaacgttatataaataggataacagttgaaaattttagatcaagttcttttctgattagttatatatatgtatgtatatgtatacatgtatattcatatatatttatcttaaaacatcaatataaaatattttagctataatgaaatacaatgaattatttcagaaatataagatttttaaaataaaaaattgttattagaagcatttacagtgtcaaaaaaacagctgcagcttttttttttttttttggcaattacagagtggtattcagttaagagtaatacttattttgtataagctgcatcagagagaaatgaaggtgaaaaactaccatctccatatataactcatttgtgctgtgcaccaataagaacctgctttagattttcatgctggcttacagctctcatactgtttcaggcaaagttagtggttattgaaaataccaccaggatgrgctgtctgtccgtctgtctgtccttccatccatctgtatttttttttctttatgctctctcatcaactgactgtcaaggatgggctatctagagacacatttgatagtgtggttaactgttagtgtgttaactgtacagtttaaaaacaaagccttacctttaaaggtttttctttaaaaggagtgagttgtgtacaggggtgctaaataatttataaacaaggacaaacactgcactagaaccaacttattcattatgatcatcttcatctttcttctcttcctcatcctyttcatcttcctccttttccttcttattttcaacttcctcaccttcctcttctttttttttcagcattgacatctcccttttttttttttttttttttttttgctgcatgaggccttcctttagctcagtatgcagcaatatccatttcttagtttttcttcagcttcacagccttttcataaggctgcttgtcatatgcaccatatccacatctttcccagtttctttgaaacatcacgaatggataggtttggatattctccttagatttttgggcagtactcagggcaaaatgaaaagactgaaggagccctcttgggtacattgggatccctaaacttttttgtttcttctttaggagggatgtaagtttctctttaatagccatccttgtccccctttgccatgtcttcagattttcctttctctttagcagatacggctttccacctctctgagcattttttagaaaattccgagaagttaactgaagcatgagtgctgcttcttgttctcctcctggaagtttgcacaaagaatgcatatgatgaccttttgcctcttggcttcttaggatcttcttttaccaagtttagttatttttcctcagagaagcacagagtcacctagtgcacatctggctgccattygccccagcactgtctccatggaggtcaatgtactgtaatggctatcagaaatacatgattatatgaaaataaaaaaagctttcatgttgtaaagcaactttgaaagtcaccctaacaagtaaaattatatttgaaatttttgttttttcttttgagaactatcttttattttgttttacaaataaattgagtaaggaattttataattttagtattgtaaaaggcactagattcaacactctaaagatgacggaaactgaagtctagagttataaaacttgtgcagtatgacatggatccatgtcttttggctgccactccagtgctttatttctgttacattctgagttaggagagtttaaaggctgctaaaaggccaagaacttaatgacaatagagacaatgacagtaaggattaaaaaaaaaaagttatttttggtatcattgattttgaaggtgagccatatttactactgaaaaagcaaatttatattttaggctcactttaaaaaatatrtatatttattaatagagacgaggtctcactgtgttgccaggctggtctcgagctcttgagctcaagtcatcctcctgcygcggactcctaaagtgctaagatgacaggtgtgagccaccatgcctggccaaggctcaactcttataagtgatgagttacagaaaaactagaagaaatagcatttaggagtatgtgtgcgtgtatgtcctagagatactcggagctaaacctcagcctttcacatctctgatagcataattcatagatttatgtttgtaccagtgaccttataagagtgcctgaggacattggtccaggactctggccctctaaaaagctgcttctaaagaggcattgtgagatctggtttattaaagacatgttatattctgttcatgatttataaattgggggattagataatctccataagcagtcttgctatcttgtatttatatttgaacataaaagtctagaatttatagatgtggattttactggttttagcttctagagacttcttagaatcattttttataggcaagcttgtagatctactagttaaaactgttttttggtttaatttgtttgctcaagatcatacaagttagtggtcttggtacatggtagggagaaggcacaagaggtaatatgtcaaagaactgaggcatggcatatatatgaaaagagttagaaatgaaatcaaggtgatatgttagaatagctttataaccttatacaggtaatgtactttttcttggtctcattttcttcaggtataaaatgagggtgttagatcatggtgctaatatctcttatctcttctaaaagttaatggttctaaactacttttcctttaaagttggaaatatcttgattgatcatggctgacaaataaaaagtaaaaataaaaatatttttgtgctgattggsaaatgactatataaaatggctattcttgtatgtaaattaagtatttttcttaagtaaattaagtattcttgtatgtaaattaagtatattaagatgaaatgtgtccaccaccattaacatttttatgaatagcccttcagatctcatataccattttaaatttcatgtacagttatatcttagatctctttctgtgtcaataaacatagctctacatttttcctttaaatggctacataaaattctgctgtttccttgataaatgtattatttaccagcctgccaactaatggatgtatagattgtttcctcttttttactgttaaaaattgcaacaggtaacattcttgcacatattttctcccctcaatatttttatggttatttccttaagattaatttcctagaagtagcattgtcagacatttgcattttgatacatattgccagatatctctttaaaaaggttacacagatttatactcttacacctataaattaaatattgacttaataataccttcatgtatagtctgtggacacacttccccaattacttcacaaaaatgtctcctatttttttttttttaatacaggatttaatcagggtctacacattgcctttgagtgtcacatctctgtagtcagtattactcttttaacagcttaattgaggaaaaattgatagcaataaactgcttatatataaagtttataatattgataacttttgacatatgtttatgtctgtgaaactatcatagcatttaagataataaacatgcccatcacccccaaaagctttcagtgtaattcttctctcctctactccccgctaccctcttgcactaatctctaggttagtttgcactttctgaaatgttatataagcacaattatacattatgtactctttaagaaagtctggctttaactcagcataaatagtttgggattcgtccatgttgtatgtattaaaagttaataactttttgttgataaatagtagtctgttgtgtggataccatgatttgttaatacatttgcctgttaatggacattttggttgggttattacagacaaaattaaggtttttaatattaactcatcaagtattggtcgattaaagagaagataaattttgaagaggcaaggggatgaaataactactaaggaccaaaaaatcttgctctgttgcctgagctctagagagggggcatttggaaacaagacaagcaaaatacccaaagaattttaatttaagctagtagcatatacagcatgtacattctctctcctccaagctgataatacaacttaggtgtaatctcctagaattttttcctgacctcacagttctgggtatcctctctttactgctgtttatgtgttgataagtcttccctatcttttgaatccagtggtttactggtcattgatcatatgactgacctttgagaggcatggaaggaaaccagctgttgactggatgagtaaattaaattcaaccagtgtttaataaactgtggatgattgccgggagaccttaacacttgggaagttggtacttaaatgccatgcttgtttacatgtcagacacctcagctagactgacagctcttgagagtgcatgttctrtgtcatttatttttgtatccctttgtttggtatataataatttttcttaattgtttgcttaataaattaatgcagttaaaaataacattgacatatgattaggagatttatgtrtacacagctgttaattttgaatgttctgtatgttatagtcaatctgtaaagcagttaggaatttagaacacactttgccgtagaaacaatttaaagtgttagacaattcctctttattgtaggtggaatgaaggctaaaaggaggttatgggagccagcagtttataggtctttggttaatggatgacctttgaaaagaggcatagaaaccacatactggctgaaaaattaaattcaacaagtatttattggtttgtgaatatacaggaaagagaattttaaaatttcccctgaagattaaaaaccttcaggggaattttcagtaatagagagtcaaaatgtggtaaatgctataacaaaaatgttatcaaagccctggggtagtgcatactacctcagtgagggagctttagggagatttaggaagacttccctggggaggtggaatttgacttgaaccttgaagataaggggtagacttttgattgctagaggagagaatctgtgatcacaggagaagcctcagccctattactctggctgcaacaatatttcttttcagttgtcacagcttgggaactaaagaaaggaaaagagattcgcatgttctttggcctagtcacccattcacccctgtgtatagctgtatagtcccaagtcaaatacacgtaaataatggtcacttaaagttagtatgttacaagttttcattccaagtgtcagttgtaagttttacaggtttaacaactgattaatttgttaataaacattttttgagtgcctaatctgtacaagacacttttagaaactatccatacaataatgaatagggcaaaggttctgccttaaacactttagagtctagtaattctgtttgtcattgatcagaataataaagcaacatttctctggttgacctgactcccattatcctttggctgccaatagtaaccctttctttctaaaacccatggggtgagaagggacatgtctggccctcttcctcatctctgtttccagagagatcagtgttgtgagtgcttgtggaaagtggggtcattttcaacttcctcctctttctagggacaatcactctgtgcttttcttatgcccacttaccctcccaaaacagaaattagacatggggattgggaagacatgagaattggtacccgggagaaacggcctcccatccactggaattaggaggaagaacatttggagttctttcctgtctccaaacttttcatttcttctcaaaagaaaaaaaaaaaagcctatcctttcttctactctccatcagtgaatccttgttgatgtaggcaactttgggaataaatgacgattttcatggacaaggcccccacctcatgatactctggatactaacaaaaataatttttatgcataataatattattctatagaagtcattctattttaaattcaattaatgcagatttttaaaaattggctttggtgattcatggcatattattggagggattaccatccagttttgactattagagggtcatctcatagccaaggccttggatgtttgcagttaagtttctgagctgctagtcacataaggctgaggggtaccctgttggaggtagtgagggtgcaaaaagtgagtattttatgcctagttctgttgacagagaatctgaactgtaaatattcctccttgaaagagtggatgattgagagttaactagagctatttcctgcttgagttagagtcacaatatatgtactatttatatttgtgtcttgaacaacaaaacaaaagcaagaggctggcagaggaactggaagaaaggcaatagatctaaagctgatctttgttttaaataggccgaatattctacacccatgactcattgtttgtgaaagaatatgctgtttggccttttcaggggaactacagtgcatcctatgatttagcatctcartgagggcttattcattagttgaacaaaggctttttctagaaatgaggattatattgttagtaattttagagggaaaatgtcattgtccatttttatagttaatgtggtgtccaaggaaaacagcatcttttagaaattttgaaagtatatgggaaaaattgcatgcttgaccctttctattgggagagttttgtgctgacagaatttgaagcatatataaatactgttttgttgctttggaaatatttggaaattttttttaccctaagtttcaagctttcaaaaggaatttatatttttaattcgtgatatataaaattcagtttgcgaagaaataaaacactaattcttttaaaatcccaatgttttaagtaacaatgtactaaataaatgtttttttttgttcccctatacattaataaccaatggtaagtgagttttagggttttgacgaaagattttaaaggtcacagaacagttgtaattttttccccattgattattaagatcattttgcatagtttcagcttgcatggtcagttttatgactggcacttactggtgtggcaaagcaaggactgcctggtgttaactaggtgaatgaaattgagaatagactctggaaattcagttgctagctggcattaaggaactgcttgaggttatagatcatgacttttgaatgagactggaattactagtttttctttagcctcattcagcttcaggaggagcttctctctttcatagttacacttctgaagtaagtaagacaccactgcattcaccatcaactcccttcaggggygttggggtggagcacaagggagttgatggtgaatgcagtggtgtaattataataataattgactgtgggatttaaactgaataaggaagagaaagaatatctggtgatagacaataaggtggtagcattggtggattaaagggtctcactgatgttaaagggttgatggaacctagagggaatgtgctgaaaagataagtggtggaaagaaagtagaatactagaagttgagattatgaagtgctttcagttatcaatagtgacaagttcagaagagtaactatggaaatgagaaactgaggtaggaaaaaatcattggagaaaagaactgagtgtagtggaaggatcatcgtcatgaatgatgaatgatgatgaatgaatgatgaatgatgtcatcagtcatgatgatgaggtggtgtcagagagactgacagtaagtcaggatctaaaaataaggaaataagggcagtaatgacttgggtgacaacaaatgcctgtaataagttggggtagtcagtgatacagtcacgtaactgtaaaactgagctactatgagaatagtcttaatggtcctaagggagaaagtggtagatagttgtgttttgtgaaatgaggggtggggagtatcttcccaagagtaggaagagttttggggttctcttttatatttgctagagtcctcctgatggagctcaggaatactgcagaaggattctcttgacccctgccagatgatggtccagaaacatagatattctcttggtgacagccgaatgcaatatattggtgatagggtcagaataatgagtggttattgcccttttttagaattcacaaatcatctatatgacaaaaagctaaagaccagtggtttttattgagggagagcttaggaacctgctaggttttagcattaaaatgcctagcataatgccttttccataggtgcttaataagcatttatggttttcattagttaagacagttaartttttacttgtaattctcatttataattggttatacctaaatgtgtgatagtaatgacgtttcttctttgtattttagactatccccataaatacggtcctcaggggggctgtgcagatcattcagtatttgaaagaatgaggaaataccagatgactggtgtagaggaagtaacacaggtaaggattttaacactagcttgcatttaggaaatggaaatgaatttgaggatgtatatctacatttaaaatatatgttctaggatttctgaaagacttaacaccactgtggggaatgttttttaatgctcaaagaggccaggtaacgtgccaataataaagagataggactgaggtttgaatacaaatatatgtgacccaaaagacattacaagtctaaaatatactatcctttacatgttttgttataaaagaaaacaaatgttttatataaatgtaaatatttttattagcattaaaattagagtgaccacttgccttggtttgccaaggtattcctcatttttaacactgaacgttgtgtgtcagcagacaatctggttggtcatgttaataaaaatctcaggacttttcgtattttaattatttttttcccttcctttttctttagtcataggtgacaggttatagttattcaaaacataagttcaaaatgagaaaacattttttcttttatgataaaacatttatcatatattttggacatcctttctaaaagtagtatggtagagttatgtttcttgagccatgaatatttgtattcagatctattctttgatctgtaaaatggcataaacaattctgtttcaggtgggtctttctagtgttaagtgagattttattcttatatgtattgaagaagtacatattgatcttctgccatatgtcagagactgtggaaagttctgggaatatgtggagattaagatgaaggctattctcaaaaggttatcgtttaattggagacacagagaaacaatttagagtagtaggagagggttaagtataggatgatattctacacacaagaggaatagctaatctagccttataagtatttgaaggcaataatcagaccttaagaataagtaggagttaggttagccatgaggatatggaaagactattccaagcaggaggaacagtacatacaaaggccaaggagacagaaagatcagtaaagaatttttaacatgagggtagagtttaagagtagattttaggagactaatgagaagttgttgtagttattcagttgagaagtgatagtggcctgtactaatgtattggcaatttggatagaggggttgagattatagactgttagatatgatagaatttagcatggtgcttgataaaatattaatatacaaaagtaggttgcatttatttataccacgagtagactaccagaaatataatgaaagggtggacattgttaataatgtcagagaatattatatattatagaataaatgtaacaaagaattataagacctatgtaaggaaaatcaaaactttataaaaatattaaggaagattgattttaaatgaatggagagatataccatattaatgggaaataataatattataaaattatcagttctccctttattgatttgtagattcaatggtagtccaatacacattacaacaggcttattcacaacactcaatgggtcaaaaatgttatatggaaaagtaaggactaagaagaagtagggcccatttaaagacgatgaacaggaaagagggaaagagggatttaccctaggaggtattaagacttgctataataattgagagtgtgatagcacaaggatggacaaattaactagcggaataaaaatgagtgcttagaaaaagacccatgcgtatatgaaactttgttatgtggtagagatgcaatctcaaattagtaaggaaaagtgaggaccattgaataaatggatccagaaaaaaatgtttatctatttgaaaaaagatgaagttggatcaccatcctacaacaataaagtccaggctgtaaatgaagtccatatttacaacaaaaaagtctagatggattgaagttttaaatgtctaaaatgaaaactttgaaacttgtagatttccctttcaagctgtgatagagtaactgatatctaactaggctttctacaacaaacaactagaaaaccaaacaaaatatttcaaacaattattttcaaacattagaaaacaagcattgcaggattgatatctgagtgaggaaataaatatctctgtgatttccctgccttcttggctggagtcgaaatttcagatatgacacacagaaggagatctcaagaaggataaaaacacagcagtgttgctgagttgaagagttagaattaagagttcaggaagactgaggtgtctggacttacgggcgcaatacctgagaggagagagctgtgttgagaaaaagctccagatatctgcacaggtgttgctttccttgagtcttagctgaatactaagctgtgcctgcctgcacgggatgaaattctttgagaaaaccatgagacaaagaaaaactacctggactctgtgaaatgaacaactgtcaaaaacaatacttgggccaggtgtggtggttcatgcctgtgaatcccagcactttagaaggctgaggcagcaggaccacttgaggccaggagtgcgagaccagcctgggcaaactagccagatctcatctccataatagtaataattattattatttttaattagctgggtgtggtgatgagcatctgtagtctcagctactctggaggctgagacgagaggatttcttgagcccaggtggttgaggctgctgtgatccatgattgtgccatggcaccccagcccgggcagcagcgcgagaccctgtctctaaaaaaattacacttattagatatcccaagccgtggtagtagcagggctaacctagccctagagtagaagctacttcagacctgcccttcctaagcagaaaaacaaacctcaaaaatgtcaaactgcttttcaaataaattagctgtctgtcagagaaaagctcaataatatttgttaaaggaggacactaagtccagttactcagcagtataacattcagtgttcagyattcaaagaacattactagatgacaagaaactgaaaaacgtgattcataataaggagaaaagccacctaaatagaaacacaacgtctgttaattacagatgttaacaggcaaggactttaaaacaactattattagtatgttcaaagaattaaagacatgaacacaaaaaggagagaatggaaattctaataaagaaccaaatggaacttctagggtgaaaaatatattatctgaggtaaaaaatttagtggataggcttaaaagaaaattaattactgcagaactcaatatgaatatacttgagtaaaggaaaataaaatagacagtatccatatctaagcacagagggaaaataattgacgtccagcaggaagagatgcagaaaaaaatatttaaaaattaatgcctccgaatttttagatactaggaaaaatttcaattcatggtccaagaaactcaatgaaacacgtgcaggataaacacaaagaaaaccataccagggtatgttacaattaaattattggaaacacctgaaaatcataaaaaaccataaaagcaggcagagaaaaggagatacatttacatacaggggaacaaagataagtataactggtgacttctcattacacagtacaaactggaagacatagaataacatcttcaaagtgttgacagaaaacctgccaaactaggattctatattcagtgaaaataattttcaaaaacaaggcaaattaaagatctttttaaataaaaattgagagaatttgtgtctaggtgacctacactgtaagaaacattaaaggaagttcttcaggcagaaaaagataccagatggaaactcggatacacacagaagagtgaagaacataaaatagtaactatatagataaatattaagcagttttttctcatttaaaaaaaccttcaagagattattacctaagtccaaataataaggtataatggattttgtaatatacagagaatcaaaatttatgacagtagtgcaaaggacaagagaaagaagaatagaagtatgtttcttaaacaatttgtgaagtgatgtaattttgacaggtaaactgtgccgtgataaagatggatattgtaaaccgtagagccggggtcagcaaactacggcctgtgggccagatgtttgcttttgtaagtaaagttttattagaacacagccacacctattcattgataggttgtctatggctgcttttacattatagtggcagaattgaagagttgtgatagagaacaactacatgttgttcaaaagtstaaatgtttactattaggccttttcagaaaaagtttgcaggaatttcctctgcccttggagcaaccattgaaaaaagaagaggaaataatttaacatgttaataaaataaatcaaatgtatttaaaaacagttaagagaagttaggaagaagagaaaaaggaacaaaaaactgatgggataaatagaaaataaatagcaaggtggtaagtttaaatctraccatattgatgactgcattaaatataaatggactgctgaggtgtgaagattgcttgaggccaagagttcaagaccaacctggccaacacagcgagaccctgtctcaattttttttaattaaaaaaatataaatggactaagcacgttaattaagaaactgagatggttagagtgattaaaaaaaaaagaccaaatgagcgtaaaagaaatgcaatttaaatgaaaagacacagttttaacatttaaagagctaggtgagatggttcactcttgtaggcccagcttgtcaggatgctgaagtaggaggattacttgaatgtagaaggttgagactgcagtgagccatgattgattgcaccagtgtactccagcccaggctgcagagtgagaccctatttaaaaaaaaataaaaagaaaaaaaagaaaagaaaatagctaattgttttggatttgggtcataaaatgatggaacagaaattgggtttagttaattatgctatgaattaatttatggatccatattctcagagtttatccttaaagacagtcttaaagtccttaagaaaataaagagagaacggccaggcgtattggctcacacctgtaatcccagcactttgggaggccgaggcaggcggatcacaagatcaggagatcgagaccttcctaacacagtgaaaccctgtctctactaaaaatccacaaccaaagttagctgggtgtggtggcggacgcctgtagtcccagctactggggaggctgaggcgggagaatggcatgaatccaggaggcggagcttgcagtgagccgagattgcaccactgcactccagcctgggcgacagagtgagactctgtctcaaaaaaagaaagagaaaacttcataacacattttatgagggcagtgttactttgatagtcataccagagacattacaagaaaactaagctacagggcaatattcctcagaaatataaaagtaaaatttcttaaaatattagcaagtgaaatccagcaatatatataaaaaaacacattatgctcaaatgaagtttataccagaaatgcaaaattgattaacattagaaaatttgtgtaatccaccacataaacataataaaggatgaaacccctctgattatctcagtagactagtaaaaaagcattgccaaatttcagcactcaacacatggcaaactaaaaatagaaggaagctttcttaggctagtaagagctttttataaaaaacctacagctgataccatgcttaaaagtgagagactaagtccttttcctttgagaccaggaataaaagctttttttttttcttttttgagacggattctcgctctgtctcccaggctggagtgcagtggtgtgatctcggcccactgcaacctccacctcccgggttcaagtgattctcctgcctcagcttcctgagtagctgggattacaggtgcgcaccaccacgcccacctaatttttgtatttttagtaaagatggggtttcaccatgttggtcaggctggtcttgaacttttgaactcatgatctgcctgcttcggcttcccaaagtgccgagattacaggtgtgagcccactgcgcccagccaaggaataaaaacttctactcagcattatacacaaagtcctagccaccataataaggcaagaaaaataaatgaaaggcatacagattataaaggaagtagttaaaggtaatacaagagtatacctagaaaaagttactagaatcaataagcagacttatcaaggacataggctaaaagttggtataatcagtcgtattctatatactggcaatgaatatttagaaaatgaaaaaaattaaaatagcatcaaaatataaaatatgtagaataaatttaacaaaatatgtgcaagatgtgtacatgaagaactagaaaacattgccaagaaaaattaaagattaaataaattgagaaataaactttgtttgtggttggaatcctcaatgttaatatgtcagttctccccaaattgttctgcagattcagtgcagtcagtatcaagacttccagtggacatttatctagtagttgacaaactgattctaaaagttatactgaaaggtaaaagatctagaatagacaaaacaattttcaaaaaagaacaaggatggaagatttaatagtatttggtttttaagacttagtataaagttacagtaatcaagatagtgtcatcttgacctaagggtaaacatgtaggtaaatgtagcaacatagagagtccacatggtcagttgatttttgcaaaagtcccaaggtaatttaaaagaggaaagaacagtcttttcaacaaatggtactggaacaattggatatccatatgaaaaaaaaattgagattcacctgtacttcacaccttatacaaaaattaactcaaaatggaaaatggacctatatgccaaagctaaaactaaaactaggaaaaaacataggagaaatttttgtgacttgtgataacaatttctcaaggcacaaaaattccctatgaaaaacatgtataaactgacttcatcaaattgaaaaaccttgcctcaaaaaacatagttaagaaaaataggaaaacaagccacagactgagaaaatgtccacaatgtctctgataaaaggcttttttccagaatagtaaagaactgttataactcagttaagaaaaaaaaaaaaacacaaaccccaattaaaaaatggacagtgcacctggaaagcctttccaagaaggacaggcacaaataagcccagactrtgaggactacagtgaatacgtaactcttcaatgcccagacgtgaaccaacatccacaagcgtccagaccatccaggaaaacatgacttcaccaaagaaactaaataaggcactggggacaaatcctggagaatggatccagagataggtgacctttcagatagagaattaaaaatagctgttttgaggaaactcaaagaaattcatgataacacagagaaggaattcggaatactatcagataaatttaaaaaacattgaaataattaaaaagaatcaagcagaaattctagagttgaaaaatgcacttgacatactgaagagtgcatcagagtctcttagtaacagaattgataaaacagaagaattagtgagcttgaagacaggctatttgaaaatgtaaagtcagaggagacagaaaaggaatactctaaaagaatgaagaacacctataatatctaggaaatagcctcaaaagggcaaacataagaattatgtccttaaagaggaggtagagaaagagataggggtaaaaagtttattcaaagtgataataccagagaacttctcaaacctagaaaaagatatcaacattcaagtgtaagaaggttatgaagcaccaagcgtatttaacccaatgaagactaactcaaggcatttaataatcaaaccagcaaaggccataaagaaaagatcctaaaagcagcaagaaaaaagaaacaaataacctacaatggagctctgataaatttggcagaagacttttcaatagaaattttacaggccaggagagagtggcatgacatgtttaaagtgctgaaggaaaaaattttttatcctatagcagtatattcagggaaatagccttcaaacacgaaggagaaataaaaactttcccagagaaacaaaaacagatggatttcatcaacaccagacttgtcctacaagaagtgctaaatagagttcttcagtcagaaagaaaaggatgtgaatgagcaataagaaattatatgatggtacaaaactcattggtaataataagtacacagaatattgtgtatctgtgattatggtatataaattactcatatcttgagtagaaagactaaatgatgaactgataaaaaataactcttcaggatatagacactacaataaggcatgaatagaaacaaagttaaaaagcagggggacaaagttaaagtgtaaagtttttattagtcttctttttgcttctatawttatgcaatcactgttgtcatcagtttaaaataaggattgtaaggtagtatttgcaagcctcatggtaacttcaaatcaaaaaacatatgatagatacacaaaaaataaaaagcaagaaattaaatcataccaccggagaaaatcagcttcactagagggaagtcaggaaggaaagaaggaagagaaggccgcaaaacaaccagaaaacaaaaaaacaaagtggcaggagtaagtccttacttatcagtaataacattgaatgtcagtggaccaaagtctctaatcaaaagacatagagtagctaaatggattaaaaaaccccgaagatccaatgatctattgcatacaagaaacacattttacctgtaaagatacacatagactgaaaataaaatggtggaaaaagatattccatcccagcggaaaccagaagagcaggagtagctatacttgtatcagtcaaaatagatttcaggacaaaaactgtaagagacaaagatagtcactatataattataaagggggctgggcctggcagctcacgcctgtaatctcagcagtttgggaggctgaggtgggtggatcacctgaggccaggagtttaagaccagcctggccaacatggcgaaatcctgtctctattaaaaatagaaaaattagctgggtgtggtggtgggcatctgtaatcccagctactcaggaggctgaggcaggagaatcacttgaacccaggaggtggaggttgcagtgagctgagatccggccactgcactccagtctgggtgaccaaaccaagactctgttttcaaaaaaaaaaaaaaaaaaaaaggaatatatatatatatatatatatatatatactatatatatatatactatatataatatatatatgtatgtatggtatgtatgtaggtatgcaaagggttctgttcagcaaggaggattaaacagctgtaaatatatattaaaaatggttggatatttgtctcaggcccaaactttttggtgaattgtaatcctcagtgctggaggtggaactgggggggagttgtttggatcatgggggcagatccccccatggctgggtgctgtttttgtgatagtgagttctcatgagattgggtggtttagaagtgtgtggcatcttcccccacagacattcttgcttggctcctgcttccaggcatgtcatgtgcctgctcccccttcactttctgcccatgcttataagcttcctgagacctctctagaagccaagcggatgccagcaccatgcttcctgtaaagcctgcagaaccatgagccaattaaaactcttttcttgataaattactcagtctcagttatttctttataacaacgcaaaaatggcctaatacgtatatgcacccaacactggaacacccagatatataaagcaaatattattagagctaaagagagagagatagacttcaatacagtaatagctggagacttcaataccccactttcagcaatggatagaccttccagacagaaaatcaacaaagaaacatcagacttaatctgcagtatagaacaaatggacctaacaggtatttatagaccatttcttccaatggctgcagaatacacatttttttctcctcagcacctggatcattctcaagaatagaccatatgtttggttgtaaaacaagtcttcaaacattcaaaaaattgaaataatatcaggtatcttctctgactacacttgaataaaactagaaatcaataacaaaaggagtctttgaaactatacartcacatggaaagtaaacaatatgctcctgaatgaccgataggtgagtgaaaaaattaaaaagaaaattggaaaatttcttgaaacaaacgataatggaaacacaacttactggctaggagtggtggctcatgtctgtaattccagcactttaggaagctgatgtggaatgatcatttgagcccaggagtttgagaccagcctggggtctatagtaagaccttttctttgcaaacagtttaaaaattagccaggtgtggtggtgcatgcctgtagtcccaggtccttgggaggctgaggcaggaggattgcttgaacccaggaggaggaggttgtggtgagaaagattgtgccactttactgcagcctgggcaacagaaggagacgctgtctcaaaaacaaagaaaacacaacataacacaacgcgtaggatacagtaaaagcagtactaagaggaaagtttatatagctataaatgcctgcatccagaaagaaaacttcaaataaatgcactaacaatgcattttgcaagagcaaaccaaacccgaaattagtagaagaaaagaaataataataaagataagagcagaagtaaatgaaatagaaatgaagacagtataaaagatcaaagaaacaaaaagttgttttttgaaatcgtaaacaaaattgacaaacctttagccagactaagaaaaaaaaaagacctaaataaataaaatcagagatgaaaaaggagacatcacaagtggtatagatgaaattcaaaggatcattagtgggtactttgagcaactatatgccaataarttgcaaaatgtagagaaaatggatacattcttagacacatacaacctaccaagattgaaccatgatgttcaaaacctgaacagaccaataacaagtaatgaaattgaagctgtaataaaaagtcttccagtaaagaaaagtctgggacccagtggcttcactgttgaattctaccaaatatttacaatataactaataccaattgtactgaaactattccaaaaaatagaggaggagggaaaacttcaaactcattctaggaggccagtattactctgataccaaaascagataaaggcagcaaaaaaagaaaatgacaggccattatgtctcatgcatattggtagaaaaattatcaacaaaatactagcaaactgaatttagcaattcattaaaaagatcattcatcatgactaagtggtatttatcccagggatgcaagaatggttcaacgtatgcaaatcagtcagtgtgatacatcataatggaatgaaggacaaaacttatacgatmatttcaattgatgctgaaaaagcagttgataaaattcaaaatcctttcctgataaaaatgctcaaaaaattgcgtatagaaggtacgtatctcaacataataaaagtaatgtacagtgaatccatagctagtatcatactgaatgggcaaaacctgaaagccttttttctaagattgggaacacaagaaggatgccttctttcagcactgttactcaacatagtactggaggtcctagctagagcaatcagagaagtgagagaaataaagtgcacccaaattggaaacaaagaagtcaaaatatccttgtttgcagatgatataatcttatatttggaaaaacccatagactccwccaaaaaactattagaactgrtaaacaaatacagtaaagttgcaggatacaaaatcaacgtacaaaaatcagtagcatttctactgttgtttccagcaacaaacagtctgaaaaagagaagcaatcccatttgcagtagccacaaataaaattacatacctaggaattaaccaaagaagtaaaagatctctacaatgaaaagtataaaacactgtgaaagaaatcgaagaagacagaaaaaaatggaaagatattctatgttcgtatatcggaagaatcagtgttgttaaaatgtccataattacaaaaggcaatgcaattgctaccaaaatgccattgtcattcttcacagaaatagaaaaagccatttgaaatgttttatggaaccagaagaaactcagaataaccaatgctatcctgaggaaaaagaacaaaattggaggaatcatattacctgacttcagattatactgtagcgctatagtaaccaaacaacatggtactggcatgaaaacagacacgtagacccatggaacagaatagagacctcagaaacaaattgatacacctacagtgcattttttacaatggtgccaaaaacatccattggggtaaagacaatctcttcaataaatggtgctgggamaactggatatccgtatgcagaggaatgaaactagacctctatttctcaccgtatacaaaaatcaaatcaaaatgaattaagacttaaatttaagtgctccactgtgagactgctgcaagaaaacgttgaagaaactccccactttcatgtggacaaaaatttcttgagtaaaaccccataagcacaggcaaccaaagcaaaaatggacaaatgggatcacatcaagttaaaagctgcggctcagcaaaggatacgattaacaaagtggggagacaacccatagaatgggagaaaatatttgcacactacttgtctgacaagggattaataaccagaatatataaggagctgaaataactctatagaaaaaaatctaatctgattaaaaaatgggcaaaagatctgaatagacatttcctaaaagaagacatacaaatggcaaacaggcatatgaaaaggtgctcaacatcattgatccttggagaaatgcaaataaaaattacagtgagataccgtctcacctcagtaaaaatggcttttatccaaaagacaggcaataacaaacgctggtgaggatgtggggaaaaggaaaccgccacacactgttggtgggaatgcaaattagtacaattgctatggagaatagttcggaggttcctcaaaaaactacaaatagaactaccataatccagcagtcccactgctgcacatctacccgaagagatacatcatagagatagctgcactcccatgtttgttgctgcactgttcacaatagccaagatttggaagcagcctaagtgtctgttaatagatgaatggataaagaaaatgtggtacatattcacaatggaatactatttagccataaaacagaattagattctgtaatttgcgacaacatggatggaactggaggtcattatgttaagtgcaataagctaggcacagaaagacaaacttcacatattctcacttatttgtaggagctaaaaattaaaacaatttaactcatggagatagagagtagaaggatggttaccagagggtgcaatgagtattagagcagtggtgggggaagtggggatggttaacgggcacaaaaacatgttagaaagaatgaataagacctagtatttgaaagcacagcagggcaactatagtcaataataattaaattgtacattttaaaataactaaaagagtgtaattgtattttttgtaacaaaaaggataaatgcttgaggggatggatgccccatttaacatgatgtgatttacacattgcattcctatcaaagtattatatatcttatgtaccccataaatatatatacctatgtattcacaaaatttaaaaacaaaaaataaaaaaatttaatagataatgggcaaaacatttgaaaagacacttcacaaaagatattataaaatattttggattttgatctggagaaatggtttgaatatgtaagacttttcagtataaaaaagatgaatatatttcactatatgaatattaaaaataaaagacaccttaaagtgaagacaagttataaactttgtataaaattttatgctttcacaatgtataaaattaataaagaattgtttttaagaagtagagaacaactgattagtacaactaatatatagcaacctggcctgaaaataaaaatattttaaaaatatatgtgtatgtatatttccatatacgtgttttgtatatttgtgtgtatttatttgaaggcattggaaagataacatgactgtgaagtagtacgcggccaagatttcagaaaaaagtatacagctagaatggtgatactggtatttggttctaccttttctccaggtgtgtctttgagtttctgaggaggtggctgagagactgagagggagagtagaactgtgcagacacatgaggctgaggatgaaaatattgtttaggatctgcccagaagagcttttggttgggaccttgaaggactactccctaagaataagggtataaattataaaatgttcagtctctcttcacagggattaaagtttcacaccacatctcagtccctaactggattaaggtgatccaggattactagtgcaccaagcctaactctgcttaccagaagtgaaagtaaatcttttgagaaaggtgtcaatcacaacttcacatcaaatctgtggttatccatatacatagcctggcactcagttcaatgtaaccagtatatgaacaaacaaaacaacatgatggaagaacaagagagtcaactgacaaaggaaatggtacctggataagaaaattatctgacacagactttaatatattcaagtcataaagactaaatttaaaattttagcagaaaattgaaaattaacaaaagaacttgatgggaaatttagaattgacaaatgttaacaacaaaaattaggaatttgatggatttagatttggatagtataagaaaatagagcaaactgctaagaaaaggatggaaaatacagaaaagagcataagagaaatagatgataccttcagaaggtctgatatatgtattatgtaattgatgtcctagaaggaggaaaatggagagtcaaggacaggtaatggctgagaatttttccaatgtaacagagagatatcaaacaacacattcattaagccctgtaattagggcaggataaatgctttacactgaaaacaataccatagcacattatttgagaagtccgaaagccaaagatataatcttaaaagcagccggtgagaaaaagtttaatcactcttaagcaacagtaaacatggcagctcatttctcattggaagcagttaaaaagacagaagacagtaggatatgctgaaacagagaaactgccatcctctaggatgctctactcagaagaatagatcaaagtaaaattaacacatttcaaatggaatatataaccatctgacacgctaaaagtagtttttttcctgttgaaaagattgcgggctcaaatgctaacttgtagatgaagtattgaataaagaacacattagataattttgagtattgactgtatactacaaagcactaatagtaaagacttgtagggtggtatatatttgtatgttgtgtatgtggatatagagggagttaaaattggagtgagaaaaatgtaatttaagtgttctgaggttcttttctaggaacaagtaaatgttataatttatatttgattttggtaagtcaagtattagtaaaatatataactaacaagctaatgggggaagggatagaataaaaattcaaaatccaaaacaaggcaagaaagaagttaaagaagactattgaacaggcaggacaaatagaagataataaaattggagatttaaaccccaaaatatctgtaattatattaaaggtaaatggattaaatgcacygattaaaagataaatattatcagattggatttaacagcaacaaaaccccacaaactgttttacaaaaactgctcctaaaatataaggatgcagaaaagatggaaagtaaaacagcacaagatgtaaactttgatgactctaacaaaaatatgtctattatcagccaaagtagattttaaggcaaaaaaaaagcattactaaaatagatatgtcataatgataaaaagtttagttctccattatgttatagcagcctttaatttgtatgtccgtaatattataacttcagaatatgtaaggcaaaagttgacaaaaccggaaggaataatagaaaaatcatatgataaataagagaacagttgtacaaaaaataaaacccagtgaagatatgggagagctgaactacttgatataataaacttgaacacctttatgttatttttttctgcttggaacactttttcatatttcagactgwtttcttatttaaaacctttctttaaatagaattttcacattaaagcatccagttttttttcctttggtctggagtagaaaatctttcacacataaaacttcaccattagctaagataaattcctttttgtgtggaataacatgattgtaaatataaactgcatttcacaaataacatggatttgaaatacttctcaatgtttgagtcatttacaaactgtgtaaactgagacctggagaccatctaaatcaaaatcctgagtggaacagtattcaaggtaggctttggggacagttcccccaaatgttacactgtttcagtagtgttggtacccatctataatacaaattgttttaaaaataagttttattgtgtatatatcaggtatattacatgatgttatgggacacatatagatagtcaaaatggttactatagtgaagcaaataaacatttccatcatttcacatagttacccttttttgtgtgtttggcatataatacaaatttttcattttgtgtatgttcacatggaattattaagggagaaggaaatgtcaaggaagaagaaattgtgacttaaaattcaatttgggttctatattactgtgccatcaaaaatacttaagatgatccttttaggtgttcacaaatgtttgactggattcaatagcagtggtaattctttgaagaaatacttaattgaggccaggcacagtggctcctgcctgtaatcccagtacttcgggaagctgagacaggaggattacttgagaccaggagctyatgaccagcctgggcaacataggaagacctccgtctctacaaaaaaattaaaaaattagccaggcatggtgatacatgcttgtagtcccccagctacttgggaagcttaggcgggaggattgtttgagcccaggagtttaaggctgcattgagctgtgatcatgccactgcactccagcctgggtaacagagtgagactctcaaaagaaatacttggcgggggtggtggctctgtaatcctagcactttgggaggccgaggcgggcggatcacgaggtcaggagatcgagaccatcttggctaacatggtgaaaacctgtctctactaaaaattcagaaacaaaattagccaggtgtggtggcaggcgccggtagtcccagctatgccggaggctgaggcaggagaatggcgtgaacccgggaggcggagcttgctgggagccaagatcgtgccactgcactccatcctgggcaacagagtgagactctgtctcaaaaaaaaaaaaaaaaaaaaaaraaaaaaatacttagtgtctactctttgctgccaagcctgtgttaggtgatagcattacagtgaggatcaaacagagataatttcttctttccagaacttacattctagtgggtgaagtgggatgtggacagaaattaaataatcccacaaataaatgtaaggttgcactatgtaagagacattggtrtatgattctatggagtggtataatggatgaattgaccttctcgaagtctaaggaaagaaggaagccattaacaagatcagaagaggtagtgtcagcatgtgcaaagactggcaggagatagactgtgtgtggaggattggaaagaaagcttatatagctgtaccacagacagctagagttggctaatgtagggtctctttgtgaagtaatgtggaatgagaaaagctggatagttaagtagaggctgtgtaatgttgatatttaggggagcatataaagaatattgggcttaatcttttagagcaataggaagtcattgaaatacattmttgaggtggatgacatattcaaatttgcgttttgaaaacattgcaatatggagaagagatgtaaggccattagtggctattggttgattaaactgatcttactgcagtactctaggtaacaagtaatggtagcttgggctagagtggtggagccagagataatgggtagataccttaggtatttaggagataaatttgacagaactggatggtagatgggtattagatgtgaggtagagaagatatcaaagtagtataagctattatacaacttgctttagatttaaatgaatacatattaaaatacatgttttgaaaatgtttaaaagtgaaggagttccttgaatagatagtaaataatctatatggagaagattatgagacaaagtgattttatgaacttttaatggcagcagaaatacctatggtgttatataaagcagaatatgaaattgtttatagtatgtattcttaattagataaaatgatagtattgaagcatrctaattgtcagaaatgactttttgatgtatagatacctcaagaagaacatgctgctaatggtccagaacttctgaggaaaaaacgtacaacttcagctgaaaaaaatacttgtcagctttatattcagactgatcatttgttctttaaatattacggaacacgagaagctgtgattgcccaggtatttatgattatgcgctattttagtagttcccatattgttttataatgcctattctttcctttaaaaatttaagttagtgtattctstttttgggaaaaagtatgtgttttcagttgtgatgtgataaaatgtgtaagataagtacatggataactgaaagaccagttgggatattttagtgtcaaaagagaggggtaagacaatgatttcctgaaggagatgatgacactgaagtttagctttggaaagagagttgaattttcatttgtggtcttaaaggagggaaagttggaggaatccttccaactggaagtatttaattttttttctgtatttttattgtatgtagcactttctaagttacattattatttgtacttgtgtcttctcaaccctcattaaagtataaatattttgagggtgcccttcaaaatgtccttcgtgtggaaggtacccagtgagaatttgatgaatgaacttttgactcaaaggatttgaaatggagaagatggaggtacgactagtataaatgaatcattttggtggtgaggatgaacttccttttaaacatgtataaaagctaggtagttcttcccttaggattttgaaaatgtgaaactagagcttgagggaagggtagccttgagagattgaatgtggaaagaatgaaaccaaaggagaagaaattggagctatctgtatatggtgaataggttgaggaagagaagctagtgaggaaaacataatagtaataaggtaggagattttgtaggatttaccaaggaacaaataaatttcaagacaaaatagcgtgaattttataatgagccctatgagcagttaggaatttcattagcagtgtttggcagcgtgggctacctttgaaatgattattgttaatgcttttacttgaccatcttgttttatgttttatgtttatgtttttacaatttctttgaaaataactttgagactatacatacatgttttcacataaatggtagcaagagtactttttgtaaatgaagttgggaaggttgtttacagagtggtttagaagtcagaaagtttagttgggggtcagctaggtaaacggatacttttgggtttatcatcgtttatctccttgtagaatttagcaaaatctgaatgtatgtttattatatttgtattatctccctcctttcttccgctactaaagtaagcctctgtaaatttatagggaccttctgtattttgttcaccactatatccccagtgcctaaaacagtgccaagaatatagaaaggggtcaacaaagtttacagaatgtgcagcaatagaaggattaaagtcagggaatgactgtgtgtcctgagccatcagggaagttcttataaaaatgtttgagctgagtctgaaggataaatagagaaggatactctacgcataggaaatatgtgaaaaggaatggacgtrtgacgttgtaggattggattgaggaaacaaaatttttatgtgactgaaacaagagtatatgtttaggccagttgtggtggctcatgcctgtaatgccagcactttgggaggcccaggtgggtgggtcacttgaggtcaggagttcgagacgagcctggccaagatagtgaaacctgtctttactaaaaatacaaaaattagctgggcatggtggtaggcgcctgtaatcccagttgtttgggaggctgaggcaggagaatcacttgaatctgggaggcagaggttgcagtgagccgagattgcaacactgcactccagcgtgggcaacagagcaagactcttgtctccaaaaaaaaaaacaaaaaaagaaaaaaaaaaaccgcaaagaagtatgcatgtttattgttggccagaggagtctggaaaagaaagtagaatctcccttcccagcgcagctcactaatcttttttatatttatgtccagtatataatgttgacattttaaaatttgaatgtggcaggacatgaataattactgattttggaaatggaaatttataatctttttcatatttcaacattgcctctaaaatgttcttttttttaaatcatagatatccagtcatgttaaagcgattgatacaatttaccagaccacagacttctccggaatccgtaacatcagtttcatggtgaaacgcataagagtaaggaacttaaatagttaaaaacacttaaaaagtgaaacagtccagactatgtttacacacacacacaaaagcttgcttttaattttatctttatgrattaagtagtttagtttaattgtatctgttgatgcagttttttactcctggcatttacacacccacacacacacagatacttgggtttatgatttaagaattaaatgtataaggtcttaatccagtctacagtagaggtaaagtgtgtattcagtctgtctgattaacatattattaagaaagctctgacccttcaataactatggctatagtgcttgacttttccccaattatccctcagtttcctaaaatttgctttgtgcagtgtttttcactgtatgttccatttggtgttccaggggagaaaaaggataaatacagtgtttaaataaaattggaagttggaaaaacccttagtactataatcttcttgaaaattcacaactcacagtaacatatatcaagttttgagaagtctttcaggaaagaaacccatatttttctaaatttttgaccatgaaactttttttttagaaaaaatatattaacatcaacagattccaaaatactttaggcattttgagaaaagctgatccggagccatagggtcacgtagtatgagttctaatgttataaattacaggtaaataaataaatattaaattactgacaaatttaggctattttttcaaaagatttctgaatattctaaatatatatgtatagcttttaaagaaacagtatttatatgctaaataaacaaccgaacttaaaaaaaaatcatcctttcacaaaagtrtttgccacagggttccttaatatttatgctttcctatttttcttcaaatgtggttggataaaatgtctatactagagaagtttagtatatacattcagccacatagctgtaggtagtccttaaatttagaagcagtgtgattaaatcttaaattggattttcttaaggtgaaatatgatttattgatttacagtataagaattgttcataattaattgctttcatgtattctgtgaacaatataaatccttaaatgagcaagtaacagtgataagaggtataagtgttgctgtttagtaggcagagcaataaaatgcaagtaatgaaaagtagagagcacctgaacacattttagtgacgcacctttgaggaaaatgatatgtattatgaagaaatgcatgtatataagtaaatgatgtggtagttggttgtttttagaccttacctcttattaaaactttagtaaagttttatctgttgaagattgttcataacctattaatttaaaatttctgtcagctatattaataatccatttaaatataggtaattaaaatttaaatgcaatttgttttttttttttgagaaggagtctcactctgtcgcccaggctggagttcagtggcgcaatctcggctcactgcagcctctgccttccagtttcaagcgattctcccacctcagcctcccgagtagctgggattacaggcgtccactgtcatgcccggctaatttttgtatttttgtagatacagggtttcaccatgttggccaggctggtcttgaactcctgacctcaggtgatcacccgcctcggcctcccaaagtgctgggattacaggcgtgagccactgtgacgggccttacatgcaatttttatttatagccagtattagagaattactaggaaatttcatttttatatttagtgggagaaagccatctacagcatgtcttcaagcatggactatctgtaacatacagtgtgcttgcttttgaattgttttagtgttaaatggccgtaactgattgtttttcgttaattgttaatagataaaccagatgttctgaaatctgttcttaagcagttgccctcaatggtgtttttgcctccctgcttctgagcctcttggttttactggagagtacaggtcataaagagacctgtagctcttgttgtatcaaccattatgtcatcctcttactgccaacattttcaaacagactgaggtttgcctttcrgtaaaaacatttactttcatattgtaattccttggcttacctggggaaagccaaatcgttctaggacttcagaggagacacacaggtctctgaaaggatgcaggggctaataaataaaagcttttgtttaatagawgtctggtattagaacagattattcagattctgaaggaggaacctgtggtaggagtatagtagctaagtatcaaaagaaacattctggaagaactcagcttcaaagagtaaaagaagtgagtttaaattagcaaaattcttgcccacattcaggaaaaaaaaataaatttgcagttagtttggcttggctcatgtgactctctaggcaaggaaaaccaggaaaatgatttgtctgctgaactgacagtcttgggtttgatacctattttatattctagtaattagttaaaatacagggttttatatccttgtaagtgtcaccatatgtaggagattaggactaaaggagacttgttcagagaattaaatttgaaaaactatacttcctttactaaaggttttgaaagcaaaacttgttttttcttcccaagtgttcagtgttcaggaatctggtgaatacttgctcagaaatttaacatcttcaattttaatttccctacctagcctttcttttttatttgttgttattgttttgccttctgtgatcagctcagggatgtgggcagtgggaacaaccttagaagccttaattcaggcctgatttccatgggagcatattgtccaggtgtacgcagaagaaggtgagcagacattcacactaaagctctgctaacattaattacttactaaattattgttttggattttagatcaatacaactgctgatgagaaggaccctacaaatcctttccgtttcccaaatattggtgtggagaagtttctggaattgaattctgagcagaatcatgatgactactgtttggcctatgtcttcacagacmgagattttgatgatggcgtacttggtctggcttgggttggagcaccttcaggtagtttatcatattaaatatgtcttaacttactacttgaaacraaggggagttttcagagaatgttgaattttcaaagtataggagaaagtgatgcctgtataatatcctaatttatgctacttgagttaggcaagactcataagcataatgtaaaagccacaatagatgaaggagctttttattttgaaacgcatacagggaaatatcctgattcctgacatttgaatggaccaaatgaaataaataattttatgagaaaaagtggtaattctgaaacccaaagggaaatttaatttttccacaaaagttaataaatgttatatatttattaacttttttcccctccaaaatagggtacttagaatcaaaagaggaaaactgtgtcttgctctctcttctgtagtgagataaagaggagagaaatcctcatcaagagtggcaggtaaaaggaaaagaaagcctgcctttattattttatttctagcctttattttaataaaagggaagcactgcatgaaagagatgtaggcaggaagcccctggtacccacaactccattgacatcatcacctgggttcatactctgccgagtctctgccttagccatgaaagctattgtcattgataatgttgggatgggacaatacccttcccattacagtgggggtggagtgttgtggaggagctgtgatttactgtataagttcagttgcctagtttagaaatccaaatttattaattgaaagatgagtggaaaggaccccaggctctttgaatataaattgtgccaagtagagtttaatcaatagtatattatcttctgagctatatacaacagattctccttctgatacttcatttctatgttttttttttwaaaaaaaacttctgctttatccagagtaagagaagcttttgtattcctattcttattagtttattctttgatttgttttgtatattttaagatcttaagtagtrctgtattttcctttgtatttctttctccttttttaaaagtcagtatcttaagtcaatacttttacaatttccatagcttcttttgtttttcttctatgttttaaaatgtactcaatttcatgatgtcattttaaagtataagtttatgtcatgggctgcatattaatagtgcagtacttttggatatttgtcttttatgataatctgtacttttttgttacttggattagtcagcagattgtacagctcactctttcctatgatttttcatgttcgaaactttcatactctgaaacctctttgccccttcaatggttggatgattttatcacaaagtctgtgatttcttctccctattcattagtaagtactactaaaaactcagggtctcatatgattttatttgtatattatccattaatacagtagctgtgaagtctcaaacaagtggttctccaagtgtgatccatggactagcaccatcagcatcacctaggaacttgttagaaatataagttcataggcactaccccggtctcttgaatcagaaactatagatgtggagcccaacagtcttagtttgaacaagttctcaaagtgattctgatgcacagtgaagtttgagaagcaccacattaatatttttgtctctaaagcttgctcacaaaatgcctcctgggtaagtgagtatgtgatcttaaactaaaaactttctgccattttgcattttcagttacagactattgtacttaaggatgtaatgattctgtaggaatttggtaaaattcttcctaaatcttcagatattctcatgtctttagattcagctactcattttgttgtaaaaagtaagctttattttttagagcagttttagatttacaaaaaattgaacagattaggtattctcaaatctccttcctccctcccctgacagttttgaggagtactgatgaggtatattttagaatgctcccctatttggaatctgtctgatgttttccttatgattaaactgtagttatgggtttttgggacactcagtgtttatgtctcattgtttgtgatatttggatcaccatttgtgatgctgctcattttcctgaggtggggagagttctggattgaaaatggtggggcatgttacttgtattttctttttttttttttttttttttgagacagagtgttgctctgtcacccaggctggagtgcagtggcgcgatctccgctcactgcaacctccacctcccgggttcacgccattctcctgcctcagcctcccgagtagctgggtctacaggcgcccgccaccatgcgtggctaattttttatatttttagtggagatggggtttcaccgtgttagccaggatggtctcaatctcctgacctcgtgatccgcccgcctctattttcattattagggtcttcttaaaggtgaaacaagatacttcctgtgtacttcatgagcaaaaatatggtgattggcaaccagaatagaaaacgaagactcccgttgtcaactttgtatccccattttccccccctctgctttttttccttttatattattatctctctttctttcagacattagatgtccgcttccattactctatgttaaacccccaacttcagctcttggaagccatcttctaagagctgctggggaggggctaggcaggcacagaagaatagaggccatagtgggaaagaaaagggatctttgttyctttggtccaactttttcgagtgtaggttacctgccttgaaataacactgccagcttcttcacttgtctttgcacttactactagctgaactgagtttcatatttgacatttttttttttaaaacaaggaatgttatatatttattcttgattatttcaatacccttatgaggtgtaggtattattgtctcccttctacagatgaggaaacttgtgttcagaaactttgtgaccaacctaataccacacagctagaggtggaacaggatctggaatctggaccttttgactccagattcagttcatttggtaattatattactaggtattttatatatatataaatacaatctacacacacacacacagtaacatcttagccttttctttgatgtttcaaataagaagctgaaatgttttctgcttcttagtagaggttatacattggtggaatctgttttcttctttcttgagagagaagagttataaaatcatactaagctataatattttgatataattttgggtaattgtcatggcataatgggaagagcaatggactgagagctgggagacaggattcttgtgtgttttctgtctgtaaattcaggaaaatcattttgcttctggctgttttttcattgtagttctgtctttgcccttcttttgagtcttcatgtttctacctataggtcttatcagttaactgaatgaacatagtctcagttcggcttggtcgttgaatgaggctggctttggaattcatctctacagttagtcctgaaaccttcagtactcctctatttgtgaagaacwtcttttgaggcatttcatttggtagaaatagtctcttctgttttctttagattagatgttttagtttgatattacatattaaaatttgagagcgtacagaacttaacacagggttctcgggataacccrcagcttattgaattcttaacccatagtttaaaagtataacttcaaatgctgggaaaattacatcattgaaatattgcaataggacacttgctattggcatttaatgcttgtctggatcccttggatatttaacatctttgatccctacccattgcatgtgagtagtgctctccagacttgaaagccaaatgcctgtgctctcacatttcctggtatcacttgtgggagtattactatggtctggtccagaattattgcttacattaatattgtatgatcagcatgctactattaatttttggcctcctcacatcaaaactgtatttatggaatatgtcaaggtatcatattactcttgtatttttttctaagacttttttttggggggtggggtggagtgggtctgttttgaagtttaggacagatactctaactttagctctcaaactatcctgtagatagaaaattgtcattatacttctttgttgcttattgaatccttcatcaataattacttttgacccgaattgaaaacgtttcacccttctcattgttattcacaacttatgtatttgtcagtgataaatatatgtatagtaaaatcttaaatttaaaatatatagcaattgagtttgagttaatggtttagctgtgggtatatatgatacctcattactgagttttctggcatatcaaaactagttgcagtatttaaaaaaattaaaccataactttcagagttacaaatagtattttatttcttcctgtataatcaagttactccaacatatgctattagcctgcaacaaatattaaacttcctttttttttttttttgaaacgaagtctcgctctgttgctcaggctggagtgcagtggcatgatctctgctcatggcaacccccgcctcctgggttcaaatgattcccctgcctcagcctcctgagtagctgggattacatgcatgcaccacctcgcctggctaatttttgtaattttagtaaagatgaggtttcaacatgttggttatgctggtctccaactcctgatctcaggtgatccgcctgccgccgccacccaaagtgttgggattacagacgtgagccactgcgcccggccattttaaactttcatataagcgataatcataaaraccaaaagcagttgtttaagaagttaggcaatatataaattactatatttcagaatagtatattctaatttatgtatactcttctcttaaattagccagaccctaaaagtgcagaaaaatgtatattatcagagatttaaaaatatgcctatttactttttttttttttaactgataaagatttgaagtgtggagtcttctatgcttaattcaagtttgacagtactgcattggaccaatttgcacatgacaaatcttcactaaggcaggatattaatttactatttgtttaaaactatgctgtgtgtacaataattattatatacagaatacttatttatatattttctggtttccagaaataatgatgtgcttctcaggactgagctccaaaagtagaactagcttgaagaaaatatattaaattctcacaaattatttggtattttctctctactcagttgtcagtgtagaaaaggtattaaattttgaatatcataaaagttctcaaccccttgctgggttaaatttgcatgtgactccagctatttgtccggcctatagtctcaggtcactcattttaatgtgcatatacatcacctgaggtgggcagagttctggattgaaaatggtggggcatgttatttgtattttctttctttctttttttttttttttttttttttgagacagagtcttgctctgtcacccaggctggagtgcagtggcatgatctctgctcactgcaagctccacttcctgggttcacgccattctcctgcctcagcctcccgagtagctggggctacaggcacctgccaccatgccctgctaattttttgtatttttagcagagatggggtttcaccgagatgttctcaatctcctgaccttgtgtttctttgaaacacatttttcttttcagctttctgaattttaacagtaattcaaatttgtattttgttgccatatatttattatatttaatgggagcaaggcaacagtcgtagtataatgctgttcttgcagacctattttgaattgccttctgttacatgctttattagggattctaaatactagacttgtttttgaagtggggagaatgggaaggggaggagaagcaatattagactttttttaaatggtttagtaactttgttgtaacttgtctatagaaagctaattagagcagttatcgtaatacgcttatccatttgattgtatttcttttaaaaatcaaatagggaaaactttaagtataaatataaactaaataacttctcactgaaaatcttataataaagttaattaaaagaaaatatgatcttaccagtgtaatgtctatataaaggcatgaattgaccagatggtttctgattttcctattattatttttctgatttctcttaattgattttagctgtgaaagcactgtcatttgctgttaaattctaaagtccctgttaatgaatagatgaagtacaaaatgataaaaatatttaagtggaaatatggtttttcttttaaaatttgatagtgtcctaaagacatactggaacaatcataattcagtttttaatttttttttgaagatttcaaacctgcggaaaggttgcaagaatagtatggtgaaattcttcttcttttttttttttttagacagagtgtcactgtgtcgcccaggctggagtgcagtggcacaatctcaactcattgcaacttccacctcctgggttcaggcaattctcctgcccgagtagctgggattacaggtgtgcaccaccacacccagctaatttttgtatttttagtagagatggggtttcaccatgttggccaggctggtctcaaactcctgacctcaagtgatctgcctgcctcggcctcccaaagtgctgggattacaggcgtgagccactgcgctcagcagtggtgaattcttgatggattaatcaattattaaccttttgtcgcatttgctttctatctctcccttccttcccacccatcttctctttttccttctttcctctaccccctctttttttttttttttaaccttcttgacatgattattttctatttttacaaatacattgtatgtcatatctcaggacagggaatcatgtgctcatgtgcctcactgcttcttgtagaagtgactttctcagaatcttcttgaggatattttgttcaactttcatttaacttaaatcataagatttctttttaaaagatgaaaggatgtacactttgacttagtgtaaatactgatatattcaaattgaaaggaaatgtaaatatttgttttcctaaattaatgggaataacatttgggggacattttgattgtgaagaacattttgtaaaggctgtgtactcagtcctgggagtttctttctgaatgtcattaaaacttttatatgaagtgacttcttagtcttggaccaaagaaacttttgcatatgtgatacgtttgagtaccagttctattttagattaaaatataaaatgttttcatttaatatagcatgtattacctttttgggggtaaggggaaacagatactaatttagccatttttttgttctggattaggaagctctggaggaatatgtgaaaaaagtaaactctattcagatggtaagaagaagtccttaaacactggaattattactgttcagaactatgggtctcatgtacctcccaaagtctctcacattacttttgctcacgaagttggacataactttggatccccagtaagtattgtctaattattagcttaaaaaatacttattagtctaatttttatgttgagtgatttatttaaaattcaccgtgaaaacaaatgtacttacgagtgtttagtttttatgtcagagcacagtaatgtatttgaccatactgaaagggaggaagatagaatgtttgtggttaaagtaagaaaagtaagcataacagtgctagaattctgtgaaggcaagggatttcatctggcttattcagacaaaatatctatatctcctggccctagaacaatgcctagtacataatgtactcaaatatcttttgaatgagaatcattattcattgtttaaaagtacattttgaatgttcagcaaattgtgagaaaytctttttttgttttgtttctgttaaagcatttttagggaatgagattgatattttaaaatcttttctctactgtggaatgagattgataatttaaagtattttctctaccgtggaatgagattgatattttaaaatcttttattaggaaaaaattctaacatacacaaaagtagaacaaatagtgcaacaaagcgttatacgcccatgattcagaacagggatcagcaaacattttctgtaaagggcctactagtaaacattttaggcttcaggggcagtgtttggtttctgttgtacagtctttgttgcttttacaatttgttaaatatggaaaagccattcttagttaagccatataaaaacaggctgctggctactttgtcaacccctaattcagagccaataattgtgaagattttgacatatcttctatctgtatttctttttctttgctaaggtatttaaaggaactctatctatccttacgtatttcagtacacattcctgaaaaaatagacattttctaatacaactacaatgtggttattacacctaacaaaattaacagcgatctttgatattatctaatatccagtccattatattgatcttttaagtgaccttaaagatcagtacaacacagaaatatgaaatactgaatgatactctgtctttgtgattttggtagagcttattaaagataacattttgaaaatgtacacttgaaaactgtatgtaaattcattttactttcaccttatcacttgcaaaagtgcaaatttttatgattttaaaaataagttgtctacttgtagcttaaaatccccaaatgcacttctctaatttttcccatgtttgtaaaataggtgccatctcactaagttgcaagtctttcttcttctacatcccaatcagaaattgatagattattattaatgttcttggataaggtatttaaaatgtgcttaatctctgtaactcttgactgcttttgtgatcttctcttaaaagagtacttggaattttagagatgagcagagaattattgttcatagttgatttgcattttcaagagcagataagtgtcctctcttctccccaagtcatcttggttccaggccttaccaggggaattttagtactcctccagctacttgtctggcctttagtcccaggtcactcatttttatgtgcatatacatcacctgagaatcttaaaacacagattcttttttagtaggtctttgatggggcctgagtttctgtatttctaacatactcccacataatgctgctgctgctgctgctggtgctcatctgtgaaccacactgcagtagggaatctagaccattctcttttcacttcttgtgtaatctctttcctacctagctgccagtgagatgtttttattcaattaatgttatattattgtttaatggagaaattggttcacactctttgcctaccacgctcaatcgtaccccattcttttgcacatgttgttaattctgccatctgtatccgtagtagatggttgtcttcatctgttttgtgttgttataagggaatatctgagggtgggtaatttataaagaaaagaggtttatttggctcatgattctgtaggctgtacaaaaagcatggtgctggcatctactcagcttctggtaagggcctcaggctgcttccacttatgatggagggcaacaggtgctggcatgtgcagagatcacatggtgggagtggaggtggtgggagcgtggggtcaaggagagaggaggtactaggctcttaacagccagctcttgcagraactaagagagtgagaatgcactcacccacccacctccaacccttcaggaagagcattaatctrttgatgagggatctgcccccatgacccagacctctcttgttaggcccactaacaactttgggatcaaatttggggggacagacatccaaattatacaatgcttaataaatatttgttgagtaatttaatagtaagatcagccagaatcataaacacctgaacctgtctcccttaacatctttatctgaaatctctttctctcttatacgtttgtagtaatgtcaatgttactttttctgagtggttcacattatttcttaaatgtatttatcctatctgaaatatttattgtgcacctattataaactgctttataaactttgttgtaggaagttgtaatcataaatgagacaaagttcctgtctctcagggtgaaaattctaatatgtacctactctcaccagattcaccttcatgtaaatacagttctaataatgccacttctgcttactaactcacttctactactttctaatattgctgatacaatttccttatcttaatgtttggggtgtttgataatttggggtttaagtatatttctagtgttatctctcctcatctgtcaaattaattcacagacctttaaaactttcctccgctaggaagtcagttccttcccatgtctgcctgttgaaatcttgatcygtgttgttatatgatgtaaatgaatatggcccttaataaaaattaagaaaatatgaccatcatagttttatttataataccaaaaagttttaagcagcstagatggccctacagtatgaaaataccacggaatgctctgcagtcatttaaataccaagttttgcagtgctcattttatactgttaagctgaaagaaaggtgtgtataactgtacacatggagggtagctgtggtgactcacacctgtaatcccagcactttgggaggccgaggtgggcagattgcttgagcccaggagttcgagaccagcctgggcaacatggcgaaaccccgtctctaccaaaaatacacacaaaaacaattagctgggtgtgctggactgcacctgtagtcccagctactcgagaagctaaggtcggggaggatgacttgagtccaaggttgcagtgagccaggatcacgccactacactccagcctgggggacagagtgagactctgtctcaaaaaaaaaagttataactgtacacatggtatagtccaaattttaaattaaaatgtgatacagctagatataagtcagataggaaatagatcaaaattttaatagttatagtgcatggtagattatgattgaatttttatttatgcatttttgttttcttaattttctttcttatagttagacaaatttttctgttttcttgtcacaaagattatagtttcttagtgaaacgcttctcttgatttgaactctgaatacttgtgcgagtccagtcaagatggcctttatgttctgttttgtgttttgcttattcatgtgcttgttttattcgttatctgaggatggcaaatagctggcatgcttgcttacaacctgtttccccttctattcctgttaatggtgatctattgtaatatctcctggcctagtaaaataataattgactagcaatatctgtaatggatttatgcagcagcaagtcagactaagcagttatgtcaagatttgctatcatttaaaaatagaaggtaagtgccttgaaggctagggataatacttttctcatctttatatttttatattttagtgcctccttttatagcactggacattcattaatatttactgaattgaaaagtggcaagatattctgtgatgacatcaagagttatacagaattgggatttttttctttcctttctaaaactctaatgctgagaataattctagtgctacacctttttcagaaactgagttgaattttataggttgaaaacataaagcaagataatrttggtgaatagtatagagttgctaaatgctgcatctagattcagaagaaaggcaagaggtatcaggaagaataaaggtgatagtagaggacacattttttaatttaacagttgcctcagaagagggaatagaaaatgaaagtaacttagttgggctctaggaaaaaacagaacgtccttgggcagtctttttctttcttgagagtggggttgttgggtatttaaaacaagattttaattaaatagcacaattactctagtgtccagtgttttttgccccttctgatgtgttctgaattgtttgaggggcattgtgagggttgttttagtgcatatccccaggatggtaggggctgctgggatctggtagtagtgttctgttgcttggtctcataagcattactttgagaaaattcagggagctatgctgtatgtatctgactcttcaataaaatttatcaaaaccgaacaccacttatgtgcatttatatgttacgtgtacacagaactctgtttatttggcaaagcagtattttggttttatctctaggcttttaccatttttcatttaaaaatatatcattgtgtttctgttcctagtcagcatttttacttacctttcctatatattggctattaagttagctgtcttagattcctgttctgtgtgtatttagccccatgtcagtctcttgattcttttgtctttccccacctctgtcttctctgaactattcataacatgtaatttaacatatgtgttagagactatttagtagttttaaagtagtttattttactgttactagttttaaaagtatgtgagcttatttttratagacttttatgacagtctgtcctcaattctagtccctgcttacaaagctataaattgttatggctagacctccactgattttcctycttttctaagacagtgacccctaaaagagcaaattcttttcctactcaaggtgtaaaacaattgtaagatcctttttaaaggagagtccacaagcttccattgttttcctgatgagamcattacgtttaatcagttgacctgaaaaccttattttacttcctgtttatgtaactttatattctttttgacagcatgattctggaacagagtgcacaccaggagaatctaagaatttgggtcaaaaagaaaatggcaattacatcatgtatgcaagagcaacatctggggacaaacttaacaacaataaattctcactctgtagtattagaaatataagccaagttcttgagaagaagagaaacaactgttttgttggtatgtatattttcctaacgttttgttatgaacattttcaaacattcagacaacttgaaagaattctatagtgattactgacatacccaccacctgcattttactattgctaacactttgctgtattccctttatctcgttatttcttaatcttgccatctctcaattcatgttttattgcaatttaaagtaagttgcagccatcagtatacttcacacctaaacattttagtctgcaaatcattaactagagttcaatattgtttatagttctttttctgttttctgcataagtgaaatgcacaaattttaagtgcatcatttgatgagttttgacagatgcatttacctttgtaaactacctatcaagatacaggacatttctgtcaccccggaactttcttttatcacccttcccaatcaggctctgtcccaacacaccctcagaggcaaccactatctgatttatttcactctacattggctttgtcttcatataagtgaaagtatacagtttatacccttctgtggaaggctgtttaactcagtatacagctttgagattcatctttagtattatactcctttttattgctgagtactattacgttgtatgaatatgtcctagtttgtacatctactctcctatcatgaataccttggatttgggctaatgtgaataaagttactatgaaattatttcttattttagtaaaatatatatagcataaagtgtgccattttaaactgattttaaatgtacagttctgtgacattaattataggtacaatgttgaatgtgaatgtaatcaattacattcactcttcatttgcaaactttttcatcatcccaatggaaattctataaccattaagcagtaatgctctgtcttcccctcagcccctggtaacctctaatccactttctgtctttatgaattggcctattctgggtatctcatgtaagtggggacatacaatatttgttctttcgtgcctggcttatttcacttagcataatattttcaaggtttatctgtgttgtagcatgtatcagagttccattccttttcacggctgaataatactccattgtatgtatagaccagattttgttcttccagtcatctgttatgtctttcttgcggcattgaacatactctaaatatttactttgtattagggtttttttgtgtgtgtgtgtccttgtcctatttcacaagaccataggtttctttaggggaaacactgaggcctattcatctttgtacattaagagcactgaaagaggggttaaacatgtgacagcaaaggagaaagaattcaggaagatttccagataagcatgggattttgtttttaattgaaattttattgagataattaatagattcacatacagttcataagaagtaatagattccctgtacccttcactcagttccctccgatggtaatgccttgcaagactgtagtacaatatcatgaccaggatgttgatattgagaaaatccatagatactattccaatttccctagtttttttttttgttctcatttctctttgtatgtatttagctctatacaattttattacatgcgtagatttatgtatccaccatcacaatcaagaatcagaacagttctgtcattacaaggatccctcattgttttataaccatgcttacctcccttctgttgtcccttcctcccccctgctaccctgttctccatatgtaaaattttgtcacttctaaaaaagttatataaataaaatcagacagcatacaaccttttggaattgccttttctcactcaacataattccctggggattcatctaaattattgcctttatcaatagttcgttcttttttatttctgagtagtattccatggtatgtatgtactgcaatttgtttaaccatccatttgaaagacatctgggctgtttccagtgtttggctattatgaataaagcagctgtaaacattcatgtacaggttttttgtataaacatataagtttttactttgagataaatgctcccaaatcgaattgatggaccatatagcaattgcttgttttgctttgtacaaaactgccaaactcttttccagggtggccatactattttatgttctcaccagcactgcacaaatgatccagtttctctgcatgttcacaaccatttggagttttcacagttttttattttagctgttctgatgggcgtgctgtgatatctcatggttttaatttgcatttctctggtggctaatgatgctgaacatcttttcatgtacttattggccatttataaatcatctttgatgaaatgtctgtccatgttttttggtcattttagtgatcattagtgggacttttttcttttctttggagtattgagaattctttatatagtctagatactagtcctagatactggtttgcaaatattttctcccagtctgtagcttgtcttttcgcccttttcacagttctttcgtggagcaaaagtttcacattttgatgaggtccagttaatcagttttttattgtattgattggcattatctttttcttttaaaagggcagattgaaattacatcttcaatcttcaaaaactgatgttatcatttttgttattgttattgtcagtggttgtttttctaatgcttcttaatgtacaggtacattaagattcttcatttgtaaactgggttttcacagtaaaccttctgaaataagttgacttttaaaaatgtacatattgctttgtaggtattaacaggaaagaaaattttttcttaaattataacaaaatgtgtacctattataatttttgcatttaaacagtatttttaggccagacagggtggctcatgcctgtaatcgcagcactttgggaggccaagacagggagattgcttgaggccaggagttcgaaaccagcctggccaatgtagcgaaaccctgtctctacaaaaaattaaaaaatcagtgaggcatggtggcgtgcgcctgtagtcccagctacttgggaggctgaggcacaagaaattgcttgaacccaggagttggaggttgcagtgagccaagatcgtgccactgcactttaacctgggcaacagagcgagactctgtctcagacaaacaaacaaacagtacctcattgttgtttaaactgttagcaaataactaacttgaagtactaattttatatgaaataaaaattaatatgtagtaaataatgtatgtaacattttctgacttcgttatttgttttcttataaattacgtgtcatgtgaattataaaattattactagacttgtaaaaatcattattcacctagtatatatgtgcagatgcatgtttctagttttttttgtttttgtttttgctttttttttgagacagagtctcgctctgtcaccaggctggagtgcagtggcacgatctcggctcactgcaacctctccctcccaggttcaagcgattctcctgcctcagcctcccaagtagctggggctgcaggagtgcgccaccacgcctagctggtttttttgtatttttaggagagacggggttttaccatgttggccaggatggtctcgatctcttgaccttgttatccacctgcctcggcctcccaaagtgctggcatttacaggcgtgagccacctcgcctggcccccccttttttttttttttttaaatttcactttaagttccgggatacaagtgcagaatgtgtaggttcattacataggtgtacgtgtgccatggtggtttactgcacctatcaacccatcatctaggttttaagccccacatgcattagctgtttgtcctaatgcgctccctcccctcaccttctacccctggactggccctggtgtgtgttgttcccctccctgtgtgcatgtgctctcattgttcaactcccacttatgagtgagaacatgtggtgtttggttttctgttcctgtgttagttttctgggtatgatggcttctagcttcatccatgtccctgcaaaggacgtgatctcattcctttttatggctgtgtagtattccatggtgtatatgtatcacattttatttatccagtctatcattgatgggcacttgggttgattccatgtgtttgctattataaatagtgcatgcttctggtttttgagaacgaaagagatggtttaaagtgaaacagggatgaagcttcgatgacctccaagattttaaaaaatagtcgatgtggttaagaatgaactttctgctttcatctaggccagtctggctctggagagcaggtgcctccacagcaacatccctgggggccctgaaatcagggttcagctaggctcctatgtgccctgagggtctgggttcccagtcctgttgccaagtggctttgtcccagatcctttcttctgggctgatgtgagtgcatatgtttgtgccaagcttctgttttatattgcacatataaataaaggaagataatttaccataaagaaataattatctgaatataaagccagtctttctagaacatttttgatttagataggcctcatgtgggtttcctgtgttgagatgtatgggttcctgtgttgagatgtatgtgttcccttctacttattcaattcgcaacttaaagcctgtacaatgactgttttccatgtcgatttggtgtaggagaaagaaaagagcaccagatcgtagacctagaaaaccctagatatagtctgtgttttgcctatactgggatatatggtccctagcaagttacagactccttggaagttagttttatttcctagaacatttaaggcatttgatttttatcattctctgcagttgctaaagctctttgattttatgatcttacaaagaggagcatttctattccaattttaaattccattgacaaaaatcaaagaactttagaagactgctgaagaaattttctaaaattattcactatgcttagatgagactgtctaatcttaatcaaccaagatctggctcaataccattaaggtctgtgagaatacagaagatataaataatacatgtttgttcccttaaggagcttggtttagttcagcagcaaaactaatgtacataaaaaaaattacctactgattgtattacaatcagctaaatagaatgtgggacatttcatagacaaaatcacccaacttctttaacagatcaatggtgtaaaaataaataaaaatggagaaatctattatacgttaaaagaacataagagacctgtcaaaaagcaaccatgaggggaggagttggggttaggggaaccttgggtttgaaacttgattcacagcaacaaattgtaaagagacatttgaggaaaattgaacatggcttggctgttagatgttattaagcatgctattaattttgttagatatgatcatggttattatggttaggtttaaataagaaaaaaactttatgtcatagtgatacattctgaagtatttacagggacaataatatgttaggtggggttgttttaaaatactccagaaaaaaaytgtgggagtaagtgagacaagaacagcatattgttgttgatagttgttaaagatgagtgattggtacatgggaattcattgtacatattcttttattacttttaggtgtgtttgaaattttctgttgcaaaaaaaggcttartttttttttttcctggttagtgaagcactaacttggtttgtatttgtgtgatatgaatagaacagtcaataaagctcaatgtagcatggcctaagttgcaagttacagcttctagaagggaccctctgtcaaatcctctcactgtacagattgagaaactgaagaccccaagattgcattgctagttagtagcagaccccctgttagaattaggtctcgtaatttccagattcctagtttgttctacttattcatcaaagttttcctttatccctttgttatgatgatctaaagaatttgtgaattttaaataaaattaatgtgtgcacacaatgcttactttgtcttgtttattttcctcagaatctggccaacctatttgtggaaatggaatggtagaacaaggtgaagaatgtgattgtggctatagtgaccagtgtaaagatgaatgctgcttcgatgcaaatcaaccagagggaagaaaatgcaaactgaaacctgggaaacagtgcaggtaccttgctaatttcagtgatgttaacattcttgtaaagttacctcaatgcagttatgacaaatttaaaactgagattaagagatgcatatggttttgaaactttgcttttatctgttgtttgttttctttttctgaagtagtgttggttactgctctgttattggcagattgaactacttttttttttttttttttttttttttttgagacagggtctcgctctgttgcccaggctggagtgcagtggcatgatctcggctcactgcaacttccacctcccgggctcaattgatcctcccacctcagccccctgagtagctgggactataggcatgtgctaccacacccagctaatttttgtatttttttttagagacagagttacgccatttgcccaggcttgtytggactacttttaatagtaatttgtgtggtgaatgttaacaaaaggacatactcaaaggacatactaaaaagaatcctaaaaaatacatattctttagttacttattgtgaaaatgtaactatcttccatattttaaaaatcttaactttaaatatttagttaatgtggaatccatttacttttctaacttggcgagttataactatttcacttgtcaaatttactttggtagcagtgtaagcaattgtttgcacaatactttttttttttttgagatggagtctcagaaaaacctgtcacccaggctggagtgcagtggcatgatttcagctcactgcaacctctgcctcccaggtwcaagyaattatcctgcctcagcctcctgaatagctgggactacaggtgtgtgcctccatgcctggctagttttttgtatttttagtagagttggggtttcactatgttggccaagttggtcttggactcctgatctcaagtgatctgcccaccttcgcctcccgaagtgctaggattacaggcatgagccaccgcacccggccagttcaatatgttttaaacggctggtctgtatatcctagtttgattttagtatgaaaatgggagagaaagtgataaattaactaatgtgtgatgtaactgaaaaaatactgataaattgcctaatattaaatccattttccattgtagccttttcctaaaggtgaacagggcaagaatgtggaatgtagtatgctttgactattaaaaaaaaaagtcgcacacttttcttgactgtttggcttagtagcttcctattcctttttttaaatttttttttttgagatggagtcttgcactgtcgcccaggctggggtgcagtggcgcgatctctgctcactacaagctccgcctcccgggttcacgccattctcttgcctcagcctcccaagtagctgggactacaggcgcccgccaccacgcctggctaattttttgtatttttagtagagatgggctttcaccttgttagccaaggtggtctcgatctcctgacctcctgatcctcccgccttggcctcccaaactgctgggattacaggtgtgagccactgcacccggcccctattccatttttaattgatacataatgattgtacatatttatgaggtatatgtgatattttgatacatgcatacaatatctaatgatcaaatcaaggtaataaggatatttatctcctcagatatttatcatttctttgtcttgggaacattttaaatcttctattttgaaatttacaattagttattgctaattgtagtaactttactgtgctatcaaacactagagctcattccttctatgtgtttgtacccattaaccaatctctctttatccacctctccactacccttctcatcctcttgtaacaccattctactctctaacctctatgagatcaacttactttgctctcacatatgagtaacaacatgtgctgtttgtctttctatgtctggcttattttatttaacatgatgacttctatttccgttcatgttattgcacatgacagtattttgctcttctttgtgaccaaatatataccaccttttctttatccatttgtctcttggtggacacttagactaattctgtatcttggctattgtgcatagtgatacagtaaacggggctgtaggtatcccttttatatactgacttccttttctttggatgtatacccagctggatcatatagtagatctatttttagtttttagaggaacttctataccagtttacacagtggctatactaatttatattcccaccagcagtaaactaatggttcctgatctctgcatccttgccagcatctttatttatttatttttttgatcattttgataatggtcatttttactgggtgtatctcactgtggctttgatttgtgtttccctgatgattagtgatattgaacattttttcatgtacttgttagcaatttatatgtcttcttttgaaaaatgtttatttaggtcatttgtctactttttaatgagattatttagttttttgctgttgagttgagttccttgtacattctatcagtccctagtcagatgaataatttgaaaatgttttctcccattcagcagatcgtctcttcactctgttgattgtttccttttctgtgcagaagctttttagtgtgtgtaaccctatttgcctatttttgcttttgttgtctgcagtattgaggtcttactcaaaaatcttggctcagatcaatgtcctgatatcttttcccaatgttttcttttagtagtttcatcgtttcaggtcttaaatttccatcacattttgatttggtttatgtatgtggtgagacataggggtctagtttcatttttctgcatataggtatccagttttcccatcaccacttattgaagagactgtcctttccccactgaatgttcaaaaatcacctttgtcgaaaatcaattggctgtaaatatatagatttatttctgaattctctattctgtttcattggttaatgtgtctgtttttatgtcagtatcatgctgttttagttgctatagctttgtagtatattttgaaattaggtggtgtgatgcctccagctttattcttttggctattggcttctgtggtttcatatgacttataggattgttttctctttatctgtgaagaatgtcattggtatttggataggcattacattgaatctgtagattgcttttggtagtatggccgttttcrcagtattaattcttccagtccatgaacatgaaatgtgtttttttttttttttgacttgttcagtttctttcatcagtgtttcatagttttccttctagaaatttaataaactcacctccttgcgtttattaaacttactcttttttttgcagctattataaatgagattgattttctgctattttcttgtatatagaaacacaactggttttttaatgttaattttgtatcctgcaactattctgaattcatttatcaattctaagagttttcagtggagctttaagggttgtctatatatataagattatgctgtctacaaacaggaacagtttggcttcctcctttccaatttggatgtcctttrttttcttctcttgcctaattgctctggctcagacttccattactatattgataacagtggtgagagtggacattcttgtcttgttctagttctttttttcttacttattttacctggtgatcaggaagtattgttgggaaacttttttttaattactgattcaatcttgttacttgtgattgatctgtccaggttttctattcttatttcaatcttggtaagttgtatgtgtccagggatttattaattatcattcggttttcccatttattggcatatagtttattgtaatggtttctaatgattctttgtatttttgtggtatcagttataacgtctccttttttgtttctgattttatttggatattttttccttgtctagttaatggattgatgattttatctttccaagaaaccaactgttcattttgttgatatatttttattttatttttttatttttttattttttgagacggagtctcacttttttccccaggctggagtgcagtggtgcaatctcggctcactgcaagctccgtctcctggattcacgccattctcctgcctcagcctccggaatagctgggactacaggtacctgccaccacgcctggctaatttttttgtgtttttagtagagacggggtttcaccgtgttagccaggatggtctcaatctcttgaccttgtgatctgtccgcctcggcctcccaaagtgctgggattatagacatragccaccgtgcctggcctgattctttgtatttttttagtctcaattttgtttatttctgctcygatcttcattatttcttttcttctactaatttggggtttggttcgttcttgctttttcctgattcgttgaggtgcattgttaggttgtttatctttctactttttctatgtagacatttattgctataaacttccgtcttaatattgctttagctgtatcccatagtatttggtatgttgtgtttttctattttcagttgtttcagagagcttttaaacttcatttttaatttcttcattgactcattggttgttcagaagcaagttgtttaatttttatgtgtttgtacagtttctaaagttccccttgtgattgatctctagtttcattctgttgtgttcagaagagatacttgatatgatctctgtttttgaacatctgttgataattgttttatagcctaatatgtggtctatcctggagaatgtttcatgtgctaatgaaaagaatgtgtattctgccacagctgttggatgaaatgttctgtaaatgtctgttagatctatttggtctaaagtatagttctaatccagtgtttcttgattttctgtctagattatctgtccagtgctgagaatgggctgttgaagtctccaaccgttactttattggagttgatctctctctttagatctaatagtatttgctttatgtatctgggtgctctggtgttcggtgcatatagatttagaattgttatatccctttgctgaatggaacattttatcactatatagtgatcttttttgtctcttttcacagtttttttttggagacagggtcttgctctgtcacccaggcttgagtgcagtggcatgatctcggctcactgcaacctgcgcctcccgggttcaagcgattctcctgcctcagcctccctagtagctgggactacaggcatgtaccaccatgcccaactaatttttgtatttttaatagagacggggttttgccatgttggtcaggctggtcttgaactcctgacctcaggtgatctgcccgcctcggcctcccaaagtgctggcattacaaaatgagccactgtgcctggccctcttttcacagtttttgacttaaaatctgttttatctgatacaggtatagctastcttgcttactttgtttctggttgagtgaaatatcttcttctgttcctttacttttagtctatatatgtctttagaggtaaaatgattttcttgtaagcagcatataggtggatrtgtcatgtgtttgggaggccgagccgggagttttgcttgagcaggagtgcaagaccaacctaggcaacatagtgagatcccatttctacaaataaatgaatacataagtaatttaaaagctacagagggagaagagattaaaataggcccattcagccaggttgtgtctttttaagtagggggatttcattggtgtatattcatgattgatatcagtaggtgaggacttcctcttatcattttgataattattttctggttttttttttttttttttttcttcagacggactcttgctctgtagcccaggctcgagtgcagtggtgcaatcttggctcaccacaagctccgcctcctgggttcacgccattctcctgcctcaggctccctagtagctgggactacaggcgcctgccaccacgcccggctaattttttgtgtttttagtagagatggggtttcactgtgttagccaggatggtttcgatctcctgacctcgtgatctgcctgcctcggcctcccaaagtgctgggattacaggcgtgagccactgcacccggctgtttttgttttgttttgttttgtttttgcatattcttctttctttttttctctcatttagcattgtggtttggtagttttctgtagtggtaacatttgactcttctttttctcatttgtatatcacagtggcctgtattgtacagctttgtggtaatggcggtgttggtgtacgtaggttgttagcattataattctgtgtgttttcacaatggtgattattggttttttttgcttccaggtgcaggaatcccttgagtatttcttgtagggtcagtctagtggtgatgaatttcctatttttgcttgtgtgggaaagactttatttgtccctcatttctgaaggttagttttgctgggtatagactcttggctgctaatttgtaaactatccttcagaaatgagggacaaataaagtcttatagattcttggctgccaatttgttttttctttcagtactttgaacatattatcccattctctccatgcctgtgaaatttctgctgagaaatctgctgctagtctaatagatgctcccttatatgtgacttgatastttcctcttgctgttttttttagaattctctatgtccttgacttttgacaatttgactataaatcctcaaggaagacttccattttcagctattattttaataaataggttttcttttttttttctttcttttttctttctttttattttgagacagagtcttaacttcatcacccaggctggagtgcagtggtacagtttsagctcactgcaacctctgccttccaagttcaagtgattcttgtgcctcaacctcctgagtagctggtattacaggtgcgtgccaccatgcccagctagtttttttcgtatttttagtagagacggggtttcaagctcctgacaagtgatccacctgctttggcctcccaaagtgttgggattacaggtgtgagccagtgcaccccagccaaaacaaaggttttctgtgcctttttaaatctcttctccttctgtagcttttaagtgattgattgattggttgcagaggtgggctttcactacattgcctaggttgatcttgaactcctgggctcaagtgatcctcccacctcagcctcccaaagttctggcattacaggcatgagttactgcacccaaccttctgcagctcttataatatgaaaatttattcacttggtggtgtcccataagtcttatagactttcttcctttttttttccttcccctaaatgagtaatttcaaacattctatcttgaagttcagagattttcttttgcttgatsaagtctgctgttgaagctgtctattatatatttttattttattcactgaattcttaagccacaggatttttgtttctctttaatgatatttattacttttttgaatttctcattcatatgaattgttttcctagtttcaytgaattttttatctatattttcttgtgtcttttccctcaaatcattattttgaattcctttttaggcaatttattgatttccttttctttgggacctgttgctagagagttaattatgttcctttggtggtgtcatatatatttgttttttcatgtttcatgagtccctgtgttcatgtctgtgtgcctgtctggtggaacagtcgtctcatctaaattttctagagtgactttcatggagatatactctcacctgtagctaggtcttagtgtgctggtcgggaagggtgtggtgcttctttttccaggtaggtgcagtggtatagtctccatgcagcttcttcagctgtattcaacatcatcaataactgtaggcacctcagtggtctgtgctgtagaagtttgtggtaatggatgctggtggtgtaggttgttaatgtcctcagtggcaacgccttttggggccctcctattctcatttttcccataatggtgagacttagccaaggggatccctcttggtgtcaggtctgacatggcctacgagcacctgctgcggtgctggcttccagttgcggatgcgtagagtaactgtggggctggagttctaggctcaggatctcacaaacctattatggtacttgtgtcttgcagtgcatgtttactgtctggcaagattgaatgtaggttgcctatagcaccaggatctgtgactctgggttactccctagcaccttgggcccagcgggccagtctgtagctgggattatacactttgtgggcagggtatagcccgggcttgggtccagggaagaggtgctctggagatttgagcccagagcacagtgcatggcagtaatttcggagcctgagccaataggactcagtgacgagttgggtcaccggggatggaggtggtggtgagtctagaccctgggatggtggggcttggtggtatcccaaagtctgtgagaccaggtgcagcaacagcaagtacctcagaatgttcaagcacagctgtcatttgggccctagggggcagggaacagcacagtgatgactactgtggggagaagggtgtctcagcagctcagactctagggggctagtctagctccagggaagcagggtgctagagttgtttggcctgtaggcatagtatcccagttcagccactgatatttccctgggatgtgagttactgtgttggcttagccctggaatgcacagctcctcaacttggccaaggcattattacctgaaggagcaatgtgctgctttatctcataccctgcagggtgtgacttttctgtgtaggcccaggcactgtttctttgggacacacggctccaccagtgcactgtttactcaggagggcggtgtgcggtttcagttttttgaagttgtataccagtaacatacttatcatttaagtgatgagacttaggatttaaaaattggtactatgtctaataatgtggatctaatctaatatctaatagtatataggraataactagtgatttactttgtttaatcacttaatgtttcctctagtccaagtcaaggtccttgttgtacagcacagtgtgcattcaagtcaaagtctgagaagtgtcgggatgattcagactgtgcaagggaaggaatatgtaatggcttcacagctctctgcccagcatctgaccctaaaccaaacttcacagactgtaataggcatacacaagtgtgcattaatggggtaagcatttaactatatgttttaaaatttaattttaraaaacttgtttttcagaagaattattgatgcttaaagctacatagttaaagtaattaatcttggtctctgtttaagtaatattccctcacaaaaccatgaatatattatgtggcattcaattagctactaatttgtctttcatctttccatgtacatgtggttgatattctctagagaaacatagttgtacaactcggcatgtgatttgtctataatatttaagttttataaaataatatttcagtagcctaaataaaagaactctttggtcatcttctctgaatatcaaaccttcaaagcttttgtggctgaatatcactttgctctacaggaaaaaaatttaatttttctttctttatagaagagccgtaataaccaacataaaatcgatcctcatctaatctcttgctctgcttttatttcatttttttaagttgccattgctttaaaagatttactatctttcttggatttactgtttttcaaattttttcaaatgtatttatgtaattcagttttgatactcatctctgtttgtttttcactttcatttccatttaaatattttgacattggaagctcatacttgcctgtctgttactataaaaaataggtttgactgtatagggattaaacaatttgtcttttatttttcttctagcaatgtgcaggttctatctgtgagaaatatggcttagaggagtgtacgtgtgccagttctgatggcaaagatgataaagaattatgccatgtatgctgtatgaagaaaagtaaggcttttaaaaacacaagagtataaaatttgcctcaaactattattttctcctaaattttaagtgtaaaactttgacctacagtttggccagataatttccagctaaatcygtcctcttgaggagattataaatgtaacgtagcattgtgtctctattattatggtctctacaatgttttaaaaatgrtaaactagacaaaacgttgccagctttacagcagtaatttacataaacactgttagactttaagtcatcgtggacactgagtcaagacttgctggttgcttgtttacattgtaacatttaatatgaattactgatggcgttacccagcctaactagagaaggtctgtataacatgttatggtaatgatttcagttttttttccctctttgtatttgcacaactggaaatctgatctkcaacttatatttgaatctgaccttcagcttatatttggcatttcttttccagtggacccatcaacttgtgccagtacagggtctgtgcagtggagtaggcacttcagtggtcgaaccatcaccctgcaacctkgatccccttgcaacgattttagaggttactgtgatgttttcatgcggtgcagattagtagatgctgatggtcctctagctaggcttaaaaaagcaatttttagtccagagctctatgaaaacattgctgaatggattgtggtaagtatgttttttatttacaaagaaaacttaaagtggtttgatcttaattttacttggccagaagtcatcaaagttacgagaaaacaacttaactatttatattagaattactttatatgaagatttttaaagttctaatatttctggttattatttccttctgaagtgatcagaatcatgtgtatcattcatagattgcttagtaggtgatgggagtcattctgttttaccgtgctccttagttcatctcctggatgggttacttcttttggtgcatattattagggcattttcatgggacttaaaaaacatttttttttgttgtttttcaagacaacttatttgcccaaatcgtggactaattggtgatttttcctgatctttcagtataatctctgggtctttatcttgtttgtaataggaaatgttgaacagaataagatcagatacacagccttttgtagatctactaatgattatggatgttcatccagcagtaatccactgaacgcttatttttaagcccacatatctccaagttgtacaaacacagaattacctgatgttttcttaaaagattgtcaagattgactatctcaacttaagtgttcatgctttaaaagtgataacattaaaatatctataggaagcttgcaaatgatatatttgagaatgtgctataattgaactgaatgtagtttgctttggaaattgacttataactcacattcccctttctcaaattagtgtgtatgtgtgtgtgtgtgtatgtatgtatgtgtgtgttcagaactatggatgccttaaagcacaaaagatgttgtttgtgtgggatgtcagccttttttgtactcttctaataacattctagagtaaaaattttatagttaaccccagcatttaaaatgatgtttaccgttcctaggacacattaggatatgtggtttttagatatgtaatgatcatggagtagaaggattgttgaaattggatttaggagatctacctaggtttcaaaccaaatacttgagcagttgacttaacttaggtttccttaaaacatgttactctttttttaaattcctgtgcttgttgcrtggtaagttctagtaaatacctgtcaaactgaagttgtcttctggtaccatggtgcagtggaaagagcacatgtttgagaatcacgtaaggattcaaataatctttctggtgtttatcaattctgtgacttcaagcagcttacctttcttggcccttctttattttcaactcagctatttttttttctgattgtctctaataagaaaagttgaaatttggtatacttgtctgctgtagaagacagtgtatacagaaaacgaaaggagatctcagaattacattctactgagtatatattgtgctagatattttagatttttggggtactaagtcatatctaaacatagcatttttttacttttctctgttatctctaattttcactcattacattatttagaatttcaaaagcccatttattttcactttaaaaatatttaatagacatgatcttttaagtatttttaagaccttttctccccatattttagatgtgaggattaatgaaatgtttcacaatgaattggcaacatgaagtcctttcttgtgctctggaactaattaatcagacactttcaagttcatagacgttgactttaagtgtgtgtgggatagaacatgcctttattttatatcattgttgacaggcatatgccagtctttcgaatagcatgctcataatgtgtgaagagtaccgctaggctgttggtgcatttgtgggcattaaccacatcaagcagtaagataataaacatctggtctttacaagttacttgtctcatttgcttatgtgcatagtttacttgcataccgggatttatcatgttagggaagtgcccttccagttagtaatacagattatcaggatgctcttgtgtaagaagctgtgaaagaagtgaggggttagtttcactactttcctttccagtggtgcctggtggcgttttgtcttctttctgtgttacactatggcagcttttctcctcatgcagggtagagtaggaagaaccttaacaatttagaacttcagggcatgggttattgactgctgctactggtaccacggaagtgatactttcttttctgtgttgacaactatgttttgatttttccaaatacatttactgtatttgctgagtgcctactgtgtgtttggacaggataaaatgataaacatcctttggatttatcaaagagtcatctagttcttgaaacatttaagagcattcatcagtaaatctgttgagaccttatttcagcatctccttttctttaattagggattgagggcattggtaattcatttccagtttcttctatagttgatgtgttctgattttctgtatctttcatgttaggtttgacattgtagaaaactacctcttaccttgacttttattgttcaaatgtattgttgtgtttcccctccttttaaaaatcattgcctgatgattttgtggcttttttctttttaacttgttcagatttatcaggagtttgtatttttgtattgctaatttatcaagagtcaaacacattctcattttaaaattagtttctgctgtcatattttgctataattttatgcatctaagtaktaagtatctggtattctttatgaatgaaagatttagagcactgtttcccaaatgcttaacagaacactagttccattagatgttctgggccttcaatggtcaaatgaatctggaaaactactccatactatagacctttcttggagatttgtgagaagacctgcaataaataaatcgtttaaacttcattttccaaacttacctaaccctagaaacttttatgatgaaaagactaagtcctaaatatccttagatgtcatttggaaaaatattgattaatagcagtagttctcaatcctgattgtataccagaatcaccctagggtttggactaattaaatcagaatctcttgggtttaagtatctgggtcttttaaaactctccagttaattctgatgaggagccagggttaagaaccactcatctagaacaggggttggcaaactatggcccatgggccaaatccagcccgtgcctatttctgtatggctcagaagctaagaacggtttttacatttttaaatgattgaaaaaaatttaaaaattatcaaaacattcttttaaaaatcatatgaaattcaaatttcagtattgataaataacattttataggaacatggccacacccatttgtttacacattgtctttggctgcttttgcactttgagtagctgcaacagtgactgtatggccccacaaaacctcaaatgtttatctgggcttttatgggaaatatttgccaactcctgatcgagagcggtgatctcaaagtgtaggcctgagaagcagcatcagcatcacctgggaacttcatagaaatgcaaattcttacgttccattccagacccactgagtcagtaggtgatggtgcgtgctaatagtttgtctgccatttttttcagtctctgtgatatgtgactcctttttaaaaagacttgtaacagaaattttccattttatcatcttgatatgttgaaaatagaaggtggtttcattgctttgtggaacagaccacatagcatagcacttaatgaaactttaacaacaaagatataatgatattgtaaggttttcagcatatagtgaggacacagtatacatttgctagatraatgaagcagatttctcaaawgtaataatttatatggaaaagagtaaaacttgtgcatattaactttgaaactggaatgttttcaggttcctgttagtggtattttatcttacttgcccaggttgagcttaaagtaaccaaaagtttagtagcaagttgctttctgcttggcagatcgctgttgctgctgctgctagtggtggtgggagtttgaaggataggaggagtatatattcaaagcccagactatagtattatgtcttctgaaaaattgaaaggaaactttctgcccctatagggatgacataatcagtatcatggcaaggagctctgggccccacatggtcttgtgacccatgggaagtccagaatgcatttgctgagagtgagcgttgttgaacactgcagtattcattgaaaggatcatatggttgactttctggaggtctttaagaacagtagattatcttatgtctgaagagacttgagtgcatgtcttccctgtcctcgctcatgcacttttttttagatgatacttgctttgtcattttgttaccatataggttctttttgtttatatttagattatcaaattaaatactattgtaattaatacataataaattagactatttaattttgactttttactttattattggctatgtttaagtgcctgtattgaacatcatctctctttttcttatgtagaattattttctgagttgagaaacttcttgagtttttgaaaaatggttggatgtcttctctttgtccctaaagttttgcttaacacccttgtctctgggatataagaccctggcactcagtttacgctcagtaaatgttcattgaatgaatgacagctcccctttctttcagactaacaggtgggcaatttgtgatcttttcttttgagagaaatgcatattttacatttactaccctagttagtattcctttccctgattttatagtatatttaaaggggatagcatgtaatttagcatttaactcattctttttttaaaaaggaaaactataaaggtggccgtacttactaatattttcagatgcactatttattttgtttagtttttcttactgtcttttgtctattgccatgttccatttccccacacgctaaattcacaaaagctactatcattggcactaaaacatctcaagcattgggcttgtgagatacatagttacctgaaaaaatttagaagaaagccaggaacactgtgctagaaggaactggaagttctgaagggcttgagtgccatattttattatacatctgttgatctaaactgcgactaggttctttttacctttgttttctacagttttaaccactactaaatctgggctttctgtctccaatctgcctctcttactgccatagcgtgtactcgtatggctctttatttaaatctataggccaggtacrgtagcttatacctttaatcttagcactttgggaggttgaggagggaaaattgctggagactagcagttgaagaccaacctggacaatctagcaagacctgtgtgtgcaaataaataaataaatgaattcgcagggtgtggcggcatgtaccttgtagtcccagctactcaggaggatcaccacagcccaggagggcaaggctgcagtgagccgtgattgcaccactgcattccagcttgggcaacagagcaagatcctgtctcttaaaagagaaaaaaaagagtgtgtaggtactaaaaagactatcattaaatatatccaaaccagttttactgtcctatctctgttgtaacggccttgtcacattatttgtatgtgttaggcaatctggaagtaataaatgagctgttagttatgtttcaaggtcaatatttaaataatgacttacttgtaataactagttcaacaggtattttgtttgttgggtaggtactgaggtaataggatataagtccagggagctcacaggtcagtttgggatagagaagacaggccagagaaacatatcttcagtctgtgtgctgttttcacagaactgggagaacctattaggaaaagcctttaaggagataacgccagagctaagttctttgtttatttttatttttgaaatggagtctcactcagccacctaggctggagtgcagtggcgtaatctcggctcactgcaaccaccgtctcccaggttcaagcggttctcctgtctcagcctcctgagtagctgggattacaggcacctgccatcatgcttggccaatttttgtattttagcacagatggggtttcaccatgttggccaggctggtcttgaacacctgacctcaggtgatccacccgccccggcttcccacagtgctaggattacagacatgagccaccgtgcccggccaagctaagttcttaagaattagtagaagtagagagtacagaaatattttatggggacagagcatgtgaaaaagtcacagaagtatgaattttgcaaaacatttttttctactttttttcttttgaaaagtttgattattctttttttagttgacaaagtaatacattctaaagtaggccttttttttttttttttttttttttaaccctggacccccaatctttctaggatggatttcttgtgtattcttcgaaactgtctataccactgtaaggatatttactttttaaaaaggtggaatcatatacactttgctgtactttatcgtgtgctcaagtttttscttttgctttttttcctctctcctacatagtggtctatcttggaaatctttggtgggaagcattcgaagaagggtttgacatgaaggagtaacatggtcagttccatattttaggtagccataacactgatggccatattttcataaaaatgaaagtaaagatgaaggaaggaaatatattgaagatgataatgactttaggaagagaagtgtgtctcctgtacccaacttgcccatcatcgtgagaaagctagtaggaaaactcttaagcctttgtactcatggattggctcacattagaggtgttaccacttccccagcaggtgtttggaaatgtacggttgttgtcagagtaactgaaggggctctactggcatttgatggttgggggccagggatgctaaactttctgcattactcaaaatggtcrtrtactgctttgacagactgagggtggccttctaccctgtcttgcgataagtagcaggtctgttatttgaggatgaataaaaacaaaaaacaataggagtctatggaatacctatataataaaggaatgggaacatcatcctaaagactaacaaggagagcagagctctgaacacaatttttatagaaaacaaaataaaacttaaaaaaaaatctggcagtctcaagaagtggcttttagaaagtagattgtaaagttttaaattccaagccagattcagccctgtcagcatgttttgtgtattctacacattgttttaagaaatttctcacaagtttgccagcatttaaaaatagattttaaataaaaattcggatatattgcttctcttgaaaaatcagatctttaagcagtaaggttgaattgcattccaccttaccttccatgtaagcttttgagtttgccgtccctgcaataacaagcaatgtgagggacaaccatgatacagtttttacagattgaacaataaacatgaaaataaagagaagaaaggtgtctgtgggactcttctgtatagagatctaatctgagaattaaataagactgagaaatgacactcaagtgtaaatcattctaagtttgattttaaaattgaatatatatatgaatatgtgtgtgtgtgcatatatatgtacgtatgtatatatctctttcccttttttattccctctccttttttgaagcagttaattcctaaagccattaggtgagcccaagcaaggtaggcatccacgccaaagttggggagctatagtggcacagagcagagtgttggaagctgaccaggttcagaaggtgtgggatggggaacactaccagtatggggtttcagagcccaagcagggtgagaattgcacccctgtggaggagtgactggcatgggatgtcaagagtgcaagtaggatgaggaaggtgtctacataggaagggtaggactaaaagaaaccagggctctttggcaggttccaaggctggggtagggaaagaacaggataaatctggaacttcttgttgggccagaaagtaagaaagtgctcaaagaatgatgaggacatgtccaaaaaacacaataatgtcagtaattgattatakatttataaaaaataggaaaccatgagggaataaataaatgaatacrttgaaagtttgatgaagaacaggatatttacatacttccaaattaggtccctacaaaattttcattgtctacaaaagagaaacaagaatcatggtaaaatttggcagataacaccttaatccagtgatcaagttaacatcagcagtaatgaaataaaaatcacgtgttacttgataggatgcagcgagaacacagcatctgtgatattcttaccaaagatgtgtgacctgaatttgatcacaaagaaacaccagaggaacccaaattgaaggacattcccatgcaaaataactgccctgtaatcttcaaaagtatcaaggtcataaaagccaaggaaacactggaatttttccaaatcaaaggagagaaaagaaacatggtggctaaatatagcacacgattctgaactggatagtattgggacaaatggcaaaacctgaatggggtctgaggattaaatgttagtaatgtatcagccctgatttcctgattttgatgattgtcttgttatctaggaaaccacccttatattgtagaaattatatgctaaaatgttcaagagtaacagcatggtgctagcaacttactctgaggtgcttccagatttttaaaagtttttcttttttgtttttgtttgtttgtttatttgaggtggagtctcactctgttgcccaggctggagtgcagtggcacaatctcggctcactgtaacctctgcctcccgggttcaagcgattctcccccctcagcctccttaatagtggaattacaggcacccaccatcatgcctggctaatttttgtatttttagtagagacggggtttcaccatgtgggcctggctagtctcgaactcctgacctcaggtgatccacccgccccggcctcccaaagtgctgggagccacctgggagccaccgtgcccggcctcaggtttttaaaaggtacttggaacttttgaattgtacttgcaacttttctttaagtttgagactctttcaaaataaaacaaatgtttagaaagtaggaaaggctttgtgtacacaaagaaaaagtggcttgggatattttgctacaacatgccttttaattttagcattactctcattaatgctaaaattagcattagtattactttaattatataaacactgctggaaaaactaaacagtgtagaagtagtacccagtttgttgtaagtccctaagtcatagacagtcttcttaaatgggagttttgctggaaactattagtagtaattatatatgttacagtaacctgtgttaaataaatgtaaaggttcagttttgaagctgtaaatattttgtatgatgtttattagtacatgtggtcttaaaacaaagtttgaatatttggaattgcaaaatataatttaagactagacacagtaattttcctataaatttatcaataatttttgaaggtttttctgtttggctaattgatttgtttaatataggtcaggttaaaatagaagttttggtttcttctaagacgggatgaactttgcctgctgctaaaatatgtatcttcttccacttttcatatttaaaaagatagcctataaactaatgaatacaataaagatattatatataatgtaatgaaaactgatgtatataaaaagtaatttcataactagtccgagtctcaaattccaaatgaaataaaagaggaaaagggtgtctcaaagagatagaatttcagtcttaactttgataattagaaagcaatgtaggttaaagagtaatttttaaatgtattcactagtagaatttaaagcaagttacatgctttctaagccatggaaagtataaacgcaatcaaaacatagtctataagagtaagaggagatccttttgtagttcataagtgtgatgattgggtttgcacactcatatgtgagatgtgccttcctcaaaccttgttagggcattggcacattatccatttgagggagaaaaaagagtaaggggaaaaaacaaaggcaatatttaaaccagaaaatatttaataacatgggaaaatgcaatataactatatgcaagatgaccccagttttgtatttgtgttcatgtgtatgacaaatgttgttatatgtaaagagactaaaaaaaatcagattgagcggtttcctctatgagatgaaattatgggtgatttccattttctcctttaaacttttttttatatttaaataatatatatgtgcaaatatctaacatatgtatacaactcctaaacaaatgttctttaaaaattacaatatactgtgttctattctatgttttatatactgtaaaagatactctaaaatattttgtagtttttttttttcagtggaaaaatctgtttatttctaggctcattggtgggcagtattacttatgggaattgctctgatcatgctaatggctggatttatyaagatatgcagtgttcatactccaagtagtaatccaaagttgcctcctcctaaaccacttccaggtaagaatatttgagcaagatacatatttatgtaactcagaattgtttagcaggtagaattgaattataaatgagtctgtagtaactaatgttacagtactttctccgtaagaatgggattattggatgaatgatttagttgatatttgtgtgctttttgtcaatccaatctggccagtgactgctaagttaatgctaatttatctgagtgtctgaaaatatttagaactagaaattttaaattttgcttggtatttgttttcttgtttttttttttttaaatatattctaacatattcccttgccatgattatggtgaactactttaaaattgttgatctttctattctaatagttgtgcttctcatattgttgtccttcattcctccttccttcccttccatcttccctccctcccgccctcccttccttctttttcttttttctttctctcactgtgttgcccaggctggacttactcctgagctcaagcaatcctccccactttagcctcctaagtagctgggactataggcgcgtgcactgcacccagctctcttatcgtttttagtgtttgtgctcttgaaatattttctggcacataagctwattttcccccagggtgatgcttgtggggacatacagatcccagtctgtgggaaagtcttagagtagaggattcwttcatcaaataagcacagtcaagtattctccattcctgaaaacaactctttagttctggtctccaccttttacctctcagggagacatagcatgaggaagaaccctctttagatgagctgtgggcattggaaggagaaaaggacaggaaakaaacccttcgtattgtttagttccctctgtttatccctccccttctccaaggtattcgtagctattctctacaggtgtgaggacagacattgtctcagggcagcagcaggggagagccagaactaaatgacagcagttccctctcctgccgctctcagacttctcataagatgtcttgcctcaggcaaatccactaccttatacaaagtagttcaaaactaggtttcttacactttttctctgttttccctcagttgttcacctgcatttacctgtctggggcaagatggcccagtagtcatgctaggacagtatcttagtgagagttagaggaaatttgatttttatatcattgcttttcttaagttcacaatgttagttagcactctggaacttatgttagtatttaaggaagttctaagggccacatgacactttttagatgctgttaccaattgtggtcttattcagtgaaacattttatgtgtatgttggtttcattttaagtgaatagcacctttaaaaacttagaaaactagctgtcatttattgaaccctcacaaaaagtgttaaacatttttatatgaattatataatctttacaacaggctatatacgttaattatcatccttgttttacagtgtaggcatctgagtctcaggttaaggcatttgctcaaagacacttagtaattccctcatatggattctgtccagaatctgtgatattaatctggattaatctaatacttgtggctgctgagcactgaattgttgctagtttccattgaaatgtgctgttttaattaacatacataccagactttgaagatttagtataaaaaaagaaatattttgttagtaatttttgtattgattatatattgaaatgataacactttggctatattaatttaaataaaataaaaaatattattaaaattatttcaccttttaaaccttttttattgtggctatcagaagattttaaattacattgatggcccatattattggacagcactgaactaaaacctttcttattgaaacagcagctttgcttttaaagattaaaaagctcatgataaataaatctgctttgcttttatttgtggctcacaggcactttaaagaggaggagacctccacagcccattcagcaaccccagcgtcagcggccccgagagagttatcaaatgggacacatgagacgctaactgcagcttttgccttggttcttcctagtgcctacaatgggaaaacttcactccaaagagaaacctattaagtcatcatctccaaactaaaccctcacaagtaacagttgaagaaaaaatggcaagagatcatatcctcagaccaggtggaattacttaaattttaaagcctgaaaattccaatttgggggtkggaggtggaaaaggaacccaattttcttatgaacagatatttttaacttaatggcacaaagtcttagaatattattatgtgccccgtgttccctgttcttcgttgctgcattttcttcacttgcaggcaaacttggctctcaataaacttttaccacaaattgaaataaatatatttttttcaactgccaatcaaggctaggaggctcgaccacctcaacattggagacatcacttgccaatgtacataccttgttatatgcagacatgtatttcttacgtacactgtacttctgtgtgcaattgtaaacagaaattgcaatatggatgtttctttgtattataaaatttttccgctcttaattaaaaattactgtttaattgacatactcaggataacagagaatggtggtattcagtggtccaggattctgtaatgctttacacaggcagttttgaaatgaaaatcaatttacctttctgttacgatggagttggttttgatactcattttttctttatcacatggctgctacgggcacaagtgactatactgaagaacacagttaagtgttgtgcaaactggacatagcagcacatactacttcagagttcatgatgtagatgtctggtttctgcttacgtcttttaaactttctaattcaattccatttttcaattaataggtgaaattttattcatgctttgatagaaattatgtcaatgaaatgattctttttatttgtagcctacttatttgtgtttttcatatatctgaaatatgctaattatgttttctgtctgatatggaaaagaaaagctgtgtctttatcaaaatatttaaacggttttttcagcatatcatcactgatcattggtaaccactaaagatgagtaatttgcttaagtagtagttaaaattgtagataggccttctgacattttttttcctaaaatttttaacagcattgaaggtgaaacagcacaatgtcccattccaaatttatttttgaaacagatgtaaataattggcattttaaagagaaagcaaaaacatttaatgtattaacaggcttattgctatgcaggaaatagaaggggcattacaaaaattgaagcttgtgacatatttattgcttctgttttccaactacatcacttcaactagaagtaaagctatgattttcctgacttcacataggaggcaaatttagagaaagttgtaaagatttctatgttttgggtttttttttttcctttttttttttaagagtataaggtttacacaatcattctcataatgtgacgcaagccagcaaggccaaaaatgctagagaaaataacgggatctcttccttgtaaacttgtacagtatgtggtgactttttcaaaatacagctttttgtacatgatttagagacaaattttgtacatgaaaccccagatagactataaataattctaaacaaacaagtaggtagatatgtatgtaattgcttttaaatcatttaaatgcctttgtttttggactgtgcaaaggttggaagtgggtttgcatttctaaaatggtgacttttattctgcaagagttcttagtaacttcttgagtgtggtagactttggaacatgtaaattttttgcttgtaatgttatcctgtggtaggattttggcaggtacacacactgccctattttattttgagtctaagttaaatgttttctgaaaagagatacatgcactgaactctttccactgcgaatcaagatgtggtaatataaaaggatcaagacaaatgagatctaatactactgtcagttttaatgtccactgtgttttatacagtatctttttttgttcactttggaaatttttactaaaaattgcaaaaaataaagtattgtgcaaagatgtaaggttttttgaaacttgaaatgcattaataaatagacgattaaatcaacttgaaggttctatactctttgaactctgagaactatcacaagaagcttcccacaaggcagtgttttcttacagttgtctcttcctacaaaagtatagattatctttattcttaatactttggaatccatgtagaaaatttccagttagatactctgcgtacacacaataaacctttttaaaacacccaactaatctcaactgcattacattgtttctaatcaatattcagtgcttgtcttggtggaagaggtgagtcattttgaaaacttatggtcttgtttttatgtgtttttcaaagttttgaatgctaagtacctcatttattttaaaaagcctagtttaatgataagtttgtttaaaattttgagccatcatttttctcttcatagcaaataaggagagaattgacatttcagtgttacctagaaaaggaattgtaagcccagaataattccctgcatgaggtaatctgcttcaaattctttttttagtcaaggttagctataagtaatacttgttaaatgagtaaatatgtaatactttgtgaattactttgttaatttaggagcatcaaatgtatattatgtttagttatttatgaaactctcaatattgattgatttgggtaattataaattagttatttttacttgtaattgaatgcttaaattctgtttacagtccgtcctctctccctccatccctccctccccagttttataaattcaggtaccaattcacaaacaaaatcagaaataaaataaatttattgactgcttctggatttagcattccctgtagtgtcaagcaatgtcatgcagtttggggaagcatttatttaaggaaatgacaactttctctgatcagtcttgttttgtgaggtgtcttcaacactttatgctttgggtacttcgtgtttgtcacagtcttaggatagtgaaatctgatttgtccaagcggagcaaactactcgaccctcagtccttgtatttgtccctgtagtaagacctaattattattatttcttaaagatgggattggtgtccttggcaactatgaaatttcggggcttgtgcatgagaaggcatttcttattaagtatttctaattgaaggtatcagagtgtcaagcattacaaacctggacagttcacctggaggagtacaagaagagatattcattatccatatttaaagggtcaaggtttcccaaaaccagggtgcaagccagatgtagttttaaagcagctgccagggacagttcatctttagagaagtcactaaagttgtaagaaattttagtttccccaaaaccactttcaacttcttagaaactagaaagacaattggtttgccccacagaggacaacttcagtttcagcatctctcatgttgtgttcttgattaaaaacaacttccatttgatatacttttccgtttattaccagtttagttttttcactattgtttctgtattcaactctttatatgattaggatagaaatttagcccttctgttttatattactatattgtttgtgtgtcttagatatatacatgtatgtactattttcagtagaaattcatgtattttataattggtaagttcttcagagcatctcttctataaaaagcaacaggatgctaggtaaaacggagcattgagcaaaatactgattagtttttgctttttcctgaaatctacactaaagtgatagggtgtggggtaatccaacaaggacaaggtgaattgaacaagaacgaaatctggaagcagatgaaggagtactattgattgggcagacccagggaagtcaaatcctaaaccagcagtgggaacacaacagaatggtgtagtttgcactggtaagatttgggtacctggcagggctgggtgcggtggctcacacctgtaatcccagcactttgggaggccaaggcgggtggatcacttgaggtcaggagttcgagaccaccctggccaacatggtgaaaccccgtctctactaaaaatacagctgggcgtggtggcacatgcttgtaatcccagctactcgggaggcagaggcaggagatttgcttgaacccgggaggcagaggcaggagatttgcttgaacccaggaggcagaggctgcagtgagccgcgattgcgccattgcactccagcctgggtgacagagcgagactctgtctcaaaaaaaaaaaaaaaaaaaaaaaatttgagtacctggcctttgttactttttttctatgtgtgtgacaaaaacataatatgcacacttttgtaacccacctttctcatttaatggtacattgataatgtatatcacattaactactctaaatatttctgtggatgtatgtttttttttttcttaaccaatttcccattgtttggacatgtaggttccacattgtttattattttaaacaattctaaagaattttaaacaattcttaggaaaatcctcagcctaataatgaaattaattcctaaaagtggaattgttggggtaaaggttttttgagggacattgataaaaattatggtactgtctcccagatagatgtaccaagttatactaccacgatttwatatatatatatatatatattaaatcagagtcccatccttagaaatccacatatatgcagccacatgaatgtattagaaacaataatagaagactcatgcttaattcagttgattagctttagacataattcaaatgcaagtcaaattgagtgccctaattgtggtctcttaagtaccatttttcttcaagggaaccagactcctttggataaatcactaattccacctgtaagaaagaaatgtacaagaagaacctaggaaacattgttttgtaccagatcagaaagattcaggaggcaccttagaagttaccactggccaaggctgagataactttagcatcagcaaggataatatctgcaagagattgaaactcatagtattgtatttaactctgtgagttaatgatggtagtggacagaattatagttacctttgggatacgcttttaaagaaattccaggtaataagagaaatgatagaattaggatatcaccattttacccccccaacaatttatggatctagacaataatcgccagtgactgctaacctcacaaagtgagagcaatcagattttgtgcctcctaatggaagtacatataccacctatgaagcagttctgccaaaagtcacatctcatcatgatgaagcctcctgatctaactaccccttcattagaaatacaggggacagagggacaaataatatacaagggactcaatcagcaaaatccagactctggaaaactacaagacatatggtcctgcttcaacaacagaaatgcaaagagaaaagacaacgatgggttaaaggagacttaagagctacatctatcaagacaatttatggacttatttggatactgatttgaacaaactgttgagaccattggaaaaatgtgaaaagtggatatttgatattaaggtttttaattatttttaggtgtgataatggtattgttacattttttaaaggaccccttttagagatgcaaattgaaacacttaaaaaatgaaatgatacgatgtataagtttttgcttaaaaataaggattgaagttggctggtgtgtgtggatatagttgaaacaagattggctgtgagttgataattattgaagctgggtgatgggcacttggggatttattatactattttctctacctgtgtttatatttgaaatttttcatagaagttttaaaatgtggccagttgtgatggctcatacctgtaatcccaacactttgggaggccaaggtgggaggatcacttgagctcaggagttagagaccagcctgggcaaaatagtgagactccatctcaaagaaaaaaaaaaagtgttttaaatgtgaatcaaattcctatagaagctgattcattactgtttttattttagcagtaattcatgataatgacctgtattcataatgattttcataatgattgttttagtggaattaaacttgaaccagtcaagctaacataattatattctgctccagttacaatgaataattaattgatttcaactgctagggtgaactcttgaagctatcagtcatccagcaatcttagcaagcaggccattgggtccctgtttgctctgtctctctctctctctctcactgttgaagggcttagctaactacttaagtaaaatatttgttctctgttaaacatgtcaaggagtatggtcagcttatccacattaagcctgtgtgtcccacgttggagtaaatgttaagtagctcactacaataaactagattcttctgccctctcttgtttaaatgatcatgttccctggaggtggaaatagatctttaaaaagatattctgtagttgtttgttctcagtgtaaaaaaatgagaataatttgataagagtgtaggttgtcttatataaaaagtggttccatttgcatgaattttagaaaaatcattttggaaaaatgaaggctatgtggttatactgaacacattaagcaattttattctttattttaaatgaatattttattatcgttttcttcccttgccctttgggtatgggagttagcctttgtgtttctaaatacaacaggccggtttttataaattaaggtgtcaatatattcttcattatttagttttgtgattgtggttagttttcatttttcttaagtatctgctagtagcatctgtaattaagtgaagtgacctgttaaccattttcctctttctcctcctttcctcctccttgaaacatatcagagcatgtttgaaattctttggcttttatggtatgcatttgctgatatgcattgaccagttaccttactcacagatacttcttaggcacttgattgtgccagggccttggctagatgataagaatacagtagtgaacttaacagtttccctgccctggtgaagcgtatggtcttgtaggtgagatagatatcagataatcatgtgaataaatgtacaattccagctgtgatacatgctgaggaggaggtttttggtgatccaagagctgatcatgcagagataggactgagaaaggagggtgggacgttgtcacagctgataatgcagagataggactgagaaaggagggtgggacatcaggaaggtcagagaattccttatgaaagtgatgcttgagtcaaaatatgatggatgaagagagtttaaatagattacatagaatttttaataatgtcgattggttatatactgggcactgatagctgatttttctttggggaaaggtatgtcagcctagtcattcagattcctttatttttttaaatgttttttcattttttgctttgcattgcattcatttgctgaagagctggcttgtactttggcaggtgtcatacttggttattctccttaggatattggcccaacaatctgggagttgtgaaaggcgcttcgcttttcagacctgggcgtctgtatcatgactatcataaatttaggattaagacacctagcctcctaccagggtgaatgaggtgtccatgtgacctgctgtgccctggaattttatacatctttctctcatagcacacaccatattacaatataatcctgcctcatctaagccaaactttcgagagaatcatttacactcagtggctacttcagctcccattcacttatcaacctgctgcaatttttcacagcccccaaaggactgcagtctgtgccttcagggagctgagggtctagcggaaggaaagaaaccagcagttacagtacagaggggtttgtgttggaaactctacaaacacaggatgccctggtagctcagaggaagtgcatatcgagcatggtaggtaggtagtgggaagagccaagatgacttcccagaggagaaaagctggacctgagttttggagtttcggtaaaagtttgctctaactagtccaagctgctgtcacaagcttttagaaatgatgtaaccatggggcagttgactgtcgtcatgttctttgctattttcatgactctggatgtgcttttcctattccctggattgccctttccctcgattcctctgcaggactgggctttattaatctccatttcc

SEQ ID NO: 17789 - DNA, 21130 bp, Homo sapiens
  misc_feature (1)...(21130): n = A,T,C or G, or insertion/deletion polymorphism (see Tables 1-2)
aactcagtttagcccagaaagcacaacctgagaaaagggcttgtgtgcatgcagtccctgtagaggtggggaggcaagggcaagtaagtttaggaaacaggagggggtaactaggaaggaagagacagaggaggaagcaaatacaatggtgcattatccttcaagtcaggattgttgtcatctccattttacatatgaggaggctgaggctcagggatgatccatggcttccctgaagccacaaagtaaggatgcagcagtcagaatgccagaattcaaatgtggattacgtggctctccaccactagctcccagggtattaagtgcagggaacaggaagacccccagcctctatgcttagacattgtgccactttagaatagtgtccaactctaatcctttcaacaatcttgtccaattatgtatttagagagattgtctaggcctttccaatcaacatttcatgaatatacaagcctaccatcaaccaattacgagtgtgtccagttctcagggtgacctgagagccacatggaacaagaaagctttccagccagtgtttccagcagcaagcatcctaacccaggcctcggaatctgaagatacagtgctcaaatatcagtgcttctgagctactaaccrttgtaattgcccaagtagatggccaatgaattgcaataattcataattcagtttttggttattaataagatttattgtatcttacacaaaagagcattataaaatgataaatattgtaggatagaggctgagatataaccaaatattgctcttgatctttagcaaaaatcactttcaaaggacaattgattttcagcctctgattaaatccctgctagtggaagtgtagggaggtgaccagctcctatctcaatcagccaatcaataattataagccgggtggggaaaaaaagcagtagtgaaatagtttaaaatatcttattccatggtctcaagtgccgcctgctgactaaaactgtccacttccaattccagcacttattaaactagagataatatgttaatattaatttgctttaattaataaaatattcctagaatatgattttaaattcacatgacattcggaagtcacttatatttgcagtattcaagaattacatgaagtatgtgctcattaagagcgattttaaattttatcttttgtcaccacctggtggtagaacattttctcacttttcttttttcattttaagccttacgttgttgctaaggaaaatttctaaaccagggaaaccagttaaccagtattgattgtcaagtattaatgtatactaaacatactgtatgtacttaatatctattgaataaatgaatgagtttttaatctgttttagtggattgcaaatgtacttaatcttttcatttgaatgacaagaagttctcaaatgtaatgaataaaagcggtccacagtattattttgtcagaggcagttttctttctttaaagtttaattggatttttgtttatggtaatacaaacacataattaaaaagtagttgatttaaaaacgcattttattatgccctcaagaataaattcatttaacattgtaatatttttaaaatattttccataatactaggaggtaggagaatatttaattagaatttattaaacatgattgagaagatgtgaaacttttgcaaattcttaacttgaactattaagaataaaaaaggaaaggaaagaaaaaaaaaaaaaaaacaccaagtcgcacatcatttgttgtagaccatcgccaccttgtgtttggagaaagatgtactaaagtctgagaatcttttaaggtggaaattttttattgctggaaaattcctatttataattaaaacaaaactttactggaaacaacatcattccaaagtctgacaatataattacctcctacacaattagataggttaaaatgtcaaaacagttgattaaaagttatgagtcagagtcatttctaagcccccagtttgactctcgctatgacatcttgggaaaactacttaacccttttgagtctcatttctgcatcagttacacaaagggagtcgatctggcagatcatactcctctgagttctgtgagggcatgatgtggagggaatatcaattttgagtctaaatgcaagctacaataatttttctgtctccaatatttgcaatacttctgggtatataacctgtttaaactagaagttttctaactactttctcatttgtgatcaattaaaatatccatttgtccaatattactttagaccatatgttcccaaaagtaggactaataccaaacagcttccctatttctaattagtcaatcttatggtactaaaatgtgaataaaaagcatttcccggttatgaaatatgcacattagttgtttctctagacaatgtttacattaaaacaattctaatagctcatgtatattaccagatttcctcatttcatggctacttgttgaatacttactttggtatagacgtcgtgaaaattgtgaatagaatattgtgtctataacatatgaatcagtgaaacaaataagaacacataaggtgtaaatagaaattgacaccttgatgcttatctctcactttaaaatgcagacaacttgttctttttttcagacagtccctctgttcatagaggacaataatgtgtttaataggtcaaactgttaattgttccaataattttatgtcaaatgttttgagttttgttctgttatctctagaaataaaaattagcttacatatgtaaattagaacatgttgagattaatgtttatataagcccatatgtattctataaaaataaaacccaaaatatggggagtagggattaggatagcatgtgttattttgggtgcccattcaaatcaaggagcaaaaattggattatgaaactcactacaagaaccccatattacatgtcacttttactagtgccttgtacaaatttactcctgtggtcttgtttctacattcaaatgtttttccaattcacattttgcttataaatatacatatatgtcctatgtatatatttgcatattaccacaaatgcctgatgagtgctaatctttaaataaaagagaaaaagtaagtggattaaatgttcttctgagcatagatggagtttttcagcttagtagttggcaactccaacatccatgtctctgttgaagcgattaaaaaagaatcatttcccagaactacaggtgcacaacagattggagtcattatgcaaaagaacagaaatctggatagaaacccagagaataaaaaagccatgttcccggccatccttttgcctttaactcactgttttttcaaccctacttgtatctgcaacatgaaatatgaaacaattataatggatttgtagtaacccattcaagatcagaaatgtatgcttttaaacaaacctccaataagaataccctgcaggtagaaacacactaaaggtcaaacttacgttaacatatttttaaaagctaaagtttatgtagagaagttgatagactgaaatacattacatatgtctttaaagatacagattttctgctgtttttgtccctttttgccccaatttaagggaatcacatctaccttcactcatcttcattcagcctctgggccacctctccttgagatggagattatgagtgtccaaaatctccatctcaaatctccatctcaaagccactctgaggctgtaactgttgtcaccatatattatcttctgagcccttttctaagcaagaggttgaaaatgtacggatggctttgccttcaagcttttgtgatcccgcggtcaatatcttgaaagtctaacatgactttcctcatatgttctctcaagtatcttgccttttttctagctagaaagaaccagtaaaatgaaatgaaatcatagaaaatggaccgtcaaaaaattactgtaatagaagataacaatgttaaaaaaaaaagtctgaaaaccaaactgggaagtaggaatgatcagatgtttgggaaaagacgcttgggaaacagagaaacaggaaggaataatcctcgtagttcgaagtcgaagagaaggaggtaggctggacaatgcttgacaatgcagaaaggaatcacacactcaggtgtgcggatgtcaatgttgagtttgaaggagaaatgcaacggcgggagggggggagagacagcgagggctgcaaaggagagactcagtgaaaagaggtaggcagaaacactatcagaatgttaatcgagcgctgtcaaaatatatctaaggccttggttgattattcaacgttcaacgatgagggtgattttaggaaaccaaaattaaatctacgaaaccacccactcctaaatgtgtagggactagaggtcgttactaagcccttcagaagtaagctgagttgcttctctctgccattcttgctcatttgatttttcctgatgagtggaaagcaatgtttttgtttttgtttttcaagtaagcaatctcgctaggaaaaaagaagttggaaagcatccggaaaagaaagcttgtaagagggacgtgtgggagaactagaagggacgcttctggctggggccaactgaagtggggaagatctggggaggagcgaggaaaggacccagatctacttggagccaaccaagagaccggacgggagtggggcggaaaggcggagaccagttcgagcactaacgcgggggcgcgcgagtgtgagggttgcgggtccgcccggggctagggcggtcgctctcgccattgtccccgcggctttccgcctgtgaaacacgtccttcctctgggtccttgagcccctcccactttttggagagaagagccactcagttttttttcctaaggacctgttggtggacctctcctcgctttcgtaacgcggatatagccttttcccttcctggtaggaagaggaaggaggggtccgggaaggaagccgatttccttctttccccctctgcacgcttgctagccccagcgatcgctgctggcccccgggtaggaaagtggggttcctggccgtttctgcgacgctggcctagggcttgcagctgctgttgagtgaaagcacgcagactggcgggagccgatcatttctcgaatgaagaagaaaaagcgcaattccctccttatgctctagggaattgagccgcgtcccagatcacccattccagaaatgtgaaaccgggccctcacaaagtcgtctctggtgaagaggtggcgtgcggggtgggggttggtggagggtgaaggcataagcaaacatattttaaaatccagatcgtaggaagtgtcacctggcccctcacccaggcatgctttctgggggaagcgcagggccaagctttccctagaaaagctggggcgaagagagagcaggcggcggctaaggagctcctggcaggctgggaaggtggagaagtggggtgaggtatttttctagaaagtgtagccctagctcatctcctagattggggaagagggaactgagggaggagggaaggagacccagggcagctccaggatagggaaatgttgaagaagggactgcgttctccaaccgaaccctccctcctgggaaccgcagcccagcgcggtaactgagttaccgcaaccgggcggtggggaggaagggtggtccaggaaaccggcgagggagaaaagcggtggaagggagagtcttctccctggagcggccccagcagtacaaagtgctggtcacagcgccccttccgcccctagattgacgagcagtggcgtggagccagcgcggaggctgccccctccccctcccgagcccgcagcgcggagcgcggtttagcaccaacggagccgggggcggcgtctttgggatggaaaagggccaaaggggaggagtggggtgggggtgggggtttcactggtccactataaaaggaccgctcggctgcccggttcttgcactcgctggaaagcggctccgagccaggggctattgcaaagccagggtgcgctaccggacggagaggggagagccctgagcagagtgagcaacatcgcagccaaggcggaggccgaagaggggcgccaggcaccaatctccgcgttgcctcagccccggaggcgccccagagcgcttcttgtcccagcagagccactctgcctgcgcctgcctctcagtgtctccaactttgcgctggaagaaaaacttcccgcgcgccggcagaactgcagcgcctcctyttagtgactccgggagcttcggctgtagccggctctgcgcgcccttccaacgaataatagaaattgttaattttaacaatccagagcaggccaacgaggctttgctctcccgacccgaactaaagstccctcgctccgtgcgctgctacgagcggtgtctcctggggctccaatgcagcgagctgtgcccgaggggttcggaaggcgcaagctgggcagcgacatggggaacgcggagcgggctccggggtctcggagctttgggccmgtacccacgctgctgctgctcgccgcggcgctactggccgtgtcggacgcactcgggcgcccctccgaggaggacgaggagctagtggtgccggagctggagcgcgccccgggacacgrgaccacgcgcctccgcctgcacgcctttgaccagcagctggatctggagctgcggcccgacagcagctttttggcgcccggcttcacgctccagaacgtggggcgcaaatccgggtccgagacgccgcttccggaaaccgacctggcgcactgcttctactccggcaccgtgaatggcgatcccagctcggctgccgccctcagcctctgcgagggcgtgcgcggcgccttctacctgctgggggaggcgtatttcatccagccgctgcccgccgccagcgagcgcctcgccaccgccgccccaggggagaagccgccggcaccactacagttccacctcctgcggcggaatcggcagggcgacgtmggcggcacgtgcggggtsgtggacgacgagccccggccgactgggaaagcggagaccgaagacgaggacgaagggactgagggcgaggacgaagggsctcagtggtcgccgcaggacccggcactgcaaggcgtaggacagcccacaggtagaagaattgctctcgtttgtctgtccattcatcctcctctcctcactttatctatcccacgcgacttcagggtagactcctgctggcaggcaggakcataagtccgcggacagaacggaggcctggagtggaggaatgtggtttgaggtttggattggtgaactcagctagaaaacatacttgcatttgcccgaataatgaataaccaagaaaaaaactgacaaacgattttctgcaaactraagcaaagcatttaggccggggagggagagtttgtaacctgactccttccacctttagsgagttggagcttgtgcgagttctttccactctgtgtatttctttttaatgattttgtgtgcgccttttgtgcgggttgcaacgttgcgctgagttttgtaaccgctgcctgtgcgtgcatcctgcgctcacgggagggcggatgtggagagggcagaggagcaatggtgacctrggaaggyaccctgagcggctacgctagkatctctgttctgcagacttctgtcccctttcccccttataaggctgacccrggcgggctgaaggcggtggggccccttcgcagaacctgcttgggaggtctttcccgggtttgccccgcctcccagtttgcactccctctcgcggccataattctgctctcaagcactgttgaaagtcactgccggtccttcctgctacggccttctctctgtgcagtgcttattctccagttctttttgtttcatcactttggtgcctttttccttctttaactctctcgcgtgtcattttttaaagaattctccccttttcccctgctcctctgctcctgggagcaaagtggtcgcagcccagtttaggactttctgcaggggttgggtctcagtccggagtggaaggctctgttccaaataatcartcatgcctggaagctggaacttatttcgctggggcagtgggagtggggccagaggctgctgggcagagtgggtggtccttgtgcccggaattggcaagagcggagcaccccagggacccctggaatgagacagcagagctgtgcagtctgagattccttaaggcccggccccttggcagcagcccaggccctacccgaggccttccacgtggagcctgatgatctcattcaggatttgagccctcgcctgtgaaagagtgactcagggcctctgcctgccrctcttgctccaakattttactacaattgggtaggattatgtgcgaaattgccttgttcagactgtgggatttcaaagagaacagaagaaatcctgctcacacacagaaagatcctgaccatgcaaaggagcgcgtggtctttttatttaaaggagaggagagaactttaaaaataacacttggagtgaagatatgcaaatatttttgttattgttgttctgggtatatttttgctttgtttgctttgactggttaggctttcctaatatatgctaggaaggtaactattcttggacagcctgaccataagcaaacttttttttttctttacaggaactggaagcataagaaagaagcgatttgtgtccagtcaccgctatgtggaaaccatgcttgtggcagaccagtcgatggcagaattccacggcagtggtctaaagcattaccttctcacgttgttttcggtggcagccagattgtacaaacaccccagcattcgtaattcagttagcctggtggtggtgaagatcttggtcatccacgatgaacagaaggggccggaagtgacctccaatgctgccctcactctgcggaacttttgcaactggcagaagcagcacaacccacccagtgaccgggatgcagagcactatgacacagcaattcttttcaccagacaggtaagaggaagatggtaccagctgtgagactgtcctcttaggagtctacgttgtaccaaaaagatatatacaaggcatttcaccagtgtttttgcagttaaccttttttaattggctagcatggtttatcttactcatttctactgtaatttaaatatctcaagtttcacagttctattttaaaagcattagaaaaaagcttgattaaagtcacatgaagtcttcttatgtcaacaataatgaatgtagatgctccaaagcatatgtgaaggcacaccctgccaaaaaagttagatcccaagggtcatgctccccttattaataagtatttacctttgctttttgtaggacttgtgtgggtcccagacatgtgatactcttgggatggctgatgttggaactgtgtgtgatccgagcagaagctgctccgtcatagaagatgatggtttacaagctgccttcaccacagcccatgaattaggtaagtctgcttcaaagtagaagttaagctcaattcagaaatgtaaactggtaaaacaatataagaaggagagtctgtaggttatattgctattttaggtcctagtgcatcttagaaactatagaaaatattttgtcactatttcaaacatggtcatttttattaaagtaaaaaataagatagtagtagctctggacatttggaaatgtgtatgtttgtttacaccctgtgaaaagtagacatggtctgcaaaagagccaatctcctaaatatatttctttctctagaaatgttattttgggacaaatgaatgaatccctgttgggaaaaaagaacctgctgcatatcatccatattttattttattattattttttttgagatggagtctcactctgtctcccaggctggagtggagtggcacaatctcggctcactgcaacttctgyctcctgggttcaagcgattctgctrcctcagcatgcccagtagctgggattacaggtgcatgccaccacacccggctaatttttgtatttttagtagagacggggtttcactatgttggccatgctggtcttgaactcctgacctcaagtgatccacccgcctcggcttctggaattacaggtgtgagccaccgcacccagccatgatccatactttaatgtgggttctggattgcttcctaggccacgtgtttaacatgccacatgatgatgcaaagcagtgtgccagccttaatggtgtgaaccaggattcccacatgatggcgtcaatgctttccaacctggaccacagccagccttggtctccttgcagtgcctacatgattacatcatttctggataatggtcatggtgagatattccagctactctctctagatggcatccaacctttcacgcataaagtttagttaaatgaactctttcctttttgttctttttattttccccacttcaaaattacttttcctctgtcaagatcctaactgttgagatcttaattccaaataaaaaatagtgcttccggttgagtagctcccaaagcccattcattcacattgttcgcagatcaataacttcctgtcattgttaatatagaaataccccattgaggataagatcttaatagtaatctaaatctcttcagcatttccctcccccagctttacagttttcagatcactttgctgtctattttctcatatgataaatattttctgaaatgggatctaccccttcatgccctcactaactctgtattgatattggttggcatttcctttgcaggggaatgtttgatggacaagcctcagaatcccatacagctcccaggcgatctccctggcacctcgtacgatgccaaccggcagtgccagtttacatttggggaggactccaaacactgcccygatgcagccagcacatgtagcaccttgtggtgtaccggcacctctggtggggtgctggtgtgtcaaaccaaacacttcccgtgggcggatggcaccagctgtggagaagggaaatggtgtatcaacggcaagtgtgtgaacaaaaccgacagaaagcattttgatgtgagtttttctactgaaacacattcagaattgaaaagaacaaagtgatggtaaaagatatgataccaagttaaacatccccatccgtgtcctctagcaggaatgcgagatagcttatttttagaactgattctttgtcccatgtggctttctttgataccctaaaagttctctttagataattctaatgctgatgatttatgtctccatttagacgccttttcatggaagctggggaatgtgggggccttggggagactgttcgagaacgtgcrgtggaggagtccagtacacgatgagggaatgtgacaacccagtcccaaagaatggagggaagtactgtgaaggcaaacgagtgcgctacagatcctgtaaccttgaggactgtccagacaataatggtgaggagcaacggactctggttttaagaaactggattaaaaaaagatgtacccacaaacaggtggctcaagattggaaactgataatgttatcatattattctctttccaggaaaaacctttagagaggaacaatgtgaagcacacaacgagttttcaaaagcttcctttgggagtgggcctgcggtggaatggattcccaagtacgctggcgtctcaccaaaggacaggtgcaagctcatctgccaagccaaaggcattggctacttcttcgttttgcagcccaaggtagttcgtttttaccttatttttacctaaaaatcaaggcctgggcttgctaccttttcaaacaatttttgttatactttctttgctttccatattaacatatcttcaatttcaaatttgaactccttttcttttacattaattggcaactgcctgctttgagtttagtgttttcagttatgaatgaagcttaaatctaacacttcacatgcttgcaattgctcgctattactcttttatatgcaaagaaaagctttttggacagtcaagcgctcctctgtgcgactaggcttcacatacagctcatagttagatacattttatattcacacagtaaccagtagttttggaaaatagtctatgcatggtccaaaatacttgttactgggtaactagcagtagcaggtgcaaacagaataatagaagtggtagtctgagtattgattatttttatgtttgaaaacacatattgaactaggaaaagcatcatttcttttgctgttttgctaagggaatacatctggatctgagacagaaaatggaatttaatgtgattgagatgatcgtgtgtcattagcaccataggctatgaaaatattcccaagttgcagattcaatattcagcaagtgatttctgaagcacttactcttgccagatactaattattctaggctctgaagatacagcagtaaacaaagtgacaaacagctctactttcattgaccttagctggaggagacataggtcaatagataaataatttttaaaaatatctaatttcttcagatgtctatacgtagtactgaaaaayatgccaaagtgaagggtaaatgcatgaaatgcataatgtgtagagggtactgtgtttaattagcatggtcaggaaagtagagagaaaatgtttacacttatcattgcagcatctccttcctttgcttgtatgtaacactagacatgtgtccttttttcaggttgtagatggtactccatgtagcccagattccacctctgtctgtgtgcaaggacagtgtgtaaaagctggttgtgatcgcatcatagactccaaaaagaagtttgataaatgtggtgtttgcgggggaaatggatctacttgtaaaaaaatatcaggatcagttactagtgcaaagtaagttttaaaacacctatttgcagaccttataatttaaatgggcctttcaacaggtctgggaraaaaatatgtctcataaaagattaatgtgtttttargctaaataatctaattagccaatgaatcagagatttatgcctgtttttgtcacctgcagacctggatatcatgatatcatcacaattccaactggagccaccaacatcgaagtgaaacagcggaaccagaggggatccaggaacaatggcagctttcttgccatcaaagctgctgatggcacatatattcttaatggtgnctacactttgtccaccttagagcaagacattatgtacaaaggtgttgtcttgaggtacagcggctcctctgcggcattggaaagaattcgcagctttagccctctcaaagagcccttgaccatccaggttcttactgtgggcaatgcccttcgacctaaaattaaatacacctacttcgtaaagaagaagaaggaatctttcaatgctatccccactttttcagcatgggtcattgaagagtggggcgaatgttctaagtcatgtgaattgggttggcagagaagactggtagaatgccgagacattaatggacagcctgcttccgagtgtgcaaaggaagtgaagccagccagcaccagaccttgtgcagaccatccctgcccccagtggcagctgggggagtggtcatcatgttctaagacctgtgggaagggttacaaaaaaagaagcttgaagtgtctgtcccatgatggaggggtgttatctcatgagagctgtgatcctttaaagaaacctaaacatttcatagacttttgcacaatggcagaatgcagttaagtggtttaagtggtgttagctttgagggcaaggcaaagtgaggaagggctggtgcagggaaagcaagaaggctggagggatccagcgtatcttgccagtaaccagtgaggtgtatcagtaaggtgggattatgggggtagatagaaaaggagttgaatcatcagagtaaactgccagttgcaaatttgataggatagttagtgaggattattaacctctgagcagtgatayagcataataaagccccgggcattattattattatttcttttgttacatctattacaagtttagaaaaaacaaagcaattgtcaaaaaaagttagaactattacaacccctgtttcctggtacttatcaaatacttagtatcatgggggttgggaaatgaaaagtaggagaaaagtgagattttactaagacctgttttactttacctcactaacaatggggggagaaaggagtacaaataggatctttgaccagcactgtttatggctgctrtggtttcagagaatgtttatacattatttctaccgagaattaaaacttcagattgttcaacatgagagaaaggctcagcaacgtgaaataacgcaaatggcttcctctttccttttttggaccatctcagtctttatttgtgtaattcattttgaggaaaaaacaactccatgtatttattcaagtgcattaaagtctacaatggaaaaaaagcagtgaagcattagatgctggtaaaagctagaggagacacaatgagcttagtacctccaacttcctttctttcctaccatgtaaccctgctttgggaatatggatgtaaagaagtaacttgtgtctcatgaaaatcagtacaatcacacaaggaggatgaaacgccggaacaaaaatgaggtgtgtagaacagggtcccacaggtttggggacattgagatcacttgycttgtggtggggaggctgctgaggggtagcaggtccatctccagcagctkgtccaacagtcgtatcctggtgaatgtctgttcagctcttctgtgagaatatgattttttccatatgtatatagtaaaatatgttactataaattacatgtactttataagtattggtttgggtgttccttccaagaaggactatagttagtaataaatgcctataataacatatttatttttatacatttatttctaatgaaaaaaacttttaaattatatcgcttttgtggaagtgcatataaaatagagtatttatacaatatatgttactagaaataaaagaacacttttggaatgtgtgtgtctgttttttgaagtgggaattcattcctaggaaggaaacctgaggcacaaatattgaatctgaagaccgaattattttcttaaattatttggcaataagattttgttctagaggaaggtgaagcaagagggctgaatagaagatttttttctaatgagatgtatttcttatatccttggtatacatgattgctaaaaagaaagaaatttatgatgtcatttgttactaatgtatctaataatatacatcagtggttggcaaacttcttttgtaaaaagccaaatggtaaatatttgcaactttgtcaatcctgtcaataactatcctgtcaataccatctatgtcacaactgctcaactgtgctgttgtagcacaaaactagccataaagaatgagtaagtgaatggacatggctgtgttctaaaaaaactacttgcaaaaacaaataatgggtcagatttgttctgcagattcagtttgccaaccctggtatataccataaattaaatggaaagagctttcagttctggatgctttttgaatttgtatctcttcctcaattatatcccataagtaaaaatacgtgaaagtatttagctattgagtagaaaacaatgactcataaattacatgtagtaacgttagacatacatggtgagttaaaccctctaaatgcttcacttgctcatcaggaatacctgaggggttttggagaaaacttggaaagcccaggcctttctgcatagtctttttgtaaatcactgtcttttaaatactaagtggcatatcaataactaaaagttcagattccttccaaagtaactacacttctcccaggaaatagtatttactagaagactcagattatgtggttaaccacagacattttgaactctacgtttttcttcttttccttgaaaggaggagtttgtgccctcttctgttgcagtttgataaagacacacccaagactgggaaaaaaaagaggtttagtggactcacagttccacatggctagggaggcctcacagtcatggcggaaggcaagatggagcaagtcatgtcttgcgtggatggcggctggcaaagagagagagcctgtgcaggggaactcctctttataaagccatcagatctgatgagacttatccactatcacaacaacagcacagaaaagacccgcccccatgatgcatttacctcccactgcatcccacaacacacaggaattatgggaactacaattcaagatgagatttggtggggacacagccaaaccatatcacaggtattacaatatagcatgctagtttttatgtataggtgataatttctaacttactctcagttattcaaagtgttcttcccctgagcaattgaacatatcattctcagcagtcaggtgtacaggtgcagagaatcaaattaatttctggttatttttttttcctacctactagactaaaggactgaaagttaaagtcatcttctcacattgtgggaactagtcttgctcctccagaactcatttaaacgcagaatttaatcattcaattcagtggcctaacttgccacttgcaacaacaacctctcacaataaattatttgtctacattagtgcagtacaaatccccacagtaagtgacatggaggatatacatgagaaatgccctgaccctcattaactatacatgccatttgagaaaatgagatatataaatctaaaatgatagctcataagattaaaaagtcacttttagatcttgcctcattcaccagaattcttttctttttaatagcttagattgatttgatgtaagtaatgacactaaacttcaggacactaagagatcaaatcagccaaaaaatttcctatcatcctctcagatcaaggcaatgtcagacaactttctggtgttgccacattgtttttcagccctctgctggtgaaatttttttttcatcagtaggctgagtagtttaagatactctgctggcagagattagctcaaaacacacatcctggttttagaagattgattaaccgcttgcttgaaagaaggagagattttgtgctctctcctgttacaggtataaatgatgagctgtgcctctgctgaaagaaactttccacagtggaaagatcagggactcaaggcctgcagtctggtttcctttgtcccatacgatgctcctttaatgtgatgcactcccacacccctaagagtagcggtccctgagggccagactaccgtgaatactgctgctcctctgggtctcatccccagtgaggtttccatactccatgctggtgctggtgaatgtttgcaagggatccagtgatgtgatctgtctggtcccccagcagtggatatcagtaccagctcagttgtgggtgggaagggagtgacgtagaccctgtgagatttccgtggttataaatagccttagtgtgttggccttctcaaatacggctgtggtggtcatgtactgggcacatggacagactcaagatctactggctagccagggtgatgtaggcaatggtgatagttgaggttgtgcaagttttctccttcctgggcactgtgttattgtacctgcagatgttgtaatgggctgtgccacttggcctccagccaggaggtggcacttgcaaaagaatgccaactgtgttggtagttttgggattcgtgcttgccttatgttaccatgggtaggggagtcggggggaagggagtggcgtactctggtatttcaggcaatgtgcagggccatggagctcccaggagtctctgtccattgtatcacactaccagggcagatgaaggggcaaagccaggtggggactgggtcaggcaagtttgctgtttggctccccacttgtgagtacaagcagcagccccagtggtgatcagagggcaactccctgcctgctggggtaatgttacagggaggagtatagctgcctctgctgtacaaatgaatccacatggggagtcgggggtagcaggtggcagtaagccccactcagcccccacacacttggcaaggcaggtctcgcatccacagtgttctactagcagcagctagctgggttccagacagcctgcactcagaattccaaactgccccaggccagaagcattctgggctgagagagaaactccggctttcaggccacacctcttctggtcctccagcaaagcgtgggcatccagcttctgtgcctgtggctatagcacagttcccacttgactctcaattctggccaatggggttcattcccactcaaaattataccgcacatctgttgggagcatctctcatcccatgaccattaactcaattagctggcagacttctgcgaggtcctccgtgaggtaggatcaggcatgatttccttccatcaccactggattctgcgagtgaacacaaagcagatccgcacgccattcctcatatgctccccacagcagtaagtcagctccagcgctggatagagtgaaggcctcccagcgtggcctggattgcctggctcctcagtgagagtgtgtgtcataaatgcagtctctccctctcacgctctggacactcacaggtttttgtgtggttcacggcgtaagctgctgctcaccacttctttgaaataggtctgtggtttctttcagttttttgattaatttcctatgctgtttcttggaaaaacgttcacagcatgaatttctacacagtattttgtcttttcaagtgggagaggcatgctaacaatgcatccagttcaccatcttagaaaaaaagaaaaaaaaatccaagcacaattttcggatcagagatttcatctacgattggcaaaaatagttcccagctctttgtttcatttgtcttctagaagagtccactacagatattaacgaaagaggaacaatatacagcagccataattttctaacctcattgatttcccaaaagaaaaaaatacttattaatattaagattgcgtgtgctgggactatcaaggaaattaagcaaagatatcatagtagggaaatgtagtctgttctgccatgcacatatttctgtgacatgggtgaactcatatgacattggcagaaagtgagtgatgtcattaaagatggaagatgttttggttcatctacgtgttttctcaacgaagtaaattatgctttctcataggaacagcagaacataaaatatagtaactcatgaacacagcaagtcacagaggaattcagaaccatacgcaatgcccactcaccccacttgtctccatctggtcacaaacagtcttggaaattctttatatggcctttgttcaatgtgttcttgtctccataattcagaaacctgaatttttctttacagccccttctagcagccatattgcctttatgtaagggtaggtttctaaaagtacagttttttttttttgaaatttagcatgttttgttagctagggtagtttctttttatttaggattactattgtcttatgttctgctgctcttaagagaagtacaaaacaattacttattggggtgtgaaggaggtgaggagtgaaactttatgaagaataatacagaaagttttcttaaataaggagatatgtgggtggaaaccagagagatggaaggggatagctctcagagggatattataatagaggggtggccactacaggtggaagtatgcttcacttcttggagaggacagcaagaagccaatgtggctggagcaatggagaggacagcaagaggccaatgtggctggagcaatgaggataggaggttggtggagggcagagagcatgttccactaaagtaggcagtatgtttgcattttgctcagagtaagatggggagcgaaaggaactgagcacaggagagacatgcttacctaacattttaattggaagccattgtagaagaggacccaatagaagaccattgccataattgcaataaacagcaatggtgggctgagctagggtgatagctatagaagaaataaaagaggtcaacttctacagctcaagacaatgagatgtgcagatttgtagatgtgaagggaaaagaaaaaaccatcatggatgactccaaagatctgtattgttcttctgtttttttgtttttgtttttgttttgggtggggagatattttgtgcaacttatatgtgtgctgtgttctacctagagatcaacagaaattaaaatacaagatttctagtattattgaaaccagttacacctatagcaaaatataaactgcagagaatatggtttcaaaatgatctggaaatgtaaagatagttgttaaaaaagaggatatataatgtgagatattttaataaaaataattccagtacaaaaccatatgtcatatttacaaaattataaaagaatttgctcaaattatattgggagttaacaaagaatataattttattcttgagtttggtaattagataactatagatgaatgatatttcttgaaaacaaacacacacaaaagtcttttcatggaaagagaactcacatgaaacccataaagtaaagaatggaaagcaaagtaaaaacacaaaataagatgacggagttccaattacattattatggaaacacattgtttaaactcttctattaaaagacaaatatcttcaggatgtgcttaaaaataaaatccaaggacatgataagtaaaaggaaactatctaaatcaaaatgacatttttgtcaaagaagtgcaaagatttattaggcaaacacagagaaaataggaacagaattgatttcagccaaattatttttaagatggaaacacaaaaaataaaataaagaataatagttttgtgaattaaaagtacaagtcacaataaaatatgtgtcctggataataaaacaactatctataaatttaaaacttttaaaaaaattacaaaggataatcaataggaaagcactgttctatttatt

SEQ ID NO: 17790 - DNA, 32389 bp, Homo sapiens
  misc_feature (1)...(32389): n = A,T,C or G, or insertion/deletion polymorphism (see Tables 1-2)
ttttattttattttattttttgagatggagtctcactctgttgcccaggctggactgcagtagtgcgaccttggttcactgcaacctctgcttcccaggttcaagtgattctcctgtctcagccttccaagtagctgggattacaggcacgcaccaccatgcctggctaatttttgtatttttagtagagatggggtttcaccatgttggccaggctggtcacaaactcctgacctcaggtgatccacctgccttggcctcccaaggtgctgggattacaaatgtgagccaccgcacctgggctgtttcttatctctaatgattgcttctgttttctcagaaaatgtccatatatttttatcacaacatctacttatgtgactgcatctgcatctgtgtgcagtgccttctctcctgttaccatggatgaacacattgtgctagctaaggtcaagccccccacttgtcacaagaccccaaatctttctgcctactcaaagacattgttccagcaacacccacccccatctctcctgcattctcagtttttccttttctttggatcattccatatatagtaatatatggaatataaaatgcatataaatatgctatgatttctcttatttcagaaaaaaactcttgatcctacatctccctccagctatcactccatttctatgctccactttaaaacaaaactcaaaagagttaatattcagtgtctagttcctctcctcctattctttccttcaatccaattgttctagttaaggtcgtgagcttcatttccaactccaggttgttaaacgcaggagtcagttatcagcctacctttgataactttgcatttgatgctgacactccctcctccttggaacaattcctttggtttccaggggaccacacttctggtttctgcttaccggcaggaactccttttccatgctctcttgttggttctttttcatcttcacaactgaaaatgtgagtgccccagggctcaggggcagtcctttgatcccctccttttcttgtctacctcactcctgagcagcccatcacctcatgcctttaaatgtcctgttgaagccggacgcggtggcttacgcctgtaatccgagcactttgggaggctaaggtgggtggatcacctgaggtcaggagtttgagactagcctgaccaacatggtgaaaccccatctctactaaaaatacaaaattagccgggcgtggtggcaggcgcctgtaatcccagctacttgcgaggctgaggcaggagaattgcttaaacctgggaggcggaggttgcaatgagccgagatcatgccattgccctccagcctgggcaacaagtgcgagactccatctcaaaaaaaaaaaaaaaaaaatgccccgttggtgatcatgactctaagactatcccatttctatctccagacttgcttgcataacctagtgcctactcagtatcttcatgtggttgtctgatgtgatatagaagtccatgtcaaacttaacgtgctcagaaaatgaactcatgatcttcctgtccaaattgcgcctcctgcaacctttctcatctaaatgagtggcaatttggtcttctagttggtcaggccaaacacccagaaaccatcctgagctttttttttttttttttttttttttttttttgagacaggttctcactctgttgcccaggctggagtgaaagtagcacaatcatggctcactaaagccctgaactttcaacctcccgaggctcaagcaatcctctgacctcagcctcccgagtagctgggactacaggatgtgccaccacacccagctaatttttgtattttttatagagacgaggttttgctatgttgcccagactggtctcaaactcctggactcaagcagtcatcccgcattggcctcccaaagtgtaatccaaagggattacaggcgtgagccactgtgcctggcccatcccaagcttttctctctctctcatattttatatccaatctattggcaaatcctgttgactctaccttcaaaatatattcaggatctgaccatttcttagccattgctactgccctggtttaaaccatcatcatctctcacctgagtcattgccatcacctcctaactggtctcctagcttctgaccttgccctcctgtactcttctcatcatagcagccagcatgctcctcctaaagcatgccagcgtgtgccattcttttttttttgagacagagtcttgcacttgttgcccaggtcggagtgcaatggcacaatctcggctcattgcaaccttcgcctcccaggttcaagcgattctcctgcctcagcctccctagtagctggcattacaggcgcccgccaccacacccagctaatttttttgtatttttagtagatatggggtttcaccattttggtcaggctggtctgaccactcaatttaaaatttcattctccagccactcaatttaaaattacattcaggctgccaagactttgtcctctatgccctggggtctctggaccttccaggtaggagccgagaacccttggttggtccctctaacttgcatttctccccatccctcaagcaattcttatcccccttccctgcttggggcttcaccatggcatatattaccatctgatgtacagtgtattttattttatttattttgtttgttgttatcatctgtttcttgccactggaccataagctctgtgaggggggattcttatcttcttagttcatcattatgttctcagcacttggcatataggcacataataaatatgaatgaatgaatggattcctagtacttcttgcttctctttctatcatagtcatcatgattatgatgcagtacctagtgtgtctctacctctagaatgaaacaaagaaagctgtgtttttgtcttgctcaccttatatacccagcacttagaaggttctccaaattatatctactgcatgaatgaaggtttctgagatgctaatctgaccatcttcacccgtttctgcccttaaagcttactgccctcagtatcgaacctgaatcttcttagcatgtcataatcactttccctttgtctcatgtcttgacacttttctcccccttccacatcctctaagatgcagcctttcctgaatatgccatgctctttcactcccaggcctttgtactcactgttctcttcttggaaagctccacctgactaactcctacttgtcctttagggctcagctgaggtcacattttctgggaagctttccagacccttaaggcgagcttgtgtcagtgggggtgggtacagaacccatctccagcttagtcctgcccaggcttctgctgacatctgattgttgtgtgttggccagagaggttgaagattagctcagagagaatgttgatgttgtagaatgtagagtaatgagaatagcagtgggtgaaatggaggttgaggcaactaaaagccagtgtgggctctgggctgtcaagacattgtcctctatgctctgaggtctctggaccttccaggcaggagccaagaacccttggttggttcctctgacttgcatttttcctccttcctctctctcagggggggatgttaccatcactgacctgcccctggccctagaacagatccagggcaacgtccaggccaatgtgccagctggaggccaggcccaggtgcgtgccttgtcctgggggattgaccatcatgtcttccctgcaaactatgacctggtgctgggggctgatatcgtgtacctggaacccaccttccctctgctgctggggaccctccaacacctgtgcaggccccatggcaccatctatctggcctccaagatgagaaaggagcaygggacagagagcttctttcagcacctcctgccccagcatttccaactggagctggctcagcgggatgaggatgaaaatgtcaacatctatagggccaggcacagggaaccaagacctgcttgacatcacccttgctgttcttctcaatctcttgctctaatgaaggaactgtgtatctcaaaaaccatatttccagagccacaaacatgaggaccaaaaaggatggatttccctggcctctctcactttcctccttccctctttgttaccccagatactcttgggcaggtgcagtgaggtgcctgcttacaaggaatcccagagttctggcagcactagtgttagaacaccaaggaggttcctggctcctgttctcagagaaggaggatggtaaggtatccaggatttttagggggtaagggagatatatgggatgtgagagcagtgattgtagacagactgtcactgatcacttccattcctgttgctgtttacacagaatggactttaaaaaaattctgtgggatttttttttctttttttctttttttttgagacagggtctcactctgtcatccaggctggagtgcagtggtgtgatcacagctcactgcagcctcaacctctgaaggcccagatgatcttcctgcctcagctccccaagtagctgggactagaggcatgcgccaccacacccggctaatttttgtattttcagtagagacagggtttcgccatgttgcccagggtggtctcaaactcctgggctcaagtgatccacccgccttgcctcccaaagtgctgggattgcaggcatggcccactgtgctagcctaggatttttttttttttttaagaaagaattaagccttaaaaatctattgtgcaagaacccaacttttactcaggagctgagaaggaagaagcctcaaaccacccatttcctgctttttagagatagagtctagtggaaccatggctctaactgggtcaagtcctcctagctctgaagctaaggctgcagagctgtcctttggactgtatttcttcatgctttccagagttagagccttgatcacggaacatcattgtgtgcagaagaatactgtacctagtactaagttcttttcatctttgatttttctttagcttcatcagtccttccttcctaatctctaatcccctgaagcctaacacagttcctaatgtgttttgccttaacctcttttctcttcccacattggtacttctggttggggctctctttacttactgcttaggcacatagtcaccttctctggactccctgcttccatgctttctccttcagtccattccgcaaactcttgtgatcttccaaaattagctctgattagctttcacttcctgtagaagcaagaacaagctcctctgcttggtacttagtctgtgtccatgtgatccaaaattaccttcctattgcatttcctactcctttgctacgtgtattggacctctggccaaattacaaaagatgtactctttgttctctaaaaccacactaaagttttctgacttctttcacactctttatgataatcctctgcctgaaaggctattgccacctgtcaaaatcttcattattctttgcctctttcctgagcctcttgcttgaatgtgatttctttctccctgagacccataaggttcatcttatgggaccttaatttgtcttgcatggacatttgtgattctcattttctcaccattaaattaccttggagggtagggctgtggtttactcctgtctaaacccctgaagcctaacacagttcctggcacacaacaggtgttcaacagatattgtgctcattcaataaatatttactcgctttgtttaatggattccacccctgccttcctaggtgaccttggacaaattctcgaacccattcaccaaccacacaagtttgttgtgagtcataaatggataatgaatataaatgcgcattgaaaataaacataaaatgttacccacatttcttgtgttgttgttttgtgacgactttatttcttggtttctgttattttacctggggtgggaggtggggggtaattcccgtatgaaatgtgtygtctcaagaaatcaagtagaggcgaggactgtgttcctccggccagcaggtggcaccatactcgtttggtgcgttccgctggagaattctggcccttccgccgcgccgtaggtttgttgcctcaccagtgcgcccgccggagggtgtttatcgcggctagagagatgtygctgctgcggtcgctgcgcgtgttyctggtcgcgcggaccgggagctacccggtgagaagtcctggtgctggtaccgacctgctgtccctgcagctctcctgtgcgcctgtacctttcccttcctcccaacctcgtttgactccatctcaccttccccgacagcattgcctctgcccagtccagccccggtgcacccccctttgcacrctgtccgctccctaaggtcgcttccctgcccgtgtacccttcaccctctggagtttgctgcttcctgctcctcatccctttcttatctcatctaggctgggtctcttctgcgtcagtcgccccagccaaggcacacattttatgctgggccccgtctgtctgcctcggcctccagcaaggagctcctcatgaagctgcggcggaaaacaggctactcctttgtaaattgcaagaaagctctggagacttgtggcggggacctcaaacaggtgtgtgtgtggaggggtgcagggyggagtactagagctcgacctcagactcttggggcggtcacgctggggagcataaagttagactgctcttcagtgaccataatggcacagtcctaagtggaaatctggcttaaatgacaaccttggccttgactttgtcttatttgaaagcagttgagtatcccaggattaacaaaccagactgttacggtgtttcttgttrcctggagctgaaagggtttgtgtgagctttggagtcagattgttcaggagtcaaattgtggggcccccacactgtctgactttagactttttttttttttttcagacggagtcttgctctgtggcccaggccggcgtgcaatggyacgatgttggctcactgcaacctccgcctcccgggttcaagcgattctcctgcctcagcctcctgagtagttgggattacaggcgtgcgccacgacacccggctattttattttttattttttatttttttttgtatttttagtagagatggggtttcgccgtgtcggccaggctggtctcgaactcctggcctcaggtgatccgcccgcctcggcttcccagagtggtgggattacaggagtgagccaccgcgcccggctgactttagacatcttaatctttcagagttgtgtagtttttgcctgtacggtcatgcgtctcttaataggaagatacattctgagaaatggcgtcgttaggagattttggcttatgcacatcatagagtacctacacaaacctagatggtatattgtactacaacctgggctatatggaattgccagctgctcctaggctacaaaccgttacaaaatgttactggactgaatactgtaggcagttrtaacacagtggtaagtattgtgtatctaaacatagaaaaagtacagtaaataggcataaaagataaaaaacgatacatctccatagggaacttatcatgtatggagcttgcaggactggaagttgctctgggtgagtcagtgagtggtgagtgaatatgaaggcctgccttaggacactatggtgcactatagtagacgttaaagcacagtacacatargctacattacatttataagaaatttttttctgtgataataagttaaccttagtttaatgtaacatttttattttataaacttttaacatgttttaaatttttggactcttttgtaataacagcataaaacacatattgtacagctgtaccaaaatatttttctttatgcactttttctgtgagcttttttctgtttttaaaattttaaactttttttggctgggcgtggtggctcatgcctgtaatctcagaactttgggaggctgaggcaagcggatcacctgaggttgcgagttcgagactagcctgacccacacggagaaacctcgtctctactaaaaaaaaataaaattagcctggtgtggtggcaagggcctgtaatcccagctactcgggaggctgaggtaggataatctcttgaacccaaaaggcggaggttgtggtgagccgagatcgtgccattgcactccagcctgggcaataagagtgaaactccatctcaaaaaaaaaaaaaactcactgaaagccctgcttacacctagcagaaatctcataaacttctatgcagatggaggctggataagtcaatcttcccatgtgaatttggtggactctaacagacaggcactaatacagaacaaaaacacaaaatatgatgtcaattcatattgcaatagtggattaaaatgcactaaggccgggcgcggtggctcacgcctgtaatcccagcactttgggaggctgaggcaggcagatcacctgaggtcaggagtttgagaccagcccggcnnnnnnnnnnnnnnnnnnnnctcaaaaaaaaaacaacaactttttttattgaaatatctttttttttttttttttttttttttttggaaacagagtcttactctgtcccccaggctggactgcaggggcacaatcttggctcactgcaagctccacctcccaggttcacaccattctcctgcctcagcctcctgagtagctgggactacaggcgcccgccaccacgcccggctaattttttgtatttttagtagagacagggtttcaccgtgttagccaggatggtctcgatctcctgaccttgtgatccgcccacctcagcctcccaaagtgtcgggattacaggcgtgagccacagcgcctggccaaaactttttttaagttaaaaaattgttttgttaaaaacggagacacaaacacatacattagcctaggcctacacaggagtggcatcatcattaacactgtgttccactttcacatcttgtcctgctggaaggtcttcaggggcagtaacgggcatggacctgtcatctcctatgataacaatgtttttttctggaatacctcttgaaggacctgcctgaagctgttttactgttaaatttttttattttttatttttttgagacggagtctcactttgtcacccaggctggagtgcagtggcgcgatagatcttggttcactgcaacctccgcctcccgggttcaagaaattcagccacccgagtagtttataagttggagtacactctaaaataacaataaagcatatgtattatagtaaatacataagccagtaacatagttgttcattattgtttcaagtatcatgtactatatgtaattgtatgtgctatactttaataggactggcagcacagacgttttctttacactagcattgccacaaacatgtaggtaatatgttgccctacaatgttaggaggactaccgtgtcactagacaataggaatttttcagctccattataatcttagggaccgtcatcatatatgcagtccgtcattgtccaaaatatcgttatgtggtgcgtaactgtataaagaaaatacaactgtgtgccccatagggttgttgtgaagattagattcatccaaggcaccagttataataatacctggtatttggcatttagtggtagactgccagtaaatgatagattactttagtttctgttagagaatttagagaatcaggaaacctgagtatatcttagaactacatttagtgctaaattctgtgactttgttgtctgctctttttcctctcaatttacaggcagagatctggctccacaaggaggcccagaaggagggctggagcaaagctgccaagctccaagggaggaagaccaaagaaggcctgattgggctgttgcaggaaggaaacacaactgtattagtagaggtgagttgttggaaattccagataccaagaacagctgtcccttgggtgtaaagcttgtagtaggccctaaaggggcctgttcttgaagaagagatctgtttaagaaccataaagcgtagttgaagttaaactcatgaaaccctgggtattagttacgaattcgtttaagtatagaaatgtactggtgtgttgatgagaaatggcctgacagtctagaatattactcctgaatgtgagtctggcacaggcttacaccttgtcactgattgtttcctggaacagttagattacaagttaattatattaattgttgctgaatagagagtaggtattttagaggasgtttgggggccataattggtgaagagtcagatgtggattagtttagagtgagagatggggataaacaagataatagcataagtggtttggagttgggatggctggagaatgaggtgatgatggtgtgcagacataggtaagtggtgaacttgtggtgagtccttcaggacattattgaaccatcttctgaatatacaggctattgctaactcactggcccaacataaatcacttcattctgttccaggctaggagaggaagcgtagctttaaaattttggagtcattttttttccgttgagtctgtagcttgttctatcagtatcttgatttattctccagccttaaggcacttttggaaattatcattaaacagcttatacagctatatcaatttgttcccacaggtaaactgtgagacagattttgtttctagaaatttaaaatttcaactgttggtccagcaagtagcccttggaaccatgatgcattgtcagaccctaaaggatcaaccctctgcatacagtaaagtaagtttgggatttgtctccagtgtgctgaatttgctgtcctcattgggtcttttgctgttcctattgtagacattctcatgtctcattctgttacttcacatctctgcttaaatgctatctctttgcatagaattacccttcccccgttgctatatccccgtgtcatgctgcatttaaaattttttattatggtgcttatatattacattttaatttatctgtgtgttgtctatcttccccagcagaatgtaagctttatgaggcagggaatttgtcttttcactgttgtatctctggtgaaagagaattgggcccactacttagttggagctcagtaaatctttgtcagatgaatgaatgaatgattgaatgcatgcatgccagtgaaatggagttagccagatcaagtgaagccatttgaggctttgtgttcagaaatttggaatggtcttaggaaagaatttctaaataaagagattggagccaggtgtggtggctcacccctgtaatcccagcactttgggaggccgaggcaggcagatcacctgaagtcgagagttcaagaccagcctgaccaacatggagaaacccgtctctactaaaaatacaaaattagctgggcgtggtggcgcttgcctgtaatcccagctacttgggaagttgaagcaggagaatcgcttgaacccgggaggtagaggctgcagtgagccgttgtactccccccgggcaataagagcaaaactccgtctcagaaaaaaaaaaagagagagagattggaaaagacatggtttaggaaaataagcatattcttatccatagagggatcaaggaaaggaattatgtcattctgcctttgactcagccttattgccaaggcaaagatgaaccaaccactcacagtaatttttttgagtttattaccaactttttttatcttctttatccttctcttgagatgtcttggtaaatgttaattattattggcattacatagtcatatggaaaacaatgttgagattattttttttaattgtattgagtaggtaagtcacttgaactagaaattttagctttgattttgccagtaaacaccagtgtaccctttttttttttatttttgtttttgttttttgagatgaagtcttgctctgtcactcaggctggagtgcagtggtgcaatcttggctcactgcaacctccacctcctgggttcaagcaattctgcatcagactcccgagtagctgggactacaggcgcccgccaccacacacgcctagtatttgtattttttgtaaagacagagtttcaccatgttggccaggctggtcttgaactcctgacctcaagtgattcgcccgcctccgcctcccaaagtgctgggattacaggcgtgagccaccatgcctggccccagtgtactctttttccagatttgccatttattaacattttgctgtatttgctttatcacttctttttttctttaagagacagatctggctttcttgcccagcctggagtgcagtggcacaatcattgttcactgctgcctcaaattcctgggctcaagtgatcttcccacctcagactcctgagtagctgggactacatgtgcacaccactatgctaggctcatttttaagttttttgtagagacagtcttgccatcttgcccaggctggtctcaaacctctgggctcaagaaatccacctgctttggcctcccaaagtgttgggattataggcttgggtcactacagctggccctatcactttttatatacatgttatcatcgcccttttttttttttttttttgagatggagtctctctgtcacccaggctggagtgcaatggtgccatctcgctcactgcaacctctccctcccagttcaagcgattcttccacctcagcctcccaagtagctgggattacaggcacctgccatcatgcccggctaattttttttgtatttttgtagagacgggagtttcaccatgttggccaggctggtcttgactcctgacctcaggtgatctgcccacctgggcctcccaaagtgctgggattacaggcgtgagccactgcacccggtcatcatcactgtttaaaaaaaatctttttgtaagtatgttgcagacatcaggatcctttattccttcagcatgtatctcgtaaaaacaaggacattgttatataaccacaggacagtgatcacatttaggatttttttttctttgagacggagtgcagtgttgtgatctcagctcactgcaaccttcacctcctgggttcgagcaattcttatgcttcagcctcctgagtagctaggattataggcatgcattactacttccagctaatttttttgtgtttttagtagaaatggggttttgccatgttggtcaggctggtctcgcactcctgacctcaggtgatctgcccgccttggcctcccagagtgctgggattacaggcgtgagccaccgcacccagccaaaatgtgttagttttagtagttgtcattctactgttagaaataaatttcccttctcatttttatttagtgatttattcagcactaacattgactcgtgggttcttattttatacaataagttataactcattattcgttttgatgctcaaattatctgcggatttgatcaatgcaagctgactgtaatgtcctttgatatgcccttattattttctgagtattttcttactttttggcttttttgtttattcttatcttttgggtttatgtcatactttcctttccccaactgtggaatgggccacttcttcaaggagtcctggtcctttttagttggggaatggtttttagaaatcaagatttgaatgttaggtgtgctgatttctttctttcttttttttttttttttttttttgagacagagtgttgctgtgtagcccaggctggagtgcagtggcgcgatcttggctcgctgctacctctgcctcctgggtcccggttcaagcagttctcctgcctcagcctcccgagtagctgggattacaggcacgtgccaccatacccagctaatttttgtattttcagtagagacagggtttcaccatgttgggcaggctggtcttgaactcctgacctcgtgatccacccatcttggcctcccaaagtgctgggattacaggcgtgaaccactgcgcctggccaggtgtgctgatttctactgagatgtcatttgttcttcgagcagacagtgcaggtgtatgtgctgtgtgcgtgtggttcaatccttcctttttcatagcaacttcaatatgtttactgtttttagttatgtactcatatgtactaagtgttacaatatatatacaaaattgtttcagaattgctacccctgaccactgcaaataacaaaactactaaggagttcaagatttatttgtagttctttttgtctttacattgaagttaggtggtcaaatgactccgtttagttatttggattttttttttccttctgtgagcttatgttactcatttgaaatatagttttatatttctttgtagtcagtatttattttcaccccaagtatgtgttgatttaattttattttaattttattttttaaatgtgtgtttttttttttggctgggcacagtggctcatgcctgtaattccagcacttcggggttttttgtttgttttttaaatcttttttatattaatagagatgaggtttcaccatattggccaggctggtctcaaactcctggcttcaagtgatctgcctgacttggcctcctcaaagtgctggattatgggcatgagccacggcactgggccagattttttttttttttttttaagatggagtttcactctcattagccaggctggagtgcaatggcatgatctcagctcactacagccaccgcctcctgggttcaagtgattctcctgcctcagcctcctgagtagctgagattataggtgcccgccaccacacctggctaatttttgtatttttagtagaaatggggtttcaccatgttggccaggctggtctcgaactcctgaccttaggtgatccacccgcctcagcctcccaaagtgctgagattacaggcgtgggccaccgcgcccggccggccaggttcaattttatttttgaatacataagatacattaagaaagtcctcaaagttaaaactgtcaaaaaaaaagtatgctcagaggagtcttactgcttctctcccttctaccccgttcctatccatccctttatttagataaccagtgtcattggattgtggttatcctttcagtatttctttttgcaaaaataagcatatttatacaaatagttctttgttgcacagatagtagtataatatgcatatacacttataatctgcttttttcacttaataatatgtcctggaaatactccatagcaattcatgaaggtcatcctttttattttttccaactacatagtattctgttgtgtggatgtgctatagtttaatctcctgctatgtttgggcatttaggctgtttttaaaattttctgattagaaataattgttcaatgaataatcttgtgcagtattattggaagtatatcatcaaggtgaattcatagaaataggatttcagggtcaaaggataaatgcatatgtagttttattagatactacaacttcacaccattggatttgtaccattttgcattcccatcaaaaatgtgcaaatctagctctaacattttatgattttatgaaaatattgttcttggccaggtgcagtggctcacgcctgtaaacctagcactttgggaggctgaagcaggtggatcacttgaggtcaggagttcaagaccagcgtggccaacatggtgaaaccctgtctccactaaaaaagatataaaaatttgccaggcatggtggcgcatgcctgtagtcccatctactcgggaggctgaggcaggaggatcgcttgaacccgggaggtggaggttgcagtaagctgaaatcatgccaccgcactccagcctgggcggcagagcgagactccatctcaaaaaaaagaaaaaactgttcttggccaggtgcagtggcttacgcctgtaatcccaacactttgggagactgaagcaggaggatctcttaagctaagagttcaagaccagcctgagcaacatagggaaaccccatctctatatttaaaagaaaaagaaaataattgttcttgatttctaggaaattacattctaggaagttaggctggaggatgagagtggaatgtaattgggggtggtgcagtgatagaataaaatgtttataaagatggaactgttaccaatttttaacattcttgcctttatgaaaatattgtctacacttagttgtcttaaagaatgttttctttctttcttttttttttttgagatggagtctcaattctgtttccccggctggagtgcattggcrtaatctgagctcagtgcaacctccgcctcccaggtttaagcgattctcacgtctcaggctccccagtagctgggattacaggcgtgtgccaccatgcccaactaatttttgtatttcgttggagacggggtttcaccatgtttgccaggctggtctyraactcctgacctcaggtgatccacccaccttggcttcccaaagtgttgggattacaggcgtgagccaccacgcctggccaatacttttcttagagatagactatttttgcctattcttttgataatttgaatagtacagaatcagttcatgtttgttttcttcgtgcacttagggtttcttgaattcctctgagctttctggacttccagctgggcctgacagagaaggctcactcaaggatcagttggctttagcaattggtgagtatttgtaaaggttctggaaactggaaattagggactggatctcttgttatcttgttcctccaaatctaggtcaagaatcatgtgcctacaagggtcagatgatacgaacgtgagaagtggtgtgtgtgttagatgttagggaacattaggcatcttttttttttccgagacagagtcttgctctgttgcccaggctggagtgcagtggcgcaatctcggctcactgcaagctccgcctcccaggttcctgcctcagcctcagcctcccgagtagctgggactacaggcgcctgccatcacgcctggctaattttttgtatttttagtagagacagggtttcaccgtgttagccaggatggtcttgatctcctgacctcgtgatccgcccgcctcggcctcccaaagtgctgggattacaggcgtgagccaccgcgcccggccacattaggcatcttaaagagctcatacgctgctggaggaagtcccattgccaagctgtaaccaattgttatatctagggaaacggagtcctggggtcatcagaatttctaaattccttaaaagaatttagatttgtatccaaaatctcacggattttggctgtttgcaactaattaaaattattttcatcactgtgccaacaaaacaaagcatgtctttaggcagagatggccttttgacttccagctgagtacttgagtatatgctgtagggaaaatagtacattaaagattatttcctcttctttataaaaggtggcaggacaattgaggagcattgtttttaggaatttgatctttcttttcaaaaaatctggttgtgaatttgtaaagatacattcttttagagcctgttggctataggaaccacatctggatcattgtggtgggactagcatcttgctttcttcctaagtatccttgatggagggtgggtggtagggaagggttggagcttgctgggaatttactaatctgaagtttccagtcaaggcatcagttccgtttttatcaggtcatcttgtattatctatgatgtttcaatgagtcatgggtgagaaaccaggcagacagctatgtatgaggcttattaagaaattctggaagagctgggtgtttcagccttgtcagtttctgggaattaactattgrgtatatgctttgagctattttaaaatttgttttggtttctggattctcctttttcatgacttttagatatgactatggctaatccaggcatacttatacagacccttttgtttattctcctacccctttctaccttttggcttatttggacttctgttagaagagaataacatcctgagagaaaggggaaaaataagttaaaatctgtttctggttctcataaataactcttgacaatgttatcttttctgtttttgatgagaggaaattgaaactatccgatgacatggtgctttgagctgtggactttttccggatagaagggatgatcaggagttgtctgtgtcagttatggagtattcaggatggtgggaaaaagcacctaattgctttggagtcagatctgagttttaattctaactctgccttgtgttactaggtgggttacctaagttctctaagcctaagcttattgtaatagtagctagcatttgagtgctatgtgccagatactatagttaatgctttatttatttatttatttttgagacggagtcttgctctgttgcccaggctggagtgcagtggcacaatctcggctcactgcaagctctgcctcccgggctcacgccattctcctgccttagcctcctgagtagctgggactgtaggtgcccgccascacgcccggctaattttttgtatttttagtagagacggggtttcaccgtgttagccaggatggtatcgatctcctgaccttgtgatccgcccacctcggcctcccaaagtgctgggattacaggcgtgagccaccgcacccagccctagttaatgctccatatatatatatatawgtatatatatatataaatttttttttttgagatggagttttgctcttgttgcccaggctggagtgcaatggcatgatctcgctcgctgtaacctctgctgcccaggttcaagcaattcctctgcctcagcctcccgagtagctgggattacaggcatgtgccaccatgcctggctaattttttgtatttttagtagagacggggtttctccatgttggtcaggctggtctcaaactcacaacctcaggtgatctgcctgcctcggccttccaaagtgctgggattacaggcgtgagccaccacggctggctgcttttacatatattatttatttctccccaaaaccctgaaaggtaggtggtgtcatctctattttaaaggtgaggaaacaaaggcttgataaatttagtaaatgagattatgtcattgagtcacttgcccgaggtcatatagtcagtaaataggcagaactgagacctgagtcacacatacttgtgtcaccacaacctatacaacctatgtttgttgttttttttgttttttttgtttttggagagagtcttgttcccaggatggactgcaatggtacgatctcggctcactgcaacctccgcttcctgggttcaagtgattctcctgcctcagcctcctgattagttgggattacaggtgcacaccaccacgcccagctgatttttgtatttttagtagaaacagggtttcatccatgttggccaggctggtcttgaattcctgacctcaggtgatctacccgcttcagcctcccaaagtgctgggattacagacgtgagccactacacccggcctgtttttaagtaccagagtgcctggcacatagttggtgcttcataaaggtattcttcacttcccccactcccgctctcctgccccataccccttttcctctttctacaaaaactgaaaatggtatctcttcatcttactgcatatcctatgtaaatgcaaagggactgtcttccaaactgggcctcttctgtgcatattttggtaccatcacagacatcacaatttgttggtgtgttggttttttgtttttgctttaataggaaaactgggagaaaacatgattcttaaacgagctgcatgggtgaaggtgccatctgggttctacgttggctcttatgtccacggagcaatgcagagtccctcacttcacaagctggtgctggggaagtatggggccctggtcatctgtgagacgtctgaacagaaaacaaaccttgaagacgttggccgccgccttgggcagcatgtggtgggcatggcccccmtctctgttggctccctggacgatgagcctgggggagaggcagagactaagatgctgtcccagccgtatttgctggatccctccattaccttggggcagtatgtgcagcctcagggggtgtcggtagtagactttgtgcggtttgaatgtggagaaggtgaagaggcagcagaaactgaataggttccagagacttttggcccaggaggaatatttacttttagctctggacatcattacaaaaaggaatatttcccaaacctcttcagaccgagaatgcatgggtaaaattattaaatagttgtataataaaaataattttttccttgtttgcgtaatactggatttagcttttctgtgcctttcaaaaacaacaggtgggccttattgacrtgatagtgtcgtggagaacaggcatcaacaatactgctgctcccttcaacatagatttattatggtatttctgaaatttctaacttatatgttctgtcttacaccttttatgacatagaactcttttgttctgtttttgctttgcgacactgtgaaccgtgcttctgcctcggaacctccctagttatattacttgtgccacatggatttctttaggattattgattcaaacctagagttgtctggaaaatgtgggttctcttctttgtgattgtctgtagtatgctttgaaggtgctctgcagtggtagacacactggttctggcctcatttaatgaaattaataacacatgcccctatttctcttttggatgatgtgtgggtgggtgggtactgaggtttcctggccagctgtaaggcagattttgacattcttgtgccagaaacagaaattagagtagtccagttacccagagagctcacttaacattgcctctttacttccccagtactgaaacatttcttcaagtataacataaaattaccgtaacaagcagacccagaatactgaaaataactccatttgttcattataggtatctttatttgaaaagtgaaaaatgctttgacacattacagatctgggtatttggattttgcctatggagtgcatatatgatttcaatgatttacaggctaaatagattttagaaataatcatcttaaaattgaaaacaaaggtaggtcctggtataatattaaacataaagttattaaacattttaagcattgttttttggttctctttcttttgatttctccagatttatgcagttttagtgctttctgctgaggctttagctagagggccacaaaacccaaaaactatatggttaacattttaggtatataacaagcaaggaatgcaaggatgagaaaaaatggagaacatgccgtgatttgcagactctattatatctaaattaagtagctgaatgtcaggcagaaattggtggataaattatttcctgatattggcactatctgctcttttctgtggccttgcaataggtataggccttcttgctttagaaaagccccttttctttcttcatttggagctgtttccagccaggcagagctgcaaattgccctcttgtgatgccaaacacagacacaaagtcctgttcagagaggtaattctaagagagaaaacaaagtttctagttagaaggaagacatgacatcattgccaacagaagttgaggaagttggagcaagagggagttctaggtggatccttgaagagggaagtagaatgaatttctcagaaaggctgttaaagatttaaattattcattggagaggtgttcttcaggtcagggagtcccattttggcctgtggcagaagcttactggattcactgctctcacagtgccagcaagcgccagtttcttgccagaaggcaataaatgggttatgtattaaggatgaattacagacatcaaattttggcagaatgaagaactaaattgagctatggttttccttgttttctgcccgtaactaccatttttacccataaattttcaaatgcatgatcgggtggatcttattgagcataaaattcttctacacatttacttaatgatttattgaatatttatatacaagtaaagattattaatatatgggctttgctttcaagaaaattgtagtccagatacttgagttgactagataagacattgtgggaaatccagagtccagagtctgtgcctaaatcaacttcttcaaggggaaaagaaatttattcttttcttttcttttttttttttttgagacagattcttgctttgtggcccaggctggagtacagtggcacaatctcggctcactgcaacctctgcctcccgggttcaagcagttctcctccctcagcctcccaagtagctgggactacaggcacccaccaccacgcctggctaatttttgtatttttagtacagacggggtttcaccatattggccaggccagtctcgaactcctgacctcgtgatccacccacctcaccctcccaaagtgctgggattacaggtatgagccaccgtgcccggccaagaaatttattcttttaactcaaatatgttaattcattcacgcaaaacttaagaatacttgctatctgctaggcactgttgtaggtgcagagaagctgagaatatgatggtgagcaagacaaacaaaggtccttccttttaaggatattactagagggggaaataggcaatgaacaagtataaagggactggagcaggtatgggaagcagtattagggtggtcaggaaatgcctccctggggaggtgatattagagctgagacctacatgatgagaaggtgctggtgctgtgatgatttgggagaaggatgttttttcaggcacgaacactagcaagtgtaaaggctcaaaggctggaataagcatgttttaaggaacagcaaagcagccgctgtactggctgaagggtggtgagtgatgagggtattggtatatgaaatgaaatcagagagctaggcaggggccagattgtataggccttcacattctttttttaaatgtagtgggaagctattccaggtgttttaaacagggccgtgccatatattttaaagatctctttggctgttgtgtggggaacggattgtaggaacaggtggaaaccagttggattgtagtaagtagtccatgatagctggactagactagtagcagagaaatggaagaggagtgaacagaagctagctgatagactgatgtaggtggagagaaaagaatcaagaaagaaccctggttttttttggtttgagytcctaggtagctcagatgtccattgagcggctacaatgtgccggagctgtcctaggccatttgctgagctgagttttttactcacggagagctccacttccaacagacacagttccttcagccactcacctcctttttggcagggtttacatcctcaggcagctcctgattctggtttttcaacagaactgctatagggtaatattttggctcactgtcattagaattcagggagagggttgcattcttcatgtcctaggtaagataagaatgtaggcacagggaaaagactcctcagtgtctgtgtggttacagttctgaatgtgtataatatttaacattttgacttatgccacttcaccctctgtaatcatctttgataacaatgctccccaaacctggctgcatgtcagaatcatctgggaatagaaaatattcagattttggggttgttcttgggaaagctgattcagtaagtccaaggcaagtcctgtatagctagtttggcatacatcttgtgtctggatctcatttgaatattgggatcacataccttctcttggtacttttatttagccctgcatttccagcctttaaatgactttaggttgtagtcctacttaaatacaatttaaagatactacatcaacattagctttggaatctgagtttgtagagcacaaaggacagaattgccagatggtttgaacacctggtgccatgcactcctcctgaggttaaagaactgctggattcctggctagaggctccacttcttttaaccattaaaataggtgtaaatggcctaagtttctgtggacttcactgtcagaaatgaataaaaatgtcatttgggttagaagcttatttctgaaaaatactgccaatgactttaatctctccttaaacggcagagttgaataataaaacaaatattcatttttttgttgttgtgtttttgagacggactctcgctctgttgcccaggctggagtgcagtggtgccatctcagctcacagcaacttccgcttcctgggttcaagcagttctcctgtctcagcctcccgagtagctgggactacaggcgcatgccaccacggccggctaattttcatatttttagtagagacggggtttcaccatattagtcaggctggtctcaaactcctgaccttaggtgatccacccgccttggcctcccaaagtgctgggattacaggcatgagccaccgcgcccggccccatttttgttgtttttacacagcaagtctgtttgaaaatctggaagtcaggaaaataaggaacttggctctgagacctgcttttctattgattacaaaaagtctttacatcaaaacagacaactatggtaatactaaggacatgagttttgcctgtgagcatctgtagcatttgtgtgttctctggctctggttgcccatgtggctggcttctcccaagagcgaacccgactcacagcagtgattygcatgatagcagcagcatctcccagctcttcttttaattgttcatatgtttttcctgcctgagaagaagagagagaaaacacaggatgaggtctttcttataggggagggacatyttaggtctggtctgtgtcttcaggaaaagcaaaagagccagggagtcagaagacatttcaaggataagtaaaaatgaaaatccccccttttgggtccatgcaggcttgaaaggtgcttaaacataacgcacattctttgatggtaacccctcagtcctcccaataagatttaagaaagagcagttgaaggccaggcacagtggctcatgcctgtaatcccagcactttgggaggctgaggcgggtggatcacctgaggtcaggggttcaagactagcctgactaacatggtgaaaccccatctctactaaaaatagaaaaattagctgggcatggtggtgcatgcctataatcccagctacttgggaggctgaggcaggagaattgcttgaacccaggaggtagaggttgcagtgagccgagattgtgccattacactccagcctggacaacaagagcgaaattctgtctcaaaaaaagaaaaaaaaaagttgattaggagtcaggaaacctggctttctgttgattaactgtgactttagacaaatgacttatcctcttagcttccttatcaataaaatagggagcaatacttctactggctatcaggattgttgtaaagatcaaaaagatgatgtgtatggatatactttataaactgtttatacttcacactgcttattgctgacacctgctgtgaattgtccacctggacttactgctgtggcaggtgaaaaagaggagaaaagtaaaaggcagggagtgggatgggagtagggaaatgaggtcctggtttcactgagccgtgaatcagtactccaccttcctgcccactgagctgttctgagctacctggcaggaagttagagcttccctactctcttttcttacactccaaatgttagggtcccaggctaggaaccagcctgtgaagatgggaggctcaaacccctgcttaatgatcaggattggtgtgtcgggatctcggccgctggggtgagtgtgcaggtactgctgtgctgtggcaagggcactctccttctccgtggcattggcctcagccccaatccacaagaacacctgttaaggtggagatttaatatatgttactgtgttcataccaaggactaagtactagatcatacacattaccctatctttcccctttctttcgtgagcaattcacagcctcagaaaactttctcagcctaatttgttcagcagagaaaggttttcccagaaycagcttgatgtttatcattttaattgctatgtgtatcttccaggtctgcctttccaaattggagctgtctctgaacttcagcttcctgaatccaacttcttgcagaacacctcctcttgactgctctaagcaccttaaaaataacaccttcargatgtagctcttctttactaaacttgtatctgagtctccacttttgataggtggtatctatctagtcacctaaggcagaagcctgagagtttcctagaaaccccccatatccaatgagtcaccagggctgaccaactttacctcctaagcatttgtcaaatctgtcaccatccctccatccctactccactgcccttatgtgggcccacagtagctcttacttgaccatgacaatagtctactgactgcctttgttcccccaaaggcccatatcctctgcatgtggagtccgttgctattgatcctaagactaaaatgatgataggatgatgataggatggctggatttttccaaagcaaggtgggaaaatgcccaggatggtgagtttcaaacatcattctcaaacatcacccctggaaaaaaaacccgggctttcttttggtcactgctgacaaaggtttgattgagctggggatggtccagggctaccctgggtttattctagggtggggatactacacaaaaacaacccttactgtgggagtctttctcatgttctgacttctgcagctgtgtcttacctggtcccaggtatctaggagcatcacgtcagtagggttcaggtcatcctgggtgaagtctgtgatctcagtgacaacgaattggccggtcttattggaacattcaaagagacgagactggacatctaggatttcctgctgaagtctgcaatatagtccatttaagggcatcaagctgcttagaaatgtttttaaaactgaggttttagcctttgtgcaattcacaagcctggcaggcagggggagcccagaagagggggaggctgtgttcccataccttttatcattggcatagggagttttccctcccagtaggtcccagaactcggctggctcctggccctcggccacagtgttctcgctgccatcacagagaaggctggccagctccttagccattgcccgctcatccccactagacccctgagagtggggcgaggagagcacagatgttagttgcacaggggcacttcgatgtggaaagaaaagcatctgagactaataactcagtgtgccaggatcagctaccaaaccacagtccctcagcctgggaagacagacaagtttgttctagtgctggggagtggggaggaaaacagtgtggggcaaagaacaggactaggctttgaaacccacagtgggtgttggcaaaagtcacctttgtttcagcttcagtttgaatttaggcacctacttttgatttttattttagagaaaaaatttaaatttatttttaaaagtacatacaataaaatatactcttttgacatacaattctaagaattttcacaagcagaatcatgttactaccaccacaataaaggcacagaacagtttcttcctcagtccgtcccaaaattatctggggtgcgacccctttggagtcaaagcctccctgaatccttaacctctggtaaccatgaatctattctccatcactatagttttgccttttccagaatgctgtaagtggagtcatacaatatttagcctttcagtctggcttctttctcttagcagaatgcatatgagatctctgttgggtttaccagcgcgctgctcatccctttttattgctgagaagtattccatcatgtggatgtactactgtttgtttatccattttccagtggggttgtttctgattatgaataaaggtgctataaacatttgtgcacaggtttttctgtgaagatagttttttgttttacttgagtaaatacccaggagtaggattgctggatcatacggtaagtgtatgtttaactttgtaagaaactgtcagctgggcgtggtggctccctactgtaatcccagcactttgggaggctgaggcaggtggatcacctgaggtcaggagttcgagagcagcctgggcaacatggcgaaacctcgtctctactgaaaatacaattagctgggtgtggtggcacacgcctgtaatcccagctacttgggaggctgaggcaggagaatcacttgaacccaggaggcagaggttgcagtgagccaagatcgcgccactgcactccagcctgggcgacagaatgagactctgtctcaaaaaaaaaaacaaaaaaaaaactgaaactgtcgaaatgttttccagaagctgtaccatttgcaatcctgccaacaatgcatgaaaattcctgttgctctgcatccttgctcatattttatgttgtcaatttttttaaccattctaatagatgtgtagtggttatctcattgattttgatttgcatctccctagtgactaatgatgttaagcatcttttcctgttcttttttgtaaaataattttagtgcattttattttattttgagagggaatcttgctctgttagccaggctggagtacagtggcgcaatctcggctcactgcaacctccacctgccaggttcaagcaattctcctgcctcagcctccggagtagctgggactacaggcgtgcaccaccatgcccagctaattttttgtatttttagtagaggcggggtttcaccatgctggccgggctggtctcaaactcctgacctcaggtgatctgcctgcctcagcctcccaaagtgctgggattacaggcgtgagccaccgcgcccggccttagtgcattttaatccactattgcaatatgaattgacatcatattttgtgtttttgttctgtattagtgcctgtctgttagagtccaccaaattcacatgggaagattgacttatccagcctccatctgcatagaagtttatgagatttctgctaggtgtaagcagggctttcagtgagttttttttttttttgagatggagtttcactcttgttgcccaggctggagtgccatggcgcgatctcggctcaccgcaacctccgtctactgggttcaagcgattctcctgcctcagcctcccgagtagctgggactacaggcgcatgctgccacacccggctaattttttttgtatttttagtagagacggggtttcactgtgttagccaggatggtctcgttctcctgaccttgtgatcctcctgcctcggcctcccaaagtgctgggattacaagtgtgagccactgtgcctggcttttttttttttttttttttttgagacggagtctcactctgtcgcccaggctggagtacagtggtacaatctcggctcactgcaacctccgccccctggttcaagagattcttctgcctcagcctcctgagtagctgggactatgggcgtgtgccaccatgcccagctaatttttgtatttttagtagagatggggtttcaccatgttggccaggctggtctcgaactcctgacctcgtgatttgcctgcctcagcctcccaaagtgctaggattacagggatgagccaccgtgcccagcttttttttttttttttttttttttaatatcaaacgcttcatgaatttgcatgccatccttgcacagggaccatgctaatcttctctgtatcattccagttttagtatatgtgctgccaaagcaagcactccagcctactctaggtcctttgaccttgctgacaggaggaggggagtgcaggtctgggctccgaggggctggtctgacccggggcccagccatcctaccttgccataccacaggtagtgctctgcctgagttcgcagcakaaagacatcattggagtttagggaggaggcaaaggctggaacttccactgctttggtgttagatttgtcatttccatgaatttggaagagtcttactggagggtcaggctcggcatttcccttcctggaagtcccaccctagagagaagaaaagcagagtccagatctaaggagcaccatgtgagcagagtgctagaggagctgttgtgggaaacgtgaatgttatagtattatgtttgcccttgaggagcttctagactcactggaaagggtcagggtaagctggagttatgtcaccgataacaacaactttcatcctgagaactttatcatattccaggctctgtgactggtgcttacctacatcatttcattgatcctcattataactcttatgaagtagatgttattattccatagtacagatgaggaaactgagacttggaaacttgactagtaaatgacaaggctaggacttgaccccagacttgtgtgatatcaagcatgtgccattacgcattgcttggtagtgcttcagccagggcttcatggaagaagtgggacttgaatttgaaagagcacatctgaagcaggaggggtatggtatggtacacgtgaggtctaatgaagagacccacctgactggagtggagggtgcaggttagggagctgagggtggtgcacctgcataggtaatatgggtcaggttatgaaagaccttgaacataatttagatagtggttcagacttgaagccctaggcagttgggattcacttgactgtcttagagggattaacccccttcttcctctgtctaatccaagcctgactccctaccccacccctcctctgctctccaatagtcctgtgctggtttgttagtttggaacgttccagctcatggtgtaattttatcagagcatcctcacctcaaagataactagcttccctttgaagatggccatgaagtggcgtggctccgttcccatcctgactcgaacctgcacagcagccccatcaaactgccgatccacctccactgcctggtatgctgaggctgccagctcatcctgtgaggcgtggcggccctgcaatggtgagaggccatgaaggacccatgctccccgccccagcccagtggccagaggacacatcaggatccaaagctgaagcctgtgccaggcctacctgccagatgtacaagatgtgatgtggcttcccatttacctcgtatgtgtagaggaccagataacagtctcccccataaaagaagccataccattgatactccacagggaccagctccaggttctcaattctccagacctgggcatagaaggagacaccgttttccagagatgggggtgctgagaggggctaggccacactaaagagagaatccaggtgggaaaggtgctgacgtttactccatgttccctttctccctctggttctctcccagtgctgaggactcatcacatttgcatgatttgaatcgtgagatgaactgggccatcctgttcaggagcatcccatcatggctcggtctttgcaaggctgagcaatgatttgaatatatcttccaggtgagatattgatagcacatttgaggatgtgcctttcactaccctgaaaactctacagactcacaagactcttaaagaagactcctgaggtgccggaggggaaagggaaagcaaagcagacacagaatcacctgcacccctgcccccagcaggacagccatgaaggccagtgctgtctgccctgacatttgaatcattgggcttacctcaacttttccgttgccatcatcgaccattctttcctgggcagctacctctggcttggtgtgtagcagagtcacatcaaatttatcctggaaaactttagctgtggagaaagggttgggaaaagccgagtgagtaagaagcatctgtgcctgcttttctagagtcttagcaatgagaggatgatctgggggcagtctcaccaattttaccaatgctgaacgttttccccaggcccatggtctggtcctttactgaccacttctggaacagctgcttgaacatggccgactcagcaccatcgttgacggtctccacattggtgctgctggggtagctcttcatcttgatgaagccctgcagagccacccattcccaaaggcaggtcagtggtggaatacactgagttctttgcttgtctggtaattcacctctatgaagccacatgatataagcgtctcccctctgggagtcagagtcaaattctaactcacttttgtctaaggaccaaggtacc

SEQ ID NO: 17791 - DNA, 14746 bp, Homo sapiens
aagagtgattttaaggtagctctgagggtctggagtgactcagtactatgctggtctcctacaaagccaagaggaactagattggttactgactagagtagcatcagaggaaatgagggggatttgacccagcaacaactggcaactgccttctcagaggatttgcattgtccgcggcttatggggcccagggaggaggtggaaaacgtcctacattaatgtcccaacatcccagaggagaaaaaaattataactgacggaaatgtaataaaacagtcaaaagcagatgtaaccagctatagatattgtgaaacatattggtctttttgttcaaatattacaatttttattaaaataaaaaataaattaaaagtatgtgccccactctactcatatatattcccctctccatctgaatgttctctctaatccccatcctctggcaatcagatttttttttaaatgtattacaaaatatacacacaagagaagttgataaaacataaatggagagtttaaagaataattataagttaaacactacattttatgtcgggaaattgggtttgttcaacactactgaaatctgccatatgtttcttcctactcaaaatgctctctctgtcctccaattccagagttaactactattctgactttggtgataactatttccttgcttttcattatacatttaccatatatatacatatatatatggtacatgtatatatatacatatatacatatatacatatatatgtatatatatgtatatgtatgtatgtatttctatccagtatagtttcattttgcctagttttgaactttatataaataaaattaaagttgtcttcttgggttcttttaacttatgcttgtaagattcatttgcatagctgcatgaaggaagagttttatttttatggctatgcaatattccattatatgaatatactacaatttgattattcatgctgctgttagtggaccttcgaagtgtttccagtttgaggctatcttgaacatgctgctatgaccttcttggacatgtatctggtagaaatttgcacccgatgtttctctagggtatatacctaggattgggaaaagagccaacatggtagctgcaactgttattgcacttttttcttttttctttccttgagacagggtcttgtcttgtcacccaggctggaatgcaatggcacaatcatggctcactgcagcctcaactcccacttcagccttccaagtagctgggactacaggcacatgccatcacacacagtctcgaactcttgggctcaagtgatcccctcaccttggcctcccaaagtgctgggattacaggcatgagccaccatacgtggccttcattgtgcttcaaatgggtgcttctctaatatctagtcagagtaacactttttcatgtttattgaccacttcgatttcctgttttgagataaaactgttcaagtcttttggctattgttttattaagttaattgtcttcttcattgcaagtttttgttttgttttgttttgagagtctcactttgttgcccagtgaggcaatctccacttacagcaacctcagcctccccagttccccaagcgattctcctgcctcagccttccgagtagctgaagttacaagtatgtgccaccatcctggctaatttttttgtgtatgttcctagtagagacaggttttcaccatgttggtcaggctggtctccaactcctgacctcaagtgatcgacccgcctcggtctcccaaagtgctgggacatgggtgagccactgcacctggccagatttctgagttctttatgtaatttgaatataagccctttgttgcttatgtgtatttcaagcatctttgcctactccatgaatggtcttttgtttctctcaatttagatgtgtcaaattcatcagtccttttcttcattattagtactttatatacagtactaaaatctttacctatcatgaagatattcttccattatatattcaaatcattattcctacttggatccataatctacctagaataggttttttgatattttgggagaagaaggtcaagttttatttttccacatagaaaatatttgtctctataggacaccataaaggcaatttattatcccagtaccatttattggggataaaaaaagaaaatagtcttttccctattatgatgaaagatgcaacatccatcataaatcaatccatccatgtgtatgtcagcgtccacatgcgtgtggagtccttatttctggtccattagtccatgtttctatgcctcatcaataccacgctatcttcattcccatggctttgtttgcaaaagcaagtcttccatcttattctcattctctaatggtgacctggctatcattagccttttgttttccaaatatacttacaatcagttaagttctataaaataccgctcggtgcaatgaatctatatagatcaattttgggagagctgacatttttacaatatttagtcttcttccaatctatgaacatggaatctcttcatgtttaggtcttcttgaatgtctcttcattcagttttataattttcaccaaagaggtctttcacatattcttttagatttacatttagttatttgatcatttccatgccatttaagtattactttctaaaaatttctttctaacagtgttgcagtacatgtagaaatatgattaatttttaaattgattttttctagcaaatctgtaaaactcttattaattatggtaatttacctgtagatgattttggattgtctacgtatactatcacttcctcaaatcattacaattttgttttctcttttcctgtctttatacctttcatttccatttcctacctaactgcactggctaaaactgctaatgtactgtttgttgaacagaactgataataatttgtattcaggcattattgtaatgttttgctctcaaaaaaaggttttaacacttttccattaggtataatgattgctgtgggaattttgtgataacttctatcagattaaagacactctttttattcctagtctgctaagagtattttttaagtaaataagggtaaattttaggccttcattgtttcaattaaataatcacatgatgtttcttctttagtcagttcatatgatgtgttacagcaattttgcttttcaaatgaaaagtcaactatgtgttcctagaataaacccaaattacttatgatatattaatatctatttgcttattgattgatttggtttgcatcaatattcaaaagtttattgacctataatgtttcatttctatattgtctctattgggtttggcatggaggttatgctagtcccataaagggaagggtagcatccgttcttcagaagaaactatatagcatactttaaatattttctacagatttctccttaatgtggtcatcaaaaacaaaagttgaaattttgtggattcagcacattcccttggaacaatagcagcttcctaactagactctcattattccttcaacttgatctgatagtcacttcaatgctggtagttcttcgaggtttgtaagctttttagatatcttaaatagctttgattacttttaatgagaagattgcatgaaattctaggtcactattaatgaaatttcctaatcaatctttattacatgagtgaatgcatatattttactccttttttttcatatgtgcaggtttttctttatccctttcttctatttttaagttaaactaacatttttaaaacaaaacaaaatgttgaaaatttttaataaattaaattatgccaaatgctaaggcactaataaaggtgctatactattctctctttgctcccttcttcttcacgttacttttcagatgcataaagacgttttatagagcctgtacaagagaagaggttaagctctgtgcagctctaaaaataagtgaaaaaattatatatttatgtataaggaaaggaaccctaattttcatgagattttcaagagggcctattatactccataaagactgggaattgtatctcacaccaatcagaatggctattactaaacagccaaaaaataacagatgctggcaaagttgcagacaaaagagaacacttatacactgttggtgggagcagttcaaccattgtggaaagcagtatggtgattcttcaaagagctaaaagcagaactaccattcgatccagcaatcccatcactggatatttacccagaggaatataaatcattctaccataaagacacatgcacgcaaatgttcacggcagcactattcacaaaagcaaagacacggaatcaatctaactgcccgtcaatagaccagataaggaaaatgtggtacatatacattgtggtacatatacatatgcagtcataaaaaagaatggactcatgacctttgcagggacatgggtggagcaggaggctattagcaaactaatgcaggaaaccaaataatacatgttagttagcaaactaatgcaggaaaccaaataatacatgttctcacttataagtgggagctaaatgataagaactgtgaacacaaagaagaaaacaacagacagtggggtaagaggagggagaggagcagaaaagataactattgagtgctgggcttaatatctgggtgataaatatgtacaacaaatccccgtaacatgtgtttacctatgtaacaaaccttcacatgtacccccaaacctaaaataaaagttaaaaataaatacctaagtaaaagattttcaaaataaaagacagaaaaaaagagattgggaattgtattagtcttcaattctgctatttctgcaaaaattatactggattataacggttttctgtgcatacacagaatcttctaaatattttaagtgtttttaataatccattgtgttactctgcagtaatttgctgttcttttctcccattgttgagtatgcggctctaattcttttataggtagcacagcaatgaatgtacctccttctcagaagcttttgctcctgggattaggttgatgggcctctaatgtcaccagtgaaatgggatattagatattttccagctaggatacgacagctcccaataaaaccaaattactaagccttttctgcaagcaaggagccgtctggaacataaggactttaaccttgggtaggagacaggcaagcagaagtcttcaattgtgtcacaattttcactgaggactcaagtgacctaagaaagtaattgtgattgtcagagccttgttcttccttttctttctccagccgcacgcttcacctactcaggagagtgcctacgcaatctgacttgacagcttctagaaagaaattagagcaacaggggtctcagcagggtggtcttgggccaaacactgaaagcaggcaggcttaccctttcctcttctgcccccttcaactttttcctgatgttcttacccacatccctcaccacaccacaccctttcattcatccttgtcccagacttattaagtatatacagataagcaatccagggaacttgcattcattaggagaaacccagaaattcaaaagcaataatgatctaatcccagaggagtagaaaacaggaagtgggcagctgccagctttcttgctttgctggagtattctggaatttgatgggttgagggttctggacacaatgccccaagccccttccttgttgtgctgggttcctatttctgctctcggcactgacttagcagctgctcaagagctcactatgttggcttggattacacggtctcacccacatctccggcagtttgtgggcaaacytcctgagcagccttgggtgatgaaacctttcatggtagcaggagaatgggactgtgaattctcaatcccctgtccccaccccttccttcctctctcagggccttaaagtctaggaggaggaagcacagcagcaactgactgggcagcctttcaggaaagatgcagccactcctgcttctgctggcctttctcctacccactgsggctgaggcaggtgagtgaccatccccaccctcagaggcctgacctcatcccatagattcttgagccaaattgccttggtatatcctaattctgtactgttgagcaagttatttgaatttgtgtttcctcatctataaaatgagaataatattaataccgatcttgcagagttgccatgagagttaaataagttagagtatttaaatgtcttggaattgcccgcacactataagtgctataaaaacatgctttgtrtaaataatttggcagcatgtgtcagaccctacctaggaggtaagaatacagcaataacagtaccatcagctcatgtctagatttttaaacaccagtcccacgtggtcttgaattggactcagagggctctgggaagctccatgaggataaaagtataagggaacttcaggaacaatcctgtacttacagcaaagcattctcctcaatacctgaggctgaagctggccttgcctggaacaagggttgttctccctcttttggagaggaggagggaggtgaggcctaggatggggaaaagggctcctttcaagacagcagtgtttcctgtagaaccctggagccccctcccaatctgctgccccatagactccaagcctcagcaccatctcctccctctcctgcaccctctctcctgccrtccccatcttccagcctttctggagccaccaatctggtacccacattgcaggttcagcaagcatagagctaagtgccaaatgcttccttccaggggagatcatcggaggccgggagagcaggccccactcccgcccctacatggcgtatcttcagatccagagtccagcaggtcagagcagatgtggagggttcctggtgcgagaagactttgtgctgacagcagctcattgctggggaaggtgaggagctaaggaacttcctggccagccaggaacacagccctgcggagctcttcggtggaagagccatctgaaagaagagttgtagcaatgaaagggtgaaagaaagaccaagtgagtctttgcgggagggaacaggccagtgtaaatgaggaggaaaggaggataagatcaaaaagagcaagaggaagagatggargacacatattggggctcaaaatataaactcaggctatttatcaacttaatctggggaagyaaacctgaaggcaagtaccaccctgtcatccctagctcagagctgctgagaaagaggatacagctgagccccagggccctcccatcccctcgattctggttagctgcagtcttgccctccccrtgctgtctgcctaccctgcagagctggtggaccatagctcctgcagcccagacctacctcttgcttttgcagcaatataaatgtcaccctgggcgcccacaatatccagagacgggaaaacacccagcaacacatcaytgcgcgcagagccatccgccaccctcaatataatcagcggaccatccagaatgacatcatgttattgcaggtaccacctacctggccctctggctccttcctagtgtgtccgggsacaatggaggaggaagtgagggcaaggctccggggtggcggggagggcatgggatgtgtactgcaccagcgacccccgagccttggctggaggccccagctgagcgggaacgcctacattcttcctccagctgagcagaagagtcagacggaatcgaaacgtgarcccagtggctctgcctagagcccaggagggactgagacccgggacgctgtgcactgtggccggctggggcagggtcagcatgaggaggggaacagatacactccgagaggtgcagctgagagtgcagagggataggcagtgcctccgcatcttcggttcctacgacccccgaaggcagatttgtgtgggggaccggcgggaacggaaggctgccttcaaggtaaggcatgggcattggccaacacaccccgggagagaggggcccgtgcagagccaggcagtgcgaacagattccatccccacagcctcagcctggcagccagaccagggtgggctggggattgttttccccatcaacctggtctctgggggaataggaggaagacccacaacacatacataggcaacattctcctggagaagggagaggtaccttgactcagattgggctggagacagtaattaaggcagagctgaagtccagcgaccgaaaagatccagaggcttggctcctgtaccccaccgatcttccatctcacacacacccagcaattgaaggggcccacccacccctgccttccctgagagcccggagctcagggmagcaggagcagggaggcctgtctcagtctcccttctcctctctacctacagggggattccggaggccccctgctgtgtaacaatgtggcccacggcatcgtctcctatggaaagtcgtcaggggttcctccagaagtcttcaccagggtctcaagtttyctgccctggataaggacaacaatgagaagcttcaaactgctggatcagatggagacccccctgtgactgactcttcttctcggggacacaggccagctccacagtgttgccagagccttaataaacgtccacagagtataaataaccaattcctcatttgttcattaaacgtcattcagtacttagtttgtttggattgctacaacaaaatagcacaaattgggtggcttataaataacaaatttatttctcacaggtctagaggctaagaagtctaagatcaagtcactagcagattcagtgtctaattagggcccattttctggttcacagacaaccatcctctccctgtgtccacatatggcaaaaggggcaagggaattctctgatgtctcttttacaagggacctagtctcattcaaagagctcagcttttacgacctaatcacatcccaaaggccccacctaatgccatcacattggggattaggtctgggaaacatagggaaacactgtctctacacaaaaattttaaaattagccaggcatggtggcatgtgtctatagtcccagctacttgggaggctaaagtggaaggattagttgaacccacgaggttgaggcttcagtgaaccatgcactccagcctgagcgacagagcaagacaccattccaagaaagaaaaaaaaaaagactggcaggccaaaaagacagaactgaaattccaaaaaaaaagacctactttagtgtatgaaaaaggtggcatctcaaatcactgggaaacaatggatttttaataaatagcattagaacaactagatagatatttggaggggatggaagctataattggatccattcctcacaccatacttcaaaataaacctcaaatggatcacagatctaaatgcaaaaacattaaaccatacaagcactagaataaagaaaaattaaagagattttgcttctttaaaaatagctaacaaacacccatgttagtaacagcattaatcacaatagccaaggatggaagaaccatagcgtccatcaccagcccgcatggttgtcctaaaccttgtgaaagaaaatagaatctcaggacccaaacttcactattccaaagggaaagttaagcttgggaactgacccatggggggaaaaaaactgctttctatttatttccaaacagctataatccacaatcctgtggcatcacctcatttcctctacttgcttttccacatgtttactttatcttgtgtaagatgtagatttactgaggctaatcagaacctcacaagaacataaccatctgcctgaagtcctactctctctcccatttttaccttcctgcttgctctttcccctttaaatactgaagttcctaaaaccctttagggaaaagcacaggtcatagatgctcctgtggcttgtattttttccccaggtgcatcttcaaccttggctaaataaacttctgttagattgagacctatctcagtcactttgtggtttatagcccttccttgcgctataccaaccccactgtacttataagccagcattttcctcaccaatgtgatgaagatctgtctgagaacttttgatactctgaaggtatataaaacacctcacaaaatgttgacctaaataacaatacatttgccctgaagattagcccatgactgtctacatcaatattatattcaaacaaaagattactgaaatcacataatttaaaattaagctttaaacacctgctgaaagtaactacacagaatcagtcaggaggttttcctaggtaagtagaaatgttaattactcctttcagtgtgacatttaccatctgaacttttgcagttttcctaatcttaaatgaaataatccctgaacagacattttatcaaatccaacaggctatatacagaaatgctttgatgaatttgaccattattttatgtgtatctcttatcagaaagttatttgtctaatattcagtgtaagccatttatcaacaaaattttaatcaataatacatctttaacaatcctcagtcattctctctgtatttactaactgcctacccataagaattatctattactggcatgctctgggggataacagtctcattattaaatgtttgcactgacaaatggaaagaatacttgctagtagaaaagtcccccattcagcccttcctccctgtggcatttacttagggcctcagagcactgcccagtctcaggactcagtccccaggaagccccgagggcattcatctcatcttcaggtctttctctgccagtcagcacttccaaggcagctctttgtctctgctgccctactgaaaaggtctctacagaccccagggtactcacctccagaaggtgaccatcccagaagccagatccaccacttctaacaaatctgcactcttccctgttgagtaaacctcatcagcagaactttggcaagaaagcattttgcacaatgaaaaccagtgcaaaagaacacaattctttctttttccacgtgcagactttgtgcgttagaagccttatcaacttgaatggaaagtcataaaattatggtaagctcaggcacagaaacctcactgggaacttctcccccaacccaacagctaaggcaaaaaggagaaggattgggtcaggtgatgatatttcagaaagagaaagtctttctcctctttctctctctctctctctcacacacacacacacacacacacacacacacacgcacccattcacccacactaagccattttccttttcaaacaaccaaaggccagagaagggggagcagagaagaaagagtctgtgtagatggaaaatctgaagattctgagttgagctctgcctcttcccgttccatgtggagccttcagaggccctacctgcaaggccaggactgtgtctgacatgtacatgtaaatgagaaacctctctctactccagaatctcaagtgttgctccacaagattctgcagttgcctgaaactgctactcaacagtacaaagaaggtcatggatgactagattcatcagggatattggtctgtagttttcttttttgttgtatctttgtctagttttggtatcagggtgacactggcctcatcgaatgagttaggaagaattccctactccttgattttttggtatagtttcaggaagatttgtattagttctttgtttggtagaattcagctggtcttgggttttttttgctggaatatttttattactaatttaatctcactactcactattgatctgttcaggagttttatttcttcctggttcaatctcaggagatgttttcagtaatttatccatttcctctaggtcttctagtttgtaagtatataattgttcataatagtctctgatgatctttgtatttctgtggcatgttttaatgtctctttttcatttctgattgtgtttatttggattttctcttcttggtaagtctagctagtggtttgtcaatattgtttatctttttgaagaaccaattttttgtttcattggtcctctgtaaacttttgttggtctctattacatttagttctcctctgatctttgttatttctgttattctttttaattctgggtttggtttgttcttgcttttctagttccttgtcaaactagcatttctagtttgcattgttaggttgcttattttcaatatttctactttttgatgtaggtatttaatgctataaaattccttcttagcactgcttttcctgtatcccacaggttttagtatatagcatttttattttcatgtgtttcaaaaaaaaattaatttctgtgttaacttctttcttgacccagtgattgttcagaagcatgttgtttaattcccatgtatttttatggtttccaaagttcctctgggtattgatttctacctttatttcacagtggtctgagaagatacttgaggtaatttcaattgtttaaaatttgttaagacttgttttataacctaacgtggtttatcttgaagaatattccatatgctgatgaaaagaatgtatattttgtagttgttgcatagaatgttctgtataagtccatttagtctaaagtccaatttaagtccaatgtttctttgttaattttttgtcttgatgatctatctagtcctgtgagtgggatgttgaagctcccgctattattgtattgccacctctttaggtctagtaatatttgttttattaatttgggtgctccaatgttgaatgcatatacatttaggactgctatatcctcttgctgaattgatccctttatcattatatgatgaccttctttgtcttttttcctgctttttatttaaagtctgttttatctgatacaatatatctacttctgctaacttttggtttccttttgtgtagaatatctatttccacctctttgctttgagtctatgtgtgtctttattggtaagatgagttttgtatgtagaatatagttcagtcatgtttttaatgcattctgccaatctatatcttttttttttttttttttttgagacggagtctcgctctgtcgcccaggctggagtgcagtggcgggatctcggctcactgcaagctccgcctcccgggttcatgccattctcctgcctcagcctcccaagtagctgagactacaggcgcccgccactacgcccggctaattttttgtatttttagtagagacggggtttcactgttttagccgggatggtctcgatctcctgacctcgtgatccgcccgcctcggcctcccaaagtgctgggattacaggcgtgagccaccgcgcccggcccaatctatatcttttaagtggagcatttagtccatttacattcaaggttgatattgatatgtaaagctttattcctgtcactgttaattgttttcaagttgttttataaattatttctttcttttttttttctctgtgtttttctctttgtggtttgatgaaattctgtcatgttgccatttgatccttttctcttcctcctttgtgtgattgttttataagacctatgagttttatattttcatttgtttctgtgatggtgaatatcaaccttctgtttccatgtttaagacccctttgagcatttcctttagggctggtatagtggtgacaatttccctcagtgtttgcttctctgggaaagactttatttctccttcatttatgaagcttattctggcagaaaataaaaatctagactgacaattttttcctttcagtactttgaatataccatatcattctcttctcctgtgtaaggtatctgctgaaaagtctgctgttagttcaataaggtttcctttacaggtgactagatgcttttctcttgctaattttaaaattctttcttctaccttgactttagacattctgaatataatatgccatggtgaaatcctttttgcaatgtattttcatggagattgctaggcctcctatacctgggtgtctaactttcttgctagacttgggaagttttcatagattacctccttaaacagggtttctaaactctgatctcttttcctccttgggaacaccaataatttttaagtttgtttgctttatatagtcccaaacatctgctttgttcattattttttattcttttttccttatttttgtctggctggattatttcaaaagacctgtattcaaattctgagattgtttcttctgttagatctagtctattattgaagctttcaaatattttttttatttctttcaatgagcttttcaattccagaacttatgctttttttttttaaggtatctatctccttggtaaatttctcattcatttcttgaatgcctttctgatttatttgtttgatgcagatttctcttgcatctcattgcacttcttcagaatcaatattttgaattctttatctggaatattgagcaattatttttggttggaatatgttgccggataattgttgtggtcctttggtgtgtcatatttccttaccttttgtgaatcctgtgtccttctattaacatctgagcatctgatatagcttgttccaattttttgaaatgcttttttaggggacaatttttttctgaagatgtatatatatagtaggacactttggctttaa

SEQ ID NO: 17792 - DNA, 87001 bp, Homo sapiens
tttagtagagacagggtttcaccatgttggccaggttgatctcgaactcctgacctcaagtgatccacctgcctcggcctcccaaagtgctgggattacaggtgtgagccaccgcacccggcctaatttttgtatttttattttttatttatttgtttatttatttatttgagatggagtctcgctctgtcgcccaggctggagtgcagtggcacgatctcggctcactgcaagctccgcctcctgggttcacaccattctcctgcctcagcctcccaagtagctgggactacaggcacctgccaccatgcccagctaattttttgtattttaagtagagatggggtttcaccatgttagccaggatggtctcgatctcctgacctcaggtgatccacctgccttggcctcccaaagtgctgggattacaggcgtgagccaccccgctagccaatttttgtatttttaatagagatggggtttcaccacgtttgccaggctggtcttgagctcttgacctcaagtgatccgtccgccttggcctcccaaagtgctgagattacaggtgtgagccactgcaccctgccaagcaagcacttactattttcctgacttggtctggagacacaaagtgaagtgaagtgaagtgttccttcatccagctaacagttggctcagggagcccagaaagaactgagtgtttcaatccaagatggctcatgatatgttctctgatagtgggggaataaagaaatctcatgttacaaagtctgtgttggtgaggatatggttcactgggcacattcccatgtagctggcaagagggtaaattagaacatccaagttggacaataatttggcaactcctcggaggttgacagtgcaccttctctataatccagcaattgtactttctaagtttttactctagagcagggcttttccggctttttgacatgtatcctcaataagaaatatattgtgacccacagcacacataccacacaacagacaactttcaccctactagttacactgatgatgtgttacaaacattgatatttcctagtcgattttgagttttaaaaatgctgatcttggccgggcacggtggctcatgcctgtaatcctagcactttgggaggccaaggcaggcggatcacgagggcaggagatcgagactatcctggctaacatggtgaaaccccgtctctactaaaaatataaaaaattagccgggcatggtggcgggcgcgtgtagtcccagctactcgggaggctgaggcaggagaatgatgtgaaccagggtggtggagcttgcagtgagctgagatcgtgccactgcactccagcctgggcgacagagcgagactccatctaaaaaaaaaaaaaaaaaaaagctgatcttcacccactaagttgatttcctaacacattaatgggcctcaatccatagtttgaacaacattgccctagagacacgcatgtctgtgcataaggagacaagaatgtttattgcaaaactgttgcaatagcaaaactttgataagtctttatctgagacctgtcaccagcaaaatggataaagcaattgtgatgtggtcaggaagtagactatcacacagtagctatgtgtcaaaggatgcacacagggtgataacatttatacaaaatataagaccctgcaatgtgatatcatacattgttttatggatacattgaaatgcgatacaaacataaaaagctgcatgaaatgaaacccacccaaatcaggatagtggctgtctctggagggagagaatgtagttggagaagggtgcataaggaacttcaactgatcttttttctttttaagacaggatctcactctgtcgcccagactggagtgcggtggcataatcatggctcactgcagcctccttgatctccctgggctcaggtgattctcccacctcagcttcccaagtagctgggactacaggtgcacacgaccatgcctggctaatttttttttttttttttttttagagacagtgttttgccatgttgcccaggctggtcttgaactcccgggcaaaagtggtcctccagactcggcctcccaaagtgctgggattagatgtgagccaccttgcctggacacaactgaaattttttaagttttaattctttttttttttttttgagattgaactgcactctgtcgcccaggctgcagtgcagtggcatgatctcggctcactgcaacctccacttcctgggttcaagtgattctcttgcctcagcctcccgagtagctgggactacaggcatatgccaccatgcctggctaatttttgtatttttggtagagatggggtttcactatgttggccaggctggccgtgaactactgacctcaggtgatctgcctgccttggcttcccaaagtgctgggattataggcatgagccaccgtgcccggcctaagttttaattcttaaaaaaaaaaaaaaaaagaaccaaatttggcaaaatacaaagatttgacaaagctagaggaaagatacaggcactcactgtatttttatctattacttcttaaaatatttcataatagtacttaaaagattagtgctccagtactttagggaagaagactttattctgaccatgggaacttgaaaaggtgaagtgctagagagagccacaggagcgcaggcacaggggtatgactggatgaggtcctggggaaatgagaagggacacactgagtccttcctgcctgggatgctgtgctgatggctcacacttccttcacatgttggtatggtactctctccatttaacagatgagcaaacaggctgagagaatgcctgctagaaagtggcagagctgggactctaatccaggcctgtaagagtcagagtccgggccaggcgtggtggctcacacctgtaatcccagcactttgggaggccgcagtaggcggatcatgaggtcaagagattgagaccatcctggccaacatggtgaaaacttgtctctactaaaaatacaaaaattagccgggtgtggtggcgggcacctgtaatcccagctactcgggaggccgaagcaggagaattgcttgaacctgggaggtggaggttgcagtgggctgagattgcgccactgcactccagcctgggcgacagagtgagactccgtctaaaaaaaaagaaaaaaaaaaaagggagccagagtctgcactcttggccagtctacagcatggatcctccttgaggagcaattgtgttttctgcagagggtgggaggacagcaagacttgagggtccagtgtgctgggctcaggtctgtagacttctgtgggcagtgaggaggcataggaaggcttcaagcaggaagcaggggagggaactcactggagctgtaccatctgtttcttaaactttggtctttgttgttgttgtttaaccaacagaaactttcttgaaacaaattctaactcagaacgcaggtatataaaatagcttacagtggagctgatttggaagaagcaggtgacaggggcccagagccctcacctctgagacctcctggttggtggagagacagaggctctaagtattcctaggatggggaggggtggggagaaacaaggccatgtgctttagtccagagagacccaaagtggagtgacctccattcctggctgctacacctcggctgagttatggaaccatctatacggatgtcaggggaggaaggaggtggattcctgggtgtggctgtggcacaagttctgagtgtggccactggaggcaagttttcaacttgtccctcttcatcctcacggtctggggaagggaaaaaggcaattgggcccaggctgacagcttgatcagagcctggtgcccagcagaggcctgacataacaggccttcaataaatgcttatggaatgaaggcatatttttcccttctaacttttggggaagatacaggaggcctgactcctgggagcaagtgaaactgtcccaggggctgccccttctcagtgaggttccagtgacccatcgctgtggctcagttggtgtggggtaataggagaatacccagctaaaaatcagaggcttggttggcttctgcctccagttgccaggaacctgccgtgtgcccttgatgggtggtgttccttctctgggctttggtcatctctttttggcacagtggactggatgaggttttttaaactgcagtttgcaacccatttgggacattaaaaaaaaccagttcagtgggttacaatcagcattaaagcaacaacaagaacacaactgaaatagaatagaaaatatcagcatgcatcaaaggtcataaaagtaagtattgtttggtgaactattgttttgcttatatatagacgaaggtgtggactggtctgctgtaaaacttgttactgtttgccatggtgaaaaaacaaaacaaaactgtaaaacacggtacttagcgatcctggaggtgtccttccctcccacatcgttcctgggggtcttcgtaaaacaaacaaacaaacaaacaaacaaaacaacaacaacaacaaaaaaaccactgcctggggctcttctcctcccagggtcagcagctgtctctttgcttttagctgtctccacccctcccctagcctctcttcttcctgcttcagtcaccgagtcccctcctccctctctcccagggacaaacgcccccccacaactcaggaagtggggttggggggtccgaagggagcaaaagtgatcggatggcggtggcaatgggcaccctatcttaggcgttcaaataaaggactaggaagcaaacacccaagcaccggggaacagaacagaaagtaagcgagcccgggacgcgaatttgagggcaggacttcgggagccagagcctggcggcgctgccgcagcgggtcactcccagggggccggcacccagacttggcatcgttagcgcttgggtgctctgtcaactagcgaaggtaattttcatccctgctttttttttttttttgaaaggaaagacggaaggagccaagagttttggagccaactcctggagagggagcggctgaactgattcggaagttggatctctttgtacacaggaatgcggagagaaaaaaaacaaaacccaccccattgcttcatttcccctccaagcctgagcactttctattgtgcaatgaaaaggcttttcacgttgagaaaaatgaatcccgaatttgctctgcaaagggatgagcgcgcctctgggcgccagcctgctctcagctgggcgcggagaccgcgcggtggccgcagggcggccgcggccagggcgctccaggacgcgccctccgcgagcggctccggggtgacgcccgccggagagctggactcccccttccgcgggcgcctgcactggctcttagccagccgagggcccgggtgcagatagtccgggaaccccgagggcggagagctccccactacgcctgggcctcccagggatggcagctccgagagccccctagacccggtgccttgcaggacgcctctggagatcaggagggctggcggcgcattcggcgtccgggaggccgggccccggacgcgcgaggagcgcggggcgcgggaaggcaggcgggtgcacatgggtgccggcgggcgagctgcggggggagggggggcggggtgtggcctccccgcctcccgggcgggatttgcatgtgtgtggtggccccagacttcctgctccttctacgctgcaggtacgcgcgggccgggcggggcgggcgggcggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccaygcgcccctaggcgccccccacgccctgggccccggagggccgcagccatgagtgaaatgtccagctttcttcacatcggggacatcgtctccctgtacgccgagggctccgtcaatggcttcatcagcactttggggtgagtgagccgagctcgagaggggcgcgggtaaagagggggcgccgtgggccctggtgccagctgcgtgcgtccagccgccgccccccgatagaggcctggacgtccccctagtctcaaggagcgggaacggctcgcctccttcttttacagaaaggaagtgaagtgtttgctcaggtaggactcgggctccctactggagttggcaggaggagcctccctcggcggcgcagcctctaccctcccgcgcacgcctttggagggggcggagggacggaggcttcctttgcaggtggtcccgggggcgggcaggtgggtggctggaggctgagttggggaagggcagccgggccgagacgtgcccggctctgagggtagggcggagctgtcgggagtgggcaggctcagcttggagcccgtaatcctctattaccgatcccgtggtgcctttgaggggtcgcaccttctcctcacagctctctccctgttcttcccagcttcagtaggagtgtcttctcagccctccccttccaggcttcawggtcctggccagctgccccttctccccgcctctcccattcaatttcctgcgccggtcatctggcgcccttgggtccttggttctagcttctctccagcacttcacaaacattaattaattctggccgccacctcccagggtctgggctggatgaacagggaatcagttcacgtccctggagagggccaggcctgtagcagggagagggcaggagagaaattaggtagagaggatgggtttatcttcagaggagcagctggatgtgattcgctggatgggagtgtaggtggtttctccagccagaccccagggcagggtcggctatctttgtcccgtttacagtctgggggcctgggttaaattgtctcatcctcccaaccacacatggctgtcctctagggtacacccaccctcctctgctgatccactgagtgggaccagccagccgcgtggtgccttctctctgatggccttggaggacaacctggcaccctcagctcaggactgatgctggacagggcccggctcaccccaagcctgggaggtgaggggtcactggtctctcccagggttgctgggagtttagctttcatcttggtgtaaagggaatggattgtgggattggagggctggctctgccaagcagggagttctcacctggcattccagcctgccctgctcgccttctcgcagaaccatccaggtccctcctggtgccctccccttcacacgtggaatccctgcctatttgtccccacttccactagatctaacttcttcccagctccctagaggatgggggtggagccacatctgggccagcatttgtgcaggcctcctccagagagcagtgactaggccctggctgccctgaggccagggctgcccacagtaggtacagagtaaacacctctgataaagctgagggaaggaggagagggtgtggggactgggagggacatagggatctatcgtggaagtcccctcctagtgtctgaagagcaccagggacttttgggaaatgaccacctctgttgcttagtgcctggcttggggctgaacacatgatgattttcaagtgcctgtgagttttktttttttttttttttttttaagacaaggtctcactttctcactcaggctagaatgcagtgatgcaatcttggcttactgcagcctcgacctctggggttcaagcaatcctcctgcctcagctcccaaaactagctgggactacaggcacatcaccacacccggctaatttttgtattttttttgtagagactgggtttcaccatgttgcccaggctggtctctaactcctgagctcaagcaatccgcccaccccagccttccaaagtgcgtgaaccaccgtgccctgcctagcacctgtgagatttaacaagatcagggaaaacatcttattgcttcttcccctgcccttgtgcaggcctcactccctcacaaaggattccctctgttgcctccaaaacttcctcccagcttggcccttcctgccccaggaactgcttcctccagtccaccttgatcctggggcagatcctggtgacctctagaaagcccttctacgccggggtaccccctccctctgcaaacacctccaacatctcctgatgttccaccagcggatgtccaccctcctagcatggctttctagcatcggcctgtgcaggtctgcatcataattttctggggctttttcaccttcccatacctggaactccaggtgcaccacacgactgcaacctgtcccgygctctcagtctctttacctttgctcttgggttgttcccgccctttagcaagcaagtctccacctgggtaaatctgtcccaccctctaaggcttaatgcaaagtggcctcttttgagaaatccagcttccccaacccctagggcagaattaacccttcgtcctctatgcttttgaactgctttgtacaaaccactctctggtgttcctcacattggaggcttccctgtaggcccatctaatgctgggcaccttgccaggattaacaccattcatatatttagcaggtctacaggcactgtactgggtgctggggacttggtggtgattaagggagctgtgcttcctgcttccttggaagttaagagtcaaagaaggaatgatttgtaagtgctgtaagtaatcagtccagcagcttcagcgtcaccargaagtttgtcagaaatgcagaatctcagaccccgtgcccgtcctactgaatgagaatctgcattttattaagatccccaggggactggtgcattaaagtgtgaggagcgttgctctgagtgattttctctctgccccatcctcctcagaatccttctgcctcctttctgaactctggtcccctctgcttttcccgaggctgttggtgcccatgtctgtgaacccataggctgatttgactgaattcctgggctaacccagtgcccagtgtgtgggccccaggaggtacccagtaagggctggataaaaatgaatgtgttgaaggcaggggtggccttggtgggcagatgggccaggtcacctgggagatgggaagggggcattagttggggagggaggcagaggcagcattcagattctggccagagctcttcagtgcaaagtggacgaggccaattagagcctcctggagaattagaggtcctagtgaagattgtacattaactctaggtgggaaggatgggagggatctgggtagtggatccaggagcggttgagactgccagccggccagcaagggaaagcaggcccacgcctgttcttggcaggagagcaaggccaatgccactgctttatcscttaccctaggtgggagcagcagaggccagggmtggagtagctgattagggccaacaaaaagtggaggattgaatgtggcctcaggccagtggctagggagaactggccttgggtacacagggtggacccatcaggatctcaagtcatctcttgaagatctctttttttttttttgagacagagtttcactcttgttgcccaggctggagtacaatggggcgatcttagttcactgcaacctcagcctcctgggttcaagcgattcttctgcctcagcctcccgagtagctgggattacaggcatgtgcctccacacccagctaattttgtatttttagtagagactgggtttctccatgttggtcaggctggtctcaaactcccgacctcagatgatccgcctgcctcggcctcccaaagtgttgggattacagccgcgagccactgtgcctggcgaagatctcttatgagtacccagagaggtagccccagacccacagaaagtaaactgggggagtgcaggtgaactgggtcttggagctgagctttcaacatttgtcaaagtgcctctgcccacccatggctcagccttggagcctcatttggagctctcagggcctctggacctggatcacccagggctgggtaatcatagtgagtaggagatgctgcctcttacccatgggattctctgtctacctgccagcctgacctgcttccctggaggtmaggacccaagaagtatgggggtgaatatagacgaagccccaggtctccaggctcaggatccctaggtcggaaacctcagaggcatagctctcaggaagggtgtctgtctcatgttccatcaccaacttgttgggtggtttctgttttgttttgtttgaaatggggtctttgtcacccaggctggaatgcagtagtgtgatctgggttcactgcagccttaatctcccaggctcaagcaatccttacacctcagccgcccgagtagctgggactacaggcgtgtgctaccgcatctggctagtttttgtattttttatagagatggggtctccccttgctgccyaagctaatctaaaactcctgrgctcaagtgatcctccctcctctgcctcccaaagtgctgggattacaggcatgagccgccgtgcctggccgttgctggatgctttgaacaaggccctgccttctcagagtgagtttccgtcagcctgcattatcctctatggtgctctggctgtacctgagaatcacctggggattaaaaaaaaaatttcagctcccaagtcccatgccagaccaactgaatcaccatctctagggctaaggtctgggtgttagatttttaaaaagttctccaggtggttttaatgagtacctggggccgggatccctgatctgggggccctcccaggctgacaggctgtgaggaagcctgcctgctaggtctacctgcccctcagcccagaaggcccatctctttgccctcatcagacttcataatgtcattcaacaaacatttattaggcatctaccatgtgctaggcaaggcactgttttaggcactgcagaatcagtggtamccaaggcacaggtccagcttgttccgttctgtgcagtggggccctttgagccttaagtctgagacacatgtaattccaggagcaggggactgcctttccctcgctgatagcattccctgggtggatttcagacctgtcttggctttctttcttttatttttttggagagagttttgctcttgttttccaggctggagtacaatggcacaatctcagctcaccacaaccttcgcctcccaggttcaagcgattctcctgcctcagcctcccgagtagctgggattacaggcatgtgccaccacgcccggctaatttttttgtatttttagtagagatggggtttctccatgttggtcaagctggtcttgaactgctgacctcaggtgatctgcctgcctcggcttcccaaagtgctgggattacaggcatgagccactgtacccggcttggctttcatttaattgtgatttcattggaagaagatgttagacttctgttctgtacctcaaggcagattcttggtcttagcctaatccatgcaactcattttttgaaaatatatatattttttcagattaaaaaaataatatacattccatggagaaaatgtgaaaaactcaaaaaaatgatctgtaataccactatggcttacatgaacattccctatgaccttctagccttttatattcataaatgaacatttacaaacaatatcaaactgcacgtatggctttgtaccctgtccttttttgcatatatatagtgagctgtattttcccatgccaacacaccattgttatggctgcacagccatggtatgctgtaccttaatttatttaagcaactctagtattcaacattcaggctctttgtaaatttttgctgttaagaacaatttgccctgaacatcctagtgcatgcatgcctgaacacttgtctagttatagttatcctctcaggtartacgttcccagaaatggagatcaaagacaaggtacacctttaactcttaggctgtctaactttttgtgtttctgtggtggtggaggggtataggaacagaacttggtgccacagagggtcagacacgattcatgtcatgtgtgagtgttgcactagcatgtggggagtaagaccagcctctgccctcaaggttaggtaccaggcacttcccaggcagtgcgaggatgtgatggagaagggatgaagtggagagggggtggcgcggggttggctcagcctagaaccagtgccacacatccaccttgagactccagggtctcaggctgcatccaactgctcggcctgaatcctgccggcctgaaagaatcctgctggagccacttgattacactctgccctgccctacattcctgaccccatatcccctccctagcttggcccactggggcggtggcttgggttgggggtggggacacatgctgagttttagggtggggccacaccagctttctgttttcagcttagggggaggtttctgggtttggatgacctctgcacacatgcctggagtccctgcatgtccacccccagccctgctctctagacttcaccccatgtggggctgggacacccctctctgggagtgagggctgtgtgagtggaagggaagaaacctggggtgggggaaggaggaaagcagaacgcagatctctactaagttcatcacaggcctctgaatgtgagctctgagccccctgggtatgtcaggctggtcatgcgaaaggtgccagtgacacccagcatttgtacctgcagtcacaattccctgcagtcaggacacctggcttggagagcttggggtcacgcagcaggggactgagaagagaagtttgtagggcctttcaggctagggactgtgagagaaatcgtgggtgcagaaatgaggctgggcgttcacaacacagtgagtccagggtgtgggctggggatggaactgggtggagccacatgccacattacagagggatttccacttggggagacagtcaggagagactcattgcagaggcttcagtgagggagtaaaatggccagagtggtatgtttttttggtcagcaggtgggcagagccggaaggggctgtcaacacaaatctcagtccaggagcagctgcaggtgcttgaggcagacacctgtgcatatttggttagcaaattgctctccccatcgctcagccagccagcccgccagccagccagccattagcccttcctgcacagtgcaggagagccctcttctccagtatgagtctagaaatagatgatgggggtgatataggtaatgggagggaaaattaagtctgtgtctcaaagatgatgatgatgatggcagtgggtagactttacagatcacttacattgggtggccctggcctttacctatgctctcacagcctgaggcataaatayaattcaggaaaagtagtgggaagcatttagaacaccaatttgcttaccacctagacttaatcattgtttacagtggtcacatttgatatttgtattttttgctgaagtattttatgataaattatcatacattgcatctttttcacctctaaatattttattatacatccctatgtaactacagtgttgtgatcacaccaattaatagtttcctaatagcattcagggcccaatccatagtcagatgtgcccattgtcctcagtggtgtgatcagagttcactgtaacctcgaactcctgagctcaagcaatcctcctgtcttggcctcccaaagtgctgggattacagccactgggcccaggttcagtctgtgtttgaccgaccattggtttctttttttttttttttgagatggagtttccctcttgtagcccaggctagagtgcaatggtgcaatctcggctcactgcagcctctgcctcccgggttcgagtgattctcctgcctcagcctccagagtagctgggattaccagtgccagccaccacgcccagctaatttttgtatttttagtagagacgggtttcaccatgttgggcaggctggtcttgaactcctaacctcaggtgatctgcccgcctcagcctcccaaagtgttgggattacaggcgtgagccaccacgccgggcctgaccattggtttctttaaatcaggatcctaggccaggcgcagtggctcatgcctgtaatcccagctctttgggaggctgaggcaggcggatcacgaggtcaagagatcaagaccatcctggccaacgtggtgaaactccgtctctactaaaaatacaagaattagctgggcatggtggcacatgcctgtggtcccagctactcgggaggctgaggcaggagaatcacttgaacccgggaggtgggggttgcagtgagctgagatcgtgccactgcactccagcctggcaacagagtgagactccgtcaaaaaaaaagaaaaaccatcgagatcctgtcaaggtactcgtgttacattttcttatgcctcttcagtttcctttaatctaaaacagcgccccgccctcatctccttttccaccatgaacactgagtttctggcaaggcggggttgtggtgtaggctgcttcactttctggattgatttgtcagggctgcctttgttgctttgtttcccagagagctctgcggaggtttggagccagggcgagttggcctgagggtctgccctgctgagggtcctacagcctcagttactctgtcaagtgagaaagactgagagagtccagttctgggttatggagagtgggagacaagcctggggctggcaggccaaatatatgaggcaagggctggctggcggcccatggttgcaccttttctccctytcttcccagctttccctttggtctcctgctccctgtctttcttctccttggccttacagatatgtcctcccatgcacccagcaccgctgtagagaccccaggacttgtcagacagcccgcctgaccctgacagccagaaacccaggcctgtggcagaggcagggtggcacagtggccccgacctttatttctactgggccaagtttagttgttcttgctatctccattcttcctggagagactatttgggttctctgcgtgtgcggcttattgtcctttctagactttaagctttctgaaggctttagctgtacttgttttaaaattccatatattccatatactgtctggccccccattggttggcacagggtggattcttggtaaagatatgtagaggtaaaggaaatggttgcttttgcagggatgcaggagttaatttcttttctctgatgagccaggagccccaaccagtgaatctgggtttctctcttaacattccgcctagtaggtgtgactttggctatctggagaaagggccccccaggcttcccacccaccaccagcccatcccagtgttctgacagtgcctgctgttggagtggcctccttggggctggcctgcatctgtggagtggtggccagttgtagggtctagccctacggggcttagtgggtgttctccccatgtgcggagatgagagattgtaataaataaaagcacaagacaaagagataaagaaaaaacacctgggccggggtgaccactaccatcaagacgcggagaccagtagtggccctgaacggctggggtcactgatatttattgcatacaagacaagggggcagggtaaggagggtgaatcttctaagtgattgacaaggtgaagcaagtcatgtgattacaggataggcggcccttcccttttaggtagccgaagcagagagggaaggcagcatatgtcagcgttttcttctctgcacttgtaagaaagatcgaagactttaagactttcactatttcttctaccgctatctactgcgctcttcaaagaggaaccaggagtacgggaggagcatgaaagtggacaaggagtgggaccattgaagcacagcaccacagggaagggtttaagcctccggatgactgcgcgcaggcctggataatatccagccttccacaagaagctggtggagcagagtgttccccaactcttccaaggaaaggagactccctttcgcggtctgctaattaacgggtgcattcccagacactggcgttaccacttgaccaaggagccctcaagcggcccttatgtgggcgtgacagagggctcacctcttgccttccaggtcacttctcacaatgtcccttcagcacctgaccctatacccaccggttattcctaggttatattagtaatgcaacaaagagtaatattaaaagctaaagattaatagtgattgctaattgyccatgatcatctctatatctaatttgtattatgactattcttattctattttttttattatactgaaacagtttgtgccttcagtctcttgccttggcacctgggtaatcctccacccacagccagtgtctggggctgggagccagaagacctgggatctggaacttgctgttccattaacttgtgtgacctgggcgggtcagtttctcctccatgcccyagggacagttttcwcatccacagctgaatgggggcggggggagggttgttcagggtccctcggggatttccccagtctgtcattcccccagtctgtcattccccctcccatggtgctctgatggtggccaaggtggtaggttttgagtcaggctccttgatagtcacctgccccacttctatctagctcccttcctcctccttatctaatctttccagacagcactgacccaccctgctacctttcccatggcgcccacctggatctcaaagtccacgcagggtggaatggggcagaatgggatgcagctgtcttcctctcctacctcagatcaaggtcttggggtgtagaccccgtgggcatttcagggactgtgccctcctgcaaccctagaacaagctgtcaaccagctcctctccagagggcccagaacagccctgcctgcccacaggcctccagccaggaccctttccctgtagccccatcctcctgctccctctgctgttcagactggtcttgtgcctcccagtggatggaaggcgcactgcagggactgttgtcctctgggctcctgagcctctgctgggctggtcctggaggggagaaggggacacacaggtgtagacagggctcctgtcctcggcactcagcgtggtcgcaggagatcccagagggtggggaccacacccagcacatagtaggctcgtggtgaggtctgtcgagtagatggaggcctgggttgtgtctgtgccattctctgaccagctgtgtggctcaggggttccatccactctgtgggcctcactctggactgtggtaagaacacaatgagatactggatgtaaaaacgattgataaactatagagtcgcgcgatggaggggcagtttttttgtgatcttggctggggtaccaccggcctctaggtgaggggcgatgccggtggtgggcgtagcggggcgtgggcagggaaccacacgggagcctcagcttggccttgagatggcaggagtgggatggggcgtcatcctagtagaggctggacagtgagagatcggtgggctggtaaagggtgggaacaggtcttttctggggcccgtgggtggagggaccttgtggggaggcgttggcgagaggggggtgaagcgaagcggccacttacccctgtagagcgcggctctggtttcagcgcccggtgcgcactcagcagggcacctgtggtccggctagtttgataaacacaggtgcccgccatgaggaagagtcggggtggggcgctaaggccagggacgtcggtgccatcaggtggggaggggtaccccggggccgccctccgcgggcagacgagcgggggagagcaggaaagcgcgggcgcagcggcacatcacccgccccgcccccgggcgcgtctggcggaggcgcggcgtcctggcagcggccggcagtcggaggcaggccggggcgaggccgcgctggccctcccttggcggcggcggcgcgtcgtgggagacggctgcacgtgggacggcgagtttcgcttcgccgcgggggcgggggcggggccggggccggggccggacgcccggagctcgcgggccgggccaggctgggggcggggcgggcgcggggcgggcgcggggcggggccgggccgggccggggcggggccagggaggccagacctacgctctccggagccgcgcggacccagaaccgctcccaccacgcagcgatggggaggtcgcggcctcgcccggtgaggctccctctccatgcaaacttgcctaacttgtgtcccggccctcggccctccctctggccccaggtctcccgacaggccatctgataagagctttcttgcttatctgttaatgacttcacgcgacgctccctcccgtcccctcctgctcccctgtcgccagagatcaccttcatgggatcccttaggcctaatgagtacgcacagagacacgggtgaggggagcttgggggcacggtgggaccctgcaaacatctgcccagggccaccttctttatctacacacaccaggtgggggctgcgctcaacttctggagaataaaacaaggaaggcaaggtggcaaggtgccacctcttggaggttcttgggggacacagaatggagcttagcattcccagatgatgcctgttttgctggtcctggcggacccgggagaaaatgcccaaggtcccatctcctgcctcccaagtcctcactcctgaccgaccctccctgctttccgtagccctgcccagggcttgcttctctgctccagtcccttccacagaccgttgtcgtctgctcagctgcacatctgggatgttttccttcccagccttgtttgaattcccctccggaatccgtgctccccttctgaccggtccctcccttctctaagtggcttctgtttgcactccttgctttgtggactgctgggcactggcatggggaggggctgagctggagaggcggggcttcagaagctgtgccagcgtgggctcggacaaatggacatccacctaatgaccaggtgggcttgtccagaggggtgaggaaaaacgctttggcccccaaatttgcatgtctttcctgcatgtgtgacccagacaaggagttcccaggagaggcgtggaggggtcagggatgaggatgagttttttcctcagacagggaccctctgaggagggggactctgcggcctcttcctctttcccccgctacaaggccctgtgtaccggtcaagatgggggctgtggggactgccgccagcctctcttcagctgcacaacctccatgctgccctgcggctccatcaccccagtcaatgctttctttctctcgccatcaaaattcatccatcctgtgtcccctcccttcagggctttgctaagagacaaccagctaatctgattcactaatatcttacaggaaattctatgaattattcaaggctctgagcagttcctgcttctcccacaccttctctgattggccaagcagtgacctctcccttccctgaattcggacgaaacccacggctggtaccaccagtcggctctgatacatattctttatattatttatcttctgagtatgtgatttgtcttcccaatgagattttaaactacctgaggcggggaccttgtcttttgcttcttgtgtactttactgcacagctagtaaaatgaattaattaactcagtatgtattttgtgtgtcccctctctgcaccagacagtggtttgggtgctgaggatacggcagggagcaaaacagacacgtctgtgccctcacggcacttaacattccatggggtcaggctaagggatagtaaacaaaataagtaaactagctagccaaccaggtggtgataaaggctgtggataacaattacacagggaggtgcatactgagtgtggcaggaagcagtttgcaatttttaataaaaatgggagagagggtctccagtctccatgggaacaggcttgtttgagcccagatctgaaggaggtgaggatcctggaggtagagggttctgggcagaggaaggagccagtgcccactcccctgggggattgaggagcctggagggggctccagggctggagcagaggggtgaggggaagggggatggggaggagatgcgatcagagatgtgagggggtggaccacgtgggtctttcaggccatgtaagttctttggttttattctgagatgggtggttctggtgagttctgagtggagtgctggcctgatttgacttaccttttaaagggatcccctggccgggttcggtggctcacgcctggaatcccagcactttgggaggccgatgcaggtggatcacctgaagtcaggagatagagaccagcctggccaacgtggtgaaacgctgtctctacaaaaaaaaaaaaaaaaaattagctgggcatggtggcaggcacctgtaatcccagctacttgggaggctgaggcaggagaattgcttgaaccttggaggcagaggttgcagtgagccaagatcatgccactgcactccagcccgggtgacagagtaagactctgtctcaaaaaaataaaaaattaaagggatccccctgcttctgtgtgggaaataggctgaagggagtgaagggggaacccaggagaccagtgaggaggtagttactgaaatccaggtgagagctggtgggagcctggacaatgtggtggtgagagtgacaagaagaggtccaattctgtacctgattgtgtattttgaagatgcagcccacaggatttcctgacaggttaggtgtgaggtgtgagtggaagggaggagccaaggataggtccaaggtttttggaccaagcagttggaaggatggagttgccatcgactgagatggggaggacctctggaggagcatgttccggtgggaggccaggagctcagcttgcacaggctgagtttgcgatgtctgtggacacccaagcagagatgccgagtaggcagttagatctccgaggctggagttcatgggaggtgaatgtgggagttctcagtgaaggttttggaggtgcttttaagttcatgagtgtggtcaagatgcccaacgacgtgagtgcagatggagaagggaagagggccagggactaagcaggtgctggaggccgggagagaaaaggagacagaggaccctctgccgtcccgtcattctgcagtcctgcacagcgcctgctctgacgccgggctgcctggcttcaaaacctggctctgtggattgtttaacatctctataccctggtttctctgcctgcaaaatggaaataacaaagtagaattagaaacttaaataacaatatatgaaaacatgaggtagttctccagtactctggggacaccacctggatgtcctgcagttcaattcaattctgacactatctgcctggagtcagtgtcagatcccacaggtggaaagctcagtcccccaagactaacatcacctcagatgccagttgcaagtccgggcttctggtgcttctgaccaaacagccataaatctggggttcccacaactccctctttatgtttaataatttgctagaatggctcacagaactcagaaaacagccagatggaagagattaatatggagcaggagatacagagcttccaggccctcyccaggggtgaccccctcccagtacccacatgtgttcaccagcccagctctctgaacctggttttttgtttgcttgtttgtttgtttttttaacggagtcccgctcttttgcccaggctggagtgcaatggctcgatctcagcacactgcaacctctgcctctagggttcaagcgattctcctgcctcagcctcctgagtagctggggttagaggtgtgtgccactacacccagcgatttttttttttttagacggagttttgctctgttgcccaggctggagtgcagtgactcgatctcggctcactgcaactctgcctcctgggttcaagcgattctcttgcctcagcctcccgagtagctggggttacaagagtgcgtgtgccaccacacccggctaattttttctttctttctttttttttttttttagtagagatggagattcgccatgttggccaggttggtctcaaactcctgacctcaggtgattagcctgcctcggcctcccaaagtgctaggattacaggcgtgagccactggcgcctggccccttttgggtttttacagaggctgccttacctaggcacgttttttgttttgttttgttttgttttgtttttgttgagatgaagtcttgctctttcgcccaggctgaagtgcagtggcgtgatctcggctcaccacaacctctgcctcctgggttcaagcgattcttctgcctcagcttcctgtgtagctgggattacaggcgcgcaccgccacgcccagctaatttttgtatttttagtagagatgaggtttcaccatgttggtcaggcgggtctcgaactcctgacttaatgatccacccgcctcagcctcccaaagtgcagggattacaggcatgagccaccgcgtccatccacataggcatgattgattaaaccattggccattggtggtcaacctaaccttcagcggctctctccttccaggaggaggtcgtgacggaggtggggctgaaaatgggaaccctcaaattacacggttattccccggcagccccatcctcaggggctttccaaaagtcacctcattaacataaaaccaggtgtggttgaaagaggcttggaatgaacaaaattcatgccatttcatctttattgcttccgatctatttcaggaactgcatacaaaaatctaaacattgtaactcttcttgcctttatcacttaggaagttacaagggctttaagagctctggccaggagccgggatgaagaccaaatatatatttcttattatatcattaacactttgcattgtgcaaggtgttaatcattacaaagaaaacacacaggggctccsttctcaaggaactcacagtgtagacacagcaagtcaagaagtggggagagacactgccaggaccaggtgccggaacatgaaggagggaggcccacaggggctggccaaggaaggctttgtagagtaggaaagcagagctgagggtggaaggatggagttttgctaggcctgtggcttcatggggccagagtggagtgagtattaaggcactgcaggctgccaggactgcctctggagagatgagagctccagggaccttgggatcaactggaggtttagtagagttggggcaaggaaatagtgaggctagctagggagtaggtagaggtcagatcacaaaagaccttgttagactgggcgtggtgactcacacctgtaatcccagcactttgggaggctgaggcaggtggatcacgaggtcaggagtttgagaccagcctggccaagatggtgaaacccagtctttactaaaaatacaaaaattagccaggcgtggtggcaggtgcctgtaatccaagctactcaggaggctgaggcaggagaattgcttgaacccggggggcagaggttgcagtgagtcgagattgcgccactgcactccagtctggtcgacagagtgaaactctgtctcaaaaaaaaaaaaaaaaacagaaaagaccttgttaaccaacccagggagaggaggtacagaaggagcacrggctttgaaatcagctctgtgggtttaggcaagttatttaatattcagattcggttttctcctcagtaaaatggcactaaaaacaagccccttgctggcaagttggtgagaattcagaggtaacaggcatgggggtgttaagacagagktggcctttgacacggtgggtgatcagcatcactttatcttagaggctggagtggcattgacaaattttaaatgcaggaagggtggctggatgggtagatgggtggatgggtggatggatgggtgcatgggtgggtggatgaatagatggatgattgggggctgggtagatggatgggtggagggatgagtggatgggtggatagatggatgggtaaatgaatgccctcaagagatgcaagattaatgccagcatggctataagagggaaattgtcctagggtgaaccaaggaggagactatgaaatgaggcctgactgagactgggaaggggtgagaatcatcatccttccttggagacctaaagactcatgccgctagtttggtgtctcctgtgcttctctcatctgtctgtctttggtctctctctgcttctgtttcttatgctttttgtctttctgactctctgtctccctcccttccactcctctatgcttttgtttttctcctcctctcctgcccccttcacccactgcccatcccatcagggcagcagggtctcagggctgggacaggagatacacctgcagcatgtgacaggcccgactggtggcagagtccccccaggacagctgcagctccagtcagggggctggggtgggctgggtgtgcttctgtgttcttcctggggttctccccgcccccaagagacaccttgcctttcaacggtggtgccaggaaagaatgacttgatggtggggagcttgttagagatggaggaattatcttaggggctcactggtaccctggcatcccctgctctaagggaagggatactgtgggakataggtctcttctctcctgctgaccgagctgctttgttccccaggctggtggatgaccgctgtgtggtggagcccgcggccggggacctggacaacccccctaagaagttccgtggtaagacctccgcttcctctgcccccgcccctcccaggctgcagggtyctggacctgcgactgaatttattcaactgcattcagccccagtggctggattagatgtggcgctgccctgcagacctcactctgctgtcggcggaatcccccttggcttgcactgctgccatcttggcacagacgtgccattcccttcattttctggggccacaccccacttctcaggggcacacccacttctggccaggggcccattctccccccaaaatccccacagccacagggctttctttgtctgtgtgactggatgttttctgagggaacgggtggaaaagagaattgtcttagactttaggaggccctggtgacagcccttccctgtgcctcagttcctcatctgcatggtaagagatttggaccccatggtttccagaactcttctgaccctggctgtgtcctcagccccctcctgtgtgtgagtcctgccctgcaggaggctctaataacaaagccccttggtgggaagttggtgagaattcaccttgggcaagtgacttcgttcacgggaccttgtcctgagtggtcagtgggctcctcgggccgcccagcaggctgagggcctttgtggggattaaacaatatcctggctgtcattatgccaagccagggtgaggtgctattgttgtgcttacctgtgagggctgagaccgactgacagtcagacagacaggtcctgggcgtgttgggcagggtgggagcaggcagcaacacgctgggcctgctgccaccaagtctgcccgcgtggctgctcctctggggagagcttagctgggattgtcctcgcgggggatgctggaaggggagcgggatttaagacaatccggcggcatccttggctggctggctggcggccggggtccttgcccatcacttggaacctgcagaggggccccctgtctgcaattctgttcctgcttccatcacggggctctgagtgagggttttggctggtggaggtcttaggtgggaactgccctggccctggacgaaccgcaccaccataaggccccttcaccctacaccgttggcccctgctgcctctccacctcatcctctcccccttgccccctcccacttccctgcaaccacaccagcctccctgccattcctcacagtcaccagcaacactcccgcctccacatctttgctgttccctctgccctgaacgttctttctccaaatatccacgcagcccagatgctcagcagctttaggtctcacatcttcagcgaggccttccctgaccactcaatacaaaatcgcactgctggccccacctcccttccctgctttctttttctctgtagcatgaatctgctgtgctcagtgtattttatttatttgtgtttgccatttttctgccccactagaatgtcagttccaccaggggagggatttctgtgtttttgttgttgttgtttgctgttttacctgcagtgtctgccacacggcagatccctgagcacatttgagtaatcaatgcatgcacagggcccctccccagcgtcctcttgccctgcccctcactcaggcctggctgctccatgtcctgttgttgtgacccacccagaatytccccagtggagcccaggctctgtgggtttaatgtgctcacttggaggcacaggtctgacctcgcctgtcccagttccctgaaggatggacgggtagagaaaggaggcctgggcctctcctggagtcagaaatgggagggcgttgaggctgcagatggaggctagattgccatctagtaggaggatttagtctagttcttggaaagaacttagagacagagagaaagagagagagaggtgagggtcccaagggtgggctctgccaggaccggaaggggaagctttgcatgtgtgtcgaggtgtgtgtgggcagctgtgtggtgtgacaggctggtgacagggaggtgggtgtgaccgaggaagacttgccctaagcttctagtgaacagtttggggccaatttttgacaacaacaaagccacttagcagaacaaatgcgcctttgacttcttgccctcctctgtcctcattgcgccttccctctccctcctcccccaggcccctcatctcatcttctccattttcccaaagcctgtgaatgaggcccaccccaggatacctgggccaccccgtggtcccatatcctcgctgggtccatccagcaaagtgatgtggaagagaaaggttcagactccatctccttccccctcttctctgccccagctcctggttccttgatgtcttggtgaggtgggtagaggcccctctggactccctatggccctgttgggacctgagcggagccaaccttctggaacagagccaggcctccgtacaccctttggctggcgagtacaagttggggcattagaatgtgggatgagagacatggactatagcctcttcagttttgacactggagcccagaaaagacaaagatggagcttggcctcaagccaggagtcctggctttcactgtttccactggccctggagggtgggacccagcaagggggtggggttatggcaggcgttttagaagttggctggtggtcatcagaaatggccttgtcctgaagactcccagaagttctgccccccaccatcttggggtgagcctggccattgctgggactcccagctccctgcccggctscctgccagctcccctttcacttgctgaccctggaggctggactcgcaaagcccccaccacccccacctcgggaaggaatccctgcatggctccttgcttgtggcttcagctccagccaccttcgaagccaccctaagccccaacatgttcagggaattatttccagagctggcaaggccctgggaagcccaggctgctgatgccctgctatgtgtggcacccacgctaggccagcccttgaactctgcctggctgtaacgtttcgggctgtggctgcygtgagtcccgagctgctgactgggctgagcctggggcacattccctctcctagccctttttccttcttttcctcctcctgttggggcaagggacctgggtagcccttgtctccaggtctacctcagggaagctcagagcctgcacccccagccccagtgcccccaagacatgtgtgtgggggcagktgccagggaggagagtgatgaggtgactgccctccatttgcatgactggatgcccccttccctagcctacgcctcctctacctgtccatgctccaagcccrgcttattgttattgtgattaagatatatttcaagtctacacgatagtaaagagaaaaatagggctgggcgcggtggctcacgcctgtaactgcagcacttgggaggccgaggcagtcaggtcacgaggtccagagttcgagaccagcctagccaacatggtgaaaccctgtctctactaagaacacaaaaattagccgggcatggtggcatgtgcctgtaatcccagctacttggtaagcagaggcagaagaattgcttgaacccaagaagcagagtttgcagtgagctgagattgtgccactgcactccaagctgggtgacagagcaagactctgtctcaggggaaaaaaagaaagagaaaagtgacacacaccccatgcacccactgctgagctttgtcaaatcctttttgctacgtttatttcagatctttttacttttttttttttttaagtagagatggggtttcaccttgttgtccaggctggtctggaactcctgacctcaggcaatccgcccgtctcggccttccaaagtgctgggattacaggcgtgagccactgcgcctggcccagatctttttacttttaaagaattaacatagctgtagccgaagccccctacatcttcctcccttccccttcctctcctgccttctccagaggtaaacacttgtcagaaattggtgtgcatcattcaagggcctgttttatttttattttttactcatgcctaacacaaagctttgaccaggggtctgttttaatgcttttgctattaatgcatagggatgtaactgtgcacaatataggttttttktttttttttttgagacagagtctcgctctgttgcccaggctggagcacaatggtgcaatcaaggctcactgcaacctctccctcccgggttcaagtgtttctcccacctcagcctcccaagtagctgagattacaggtgcgtgccaccacgcccagctaatttttgtatttttagtacagatggggtttcatcatgttggccaggctggtcttaaactcctgacctcaggtgatccacctgccttggcctcccaaagtgttgggattacaggtatgagccactgcacctggctaagtttttatattttttaaaccccatatattaaaggtagcctcctggacaaatccttttgcactttttaaattctatactggttcctggccaggcatagtggctcacgcctataatcccagcactttgggaggccaaggcaggtggatcacctgaggtcaggagtttgagaccagccaggccaacatggtgaaacccccgtctctactaaaaatacaaatattggccgggtgtggtggtgggcacctgtactcccagctactcaggaggctaaggcaggagaatcgcttgaacccgggaggcggaggttgcagtgagccaagatcacgccactgcactccagcctgggtgacacagggagacgctgtctcaaacaaacaaacaaaaaattaataaaataaaaataaattcagtactgtttttgagatttatctgagttgatacacatggctgtagttcatgtgtttaattgcaatgttgcattccattgggcgataaactgaatcccttcattggcactcctgttgatggactttcagctcatttccagcttttggcaattgcctgcgatgctgcagtgagcctccttaggctcgtgtgctcgggttcctctggtatgttctgagtkgggggattactaggtgagaggaatgcgcctccatggcatgagaagtgaccctgtggcgactgtgggggcagctcccttcgctctgcccacatccttgccacacttggtcttgtcccacttaaatttcttccagcctgctgggtgtgaaatggcatcttactgtggttttaatttacatttctctgactactagtgaggttgagcaccttttcataagttttttggtcactgaaaatgtactctttttttttttctttcgttttttgagatggagtctcactctgtcacccaggctggagtgcaatggcacgatctcagctcactgcaacctctgcctcctggattcaagcgattcttcagcctcagcctcctgagtagctgggattacaggcacgtgccaccacacctgkctaatttttgtatttttagtagagacagagtttcactatgttggtcaggctggtgtcgaactcctgaccccgtgatccacccgcctcggtctcccaaagtgttaggattacaggcgtgagccaccacacctggccgaaaatgtactcttattcctttttttcctttttataaaagtaagacaaatacatgatctaggatcccccactctaccctggtcctccactctaccctcctcactcaacctcctttccccttctccaggggcaaccatataagaaaatctaactaggtaatttattcattctgttaaaacatcaaaacaccatacaaacacagactgagagtctgctcccaccctcttcccaccccccaccccctccaccactgcctctttaggtcatcactgtctttaattgcttatgtctcttccagtgttccattctgcaaatacaaacatatatccagattttcccttttcttatagaaagatagcattctatatacactattctgtttttttgctggtttcgctttataaatcttgctgtagacagacccttctggagatctttctctctgaatatgtagaagctcaaacttcctctctctctctttcattaattatattcactttagccaggtgtggtggctcatgcctgtaatcccagcagtttgggacacccaggtaggtggattgcttgagcctaggagtttgagaccagcctgggcaacatggcgaaaccccgtccctacaaaaatacaaaaattagctggatgtggtggtacacccctgtagtctcagctacacaggagactgaggtgggaggatcgcatgaggccaggaggtcaagtctgcagtgagccgtgattgcaccactgctttccaacctgggcgacatagtgagatcctgtctcaaaaaaaaagatgaaaaaaagtatattcattttagttgcatattgtggacaaccatgagaaaatagtctcctacaaattacatagtaatttgtcttaaayattaaaaaaggttatttatttatttattaagacagggtcttgctttgttgcccaggtcagagtgcagtgacaccatggttcactgcaaccctgacctcctggactcaagcaatcctgcctcaccttccagagcagctgggactacaggtgcgtgccaccatgcttggctaatttatttattttttgtagagacagggtttcactgtgttgcctaggctggaaaataagcgaactctyggactcaagcaatctgcccgcttcaacctcccagaatattgggattacaggtgtgagccactgtgcctggcaaaagtcacttatttttaattgtggtaagattcacataacaaggagtttcccatcttaaccatcgttaagcatacagttgagcagcattccgtacattttcatttctgtgcaactattaccaccatccatccacagaccttttttcatcktgcaaaactgaaactcagtacccattaaacaataactccccatttcctcctccccccagcccttgcaactaccattctactctctgtttctatgaatttgattactcttggtaccttatacaagtggaatcatgcagtgtttgcccttttgtgactggcttatttcacttagcataatgggttcatccatgttgcagcatctgtcagaatttctctctttcttatggttacatagcattccacacatagagttatgtggctctattgtaatttgtttcagcagtccccctgatggactcttgggctgtttcaagtcttttattattcctgttggtgctgcagcaaagaccctcttctgtggtcattttatgtaagagcaggtgcgctccgagaatgcaagcccagcactgaggttgctgaggcagagggcgggagctcggtgattgccacttgccccccgctgccgttgtatcattttgcaccctcaccagcaatgtaataagagaaagcaaccccttttaactcttttcatggtttcttctgctagctacccctgtgtctccaaatgttatgattattctatttctttttctttttttttttttttttgagayagggtcttgctctgtcatccaggctggagtgcagtggcgcaatcatggcttgctgcagccttgacctcccaggctcaagccatcctcccacctcagcctcctgagcagctgggattacaggtgtgcgtcaccacgcctggctaattttttaattttttgtagagacgaggtctcactgtgttgcccaggctcgtctcaaattcccgggctcaagcaatcctcttgccttggtctcccagagtgttaggattacaggcatgagccacagtgcccggccactactgcttgatttaccaattttagagtatctgttggtgcccttctaagatagatgataatttagctttcatgacctgctcttccattgcccccctcatcctcccaacagcatcctgtggcctgtagattctctagggtcacctttataaacctgagagtctcagttaccctttttttttcttcctcattctgtcaattcctccaagcactctgtccatgtctccctcccactactgccatgtgtattttttttcttttctgagacagggtctggagtgcagtggcacaatcatggctcactgcagcctggacctccagggctcaagcaatcctcccgcctcaagcctcccaagtagctggatcacaggtgcgtgtcaacagacccggctagtttttaaaattttttgtagaaattgggggtctcaccaagttgcccaggctggtcttgaactcctaggctcagtgatcctcttgccttggacttccaaagtacttggattacaggtgtgagccaccacgcccaggctgccatgtgtatttttttttttccaagacggagtctcgctctgtcttccaggctggagtgcagtggcgcaatctcggctcactgcaacctctgcctcccaggcaggttcaagcaattctctgcctcagcctcctgagtagctgagattataggcttgygccaccatgtctggctaatttttttgtattttcagtagagaccgggtttcaccatcttggccaggctggtcttgaactcctgaccccgtgatccacctgcctcagcctcccaaagtgctgggattacaggtgtgrgccattgcgcctggcctatgccacatgtatttttatttttattttgtttttgttttgagatggagtttcactcttgttgcccaggctagaatgcaatggtgcgatctcggctcactgcaacctctccctcctgggttcargcgattctcctgtctcagtctcccaagtagctgggcttgcaggtgcctgccaccacggccaactaattttgtatttttggtagagactgagtttctccatgttggtcaggctagtctcaaactcttgacctcaggtgatccgcctgccttggcctcccaaagtgctgggattataggcgtgagccaccgcgcccagcctatttttatttttaagtcatcaagactgaatgacctttccatcctcttctgtaaccacaatgacatcttgggtgttttgttctataggttgagtctaaacaytgaagatgattggaagcagatgcaggcattatttcttgcagagcttttacattactgcaaycgtataacttgctttgctctctgtccttgacttggatcctctactctggtgcttgattgagcagcagaaccatgtggggtagaaagggagtgggggagaggtgcctttaaaaatgcatattcctagacctcacccgagacctgccaagatctgtggaggacctgggagtttgtgtattttaaagctatcccccttgccctggaatgatggtatgcagtggcagtgggcatttggagtggtaggcaccttagtcagtattggatgaatgttgactgaccttatttaataaatgaatagcctcttgcctgcagcctcaccagccctgtgccccttcatccacaggtacacaccccgggacacacaatccttactttaggaaacctccctggaccctccaccttttctcatggtctttgatgctgcaactcctgtgtgggcccagtctcctggctacccatccaccctccttctctctgcccttcagccctgtggtttagtgacagggaaggctcaggccccttctggggttctgacagggctgcctttgggcaaggagcacagcgcagtagaagcatgggatgtgtatggcgacgggccccgagtctacccacttgtttattcattcactcagcatcttctggcatgtgtatgtgtgggcaaggctctgagggaggatctatgtgagagaaaaagttgawtcttacaagttccagttattaagtttccaagaaagatacggaggagtcaggaggagcagggagggctcttttctgacttcactgctctcccggggatgcttcagggcagtgtgtctcatgcaggcacaggctctgacccgctagtgggctgtgaagtcacttgaatgggctcagccatcatcgacagaaatggataggrtagaattggaatgcatccaccctataagggctgttatggtttcattaattctttcttcagctctggctattctctggttaaatatgtccagtgagttttaaattttggttattgaagctttttttatttctagaagttctacttggttcttttttcagtctgctatgtcatttttttttatcgttttctgttctctgcagggatcttcaagctttttttttttttaattgattgaagcagagaagacatatctgttttacaggtgatgtctgcgtctgaagtctctgcctgtgtctgtttttagtgtctattttgtgggcttgttctccctcgcggtgtctggttcccaaggatccctgcttttctttgagcatatactggttattgcatttgaaaagtctggtttgagttgccgggcggggtggctcacgcctgtaatcccagcactttgggaggccgaggcgggtggatcacgaggtcaggagatcgagaccatcctggctawcatggtgaaacctcgtctctactgaaaaatacaaaaaattagccgggcgtggtggcacgcgcctgtaatcccagctactcaggaggctgaggcaggagaatggtgtgaacccrggaggcggagcttgcagtgagccgagatcgcgccactgcactccagcctgggcracagagtgagactccgtctcaaaaaaaaaaaaaaaaaaagaaaagtctggtttgagtctaggatgaaggtaccttcctccaggaaggccctggtgttccttctgccagactcctgagggtctcgccagttcaagcccacttgaagcccagstcgtttggggttacttgaaccatctgggggattccaactagtatctttagctcctgacatgagctgttctactgtgggctcagcccttgtctgagactgtatccctatagggtcccggtcttctgttgacccctcaccttctgtgggcctgggcatggacctctgatccttccatctgaagaagctgtcaaaataaaagtccatgcttccgggaatcaggaagtcgcctcaaggcaaaagtagctgagtgtttctatatctgttttgttttcctttctatcttctctttttggtgggtaattcttcaccatcttgttgattctttaagtcttagcataacacacattttaaaaatccagttgttttagttgctttctgtcaccatagaaggtcaccatggttctcagccctgtcggacctggagcctggtaccatgaccagggacagggagtcctcatgccgttttaagcagtggtgatctaagttttatttcttaggtgagtcaaggtcggaaaagcttgagacccctgctctaggggctgtacctgtccctttctgccttttctcctgtctggactagggttcgaaggggctggtgggccatgtggagaccaagtagctgacaatccccaggacctgtgggctcagacacagggccctgcacctctcagcccttccggtctcagctcagcacctcccttgcctggcccctctttcctgcatgagctccctgccyctgccaggaggaacctctgtcctgtttctagatgcgccatatcctctcccacctcctgctctttcctccagttgtgtgcctcgtaacstcttcctccctccaaggctaaatcaaaccctacctccttatacaggaggaagtaatttctgggttgatgtatgcatccggcagattcatgctgagccaacaggttaggggctggagaaacagtgatgagcttaaccaggccctgccagcctgcccaccccgagtctggtgagggtagcaaaaaacataaagtggaattgataaataatataatctatccatatccatatttttattttttattttttgggacgaagtcttgctctgtcacccaggctggagtgcagtggtgtgatctsagctcactgcagcctctgcccccgacccccggttcaagtgattctcctgcctcagcctcctgagtagctgggattacaggtgcgtgccacsatgcccgactaatttttgtatttttagtagagatggggtttcaccacgttggtcaggctggtctcgaactcctgacctcgtgatctgcccgccttggcctcccaaagtgctgggattacaggcatgagccaccgtgcctggcctatatatccatatttatataatgcaaaatggtggcggtctagagccagggtctgagtgagcctggagccagggggagggaatgaggtagtttaatgtcctcagtgtgacaaaaaagagaaaagaaaggaaagtaactttaaaaatatatatattttagtttttagacagggtcttgctctgtcgctcaggctggagtgcagtggcatgatcagggctcactgcagccttgacttcctggtttcaagggattcttctgccttagtcccccaagtagctgggactacaggcatgtaccaccatgcccagctaatttttttgaattttagtagagacaatgtctcgctatgttgccaaggctggtcttgaaatcttggctcaagcgaacctcctgcctcagcctcttgagcagctgggattacagatgcacaccaccatgcctggctaattttttatttttttaaattatttttattttttcccaccacttgctgcctgttgataattttttattaactttttttttttttttttgtaaagacaggatttcgtcatgttgcccaggccagtctcgaactcctggcctcaagtgatcctcctgcctcggcttcccatagtgctggaattacaggcgtgagccactgcgcccagcccacttacctttaaatcatgaatgtggcagccacacatgcacccatttggtgtggccatgagtgatgtattttctgaaatagcagaaaactcctgggaaaatttgaacaacacaaaggacagctttccctcagtttatattggagttgcattcctggaaaattcagtgtttgctaaatccatgcaaaaaaatttgtgcctctgtgtatagctctaggcccagaacactgctcatagatgtccacctatgcgtgtgggcaggacatttgccatcaggcatcacccaggataatctctgtggtgcaggcgtccagcaaccctgttctgctcactaagtgccactgtgacaattggtggtacaacccaaatcactccctgcccactgaatttccggaacattccctggtgtgtcccattccccaccactctgttgggaattgcctgcctctaacaaggcactgagatccacaaaatgatgtggggaagccctgggagtgccaacccagcctgaagaggcaggaggaccccagctgcctcctgagggccgagccgaacccataaagatgcactctctgccgggcgtggtggctcacgcctgtaatcccagcacttttgtaggccgaagtgggtggatcacttgaggtcaggagtttgagaccagcttgggcaatatggcgaaaccccgtctctactaaaaatacaaaaattagccaggcatggtggtgcatgcctgtaatcccagctacttgggaggctgagacaggagaattgcttgagcctgggaggtggaggttgcagtgagccgagattgcatcactgcactccagcctgagctacagagtgagaccgtgtctcaaaaaaaataagaaaaataaaaaaaataaaaaagacacactctctccaacaaactgagtgctctttcggaagtgatgtccactcatgctggcaatgctgaggggcctaggtggggcagcccttkgtggctccatctgcttgtggaattgccatttttcccttttctttctaggaagttctgtcttccttgatctttggttcactctgtttctactcccgatggtcccatggagcttttgcctccttatgaactggatggaaaatctaatttttctttggtcccttgggactggatgaccagctttgaccagagaaaagacacagctttcttagagggaacaggaaaggacctgaagaaggggttttgtttctgggaccctcgagtggctctctcctctccagtctccccacacagccatctcctttctgttccacactgccagagcattgtacaatcagggactcacacagctgcagcatgagagggatctcagggccactgagtcctgctccgtgcccaggctgtggatccctcctgtgatggggagctcactgcttcccagcccagcccaggctattgtcacacaggcccagtcacccacaccagcccctcaccagcacccagaatcctccctcccctcctaccaagctttcgaacaggcttttccaactcctgcctcctttggataagcagaaaaattggacacccttcctgcagcttaggcttatgggaatgacacttgttttatctacttgccaaaataaaaattgtactagagaacatgtttctggaatttggatttgccttgtcttaggtcagattcctagaagcagagcctaagatgggtgaattcttgaggaagttctcaggagaacacagtgagggagyctcttcctctttgtatagggcaggagaagaagctgagcaagggtgtggtttcagtggaagatgcgcctcagcctgacccctcggggagctcaggattgtgagctgytcctcggactgtcccctccagaggctgggctgttctatgcctgtgtcagtcactggataggggctgcccctgggaagaggggtatgtcatttcccaggcatctgtgtgcaagatggtttccatcagccaaggcaattagctaaagaggatgcagatgtgagctgttagctgccaatactcacaaaagctgggcacagacatggcataagggtgaggccccagcagcctctggtaaatctcctaggggaagagggcacgtgtccaccccaccaagtgagatgcactgctctcaaacctgcctctgagcctccccattctactcagcatattccaggatgctccaaattctgtgaggttcttccaaccgcttcctctctacctgcagcggggaacgggggtggggaagggttgggagagaagagctgcaggctggggttttctccagggagggccctgagccccagatgaatcattcccctcacccccaacctgccccaccacagactgcctcttcaaggtgtgccccatgaaccgctactcggcccagaagcagtactggaaggccaagcagactaagcaggacaaggagaagatcgctgatgtggtgttgctgcagaagctgcaggtatgtgtgtgtgtgcaggcgtgcatctgtgcacatgtaccaggaacctgggtacacaagcagcggtgctgcttgtcggagccagtaggggctctgtggctgagctgagtggtttctaaaactcgtatgggcgtgacagttcacacctgtaattccarcactttgggaggccaaggcaggaggattgcttgaggccaggagtttgagagcagcttgggcaacatagcaagaccctatctctacaaaaaattaataaaaaataaaaataaaaaaataaattccaatacgcaagagattggtgtgaattgctgtgaaggaggggatgtggggggagtaggatcccttcccagtgacccaccagtctgtgtaactctgttgtgtcaatgagaagaaagtgccccttcctccaggctggcacagccctgtgccagggtgcatggctcagagagtggaatgtcgacaccatagagcagtgaacaacctgtacagctgtccatggagttcccagtggctcctggagacagtggctctggggaacccaatttgggagccctggrtctagtcttaacctctccccttgttttatagagttggagcctggggcccttagatgggactggtctgtccatggtctgaccatcctgtaagtctgcagtagagcctagatggcccccaggtctctgactcaccctggcttcctcagacatgtggatcgtgccatgatgctggaatgtggtggtcgctcatgagccccttgtgggcagtggctcagttcacatcctgggcagatctcggggtcccaaccccgttccccaaaccacaaagagagtgggaggctttggctgtggtcaagaactttgtagcctgggccctgggccctgttgccccaccccttgtcatacaaaccttgcttctctctgtccccttcctctaagccccacgcctagaggaggtgggtctagaatggggacattgggctgcgccttatagctgtggactrggctggagagagggagctgcaggtgggctgcctgagctctagtattaatacctcagctctcttcctggratgggggctgcaacaggcttccttcctgctgccagcaggtagaggctgagctggggatctggcctggggggagggcattcacctatgcagagccacataatcagaaccgcaagcggtcacacagccacatgctgttgctttgtggaaagtcacatggtccatggcaagsctctcctgctgccaccttcgcctcggtctcagtaaaggactgaggaggaggaaaggacagagaccactgctctcagagagtgccagtctgatggaggggacagggctcctgccctccaggaacccctaatctggtaaggaggcagggcacctatccttaggcagcttccagtctaacagaggacagaagagcctaaaaagctgtctctaatgggatgcaaaccaaatcctcaaggccaccagcagtggatccatcagactgggatgtgaccactcagggagggctgcctggaggcagtgggctgaatgcacacagttttgggagggaaggttgcagaggagtgggggtggtggtgggagccaggaaatggcaccaagcagcccctgccagcgtttggactgggacaagggtcccgtgtctggggcattgggagtctggtgaggtgggggtgggtggtgagacacacacagctttaggttcctgggggggtaaggggattgcgggggatgctcaaggtcctgctggcatgccctctccaggggaggtggctggggagggttagggatttggctccctgggctgtgtgtgctgtgagacctcaggctgccttctgcactcagagtgcagcactctgggtgcagcaccaagagctggggcaggggtccaaggggtcctggagtccagggtgactgtgtgtggtgtgtgtgtttgtgtgcatgtgtgcgtgcatgtgtggggctggggtatgtcttcctctaggagcagcttctgagcccacccttcacttctgtgygtgtctgtgcagcatgcggcgcagatggagcagaagcaaaatgacacggagaacaagaaggtgcatggggatgtcgtgaagtatggcagtgtgatccaggtgaggctggcctgcctctctcccgcctgcccctctccctgcctaagaggctgggctggtgctgggtgagggctgccagcaggcattgccctctgtgcatgtgtgtccccgggtgaatgagtggccctggggccacctgtgtggctgtgcgtctgactgtgtgtgtgtctgttgctgtgtggcctgagtagctgtgccatgggtgtgtttacagcatggtggccatcagcatggagtctggagccacgttgtctggattcaaatcttggctctgccactcctaatggtgtaacttgggcaagttacctaacgtcccctggcgccttggtttccccatctgtgaaatcaggcagtaatagtacttccctcttggatcgttgtaggttacttgagctaatctatgtaaagtatttagaacagcctctttcttgtgatcaccagggtgtccatgggggtgtgcctgttgtgtgcacgtttgtgtgtgattgtggttgtgaatgtgggtgtcagcctgtatgtttgtgacaggtgtctgacactatgtgtgcagccagaatgtgaccaagggtctaggggatccccccatatcccctccctaatgggccgactcctgtggcgcggtgaccttcccgcaccccacctgacccccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtgagggcagggccagggttggaggggcctggtggaactcccgaggggcttctgtagggtcttcggtgtggggactggataagggcatgcccatttcttagaagggcagacygagaccaaagggaggcctggaggcgtggtgacaagagggccctgcccttcccacctaacctgtcccacctgtctgctcaggtggtcgtgggggacaaggtgatcctgaatcctgtcaatgccgggcagcctctgcatgccagcaattacgagctcagcgacaacgccggctgcaaggaggtgagggggtggggggtcagccatgcagtgcagggacgtccacacacccctggtggtgtagacaccccgctccctgccatggtctctgcctccagccccatctgacctgccggacaagctgggcctcacggcttctgcatccatttcccaacactgccctcattctccaccccacaggctrgtggccccaaggtagccgggctggggtctggggaccctggctaggagaagacaccctgtccttgtgctgtaatggtggctgggctgcttcttcccttcagccctgctctgggccctcagtggctggggtccacctggcgtcacgggtcttgtcacccttccgcaggtcaattctgtgaactgcaacaccagctggaagatcaacctgtttatgcagtttcgggaccacctggaggaggtgttgaaaggggtaaggactgggaacccctgccctgcccagctggccacctrgccctccccaccagggccctcttcctgccttctccacccgccaggcctcaggcccttaccctctccccagctttgcaccccccagcctccctccacctccacagggccccacccacatggccctaccagggctgccgcttctctcgtctctggccacagctcccttctccattctccctgggtcctgcctggtctttgttttctcccttgtttaagggggtgtcagtggactgggggtctccatccccccaccacccagagcctttgagcaccttcctctccccaactcctgctgcctggatccacaccaggcccccgccccttgccctgtgccctcattggcaagcgagtgaggctgccctgtctgctgagttaggggtcaccgcctgtctccttcctggtcccagacatgctggtgtgggctctgggagagaagggaggcctgggaaatactgcagtgaagacttcgggaggatccaggactgagggcagagggagctgtctggggccaccagagagaccattcaagaaaccctgaacagcagatgtgggcgagagaggagagttcagatgtctcttgggtggggctgcaagggatggaaccagcagacggggtgtagacggtcttgagggagggcagatctgtagagtgtgaggctgtccagctaggggagcaggcaggaacatcagctgtgaaacctgttagagggacaggtgacaggcccgagagcagccacctaaggagtcttaggtgctcctccctgctcggaagctgcaatggctccctttgccctcctccccacgctgagctgctctgttagactctcctgccctgctcaggctgcctcagtcccccaccctcctcatccttcttacctcctgggctgcttcccgtctacccatgccctgccccaatgccttctccctccctccctcccttaaatctgcacatcatccacacattaatcaaggtgcagccatgcactacccctcctggaagccttccctaatgttccagccccgaatctgtgcagcacttaggaaatgaagcatcttggccgggcggggtggctcatgcctgtaatcccagcactttgggaggccgaagcgggtggatcacttgaggtcaggagctcaagaccagcctggccaacgtggagaaagcccttctctactaaaaatacaaaaattagccaggcgtggcagtgggcacctgtagtcccagctactcaggaggctgaggcaggagaatcgcttgagcctgggaggtggaggttgcagtaagccaagattgcaccacactgcactccagcctgggtgacagagcgagactccttctcaaaaaaaacaaacaagcaaacaaacaaacaaataaataaaatgaagcatcacttgggcctcactctgtggtctacatagaattatttctggggaatccgtcatggctccgtggttccaaggcagctcagaagcaaggctttctggtgctaagtccactgcttttttgcccctgccctgcgctactggggcacagaagtcactaggttctgccatmgtaactgacccaatctttatatcgtcattcattcatgcattcttgcattcactgctgcattcactctgcaggtgttcactgaatgctttgtgtctagtgtgtgttcagtggagggaagacagaaagtgccattagtgatgatagcaagagtggcagccatgcattgtgtgcctgctgggcggcaggctcagcgggaggaaggtgatggaatgattaaggtgcaggccctggaactgggccaaagattcatgtcccatttgccattagttgcatgaccctcggcaggatacttaccttctctatgcctgagtttctccacccataaaatggggctaatgatgtatttacccagagggttgatgtgaggatcaggtgagaaagctttcaagtgcttgcacagtggctggcacgcggtaagtgtgcagtgtgacttcatcacgcatattataatcctcacaatttctgcaaggaggtcattgtattcccattttacagaagaggcaactgaggctcagacatgttaaggaacttatctgaggtcacacagcttttaagagcagagacagaggccgggcacagtggcttatgcctgtaatcctagcactttgggaagctgaggtgggtgaattgcctgagcttaggagtttgaggccagtctgggcaacatggtgaaacccygtctctactaaaaataaaaaaaattagccgggcgtggtggcaggcacctgtggtcccagctacacaggaggcagaggcatgagaatcacttgaacccaggaggcgaaggttgcagtgagccaagatcgtgccatgcactccatcctgggcaacagagtgactgtctctgaaaaaaaaaaaaaaaaaaaaaaaaagacaggatccaaacgtggtatctctgtccaaagctatggagatgccctccatgctgcccccatccaacaggggagcaaaagaagtgggcatgagctaccaatatttaggcagaaaggaccctgagagaggggcagccatggccccggggacactgagggggtaaggtccccctccttcatggagggggtgactggagatgggccgttagaggttaggcagggtgtctagaggtacacatagggagagaggtggtccagggtgggtttgaacatgggaaggcctgggagagctctggatttggggtctgggatgcgggctgagggcagagtgcctrggctttggctgttctctagggggctcagcttgcatccccctctctgtgtgctggctctggaagaggggccctgccagcagccaaccctgtctgaggcaggtggggctgggccctgggtgggtccttgagcctggaggggccgcagccatcctgagccacaccctgctgcctgcagggagacgtggtgcggctgttccatgcggagcaggagaagttcctgacgtgtgacgagtacaagggcaagctgcaggtgttcctgcgaactacactgcgccagtctgccacctcggccaccagctccaatgctctctgggaggtggaggtcagaaaagccctgcttctrgcaccccggactcagccttggatgccacccctccctcttccccaccatcctgragggtgggatattgacccctacctccctctgagtccctccagagtcaaaaggccagagagggtccagaacccacccacccagagatctccaggcctccytggggtctgactccccatgcctgtccagtctctccttcctgcctcacacctgtgtgcccctaggtggtccaccacgacccctgccgtggaggagctgggcactggaatggcttgtaccgcttcaagcacctggctacaggcaactacctggctgctgaggtgagcgggaggtagagggcatgctggggctcrtgtgtgcatgtacacgtgggtgtgcgggarcatgtgtgcacatacttgcatatgtggcacatgtgcctatggaccctgacttctctgcactcatgcatttatccaatattatcaaataaaggcatgactgtaaataagcctaataaatatcactgtgctcctactatgtgccaggcactattctaggcacaggggatacaragtgagcaaaatttcccgtctgtctgtaatgcgcacacttgtgtgtgttggagcattggtgtgtatgtgtgtatgttcatttgtggttctatggagaggggccatgaagggctcccctggaatgatatgggcacccctgsgmrgsygcagcctgcctgcccaaacccagggccctatgtaggtgaccatgttttgcagtgggtcgtgtgggtatagtttggtgtccagtagctcccccacatcttgtatctctgtccaggagaaccccagttacaaaggtgatgcctcagatcccaaggcagcaggaatggtgaggagcaaagcaggtctccagtgagaccatgggcctgccctgggggtaggcgggggcaggggaggccgtgaaaacctgggaggtgggctggagggagacagatgggatctcaggtgggatcccaggtgcttcatgggcttgagaagagggagggccttctacctgatttggggtcctcatccagggggcacagggccgcacaggccgcaggaatgctggggagaagatcaagtactgcctggtggctgtgcctcatggcaatgacatcgcctctctctttgagctggaccccaccaccttgcagaaaaccgactctttcgtgccccggtgggtatgcgccatgtgcctgggagttgactggtggtrctcagggtgggccctcctgtctctgggactctctgsatcccccactcctccgccctcctgcggtcctttagcctctggggtctctgtaggtcccatccctctggrgatctagctctgagtctgtcggcggctgaccaccattgcatgcctgcctggtgcctggcgcctgccccagttggtctgggtgctcaagcacaggctgcatggcagtttgtctaggacaccagcagcacagggaacccaaacactggatgggaaggccagactctctggcctttgaggtcccgccaaccccgagattctaggacggaacatcargaaacttctcaagtgtcagtacaggctttggcgtgtccttagctgtatgacctcaggctgctactcactctgcctccatcattttagtgggaacatcaagtttccctgtcaacagggctaatgggagagttaattgagtcactacataggcccacagtcccttccctgaaactcttgggggtagatggatttggtattcagattgtttttcattttagaaaggtaaacttgcattttgtaatcatagacattgagtatttttgtgtaatgcatgtgtttctatgaaatgtgtgcatcttgacattcaatgggataaatagttaaatagcctcatttgtccaaatgaattttggtcccaagtgtacaaacaagctttggttttggaagcgtggacaaggctgcccgtgtcagtgcagtggtcaggacggggcctgggygcagggctagctctggctgttcttatctggcttcagcctcctcatctggaggggcaccagtggctcctgtcccacagctgttgagggtgtggagtagggtggcagctgtggcagtgttggggaggtaggccggcaggcagcatgacgtgctctgtggtgcactccccgagtcctttccctcccacccacctgcaggaactcgtacgtccggctgcggcacctctgcaccaacacgtggattcagagcaccaatgtgcccattgacatcgaggaggagcggcccatccggctcatggtgcgtgtccctggggtgggggtggggctggggccagggccggagcttgttcccaggtgccctgctgacccctgtctctgcagctgggcacctgccccaccaaggaggacaaggaggcctttgccatcgtgtcagtgcccgtgtctgagatccgagacctggactttgccaatgacgccagctccatgctggccagtgccgtggagaaactcaacgagggcttcatcagccagaatgaccgcaggtgggctgcagtggcacaggggttttctgagtgatcttgccctcccagggcctgcatttcatgaagaaaggagtcatgaagcagaagctgggcaaactggggagagagtaggggactggcccctgtggggccctggctgagcctgggaccctggagttgggtgcctcacggcttaggtactcccagaactaaccctatgatggagctggttactgtgttgagcctggtctcaaggccagttatgatgggtctgaggctcagagaggttacgagacttgctcggggtcacagttagtaagtggcagagtcaggatgcaaatgcagcccccttcacaccagactccccgccttgtgccctgtacttcctttccaggttgggatattctgagattctgtgtcttggggccactttggaatccagggtgggtggggctgggcgtgtttggagagcatttcaggggaaagccgggaagaggaattgtaggctgaggatgggttttgtgctttgggggccgctgagtgaactcatgaaagccrtgttttgggagggactggctccccaagagggacacctgctgggtgggtatctcacactcgtcatccccgggtcccctcacccaggtttgtcatccagctgctggaagacctggtgttctttgtcagcgatgtccccaacaatgggcagaatgtcctggacatcatggtcactaagcccaaccgggaacggcagaagctgatgagggagcagaacatcctcaaacaggtgcgtgtgcacccatgaggggacgcagaggggccgggtgcccgggagagggatgccttcaactgcaggctcatcccccgctttaacaaaaatcagtatatatggggcacgaccacgtgccagggacttccctaagtaccccacatgtgttgacgaatttgatcctcactgcctggaggaggcgccrtgattcttaccccgttttactggtgaggaagctgaaacacaggccagagtcgctgtcccagggctcacagctaggaagcggcagccaggatttgagcttgtgatgttgggtccagagctgtgcttcaaaaaatttttttaaaaatttttttattatgagaatcatcaaatattgagaaagtattggaagaatagtacagggaacaaggtgcctcactgttttgctgccttggctttatgtagctcggttcacacatccgtctttccatccacacattgcaaaataggcagcattttacacccaaaagtttcagcaggcatccctaacaatagggacattgccttacataaccatagtacatgatcacacctaagaaaattacaacaataccaagtccatatcacatttctctaatgttcccagaatgtctttgtaaagtttgtttttttttttttagaaacgaggatccaattaaggttttttcattccattctgttgctctgtcactttggtctctgtttcagaacaatttttcacctctccacccagccccagcctttaaaacatttttgtaattatgtaacattttactttgacaaggcaggcctgtgtctcatctcttaagctctggccacagcggtccggcctgccttttctcttagccttagaccctgagctgccgagaccctctgctcytcccccaggccccagatctgagctgggattagaatccgcatcagggagggataggctggggtcagcttcgggattccaacaaggagtagggagagctggggctgaggatggctgggctggggttgtggtccagcttagaatcagctcgaagctgatgtccgggctggctttagggcagagtcagttgggactcagggatgactcctgggatgacttaggggtacagacaggtgttggggaatcagtcctcaccctctgtattcccccaggtctttggcattctgaaggccccgttccgtgagaaggggggtgaaggtcccctggtgcggctggaggagctgtcagaccagaagaacgccccctaccagcacatgttccgcctgtgctaccgcgtgttgcggcattcccaggaggactaccgcaagaaccaggtgcgccgctgccctgctggcccactcgctggctgcacgttccttcctcagcaagcgatttcctcaggcacatgtgctgtgccaggcactgttttggggcctagggtccagtagggcaccagacagcagggccgggttcatgggaatgggacctggcccggtgctcacaagggccttgcactgggttagatgctctgctgctgagcaagggtcctgctctttcattctgcactgggccctasaagttatgtagccaatccttccacacaaacaaggtccctgccctcgtggaggtttcgctctggtgggaaacagcccacaagctaaataactatgtaawgtaagccactcttctgcccagcgatgcttcctttcctggacctctgcctttctagggtattgggtccttacctcggggtttgggggcagcgttccagagcagagctgggcccttggcccacctgtgactctctgtgacccccagcctgtctgcccccccaggagcacattgccaagcagtttgggatgatgcagtcccagattggctacgacatcctggccgaggacaccatcactgccctgctgcacaacaaccgcaagctcctggaaaagcacatcaccaagaccgaggtggagaccttcgtcagccttgtgcgcaagaaccgggagcccaggtgggcccgaaccccctccccggccggcgcctgctcctccctcctcccttgcctgggtagaaactctgctggttgtgtgaactattcctgcacctgttggtaactgccacccygaatagcactgggtggctcagcactgggaggccctagcctccctagcccttctctgggatcccctaaaatttggcccactctggcaacaatgggaatgactccttgtaccactagaggcccccaagaccttctccagtgacaaagtcagaacctgtattgaaccagttgttaaatattttgaatatcacctyggcccttgcgcttcctcaccctgtccgtctgaacccccatctagccttcccggaccccagggtgatgccctggggctttccctccttggggagctgggagtccatcccacccatctctaagccttgggagggagctagttccagggtggcggtgctgccakctggrgaaggggaagggtgggctcygtccttagagggaccagcctctgagaccctcttcccaccgctggctgtcaccaccccaggttcctggactacctctctgacctgtgtgtgtccaaccacatcgccatccccgtcacccaagagctcatctgcaagtgtgtgctggaccccaagaacagtgacattctcatccrgaccgagtgagccctgtgccccctgcccgcacttgggctccacgctgctgayccccagctgtcttagagcttaggccctgtctgggttcaggctggaactggcacccttgctctctgcagctgtgaactctgtgcctgttatgtgccccgctgtgtgcctggcactgtgggggagtggggaaggggcacagaaaagaatgagccacggaccctgcccttgagatgcatatggtctctctgggtccccgtggtggstggcactgtgtggccgggtgtgctcagggaggggtccaggcgtagtgccctggacctggctccctgtgacaggttgctggtggtctgcaggcttcggcccgtgaaggagatggcccaatcccacgagtacctgagcatcgagtactcagaagaggaagtgtggctcacgtggactgacaagaataacgagcatcatgagaagagtgtgaggcagctggcccaggaggcgcgggccggcaacgcccaygacgagaatgtgctcagctactacaggtgccccgccccagctcctcccctccctcttcctgtgcctttgggccttctcagtaggccgtcagtcaatccctgctgaggatgagctctgacagcctcaggtggggctcctgcctcctcagaagcggagtccctgctgtcactcccctgccacgaagcctcattccaggaaggctgagtgaagaggactgtgtgccccgaatagcactgggtggctcggcacaggaaccaggcttcaaagaaacccagactgttttcaaacatgtatattattaaaataatctcaccaaattagctagccatggtggtgcacacctgtagtcccagctacttggcaggctgaggcatgggaatcgcttgaacctgggaggcggaagttgcagtgagccaagatcgcactactgcactccagcctgggttacagagaaagactctgtctcaaaaaaacaaatcatcatcataataatctctttagacgcccttcttacaatgcttgccacgtagtgggcacttttttaagcacttgtcctgatccttcatttgagccacatgacaacccttgttgtagctactatagttactcctgttgtaaagctggggaaacagtggcagagagaggtaaaggaacttgcccaaggttacacagccatcagtagagagccagggcccacacccaggctatctggctccagagcccccaggaagtcatgtctgtgaggaggaggcagagggcctggtattgccagggcagcacagagcttcccacgttcctcattttggtatcccctctatcaaggttgcacccctttcaccacctccccacctccccctcctccctctcccatcttgccctcaccctccctggccaaggctggctcttctcatctcactgccctcccctgtctcccaccctttccctcatctttcagacgtccctcttcccatgaagacctgtcctggctgagccttagccaggagggggagaattgcaagtactggttatcacagacaggttttccgttcacctttctaactcagaattgcagctggcgcatctttaacctaatccctttgccactttactgagtcctcaccaagtctagtgcccagtgccagcagcctcccggctgccatctgccgtgtcctcacagtcctccctgtcctgcaggtaccagctgaagctctttgcccgcatgtgcttggaccgccagtacttggccatcgacgagatctcccagcagctgggygtggacctgattttcctgtgcatggcagacgagatgctgccctttgacctgcgcgcctccttctgccacctgatgctgcacgtgcacgtggaccgtgacccccaggagctggtcacgccggtcaagtttgcccgtctctggactgagatccccacagccatcaccatcaaggagtgagaggggtggaggcagggtgggcggggcaggggcagaggctggagtgggtgtatctcggggaccttcatgcctcatggcctccaccctcagctatgattccaacctcaacgcgtcccgagatgacaagaagaacaagtttgccaacaccatggagttcgtggaggactacctcaacaatgtagtcagcgaggccgtgccctttgccaacgaggagaagaacaagctcacttttgaggtggctgggggagtgcccaggggctgggggtccgtggagctcttgttggccccacactggcctcggtcttcacccaggagtcggctgtgggatccatgaccccacttccttctgtgtccccagccagtgcagggggaccgcatagaaggctgggattctccaagaggcaggctcctgttccaatgcctgggaaagggctgcctctccctgctccgctctccctcctgggaaccccgtcctcatgacgcccctttcgccctagtttccccagtcctggcctgccctccacgaagccccgcccctacgcgccggcccctcccacctcacctcggccacgcccccttcgcaggtggtcagcctggcgcacaatctcatctacttcggcttctacagcttcagcgagctgctgcggctcactcgcacactgctgggcatcatcgactgtgtgcaggggcccccggccatgctgcaggcctatgaggaccccggtggtgaggcctttgcccggctcgggccaccctggtggtcctcagcctcctcctagcacaggaagttccctcagatcaacaccttccccagccccgcattccccccacccaacctggctctgcctcaaggggatatcttgggcccaagcccctcccacctcagcaggaccagaggggtccctgcccggactccctggagaccccgggtctgtgggagttgccttccaaccctgcttggtcttgaggggagatagtgagggaggagcgagacagctctgtcatcgtgtgtgtgaggaggagggaggcacagcctgtctgagggttgagcggcagccctgccctcccagacactcccaggctgcataaagtcatctaaacaaaaggtgcctagagcctggcactggttttcggggctgtcctccccgcagtgtcctctcagcccccaggctgtgtagctgctctcatggtttcctacagaaaattctcagtcatctccccacacagctcacctttgccctgacacctccttcttttcccagatttgcttaaagctcatgtcctccaggaagccttcctgggttagccctgtcccttccttagcaaggctttgccctgcagctgacataaacagattatgcatcctctgcctccctcatcagaccagggacccctgtgtacascctctacaacctccttggcaacctcctctgcttccccctccacaggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcaggtgcctgggccaggaccgtgtgggaggtgttgggtatagggggagggtaatggggcgggtacagggaggctgggcagggcgaaccccttcagatctcagtatttagtactggaagtctccatcgtgactggctgtcaggcccagcggttcccacagtgtggttcttgggccagcctcacctgggagcttgttagaagtgcacattctcggttgtgcgcagtgactcacgcctgtaatcccagtgctttgggaggccaaggtgggaggactgcttgagctcagagttcaagacctgcctgggtgagaccccgtctctattaaaaaaaatagtaataacgataaataaataaaaagaaaaacagaaatgcacattctccggccccaccctagacctactgagtcaggaacactggagaggggccctgtgggctgtgttgtgacaaaccctccaggtgattctgaggtgcactgaagtctagttcaattctcccattttacagatggggaaagtaaaagcggggaggtaaaagcgggggccggggggtgctttcccaaggtcacagggattttgaagcagagctagagatttaagaacctatttcttggcaaggtggatgcagtcatccctgttgtggtctcatctgagactccccagccacaccccaggaaggggctcatccccgaggagggatgaggatgcttgcttttgccttgctgtcaccggagggcaggaagggtagtgcagtgacctccgtgggggacctctggcggtcagagtggagggagcttctgactcattctgagggctgggccttccatgtctgcatcctggggcttggccaaaggctcagtgccccatgagactgtgtgactcacccatgtctgcaagccctgcatcctcacgtctgccccacagtagcctctcctcctccctcacaggcctcagtttcccctcccatgagtatccagggtctgtttggctgagcaggataggaggacaagagtcagtttttggacctgggggcttcattccccttcctgtcagtgtctagcttgggaaagagggactgagtgggccgggcgcaggggtgctcgctgcctcatgctgagaggaggccctcatactccatcactggggcaggagctggggagagggcaccctgggcctggggagaggggtcttgttttcttgctgtgacatcctggagcatcccaaatgactgtgctgaggaccctgctgccccaagtgctagagcctatttgggggctccctgccccctgccccccataaagtaggaagggccttctgacctcagatcagtcctcaccccatcctcacctgacctttcctctcttctccagttcatcctcaaygtccgcctggattaccgcatatcctacctgctgtctgtcttcaagaaggagtttgtggaggtgtttcccatgcaggacagtggggctgatggcacagcccctgccttcgactctaccagtaagcccctgccctgccttcaggctgaggctgtgcgactctcccagggatacacagcagtggggtggagccagctcctcagccctgctcctttttctagtctgcaaaggccttttctttccactgtctcatttaattgcctcagtgagggggaagggcagggatccttcccttcgttttccaaatggggaaactgaggctcacagaacagcagggacttgctygaggtgacagccagtcagaggctgagccagaccgggatctggtctcctgactcccagcctggatctctgccccctttgtactgccctgcaggggagtagggggctgtggctcctcccctacttggttccttcccagaaaggggcaggcagagcagctgctgtgcagccagtgcagrgaagagggtggtttgagtgtctccctgtgctcccctctttcccgggctgggcctacaayctgcttccatctgcccctctccccacagctgccaacatgaacctggatcgcatcggggagcaggcggaggccatgtttggagtggggtgaggccagggttgagctgcaggggtgtgtggggttgggaggctcgacacccmctcttggtctggtctgggttcctgggctgggggctggctcttcctctctgccattccctctgcagaccctcaccgggctttgtgctcagcccctcccctgcctccccagtcccagagatctggggggccctttggttcccagtcatcccgtcattcttccacccctactcagggcaggtgtgcctctcttgtgcagtggacttgagtcaggtagctggacagctggaacaacgtccccagtcccacagcagggcggaagtgtggggacatgcatcccatccacccgaagccctgaggggctggaggcagaggctcactgggggcttttagcatcttggggccaggcttgtgcctgggtctagcagggcttatggactgcttttcagaatggtgattgtaaactcataaaataaagcacataacaagacaaagggaaccagtggcttggagcgagttatcaaaatattggagaaaacaaattagtagtgacarttatrtatgtgcctctttactaatacgtwaagtagcgagctgcactggtgggtgtaattagtaccactacttcaaggcagcgacgaatataaacgatattttgtgatttaacaactctgaggtgatgtgaaaacatctgttatatttattggtgacagacttacaggtgccacaaatatttcctcactgaaggaaatgctgtattttggttagaggttgggaaaaataaagatgtaacattttctccatctctgttcatgggccccgcttctatccatgaatccccygcatggtggcagtgggatctgtgttaagagtccttgtttctggctaggtgtggtcgctcatgcttgtaatcccagcactttgggaggccgaggtgggcagatcacttgaggtcaggagttcgagaccagcctggccaacatggtgaaaccctgtctctactaaaaatacaaaaattagccgggtgtgttggcacacactggtaattccagctactcaggaggctgaagcaggagaatcatttgaatccgggaggtggaggttgcagtgagccaagatcatgccactggctgcattccatcctgggtgacagagcaagactctgtctcaaaaaaaaaaaaaaagagtccttgcttcagttgcttaatcaaggggagtcccgagagatcccaggagacacgggtcactccggagattcaggggagtggctgttaaactgctgagaaagtgtcaatattttaaacacatttagactggccctgcatctgctaattgggtggcggagagtgtgcttgtgccagggccccttacccaccacggacagcagggagtgtgccagtctcacccatgcgccctgcacccttgtgcccgcaggaagacaagcagcatgctggaggtggatgacgagggcggccgcatgttcctgcgcgtgctcatccacctcaccatgcacgactatgcgccrctggtctcgggtgccctgcagctgctcttcaagcacttcagccagcgccaggaggccatgcacaccttcaagcaggtgacgggactacctggccctggccctgagcatgaggcctgcaccaggcacggggggacagtaaacgatgattgaggagctcacagctcaaggggtaacttgggatgcccatytggggttttcagccttgctgagttcctaggtgaagactgagtctcctggcctggctcagtgcctgccatttcttatgatgtggacagcactttacagcttgcaaactattatatgcacctatgctaaatgctttgaatcatgcctagcatgcagacaaccctcactgacgtgactggcatttgctattgtgatgtcacgcagtcccgacagctccctgtgaaatatcaataccagtcggcgttggcctttaaaaaaataagtgcctgccatgtaccaggcactgagyactggacttgcattatcgcatggcattctcacagcagccctgacagtgaggttactactctccctcccattccagagcggggagaaatccaggcccagggagctttcctccattgcccacagacccagagcgaggatggtggcagtcagacgcaggcctgggtctttcagggttcagggctgccaatatgttttgccctgcctgtttggggtctcagtgrataagtgacagaccacagccacatgtgacactagtcagtgagtaactgaagccaggttatgtggcagctcagggcaggcagtgcagggaggcctgtggccagcagggaaggcttcctggaggtggtgggcttatggcagagccagaaacattgagtgggaatcggctcggtggagagggacaggtggtggtctacaggaggggaaccctagagtaaggaaggtgctggaggtctctaagtggcatggacctggagcccatctcaccagccaggcccatcctccaccttcaggttcagctgctgatctcagcgcaggacgtggagaactacaaggtgatcaagtcggagctggaccggctgcggaccatggtggagaagtcagagctgtgggtggacaagaagggcagtggcaagggtgaggaggtggaggcaggcgccgccaaggacaagaaagaggtaagtggggctccagggggccagggcaggcctccctgtgagggctgggcctggctgacctccatcctctctctgctttcagcgtcccacggacgaggagggctttctgcacccaccaggggagaaaagcagtgagaactaccagatcgtcaagggcgtgagtggccaagggtcctcggggtagggatctgcagccccagtggtcctgggggctcccgctggcccggccccctgtgcctctccctgtgctggccactggccctcacaagagacatctttcagcctttgctgcacattaaaaacagccctgccaaggtccagatggaattattttaaagccgaaggaattccatgaaattccatttcacagtcatattgttctatttacttttatgggtggaattgktttttttagtgcttccctagcctgttgcaagggtctgattcagcgcctgtgacctccttcccccttcctgtcccgggtgccagctggaacttggctgtggtgggctgggcagagggcagcctgagaagtagggaaggggctctggctcacccgcctcccctgcagatcctggaaaggctgaacaagatgtgcggggttggggagcaaatgaggaagaagcagcaacggctgctgaagaacatggatgcccacaaggtcatgctggacctgctgcagatcccctatgacaaggtggctctgacttctgacctctgactccccagggtggcttccccctgaacsccggcctgacctgtatgctaggccctaatgcaggcaacctctcccagcctcgcctggcctcttacactgccctgtttgtttgcaggcacaccttgacccctgaaccctgtcttagtatcggttcaacctttgaccctctacccctcatcctaattccctttgaccttgatttgaccccagccttatgctgattcttgaccttgactcccttttcttccccctctccagcctaaccctgataatctcagcttcatctcaacctttgaccctcagcttccttaccttgacccatgttgaccctaactgaacccaacctctccttgacccatgacatcaatgctggccttgtcctgacccctggttttgattcctcatcctgacatcttatgctgacctgtccccaggcccaccctggctcctgactccaatcttagtctcatctccccttttgaccctcagccccttgccatgactgatcttgatctcagtatgtcccaggcctcaccttgacgctgaccgtgacacttcaccttgccccaactccagcctcatcttggccattgagctcccgcccctcacacatttccatcctgacctgggggccccactttccctttacgctggcctcttcacggtcccagtcccaagcccgacccacccctgctcctgtcagagctcagccagggcctcgcctccctccttggtgggcccagcaccctctccctgactcctgtgtccagggtgatgccaagatgatggagatcctgcgctacacgcaccagttcctgcagaagttctgtgcagggaaccccggcaaccaggccctgctgcacaaacacctgcacctcttcctcacgccaggggtgagggcgcagggctgggagcacctggacgaggcgggggatggggggtgggggcggggcccagatctctttctgacagatgccccccactgcagctcctggaggcagagaccatgcagcacatcttcctgaacaactatcagctctgctccgagatcagcgagcctgtgttgcagcacttcgtgcacctgctggccacgcacgggcgccatgtgcagtacctggacttcctgcacaccgtcattaaggccgagggcaagtacgtcaagaagtgccaggacatgatcatgactgaggtgagggcggggctgaggggtgctcaggcatcttggggtgggggaccggagcagaggcttggcgggaaggccacagagttagagaagtcagacggtgggtcacaaaaggaacactcagctgctgaccatggaggggacgcagagggagaagtgaggctgcagatgtggtagaactcagcctgtgggcctgatagaactcaagcagggtcccagtagcatcaggcacctagcagaactcagacaayaggccagaaagaaatcaagcatgcattccttgtcacttgtcgtcgtttatttaaaatcaggaagcacctgctacgtgccacggactgtacatgcatgggggacatcagctgagtgtcagctcctggggggcacgggcagggaccccatcctttgtgtgcatcgccagggccccagtgtgtggcgcatagtaggttcccaacagacacctgttgagtgaaggcacgaaggatacagggctgagtctaaatctggaacagacgtggtccctgcccctgagcatctgacagtgtaggcggcagggggagaaagaagcaaacactgaagggagattaggacatcataaacaagacatgatgtgctggaactgctgtacagtgttagttttattaatttctattattatattactgcgaataatgcagtcgctggcacgagaggtgtgtgctcagtgaggagggtttaagtaactgctgcgggagcacaggggagggagggggtgagcaaggcgggattagcgaggcttcctggaggaagctgcctctgagatgacccctatgggacttctttccagtggggagaagcggggactttctgggtcatggggtcaatatctctgctggcagagggcctgagacatcagctggggaacccccaaatcccagccaggggagggttttcctgatttcaggtaagggctgtggtcagagtcccagtttctccctggtaagcaamggagaggagagcccagggcttgctggaccgagagagtgtgacacgtgccccctcccrcccgcagctgaccaatgcaggtgacgatgtggtcgtgttctacaatgataaggcatcgctggcccacctgctggacatgatgaaggccgcccgcgacggcgtggaggaccacagccccctcatgtaccacatttccctggtggacctgctggccgcctgtgccgagggcaaaaacgtctacactgagatcaagtgcacctccctgctgccgctggaggacgtggtgtctgtggtgacgcatgaggactgcatcactgaggtggggatcgggagactgggcaagacggctggagatggggcgaaggggtgggtaaagccacgggacaggaagagtgggtgaagcaaagccagggaagtgggcaggaaccggaggccaggggacaggagcattgtggcagggagagcctggccaggcggccctgcttgcgcccctgacctcccgcccrctgcccaggtgaaaatggcctatgtgaacttcgtgaaccactgctaygtggacacggaggtggagatgaaggagatctacaccagcaaccacatctggacgctctttgagaacttcaccctggacatggcycgggtctgtccctgtgaggggtgtgggtgaasccccccaggaggtgtgggagtggaggggccccatgtgaggagcccccagccatccctctctcctgcctcaggtctgcagcaagcgtgagaagcgcgtggctgaccccmccttggagaagtacgtgctgagcgttgtgctggacaccatcaacgccttcttcagctccccattctctgagaacagcacttccctgcaggtgagcttctcctctcccaccaccccagggccgacttgcctagcttttgtgaagggaaggggggaaataagaatacatatttatatttgcttatagtacagaaagaagtaacaaaaggatacataagtgtattggttatcttttttttttttttttttgagatggagtttcactctgtcgcccaggctggagtgcagtggcgcgatctctgcttactgcaagctctgcctccygggttcacgccattctcctgcctcagcctcccgagtagctgggactacaggtgcccgccaccacgcccagctaatttttgyatttttagtagagacagggtttcaccgtgttagccaggatggtctcaatctcctgacctcatgatccgcccacctcggcttcccaaagtgctgggattacaggtgtgaaccaccgcgcccggcctaagtatattagttatctataccgtgttaacaaattatccccaaacctagcagttaaaacaacaagcattcgctatctcagtttctgtgggccagaatgacrgtgggaatggtaccayccagcaggaactcctaactccagtgggtgggcggatcccggagtggcagcacttattcaccaaagataaggcagacgtgccatccatgggatggtacagccaaagcagggatcacgacagtctccctggcaggatccttcgtgctggctagttgatcatagtgatcttagaactgaaataggcaggcagccttctgaaggcctaagcagaagggctccaggccagtgtacagaagcctgatttgaatctcgaaagattcatggctccttggtcaatccccagattcccagactcgagccagtgctcagcccagagcccccctgaatgaaagcgagccaggttcccttaaggaagggccctgctacatgaccgaaatcaaagaaacactggaaggatacaaaagaaacccacaaaaggggctacctaggggcataggagctggggtggggtgggatcgtgcttctaagtctggggggaaaaatgctgagtcctgccttctcaggaagggtggtgtattttgacacacattgtttgggccctgggatcgcattgggacgatggaactctggtaattgatatcagctttccccatccttgatcagctccagggcaatgagggtgatgggggagagacttctcaaagtgttatgttttttttttttgagacggagtctcacttggtgccccaggctagagtgcagtagcacaaccttggctcacttgcaacccctgcctcccaggttcaagcaattctccagcctcagcctcctgagtagctgggattataggcacccgccaccacgcccggctaatttttgtatttttagtagagacagggtttcaccatgttggccaggctggtctcgaactcctgaccgcaagtcatccacccaccttggcctcccaaagtgctgacattacacgtgtgagccactgcgcccagcctcaaagtgttatcttttaaataaccttttggtttttcaaccatgtaaatccatcacctttttatgacattaatttttttaaacattttttaaaagggtcagcaacatggctatgagcccacggccttggtgagttacagggctgccgtgtacagttgggcaggtcgtgcactgctgaagggaatacaagtacctttttccaactggcacagaggcacatggtggctagtgaaggctccgtctctccacccatgcccattctgattgggccctggttcctggacctggggttgcccagggtgggggcctgggctgcagcagcgggctctgtgacttcttgcagacacaccagacgattgtggtgcagctgctgcagtctaccacacgcctcctcgagtgtccgtggctacagcagcagcacaagggctccgtggaggcctgcatccggaccctcgccatggtgggtgagtgtsccrgggcactggccagccccaaaccactcctcctgcygctcacagtggggacgcctgccctcctaataaacactttatccctaagctcgcccatctcctgctcccaggtggttgtcagtaagttcttcttggcgtctgcctcatcctggcaattgagagaagctgttttctcctctgggtcagttccccagagaaggatgctcgccgacattctccagctagttttttatgggtatttgcagatgggctcaggcaggagcaggcctgtggattgttagggacagttggggaagaagagaggacaggtgagagrgaggaaggggaagtcagggtagagccggggggaatcaaagaggcagaaactccttttacccaacaaggrgaagaaagcctctcagtccctcaagcataggccggggtgggggggtctctgtctcccagacccttggtctagttcactctgtctcctggtgtggcagccctgagcctggcctctggctggctgaactgcccccgcaccagcactccagcactccctcccttcccacccagccaagggccgggccatcttgctgcccatggacctggatgcccacatcagctcgatgctcagcagtggagccagctgtgcagctgccgcccagcggaacgcctccagctacaaggcaaccacgcgggccttcccccgcgtcaccccyaccgccaaccagtgggactacaagaacatcattgagaagctgcaggtgggtgtggggctgcctggcatctgcctcgggagctgcttggttgagtcagcagctcccctactttggaggggcaagttctcggggagtgtttcttcctgtyctgcccacacttccaggaaggggctggttggcttctctacactcyggggctgctaagggccgacccagcagcaagggactggggaacctccttccagaggaagcctggagaacccagaggcctgctagtggggttggagctcatgagggggtcgggaccacccctcactcctgcagcgccctcctgtctatgcagcacatttctgtgcgctgtctcgttggcctgtagagggggtgtggtggattattttccccacgtggcaggagactgaggctcagagaggctaaggggtttgcccaaggtcacacagagctgggagagaagccaggcttggcagctcccagccagggctctgagcagacagacatcacgctgtgttcagggtgtctctgtgggtgtgggcccctcagacagaggcagggcaatctgtggggctgtttggcgtttgggtcrgaggaatggcagtcacacccgggtcatttcttgggcctggcaatgactctgccctgcccaccccaggacatcatcacagccctggaggagcggctgaagcccctggtacaggctgagctgtccgtgctggtggatgtcctgcactggcctgagctgctcttcctggagggcagtgaggcctaccagcgctgcgagagtgggggcttcctgtccaagtgagcgagacactggggcatgggggcagsaggggtgcagcggcaggggacagagaagggcccggtggggactagacaggctcactgggtcagagggcctgggggtgttcctgcctgggatggggtggggaagtagctggagggaggcagtgtggggctgccctgagctgcctccttggccggctcaggctgatccagcacaccaaggacctcatggagtcggaggagaagctgtgcatcaaggtgctgcggaccctgcagcagatgctgctcaagaagaccaagtacggggaccgggtgagtgccctggtggggcaagtgctgggtgggccagtcaggagtacccaggggctcagggtcaagcccgtcaggccagtggtcagtggtgggctgtacccacaatggggcctcactcccatcctcccccagggcaaccagctgcgcaagatgctgctgcaaaactacctccagaaccggaagtccacctcgcggggggaccttcccgaccccataggcactggtcagtatcaccttcccctgcccccgggccctcccttccactctcctgtcacaccagctctccctcaaccgagtcccgcctccaggcctggacccagactggtcggcaatcgcagccacccagtgccggctggacaaggagggggccaccaagttggtatgcgacctcatcaccagcaccaagaacgagaagatcttccaggagagcatcggcctggccatccacctgctggatggtggcaacacagagatccaggtgtggggggcctggggcctggacatgccctcctttgcctccctccctttttggaggaggtgggccttgagttgggcactgaaggccgaggagggtgtgaaagaggagaggcctgagcagtggctgagaggtgagaagagtgggcatgatgggggcaggrtggtgaggagacgggctcaggcctggctggggcagaggggtatgcgggggtgatgaaaggaccacgtgacacaggagcagatatggggcatggagccgcccatgggtggccatggatgctagccaccagcacccaggcctgcagccaggcccctgcagccccagcggccccagcagtgtggtgtgcctgccccacgccctgagtaggagcagggcccagtgctgaggttgytccctggccactgtccacctccagaaatccttccacaacctgatgatgagtgacaagaagtcagagcgcttcttcaaggtgctgcacgaccgcatgaagcgggcccagcaggagaccaagtccacggtggcagtcaacatgaatgacctgggcagccagccacatgaggaccgcgagccagtcgaccccaccaccaaaggtcaggggtctgaggcagaggcacggcgtgacggggatcccaggataagatgtgcaggggggtggccaagggggtgggcagctccagcctcaccaggtctcgcccacaggccgcgtggcctccttctcgatacctggytcctcatcccgctactcgctgggccccagcctgcgccrggggcacgaggtgagcgaacgtgtgcagagcagtgagatgggcacatccgtgctcatcatgcagcccatcctgcgctttctgcagctgctgtgtgagaaccacaaccgggacctgcaggtgagtgcctcgccacacacctgccccttccccygctggccagccggcatgcagactaggcagtgtggctggtgtccctctatggcaggtgtgccctgccctgggcactgctgctttgtggctggtggttcccctacccctgcagcacacaagatcgtgcttcccaggccagcctccctctccgtgctgtagctgtgctgtgcccaacccttctgtgccccgcagaacttcctgcgctgtcagaacaacaaaaccaactacaacttggtatgcgagacgctgcagttcctggacatcatgtgcggcagcaccacgggcggcctggggctgctggggctctacatcaatgaggacaacgtgggcctcgtcatccagaccttggagaccctcactgagtactgccagggcccctgccatgagaaccaggtgagctgtcctggtggcataagtggcagccagggtggcagtgtggacatgtgggtagatggagccagctggggcagggagagaggctgaggtctctggagctgccactattctgagagggcctgggccctgtgtcccccactgcctcctgccagacttgcattgtgactcacgagtccaatggcatagacatcatcaccgcactgatcctcaatgacatcagccccctgtgcaagtaccgcatggatctggtgctgcagctcaaggtggggcccagtggcaggtgtgtgagtgctgggtgtgcatgtgatgtgcatgcatgtatgtgtgacttgtgtgtcaagtgtgcatagtgrtgtgtaatgtgggtgttagcattgtgtgatggggcatcatctggatgcacaagtgtgtggtgtgtgcagggtgtgtgtgtaatatacgcatgtttaagcatgctggaacatacactcactctggatgcaaatatattctggtttagctgaggacttgctatgtgtgtgtctgctgtctgggtagctgagtgtttgccacagyggsggtgaaggcaagcctatgggtgggctggctgtgcaggatgcttctcattaagccggggggagggaggatgggaaggtcatggcacctgaccttttgttggatgggagagctgttatggagaggaatgagggagaagttgtcaggggcatggtgtcctgagackgtggcctgcctccctctgcccctccacccaggacaatgcctccaagctgctcctggctctgatggagagccggcatgacagtgaaaatgctgagcgaatcctcatcagcctgcggccccaggagctggtgaggctgggcaggygggcaggcgggcggaaccaggtggagtgtgttgggatggggatgagggcccggctggccctaccgccctaggaagagagcattggaacaggcactgcccctccaggtggacgtcatcaagaaggcctacctgcaggaggaagagcgtgagaactcggaggtgagcccacgtgaagtgggccataacatctatatcctggcgctgcaggtaccagttccacccgtggcaacggccatcacccccctggccaccataccccgccccagctgccatcaycccccagtcgccattgtcgccccccagccaccatgtcccccagccaccacaccctggtgactgtgctgccatttccctcagctctccaggcacaataaacagctgcagcacctgctgaagccggtgaagcgcattcaagaggaggaggccgagggtatctcttccatggtgggtgctggccccgagactggggtgggggkggggcctggaacccagggaggacacttgacccaagggcgtggcctggaacagagtgaggccctagaatatgagccaggctagaatttgggggtacagctcagggggctgattgggactggcagccgtgggtgaaacccagacagaaatggaagcaaggctcaggtgggtctagggtgggtctggaagcttcaagcaggacccgggctacacttgggcaggactgaggaggcccccgctatcctctgggattctctggtcatggctctcccactcccctccctttggcaccaggttctcaaggctcagtcctagttgggctgggcttggcctgctctggcttggcggggacactcsctgaagtgtagttcagagctaggcgaaggcctgggagggtgggggctgagtgccagcctggatgtggaggctggggcctgacctccgcgccctccccacctccagctcagcctcaacaacaagcagctgtcacagatgctcaagtcctcagcgccagcacaggaggaggaggaagaccccctggcctactatgagaaccacacgtcccagatcgaggtgggcctgtgggcagcaggggcgggcgtgggagcctgcgccgggcgtgaccatgtgctgtgtgtgctcagattgtgcggcaggaccgcagcatggagcagatcgtgttcccagtgcccggcatctgccagttcctgacggaggaaaccaagcaccggctcttcaccactactgagcaggacgagcagggcagcaaagtgagcgacttcttcgaccagtcctccttcctgcacaacgagatggagtggcagcgcaagctccgcagtgaggacccacgggcgggagggtggggcggtctggagctgytcactgatgccctgttataacggcctcctttgcctgcctgtgggtgccctgcgcccaaccccgcctcaccccaaggaagggctcttccatgtgtggcttcctcctgagcggggccccacatgcaaggggcagggggtgctcaccagggccctccagcagctcaccrttgccctcctcttcaggcatgccgctgatctactggttctcccgccgcatgaccctgtggggcagcatctccttcaacctggccgtgtttatcaacatcatcattgccttcttctacccttacatggagggcgcgtccacaggtgagaacacagggctggccggcaggttccccgggccctgccatgcttcctccctgggttggggcagagccttgaggccagctggcctctgagggsaccagatgcagagtgtgcagaagcaccccctgcgccatcctgtgggctctcgccccatcatggagacacaggtgcggtcaaaggggatggtcagggtctttgacctcatgggagatggcgcatgcaggcacgtgcacacgcatagatgtgtcagccagaaacaaaacctggtagccgcagccggacagggcctcccgcttaggcctgagaggcaggtgtaatggaggaggctaaaaccaggcaccaggaacttaaccgggaaggcggccaggagaaggtggcttttcggcacctgttggacctgctctggggccrtggtgggcttgagggagccctgctcaccctgcccctggcccccaggcgtgctggactcccctctcatctcattgctcttctggatcctcatctgcttctccatcgcggccctgttcaccaagcgctacagcatccgccccctcatcgtggcgctcatcctgcgctccatctactatctgggcatcgggcccacactcaacatcctgggtgccctcaatgtgagtgccagagggagcccccattcccaaacaagctcatgctcactgtgcattcagayggcaagctggcctgctgcttccaggagccactgctctgtcccatcccctcctctctgttgggctcccaagttccttatagaccggtggcagggactgttctgtaccttcttcctttccctcaacacctgagggcagctggcactcagagacagaaattcaagagtccctttggagcaacagggtcagggtggctgtgcacactgtgcgggctgtgcactgcccagaggcactgctacgcggcagacacgaagattcatacataatgacaatctcctgacagatggaaataaagtgctttgagcgaggaatacctttccctgatagagccagtcagtggtcttctctgtccccatcctccgttgcctgtacctcactgtcttcctggaactgaggacccaaggggctgcctctgtattctgagtcccaggcgcctagatgcgtttctggaagcaatttcattaatgccatgcctcccaggctctgagctgggcactgggggacatgcgtgcagattcagcataggtggtagggtgctgactctcatgccttgcactcgcccccagctgaccaacaagatcgtgtttgtggtgagcttcgtgggcaaccgtggcaccttcatccggggctataaggccatggtcatggacatggaattcctctaccacgtgggctacatcctgaccagtgtcctgggcctctttgctcatgagctgttctacagcatcctggtgaggccttctgggtgggctggggctggatgggggcatggggtggttggggcttcccatgagttgttggcagttccccggcaccagtctstctgtccagtccttttgctgctgggctgggagcagtgaaattwcagagtcttcatctgcctgacccaagcctggccctcaaggccctgatggccactcctggtggccatctgacccctttctcctgtacagtggtggttcaagcctggactctggagctggaccagggctttgcatctcagctgggctactactagctgtgtaactgggcaagtttcttaactgccccatgcctcagtttcctyacctgtaaaatggggataacaacagcccctgcattctaaaataattgtgagatgaaatgagctaatgcatggaaagcacttacactgtttcctggcatgcagcaagtacattttaagagttggctggtattcagccacccgtttcacccctcgtgccttcccctgggccactccctttctgtgaccttagaattccaggtttctcgagaagctcccctgacaggcccacccagcttggatacgactaagtgcagacctccctggaggagccttgggaaactgtctggagcccaggcagccctcagggttccagtggcagccccagtgagagtggccggcccagcccctcaaggtgccatccctatctcaaccccatcctgcagctctttgacctcatctaccgcgaggagacgctgttcaaygtcatcaagagtgtgacccgcaatggccgctccatcctgctgacagcyctgctggccctcatcctggtctacctcttctccatcgtcggcttcctcttcctcaaggatgacttcattctcgaggtcgaccggctgcccaacaaccactccacaggtcttggaggcttcctctcctgggcaggttgtggggaatgaggttgggtctcacaaatgtctggcgtcaggaccaggacctgcagcgcttacctcaccaggctcccgtctgcttctcctcttggcttctggggacgtctagctaacaccagtctgcctcrctcttttctggaacacactgagtgggtgggagagccttgggtctctggcccctaaggaaccccttgcttgagggctggagtcccttgaactgtcattcatgttaaacccagtatttgcagaaactgcccgtgtgccaggcctaggggtacagagacccctccctgcccttagtgtgcaacccagtcgggggcagaagcgtgatgacccttcactgtggctggacagtggagggctggcgatccaggaccagggaaggtttcctggaggatgtgacactggggacagagccaggggataaggccaggcactggacctcctgatgatctcatccatatcccctccagccagccccctggggatgccacatggagctgctgcatttgtggacacctgcagtggggacaagatggactgtgtctcagggstctcggtgcctgaggtcctggaaggtgagggtggtgtgtgtgcaggagtctgtgtggggtaggrggagcaggcagcccgggcctyagcacactctccgcttgcagaggacagggagctggacagcacagarcgggcctgtgacactctgttgatgtgcatcgtcactgtcatgaaccatgggctacgcaacggtggtggcgtgggcgacattctccgcaagccctccaaagatgtgagcactcctgcccactcccaaacctgtggggcccaagccactgtccagatcagcaactgtggagagtcctgtccttggcctcgcrtcagatattcagggttgaaccccctcccccgaacttgtatccacttttccctgctttccacacctggccaattccatgatattactgcttagctgccccctcaccctcccattccataaggaaagactttggcaaccaaactttgccccagggctagggatggtgaccactggctttcctagcccacagcaggygggcagagggcggagctgagtcagctttatcaggaggcctcatgatttggcttgggcagccacattcccgaatgtcaggccttcccctgttgcttgggagtgagaggccgcctccctggccagacagagggtttctggaatgtgtgaggccaggcrtcctgagggtgggcagaggtgttcagagctgcctctttccctcatcaatgttaggggcagagacacaccgagactcgtagccctacctccccgccagactccttctgcaggcctccaccccggcgtgtcctgagtccacgctttcctaacccaaactcagggcttctgcttgcaattcttgctctgtggagccaggttgggtccactctgccatctgatggcccccaggccagaggccctcatttccttctgctaggggctgggtccycaatatcacagccctggccccaacctgagtcctatcttgccccagtgaatgtggggaccaccgggcccagcctccctgcctcatcccctgcaggagtctctcttcccagcccgagtggtctatgacctcctgttcttcttcatcgtcatcatcattgtgctgaacctcatctttggggtaatcatygacaccttcgctgacctgcgtagtgagaagcagaagaaggaggagattcttaagacgacatgcttcatctgtggtgagggctgcttcctgctctgtgsaggccgcagcggggctggaacgtcatctgatgccagtggcagtagcggtttggcccttcctgccctggggaaccctggcccggagctgatgacttgatgcatttgctcatcccagaactggggagaacatgaccctgcctgaacttggagtcagaaaggagtgggacaggcccatccctgtaaacccttggggtttctaggtgaggacatgagcccagtcagtgtctggagcttctggtctcagtccagtgcttttcctacccctgaaatgaagtgcyagtcccctcaccagccacctcgggctcaggcaggtgtcacctgtatggcctgtaggacctcgctcattcagccattcgggcttcccctgagttcgagaaattctcgcgtttactcctrgagtcctcggttgctgctgcgggagggctgcagctgcggcagggcaggatctccactaagtggctgctgctttaaatagaagtgacccaaatagcccagagcgagctgttggaagcgctcatcccgagaasaaatgcctccaacccccggaagctgggtcccctccagcaggtgaccctgcagtggctcttgaaggctgatggtttcattcccgccctctgcaccctcaggtctggagagggacaagtttgataacaagacagtgtcatttgaggaacacatcaagctggagcacaacatgtggaactacttgtacttcattgtgctggtccgcgtgaagaacaagaccgactacacgggccctgagagctacgtggcccagatgatcaaggtgtgagcaggggctgtgccaggcctgtgggcccaaaccagccattctagagtcatcactgtgcaccagaggcctcatggttttagcttctgagtaccctgggccctggagaggagtggccctatctgactgttggccctaggaggccaggcagaggggctcggacagctgcagacacttgttgaaaggtcagcagggcgaggagcagcagctggaagcagctctgggctgcacggaagccgctgctgcagaggggcctcctcacacttctgggtgtcaggaaaaatcccacagcaaacccatgcgccccgaagaacacgtgtggtatccctgggcctgtcgtgcagtgatgctgaggaggggtggagttggggagaccctgcccgtggccagtgatctgtgggccgctctcagggagtgttttctagctcggtgggaaggcaggctgcttcctaaaaagtctgaattagatgatcctgggctgaaggggagcctggaaaaactttaaaaatcacttacagaaatcaaatgtcatctgtccaatttctgtaataatggagtgaaggcaatgaatcataaagaaggaattatttatcgtttagtctgtatttcaaactgatctttgtgtacaggtttatctgttggtctgagaattcacagcttactacaaggaagctgagaattgcttggtgccccctccccccccgactcctctgtcctgggaaacgtggctttgcctcccagacacgtgtcagatgccagctctcctcagcggagcctccygatccctcaatttgccatctgtctgactcscgtcttcccggggcgtggggcgtgcttgtcaggcaggcgggcgggaggaaggaaggaaggagatccagggtctgtctgggtgcagaggccttcctccacctctcagggggtgttatgagagtaaacagatggtgctgataccagcaaaggactcaaactcagctgccgacgctgcctaacggaagtcagcctgtctcggtggcagagggttgacaagagggttgactgccagctcactctggccccggggaggaccaggtcaattcagattttcccatgacacatccctgacgagtagttttgttaagggtgtggcagaagcctccccccacattactgtttttctaaatgaggcctttctaggccgggccyacgcctgcttaacccactggtgatgtttttcagaacaagaacctggactggttcccccggatgcgggccatgtcccttgtcagcaatgagggcgagggggagcagaatgagattcggattctccaggacaagctcaactccaccatgaagctggtgtcccacctcactgcccagctcaacgagctcaaggagcaggtgtgcaccccgcctgatcccaggcccaccctgggttctatccctgggcagtccctgcctgccttcatccttcctgacccaccctcttccccactggcctctggccctgggcctggatgaraaggcaggtgccaaacccactctcccctgcatggcaagtcagactggggttgacaacccctgccttgggccrctaaagacaaggccaagtggaaactttagtacagggtggtggggccctctgtctctcatccccttcctctgacagctgccaggtaggtcctttgaggggatccccatcactggagmtgggggagtttaaggccctcttgcctagacatcctcttctgcatctggcagtgcctgcatgaagatgagrcagcctctgttagtgggctggtttcccagctgcatcaaatccagggtttgtgacacgctaattgagaacaagggtttggtgctgacatcgacatccttaaagcaccccgaggggccctggcccgccgccagtgccgaatagcagctgggcccacaggggaagacgggtgccaagctcttccacagcacccatggagggaaggtgccaggyggcctgaccaggcctgttggcatctgcttaaccctagatgacggagcagcggaaacgcaggcaacgcctaggctttgtggatgtccagaactgcattagccgctgaggagagccaccgaaggccccaacaggggatgctcatcactggagactgcgactgggaagaacactgccccctccctcgggttgggtggcccagccagctggccagcctccactcccactctgccagacaccctgacacccacccaggctttgaagagcatggagggggagcctcagagctgacagtcctgcttagagcccttaaaaagacttgaaagttcactgggactcagtttaccttaatgccttagcagaagataaatcctacctagagacctttgttccttaaagcaataactgacaactctttgtagtcctccttgtgggtagttaagagtggggtcacccctttaactccaagcactacattttggcggctgccggcctctgggggaggtggcagttatgctgttactagtgattttagggctttgttatttaacttatttcaagggtgctgtgctcagccctgcccatggctgtgcagctccctccgtgcctcagatctgctgtagccagtgcagacctcactgtcgtgtccatgccacccccggcatggctccaggtggcctggtgactccatgatggacgatcttgctcccaggacctgcctcttcccaggcttcctggggaagagttgtacgcccaggcaacaagggctgagctgcgcttgcgtggctgtttcatgaccgcttgtttttctccttttggtgtaatgttttacaaatcctttggcctgagaactaatatgttaattgccttaaataaattaatagaaatctagtccgttaaaaagggatgtgtttcctgcactcccccgggggctgtggggattaacaggacacactggcagaagacaggaacaagagcccctccctgctggcctggcctctcaggctctcaggagatacgctgagtgacatcctgtctcaagggtcctcccctgagatttgcctacccagaactgcatttcggcataactggtttctacggcagtcctgtcgattttattttatgcatttcagaacatcctgaggagtctagacacagacgaggttaagaacccacttccactttgtacccaccagggccgctgtgggcccagccctgtccctcacggttccagagagaaggatgctcaatatcagtaagagccaaggttccatggaataacgaggtgaccctgtgtgtgtcctcagccagcagggcctctgacttgtggccacctacagaacctgcccacagtgctgaagccaactgcagctgaggccccgcttggccaaggcctgtctatagcttccctgtcccttaagccaactgggcaatgtgggtttttgcaaggtcagggatagaggcctaaggtccatccttctctgagtcagtggggatgagggccaagcaggctttttgcctctctcggcctcacacctccctactgctttctgtttgcaacaggatgcccttttcagtatttactgctatttttggcttcctcccaggagctcctacaacaaaagggagcctgagtatcttgccaggagacaccagacccgtgccagaggggcgggggctcccgtggcaatgcaggaagcaccttgtgccgaggccccattaccctcatcaggcccagagggaaacctgcatttcctctccccaggagatttccctaccctgagcagcagtcacagcagatagctcaatcaccatcccttctcaggctgaaactttctttagagcagcaagggcttcctttctgggaaarctagaggagattcccaaaccgtaaggtcaaggggaaactggggcagttttattgacgatggcaatgtacaagactccacacctaggtatgtgcacgaggtaaggcctgagctcaggccttatgatcctcctcaggacccytgggggcaaacttctcctgcagtttcttccayatgcctttatctatttccttaagctcttccaaggtgtctgcaaaaggggaagacaaaaagagagagggactgaagtctaaaacttgatgacatagattggacccactgggctttcccgacacaagcatggcttgcttttcacacagtgtgttcctgaaaaaggtggagacccagctcctgaagagcagatcaaacaggtaacagaagtgaccgcttgcggggactgagcactgtgtgccagactctgtgcccagcacgctgtcagtggtctcctgccctctcctcaccctcggcatcaaagcgggatgtgctgctcgttgccctgctccgtatgagggcaaagaaatggccctgcgctgtccgctgtgcaacccacagacccagatgcttcatcgcaaaatttggcctgctccacacagcccttcctgtccccagttttcaggtgtggaaactgaggcaggaggcagtgaagtaacttgctcaggttgcacagctgggaagtggagcagggatttgaatcctggtgtgtggactcagcacatgctgtggagttgagcaggcactgggagggggatggccttgggcctgaatccgagcccatcatctcccactctgggtcccctcaagcaaattacttaaccctctacgcttcgggttcctcatctgtaaaatgaagataaaaacacacatctgcagacaacttggggagaggtgaaaaagtaagaaaaaaaaaaccacacgtacctcaaaagttgtaaggattaaagaaaagcatggaggtaactcgcttggcacacagcccgcactcaatgaaaaggcagccatcatccaccacaatgcaggcgggaggggctcttgtttaagaacatacacgtccctacacccaggaaccaaagcagggtttcttggccttggcactaccaacactttgggccagataatttttcgtcgtgggctggcctgtgcatcactgaaggctgtttcaaagcatcctggcctctacccactaatgccagtagcaccgctgcccgcaccaccagttgtgacaactaaaaatgtctccagacattgccacatgtcccctggggggcaaaaccatccccccagtacggaaccatttgtctaaagtctctagggctaatgttccatgaaatctaattttacgtgcatgttaaattttagatattcttataatattgttttgctttaccagcctaaattttcacgttaacaaaactactggagaaaaaaagagtatcttttctgaccaaaaaaggtaacagaaaaaagcccctgctctggagcttttccagaagtccatgtttccagtgtccaggtggacactgaggcctcccttaggcgctttccatgaccccaatcccagggtggacacacacataacccagaacacagcacatttcagacttgccaggccctcaaagcctctcactacaaggtgctgcaggtcttttcttgtcctgtcagaggaaacatttggtaagcttacgccacacaatttgcaacaaaaatatgaggcttgctgtgaaaacaaattctcagcaaatttcctgaactaaactcgctgccagaacaagctgcagcgcggaccaatggcgggactatctcccagccttcgttgctgcctgttttccacttgcagaggctgccctgaggtgaacaaaacagagggcagaggcagggcctctggaacttacttccgccctcacttcaagttcaaactttgctcaaactgtccagggccctcacaataatgtgcatcaatgctgctaattacacggacccagggatataggagtaaatttacacattaaaaaaaattgccaataaagtgattctgcctggccaaaatatcttcaccacagtttcccagagagtactggaataaaaatagggttagagttgacatgtaatagcaggtgacaccaccaggttttaatctcagaagagagttttctagaagcccaaatcctcaaaacttaagttgctgaaggctgccagaagaagaggaaagacacatttctagaataccagaaggaaatgtgtcagggccatgccctcccagaaaaggttaacctatttttgtatataatatacttggcaacaaaaatagtaattttccagtacctgcctacttcatccctggctctccggcccccctccttagggacaatggagatagggaagtaaggaaaggacgggcttggcaggatgtttcctttcttgataatcagagtctatcaatgactctaaaacatacctagttaaactcatatctaacccacagaccacgtcccctgggtcacataactcttaggcggatatccccaaacacgtttattgaatggctttttgttttaattaaaaccttcattgtttataaagccctcttaagaccataaaaataaaattattttccttccatcctgatttcaactacttccatttggcaaatatgtattcctctgttccctgatgcccagccttgaatttaaaagccctaaagatagattttcttttttaaataacrcctttgaccttctccacagtatatggtcaaaatgcatgcgccctgtagcttcagaatttcctctgggctgttctacaagactttccatcaagcaaaactgtcttcttagacaattccccttggccactcaaactcagaatcatttgcaaaccaatgagaaaaggcagctgtgctttcattacctgtggacaggatcagcttgtactcttccaacgacaggccactgaagctggtgtctctggggcgagggtactggtcaccggggcagaaaggaagtgaagggaggggagagatcagcacacaagccctgctctctaactgcatttcacctaggccctgggcaaccagaggccaggaggcctagcaaggagaagagcagcgccacctcgaggtcaagacttggcctcgcaagaaccagtacagtctccaggaggcagctccaactataatgtacccgtgagtcctccctggaaaacgcaggtatgggtggggcccctgattctgcatttctaaccagttcccaggtgatgcccatgctgctgctcatggatcacatgttagcagggaggatttagaaaaaatcaattttccacataggcatatggccacaaatgtttgtggagttaatgagcatatttttcaagtatgggaaaaaccactctaaatggaatttgacagtaatcatgttgggcccagctccgtaaaaggagggcactttcccaatcatcccatctttatcaccagaatgtggggaggtgtcagttccgtcagagtggatgggaaaataggtataaatccaatggctgtcagacattcccaggagcacacactggcatatcaaatacatggcttctattcataattggttttgtttcttccctatattcacaattttaaatagcttttatttaggtggcctaaaagcctctaccaggcacctctgttggcttggttgaaattactggtttcatttgaacgcagcaaagccaagtctttacaaaacattacctaatcagattttcactcattcttattagttgtcccgtcagaaagctgggtatataaaagactgtggcccactcaccttgtgtttgtagtagtttgaatggagtcgcgctaagctctcgtacatctgatcacaggcctcaggctctgcaacctgaaaagcaaagaatcccaaaggaggtgagcaaaggagtcctgcctcccacagtgtctgtaccttgaggaaagaccatacttaataaagcgttcacatgaagcaggcctgcagctagcactggcttctccactctgcgggaagcaaacctggactacagctctgctattagaaactactttttggaggcatagctctgcctcatcaactccccaacctacagaaaaatcagatcaattaatcagcaaacaagcatttgttgagcatctgtgacttgtgagccacgacaccagctgcagtgggagatgccacaatagaaatgtaaggttggaaaggcgtgcctaacaaagggggtgctgggcagagtgggctacagggactcagtgggggagtccccgcatgctcaagtggtcagtgcatgatggaagtgagacaatgctaggttctgaaggaagcacagcagaaggtcagcaagcagaaggtcagcaagcagaagggagaagggcaggccttcctgggggaggagatgccgtcagcaaggaagaggaggcaggaatcctgtgggatgcttcaggccagaccagtagattcttttgttttttttgagacagtctctcactctattgcccaggctggagtgcagtggcgcaatcttggctcactgcaacctccgcctcctgggttcaagcaattctccagcctcagcctcctgagtaactgggattaaaggcatgtgccaccacacccagctaatttttgtattttttagtagagacagggtttcaccatgctggccaggctggtttcgaactcctgacctcaagcgatccacctgcctcagcctcccagagtgttggggttacaggcatgagccaccatgcccggcctcagaccaacagattcttttagcaaaggcaaaaaaaaaaaaaatcatctgagttctcaatctatgataagtggggagctgctgaaactctacaagaaggaaagaaacatgaagaaggcaacatttaagataaaatgtgtaaactgaggagaaccaagccaggaccacagttaggtcctgctagaaaggagatggcccagaacactgaggccttgccatagaaagggtgatgtaagtcaattctctggtgccagagacagcagtgcccc

SEQ ID NO: 17793 - DNA, 38449 bp, Homo sapiens
  misc_feature (1)...(38449): n = A,T,C or G, or insertion/deletion polymorphism (see Tables 1-2)
caaattaaaatgttttgttagacatttccatatttttaagggcctccttggagctgccaggctgggagtgaggtttctctccctttctaaaccctgtgcccatcttgtcaccctcctggagctgccagcagacttcagattcttctccgatctacagagcagaaaaattcagccagcccttccttgtcttcctatccacagctgcctgcccagactcatgaaacctgacaaaatgcaaggtcttatcattacctgaaccttggacctgttcaaaaatactagttcctgagaataaatatccctggtgtcttcctgcccttcctgcacacctccagtggcttatcaaaatatttgtttcatgcgcacactgggctctcatttaagaggaatttgggagaatgttattttctaatctgcatttcacaccaggctccccctccttcctggggtgctagtgtcagcagaacctgatggggaagtgaggtctgggaggcagaggaggaaggaatgaggggaaaggggaagtttgggaggaaggcttctgagaagactggtgggagagaaggagagcctgcagacagaggcctccagcttggtctgtctccccacctctaccagcatctgctgagctatgagccaaaccagggatttacagggtagggagggtgggataggcagcggcattagatcrgaggaatgagatggacagacctgggctgtgggctaggagggcagtcagctggcctagggtagcccgggctggtgtcagggtaaggagaggaagggagggatgagggctgattaatttttttcaccccacaggaggaaaagctttcggactgctgaaggcccagcaggaagagaggctggatgagatcaacaaggtagaaggaagaactaagggggcagagccagggggatggggcgtggatggggagggcctaccctggctcttattttcccctccatagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaccctagcggggcccctcaactccccaaccccacttcctctgcctgcccctcctcctccttccacgttgtctcctccacctagcagttggttggcaaccccttcctcagtcccctgctgaaaaccctccagtcagcgcttatcccttctgctctctcccctcacccagagaaatacatggagtttgaccttaatggaaatggcgatattggtgagaaaygggtgatttgcgggggcagggtggtgtgcaggcctaagaagacagaggtctctcctacatgctccattcctcatgatttgggagggggcccacctaccacagtgggaggaaggagaatggggatgcggaagtgggagaggagagagagggtctccccaccttctccccatccccatcctctgcccccagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgtgagtgtcaatttccaacctcccctgtacttacctgttttctcctcccccatccctacccttgtccacaggctcaacatttctacacgttgcccatcatcccttcttccatccttagagggacccttccaaggtcccgaccccatccctatccatagtcctggtccccagaaactccaacccctgcccttcctcttcccccttccaccctcacatccccatccccttctagcctttcctagcaccctatgatttattcccttgagaggagtgttccctgatccctgtgcctcttcccatctcaaccaggatcctgatgtatgaggaaaaagcgagagaaaaggaaaagccaacaggccccccagccaagaaagctatctctgagttgccctgatttgaagggaaaagggatgatgggattgaaggggcttctaatgacccagatayggaaacagaagacaaaattgtaagccagagtcaacaaattaaataaattaccccctcctccagatcaagtcagcttagtttttatttgggtgatttttttcctgggtttgggaaggagagacaggtcttgagggaaaggtggcaaggatttggccatatgaacaatccatcaacaacgctatagtgtgtccactacagcagatggtttcacgcaccaagggggattccagctgtgtaagacagccttaacctcaaagaatgcaggcaggacaaaaacacatgtccaaacaaggtactcaggcccatgacagatttcatgaagagcaaggaataccatgaaccaacattctccaccactataagctttgtcactttgacaaatcactcagcctctgtgaggcttttttctaaaaatggggataaagtgacctatgctattgtgcctgacatatcataagccctcaataatgtttaaaacttgaatgagccggggccgatggcttatgcctgtaatcccagcactttgggaggatggggtgggcagatcacctgaggtcaggagttcgagaccagcctgacgaacatgaagaaaccccgtctctactaaaaatacaaaattagcctggtgtggtggcgcatgcctgtaatcccagctacttgggaagctgaggcaggagaatctcttgaacccaggaggtggaggttgtggtgatccgagatcgcatcattgcactccagcctgggcaactaaaaagcgaactccgtctcaaaaaaaaaaaaaccgaacatacaaacaaacaaaaaacacttgaatgggtagatgaatgaaagaactggtgctattaaataaagcaaagaatttacagctgggcgtggtggctcacgcctgtaatcccagcacttcaggaggccgaagcgggcagattacctgaaatcaggagttggagaccagcctggccaacatggtgaaaccccatctctactaaaatacaaaaaattagctgggcatggtggcaggtgcctgtaatcccagctactcgggagactgaggcaggagaatcgcttgaacccgggaggtggaggttgcggtgagccgagatcacgccatggcactccagcctgggtgacaagagtgagactctgtctcaaaaaaaaaaaaaaaaaaaaaaaaagactggaaggagaaactcattggagacaatgactatggacatcccttttaagaattttgctgcaaagggtaacaaaacggtatgtgtggtagccggccggggagaagggagaagagaatcattttggaagtttgaaaacagaagtcatcttaaatcttactgagcctctgactaaaattctcatctgatttctgcaaacttttctgccttcacttttcataatgaataagccgcctcctttatttagccatatcagcctaggcacaggcccccaaactcatgcctccactaatctgttctctgcacctgagatgtacaccttcttctgaaacttgggtaagttctaactcgttcttcatatctatttatttatatatttttgacagatatctactccgatcattcttcatatcatttttttttttttttcctgagatggagtctcatgttggccaggctggtctccaactcctgacctcaggtgacccacccaccttggcctctcaaagtgctgggattacaggcgtgagccactgctcccgctcccggccctttttttcttctttttcttttttttttttttttgagacgtagtctcactctgtcgctaggctggagtgcagtggcgtgatctcagctcactgcaacctccgtctcccaggttcaagcgattctcctgcctcagcctcccaagtagctgagactacaggcacgcgccaccagtccagctaatttttgtatttttagtagagacggggttttgccatgttggccaggatggtctccatttcttgaccttgtgatctgcccgcctcagcctcccaaagtgccaggactacaggcataagccaccacgcccggcctcatatctcttaataagagtttttctagaaacatttctcaatcaccccaggcataatcatattttatttctctacttctttcttttttttttttttttgagatagagtttcgctcttgttgcccaggctggagtgcaatggcacgatcttggctcaccacaacctccgcctcccaggttcaagcgattctcccgactcagcctcccgagtagctgggatcataggcatgcgccaccacgcctgggtaattgtatttttagtagagacggggtttctccatgttggtcaggctggtctcgaactcgtgacctcaggtgatccgcccgcctgagcctcccaaagtgctgggattacaggcgtgagccaccgcgcccatccttctttttttttttttttttttttttttgagacgtagtcttgctctgtcacccaggctggagtgcaacctccgcctccctggttcaaggaattctctgcctcagcttcccgagtagttgggattacaggcgcccgccaccacgtagggcaaatttttgtatttttagtagaaatggggtttcatcatgttggccaggctggtcttgaactcctgatctcgtgatccacctgcctaggcctcccaaagtgctgggattacaggcgtgagccaccgcgccaggccttatttctctacttctataatatcctgtgcattatctccagcgccttcaaatcatagtcattgaatgatctgttgaatgggtataactctgatgggagcagagagttctagaatcgggtagtaagagacaaaggagggtaacagtactgcatttcacaaaatgaaacccattgttaagaaattacaaattcccaataatttcaaatataaaaatttattcatgaaaattataggttataaaattaaatgtccgtcttagtcgatggttgcccatattttgatgaacgagtcattcctagcctatctttgttcaaatgatttgcatacattatgcaaataggtagaactgcccgaagaatgcctacgctgcgtggtgcggacgaaacgcttcccggggcctttggattggtctgtctagccacctcatttgcatgacgtaatataataactggaaggccccgcccctctggtgcatttccccgctccaaccacctcctcaaactcacggcaaagggatgcgagagctggaactcttaccaggcctgcggaaactcagccctccggcagctaatcccgcccgccagcccccgtcctctctctctttctccctagctgaaggcgccacgggccgtgtgtcgttgccttccacttttggcgtcccaacgtctctccgctcccatctttctactaacgtccgacgcacgctccgcctctttctcccacattcgtcgtgtaaattctgcgtcccaaccgcccagccgacctgcaccgcattcccgccccctcaacacggctcaacggccgacgctgggggcccgcctccttagccaatcggggtcctagtgcccttaagtccctcctctttatgcaaataacctccgcatgctccgcgcgcccggcccttttttttttttttttaaactaaagacagccctggaagtagagggttagggtagaaagtgccccgccctttatgcaaattaaggggcgtgtctaggcgcggagggaggtgggaggtgggagggggtgctcccgggggcggcggttgcccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggtgagtctgggtgaaccgtgcgctgacgcccttttccggcgcgggagaggtggtggcggtggcggtggcggcggcggcggcggtggtgggccggggggaggagaagctgccattagccgccgccattttgtcctcctgctgccgggcctgcttgcccctccccctccggtacctctactccgggacccgcacctccggcagttcattcaggatccgtagtctgcccctaaccacccaccgtcttggcttcagggggtgacccctgcgcctgggtccgtaactccctaccctccgctgcgctcctggcttttcacccccatttgtgggccccctccccggctgccgccccgtggtgggccgcgcccgacggttctctcggaagggcgcttttcctccatattggaccccctcctatcatccagcgctgtgttcccccctctggacgcccctcttcgtgtcgagccactcccactctagaatcctgcttttatcccagcatctttgctttctatgttgctcagtcgccctatgtctgctttttcatttttcctgttcctcgtctcctttctcccccaaccccgtttttcttcttgggcctctgcccccttacttcgttgtctacatcctttttttttttgccattcctgtttccatatattttccacctgctttcgtattcattattttctgttagttttggtctattcgctacatgactcttgtattcgttttcccttcatatatttatcttcacagattggcctcctcaaacacctacgaagcaacatccatcttatctctagcttgtcataaagttctttctccccaattttagctttcattctgggcctgtctggatttccctgctttcttccccactatttctcatctctttacactgttcccgtccataaacgaatgcctggtcactctggaatggactgagagacctgtcgtccggcttgcttagggagctggaggtatcgagtaaagaaacactggtgatggacatttttaatgaggataggaaaacgaagatggctctggccttggccctctgttttctggcccatggttacagggtgctaaggtggctccataatgctttttctcagttcttcatatggtaaaacagtatttcatctggaggcgattttttccaggagccaatacaggagcaagtttaggaaaagatgggatatttcaaatacttgaggttcctatagcctgggagtatgtacagccctagttgttctatgaggatttctctggtaccaacccccattccggctgagcaagctcataaaatccttaaactcccagcataccttcctgcaaaccttcccagatggacacgaggctgctgggctgggagcctggggtacagggccctgggggcatgattagggagcttgtgtccaataaacagggaatctaaagtgttgtttcttcttctctgatggaattgtatgcttcttttttagttttctcttgcttgaatttgtcctgttgtaagtctctgaaacgattttggtggagagagaagagattattacttgtagggaattactctttgtagacaggcacaaagggcagagtgtttatactaggaggatgctggatttttacttagatttccttgacaaaggtgtctgggggaaaggagggaacatggcatttgagctatgagggagctaagtagatcatggttgcttragaagagtgggcagtttacatagactggaggaaaagacaccagagggcctcatatctgagtccctaatgataatgcaatggagtttttaagtttctgttatggtctgtacaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctggtgagagtcctgcaaagatgcttctgatggttgaaagctaggcatgcatggggcatacgttttagagytctttaaagggaagtggctgtagtagaaataccaaaagactagaggagatttcccaactttacactgggtcctttaaagggggtgtgggctctgggtgaacaccagttatcctcctacaaaggcgtgtctgtggttccctgtctttggacaygtaagaattggaggaaaataaakgtggatttgggaaactttgaggccagcttgcttcttgcaggctcatgatcaaccaatctcacataaaagtattgaatgttacatatctcagccttcttgatagggatttcatagattttttttttttttttttttttttgagaccaagtttagctcctgttgcccaggctggagtgcaatggtgtgatcttgacttaccacaacctccacctcctgggtttaagcgattatcctgcctcagcctcctgagtagctgggattacaggcatgcgccaccacacccggctaattttgtrtttttagtagagacagggtttctccattttggtcaagctggtcttgaactcctgacctcaggtgatccgcctgcctcggcctgccaaagtgctgggattgcaaagtgtgagccaccacaatcagcgcgatttcagagattattaagggcaggggaaggaatcccttctaagagaagtttggaggaagtaggtaataaaatattcaacatgtataaatgtgtcccaggataggaggccatcagatctcccacatgaggcattttcgaccctctctccgtcttgttctccagttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagaggtagacagaggcttgggggacctagagtgatgggtattttaacttgaacttcagggagcattggggcttggtttagtccagccacgtctgagccagagacgaagaggtccctttcttacctrttgcaggttccttgttaaatgactaaggaatggtactaaactttagctttttgtcttggagagagagcatgaaaaaatagacaacagcctacaaaggatgacaaaattawtttgtccttrtatttgtaaatggtagcaatgggcatgatttcagtcctgagtctccaccagttggagaagtcagggaggcatctcaggtgtgaataaccttcccattctgtcccctcagttccgatgcctcaaccgctcagccgccggaatcgcagccactgccggcttcacagacgcctgcctccaaccagccgaaacgacccccagcagcccccgaggtacctggagaactggaggggtggggaggaagaatggttcatagctgccccacccacatcatttatcatctttctgaacacttccccagaacactcctttggttccaagcggggtaaagtcctgggcacaagccagcgtcacccatggagcacatggagatggtgagtgcagcacttaattggggagctgtgtctgggcaccatgggatgcatgaaccctgcactgtattttcagccaagtgaccttggtcctctttggctaaatcaaggaccacccatattcagtttcatggaggcacatgagcaagtttaagtctcagtcttatatgatggagtgtagtggtgccagaactgacctccttggggaataagcagttattctgtagsggggtgagtttgaaggcgggaaacctgatggtctggtacctgtcagagccttccactttttttttttttgagacggagtctcattctgtcacccaggctggagtgcagtggygcaatctcggctcactgcaacctctgcctcctgggttcaagcgattttcctgcctcagcctccagagtagcgggactacaggcacacgccaacacacccagctaattttttgtgtgtttttagtagagatggggtttcacatgttggccaggatggtctcgatctcttgacctcgtgatccgcycgcctcagcctcccagagtgctgggattacaggcgtgagccaccgcgcccagccagagtcttccacttttatagcatgtcctcaggaaatgtcttctgtctcctgttctgcatccccatcctaataggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaagtgagtggctgccttttggccaagacattacctattgcatctcagagctaggtgctggcttattcaccttcctccccatcactttcagctgtgttcacttgtcctccaatcattgatacctctctctaccttttccaaaatacagattctacaacttggagggacggaggtggkcgtggccctgatgagctggagggcccggactccaaacttcatcatggtcatgatccccggggtgggctacagccttcaggcccaccccagttccctccctaccgcggaatgatgccgcctttcgtgagtcttggtgtcttgtcttggaacgattacactggaagctggagagctaggaatcaggacttagtctttgacctatgagatagargggagggtgggaggatgattgatagcaggcttaaggagctagaagggtatatgactgtccctctgagcagctactgttggacccttttacagatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcrcttagtagagcctgtgggtcgtccctctattctcaaagaggataatctcaaagagtttgatcagttggatcaggagaatgatgatggttgggcaggtaagtggatattaagggtcaagaatttggatcttgaaaggcaaaacctaatgaggaaaaaaaaatacagggttatgtgggtgaaaggcagacattgaagtgtaggaagaccaggcccaatggctcacatctgtaatcccagtgctttgggagtgttaggtgagaggatcgcttgaagccaggagttcaagaccagcctgggcaacacagcaagaccccccacctctacaaaaaaaaaaaaattttttagttgggtgtggactgtgcatctgtggtcccagctactctggaggttgtggtgggaggatcagttgagcccaggagttggaggtcacagtgagctatgatcgtgccactgaactccatcctgggcaacagagcgagacttttaaaaggaaaaaaaaaaaaragtaggggaggatggatggggaataccaagtccttgcaaagtggtgagaggagtaagaatgacaagacttcattggtggatctagacttcggagggaaggatattggcattggtagtccatcttgttacatagttccagactacctcccaagattggagggcagaatgcttgggttactaatactcatatttcccctcaggggcccatgaagaggttgactacactgaaaagctcaagttcagcgatgaggaagatgggcgagactctgatgaggagggwgctgagggccagtgagttagggccatcaggggagaagaggagggggtcttggtttgtattttggtaatatactcttagaggagtatattagttgcagctgattttaatttcactgttgatctgctcacagcagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccrggaactggggcccccctggggactacccagtgagtgtctccaataagggattgagagggtcagctgtgggaaattggtgtcagctgagtaattgaagcggttgtgatatagaggaaggggggtgctaaaaatgggctgtgtgaagtgccaggctgcagaacatcctgggaagcttttaaatatctttggtaataggggagtctgggtaagaagtgagaaactgggatgctaatgaggaaagaagaaaaaggagccctgggtgtttgggtttcggaaggagagagggaacagaaaaataaaaagactagggtggctagatagctggatctgttagtatgcatcagtagtccaagctactcagcaggctgaagcagaaggatcacttgagcccaagttcaagaccagcctgggcaacatagcaagacgtggtctcaaagaagaccaggataatgagtttgtcaccacccagagagatcaaccccaaagcctgggtcgttgcatcctgcaagtagcgacagttgatttgtygtaaaagagatgrtagaaagcatagtaactgattcccctggccctgctgggtcttgccaattgacaggatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagamagaacctgaagagccagcacaggcccctcctgcccaatctactcctactccaggtgtggctgcggctcccactctggtgagtggtggtggcagtaccagtagcaccagcagtggcagcttcgaagccagcccaggtatggagatggggataggtactaccagatgtcagatcactgcttcaaggtgcttaaaggtgcagggtggtaaggctggggataaatgaagtagaaggcagttgttttggtttattggactatcagtgatagtgttctatcatttgtatatctgaaggagggaaggttttgtctggaatcttaggttgtagtctaataccatttcttggcagagtactgtagctcacgcctataatcccaacacttagggaggcttggggtggaggatcgcttgagcctagggagtttgagaccagcctgggcaacaaagcaagaccctgtcggccaggcatggtggctcacacttgtaatcccagcactctgggaggccgaggcgggcagaacatgaggtcaggagttcaagatcagcctggccaacatagtgaaacccgtctctactaaaaatacaaaaattagccaagtgtggtggcwtgtgcttgtagtcccagctgcttgggaggctgaggtagtagaatcgctttaacccgggaggcagagatttctgtgagccaagaccatgccattgcactccagcctgggtgacagagcaagactctgtctcaaaaaaaaatcctgtctcacaagaaatacataaataaaaatgaaaactatttcctataggcyaagactgaagaaagtactgttgttctaatggtttcatagaaagttaatgccaccaccataggctcatgagaggccatgaagtgctttaatgggtcttaaatgggaggggcttcartagaatagatgttgaatagaatattttagtcttaagggagctagagatgagacgtgagattcctggggtgttcatggagtgtctattgttggactagatcactctgttgtgttttttccgatgcagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggtgaaatcaagttgtttaccctctaagggctgcttttcttcctggcttcggtccctaattctcttcataagttaccttctgggtccctttgcttctttgtccagttgtctccattgtcacgccaatttcccctagtccaagttttttctttgctgattcctttgtccatgtgtgctttgagcctctctcatcttgtctttcctcctttcctaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggtaagggggcatgggaggagtgagaaacaggaaagtcccctcagtcttaggcattggatattagggtcttactgtgactctggtacgataggttttgcccatcatagtgatgagggaagggcatatgcttrgcactgctgagatagctctgttgcaaaaatgggcttagttaagaaataagcagtggttggccaggcattgtggctcacgcctgtaatcccagcacttagggaggccgaggtgggcagatcarctgagttcaggagttcgagaccaccatggctaacgtggtgaaaccccatttctactaaaaatacaaaaaagtagccggcgtggtggcgctcgcctgtagtcccagctactcgggagactgaggcaggagaaacgcttgaacccaggaggtggaggttgtagwgagccgagattgtgccatcgcactccagcttaggcaacgagcgaaactccgtctcaaaaatgaatgaatgaatagcacaactccatctcaaaaatgaatgaatgaatgaaagaagcagtggtccttcatttgccaggatttatttggggtgggttgattctcttgtagggaatctgagtggataaccttgttatataagagcaggcaaggcccggacctactgggaacaagagatggaagagctgacttgaccgcraggggagatgctttttgggctggagggcttgtgacatgaataggattatttttctttttctttggtttcttcaggcctagttccccgagagcgttcagacagtgggggctcaagctcagagccatttgaccgtcatgcacctgctatgttacgggaacggggcactccaccggtggatccaaagttggcctgggtrggagatgtcttcaccgccacacccgctgaaccccgcccacttacctcacctctgcgccaggctgcggatgaggatgacaaggggatgaggtgagtcttggtcatgagaaatgggtgagttcacagtgaaaggatctaggcctgggagaaaggtactttgggttagtggtagggatagggatgaacgggaaaggagaggctggatggagtggctcatgcctgtaatcccagcattttgggaggctgaggcaagaagattgcttgagcccagcagttcgagactagcctcggcaactggatgccrtctctgccaaaacaaacagaaaaatagtaaaagagagtctgcatcataataaagtgttcttttcccacctagttctggttttcctgagatacttatttccattctttctgtctktctcttcaggagcgagactcctccagtacctcccccaccaccctatctggccagttatccaggctttcctgagaatggrrcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccmccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccrctcctgsacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgyggagatctgagccagagagccaaggatttgagtaaacggagcttctcaagtcagcggccaggcatggaacggcagaatcggcgccctggcccagggggcaaggctggcarcagtggcagcagcagtggaggaggcrgtgggggtcctggaggaaggaccgggccaggacgaggcgacaagaggagctggccctctcccaagaaccgaaggtgggtaggaacaaacaaatttattgtggtttaaaaattggaggagggggraaaagcctgagggaaagataagtttgggtgkagtggagattgtggcctgaggggccatgggctctagaatgtcagtaggatttccatgtctggctaaggcaactggaaagcggttggtagggtgttagagtcaagaacacccacctatgtattcattgctggttctttgctttccagtctgtgcatctgtaygcataggaayccttagaaggactcaaaaacacctggactttaatagggaagagrataggttgtaagcagaagttgggaaacataacttgtgggaaaaartaacgatttagtggatactggagctaatgctctgttttctccagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcytccccaagcccctcagggcccctctcctaggcccccaacccgatacgagccccagagggtcaacagcggcctcagttctggtaagctggaggggttatgggtgggaatatctccatccccagagaaggtcaagtgctggagggagcgggtggagaacctggcctagggrrcctgctgctgggtgcgtttctgcagggagcaagggtagaagaattgggaggtggagtagagaggaaaagttagggtcagtggcagagccaggcagatgctgaccctttttctctttcccagacccccactttgaggagccggggccaatggtgagaggggtggrtgggactcctcgggactctgccggggttagtccctttccccctaaacgtcgggagcrgcctcccagaaaaccagagctgctacaggaggtaagggatgggtttgagattgtgcttcactgcactcttactcgtgaaawttcttctgggttatgttttctctgttytctttcctgtttctttcactgtgtttttactccagaattctcagtattagtctcccatgtgtctcccttgttgtccccacaccctgtgtcaccccactctgtcctggcttcctataattcccaattcccacccaattcatgttttgcttctggcccttctcatctgtaggaatctttgccacctcctcatagctctggattcttgggctctaagcctgagggcccaggccctcaggcagagtccagagatacaggcacagaggccctgacccctcacatctggaaccgtttacatactggtgagtaaagctgagtgaaaggactatggtagaagggttaagaatgagaggggcttctgaactgtcatctcctcacttctcttctggttggtgctcccttctccagccactagccgaaagagttaccggcccagctccatggagccttggatggagcccctgagtccttttgaggatgtggctggcacagaagtgagtgagggtgggagggtgtgtctgagctgggacttttttgagcactggtcataccccccacctgctctgggttgagtctggagctgttytctcacttggctgtcccctttctgcagtttgtatgtgtgcatcagtcaggtattggggtgctytctaccctgacttaactagctccttctccactcctctcagatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggtaaaagaccaaaaaaggataaggggaatgtttccaggaatctgactttggccctacctttttctgctttttctctctgcgtgtgtgttctgggcattccaatttggatttccctttccctcccccaatgcactttactgtgtgcccaatccaggagctgccccgggagcagcctctgccccctggccccattggcacagaacgatcacagcntacagaccgaggcacagagcctggccccattcggccatcccatcgacctggtcccccagtccagtttggcactagtgrcaaggtctgtgtgggctggatctgggtatcctgagttgggtggagagaagggaaggactaaaggtgggacatagaggacacatgtctgtcacgggacaatgtctcctgccttcttgtgatcacaggactcagacttacgcctartggtaggagacagcttgaaagcagagaaggagctaacagcatcagtcactgagrtaagtgggagtaagagtttggtggaaaggcccaagatttctggggaagattgctgggagtgaccagggcgtccaggatgccagacatccctctccacgaggcctctccttcccaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcaggtaggccccgcttcccattgcatgaccccttcagtgaataataatttttttctgcctggtatgtrtttataatcaagcctttctacgttgcagagttgtgagataccactttgtcacatcatttttctccctactttttgcttctatgggtgggatggtgatcttttttcttgaccacagatactaaagctgtttcaaccgtgctcctctcctgcagatctctgggggagccatggactctcarttacatccaaacagtggaggcttccgccctgggacaccctcactgcacccttacaggtaagactcgatgcctgtggatcacagaagtacttggagatgtgtttcggggagagggaaggggaagacacagttctagggtactagaagctagtggacttaaggcattgctaggactctggcttcctaacagcttttctccccacaatttattttcagatcacagcccctatacctacccccsggcccagcccctccctcagcactgctctctgggktagctctcaagggccagtttctggatttctccacaatgcaagctacagagctggggaagttgccggctggaggagttctctaccctccaccttccttcctctactctccggctttctgccccagtcctttgcctgacacatcgttgcttcaggtaagaggggggcaggtattagatattgggggatagggtagggagaatgattttgtgggggttgatatatttctccctgtttcccgacaggtacgccaggatctgccatccccttcggatttttattctactcctctgcagcctggtggccaaagtggmtttctcccttcaggggctcctgcccagcaggtatattgtatcktcacacttccccttcatttgatttctctgtccagttgctggctttgattttccctggttttctgacattcctccctgcccccaacatgcacacccaaatttcttgttacagatgcttctacccatggtagactcacagctgcctgtggtgaactttggctccctgccgccagcaccacctcctgccccacctyccctttctctgttacctgtgggccctgctctgcagccccccagcctggctgtgcggcccccacctgctcctgctactcgggtgctgccttcacctgccaggcccttccccgctagcttggggcgagcagaggtaaggtacaggaactgaggggctagggagcgccaagacttgggagtagggattctgtatttcaaggtaggcagctcatgatttttttcccctcagctgcatccagtggaactaaagccgttccaggattatcaaaaactgagcagcaaccttgggggacctggatcatcayggactcccccaactggaaggtgaaacggaatagggatgtggactttccaagtgcttccttactttggaaccagggtctggatcctaggcttgccttagacgcccttcttcccttaggtcctyctctggcctcaattcccgtctsaaggccacgccttccacctacagtggagtcttccgcacccagcgcgtcgacctttaccagcaggtgaaggagaaacccttgtggccccaactctaaattygagttgccacytgatttcctgtccttccrtctcatcgctgacctctcactgtgactcactstttaacacatgcctgtcccctaggcctccccaccagatgccctgcgctggatacctaagccttgggagcggacagggcygccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttstggggctggggcctcacttcccctcctcccccttcccctggtcccctgtccctggggctgtttgttaaaaaagagtaataaaaggatttaaaaaaaaaaacttctacaatgatttgggggatgagttgtttgcattgtcttaaagcatggtgctgagtgatctgtagtttcagtcagggaaatattcattacttattccagtgagctgttgaaactaaaaacatgaccatcgtattggatctttaaatttttgtgagtctggaatttgggctgagctcagctggataaatctgcttttttgtgccagtgagcgaggtcaactggttatcagtctgcagctgacacctgggctggtcccaatatggcttcctttgcatatctagggccttggtgggacatctgtaacattactgggttatcaaccagtgtcttcacatggactctccagcaggcctgttaaatgtccgtgagctcatgttccaagaggtctagctggaattttctaagcttatgccatgcttagttgatagagcactaaactagccaaggtaggggatgggggggtttagaagggacttcaactgcatctcaaagggactagcaaagaatttgcagccatgggacttcagttctttatgatgaactaaggggaaatctctgttaaggcctcaatgttggagcacacttaaggggctctttgaattggatagaccaattccagcattgtcaaactaagtgggatttcacatggtaacgctgcatgctagttatgctaaagactatacttaggtctgcagctgctcagaaactttttttgatgggtaatttgagagctctatgctagtgtgcacctggaatatgctcccaactcaaaatacaggttttttatttatatataaagtgctttcgcacaaaaaatacaaacatcaggctgggcgcggtggcccacgcctgtaattccagcactttgggaggccaaggcgggtggatcacaaggtcaggagttcgagaccagcctggccaatatggtgaaaccctgtctctactaaaaatacaaaaattagccgggcgtggtggcggacgcctgtagtcccagctactcaggaggctgaggcatgagtgagaatcacttgaacccgggaggtggaggttgtagtgagccgagctcgagatcgggccactgcactccagcctgggagacagcaatactctgtctcaaaaaaaaaaaaaaacaaacatcaaaactggcttgtacaatttagcgtgctgagtagaacacaacagtgttccaaggaagtattaatttwaaaaagttcacacaagattaagggacacactacctaatggagacaatgtagagagaaagcagccagaaaaatccgacttttatttcttaaatactgtgaaggaagaggggggaaacggtcccctgatgaggaagggccatagagcaaagagctaaggatcatcagcaaaggcccgctgggcattggggaagcgctggggactgtagttggggtcttcctgyagtcgtttttgtatatcagaccggagctaaagagaaaaagyaagcaggttggagaaasgctggccaagtcccyatgatcccagcaagcacacaaggccatccctcagaagctaacatttccccccccaagcacrctgtcaaatagcccggggtggcactgtcaagccttcccagatgccaaaggggaaaacaaatggtagcaccaggctgaccagttcatcgctgaagggatccagggaagagggaccctagcccaacccctcccactagaccatccctattctgcttcaaggtggcacctgctgcctgtagctctcctgaacctctggtgcctccaggtcccggctcaggctctcggggctcgtcaggggccgagctccggctgccttagctgcccggctcacagcctctgagagaagcagctgggggccctcaccctgcatcgtctgggggacagggggttgggagggaaaagaggatcaacgtcagatccagtgccaccatccggctcaccctttccatgagtcaaccactccactgagtctccatgctagtggagagaggggaaattaagagtccaggatgtggtttttacagcagaaatgccttcctaattctctttggcactagccaaaactaaagtgaatgtgcttgaacgtgctcttcaaaacgaaaggcagaaggggtcaagccatccgggattcagagctaggtaatccacaagaggaaacccaccttaaaggaaaatgggatctaagcacatggggattaggcagctgagcaactaatacaggactgctagcaaacagactaaggtcaagtcctgtatggttatgcaacaaccaagagcaagtctgaatcccagaaaaagtttcctcattaaacgaggggaggggagactgaataacaagagctcccaccatctctacatagtttgattccaggcatgacggggaaacctggayagagagagaggcttagggaagaggaaaaccaaccttgcgtctcttggcaggcataccactgaggtaggcatcactcagagggggctgcggtttcaccttccgctggctctgaatgtcctgctggataatagggacccattcctggggaggaaaagagaaaatagtaatgtccttgactttcagctgccatgacccactggattacttcctgacacttactggggggactgcagctgcccaaggttctgtctcagctgaagctccatcctgttcatcccgggagcccccctcaggagcaggaggtggacctcgggacatggcctcttctgctgttgttccaggggctggggaagcattctcccgctgggtgtcagatggcgggaagagccaggcttcagaatttttagcctccaaacctttctcccccagccctccactccacattatctggcccctcaacctccccctctctagagtacctgaggctcaggggaagctctttctgctccctgaacttccattggctcctcaggaagyggctgtgaaattaaagaacaccatacttcctctcagatctctccagttctctcaagtaccctgaccccatcgcccaacaggtcccttacctgggggggatcaccaaccctgcgaacgtatctgagaatggcatcagggcctacaggcatgtgctccagtaccacctgaagcctcagtcccatcatagtggtcagccagctcaccaaggagggattcaccccacgagacatacgacgctgagggacagaaagcagatttagaacacaaaaccctcaaccacctttagaaatagattagatccaggttacagaatgtcagtttagaaaagaaaaatgaaaactgcagagaatggaaacctcaggaaacaaaaggctaaggatctggggctaggtggtgcttacaattcggccattgataacagcagcaagctccatctgctgtccccccaagcagtgcaggtttagggccaggcattcaaacaggccttggttacacaactccagcaaccgggccccaaatccactatctgtgggcaaaatacaaggagggaatgctggcacgtggcagccctgcacatgcaacaggccccacttgcccccgcctggccagcccctgacctgtgcaatgcagcacatgcgcagcaatgctattaaactgctcttggagaaattccaggtttgtccggatgatgtccacacctggctgaacctgcaccaaggactgagagacaagataacacaaagatcccaaaatcaagaatcataagactgggagtggaggaggcagctgcctygaccagacccaggagaggaaaggaatagagaagggttactcacaaaactctcccgcacatactcttctagccccgtgatcaatgtgtgggttgccatctgtggaggaaacagaacaggtttagttcaaagcctcagtcctcccaagacttccacctcgaccccaacaagtccagggcttgtgtgggggcaattggagctttacctggcagagaagcagtcagaaataaggaataaaatgtgcaaaagaggagagttctggggcccctggccttcatttacccggatgttactgggtgtgggctcctgaccacccaggtagtgctggtggaagaaggatcgcagctggggctggagccgttgtagtggctggaaatgcccatggagaagcatcactacgtccaccatagagaagttctggcacagaagagaaagcaaggccccaaagaatcctgggggacaagggcagatgttagcaatggcctttaccacctggcctgcccacccacaaccagatcatcaacctcatcccaccttggcaayacccctaaaccaaggccatctacattcctctggctgccccttcctggagcaagccaaagcatcctttttgctcaccaagggccccatcagctccaggctcaaagatgttgctggatccactgaggcgttgtatgaaggcagcaatactttcactgctgccagcccgagcccccagggagcccagcagggagctgagcacaccctgcaccactgaggtaaaaaactccggtgacaggctctcaagacccaggcctccaggactccctgcgccaccagaaggggagcctggtgggggcatggtctgctgctctggggcaggtggtgggggtggaggaggtgggggtggtggaggggctgtctgtgttgcctggcaaataaagaacaaagaacagaaagtgaggtgagaatgaagacacacggaaataatacggcatcaagagggcacaaaccaacgggtctgggaagatggggagttacattctgatcttcactgcttaaagcagaagtatggtaggtatttaacagagtcaggcagcacaacttacctacctcttcctctgaacaggytgtcagaaagcagtgacactaattactatactttctttttctaaacctcattttcttcatctttaaaatgaaaggttcagagtcaatgaattcccagggccccttcccctaacatgtcactaggggctcttacccagtggttatrtaatggcaagaaggtaccactgcctggctgggccgggggacaggaagatgaggtgaatggcaagccagccactcacctgcaagaagtcagtcatgccttggagaaaggcagggacaccaggcatcgccacagtgatggtgggagaagccacaccagrccctccagcccctggccctgcaggccctagcaggttccccagaagctgagagaactgaagatcagccatggagggttgaggggtgggtggaggctgggcaggccccccaggagcggggccagctgtggtagctgtgttggtggtgccagcactggcagaagcagtggcaggggctggcggtggagccatacctggggtcccctgagctgtaagaaaccaaaaaaagaaagctgggctgagcatggtggctcttggctgtaatcctagcaactttgggaggccaaggcatgagaactgcttgagcccaggagtctaggccacatagcaagaccccatctctaccagaaaaaaaaaaagacaattactagccaggagctagtactgctagctactcaggaggctgaggtgggagaactgtttgagcccaggagttcaaggttacagtgagctttaactcactggattgcaccaytgcactccagtctgggtgacagagcaagactctgtaacttaaaaaaaaaagaaaaaagctggccgggcacgatggctcaagcctgtaatcccagcacyttgggaggccaaggtgggtggatcacaaggtcaagagttcgagaccatcctggccaacatggtgaaacccccttctctactaaaaacataaaaaattagctgggcgtggtggcgtgcacctgtagtcccagctactcaggaggctgaggcaggagaatcacttgaacccgggaggcagaggttgcagtgagccaagattgtacactgcactccagcctagcaacagagtgagactccatctcaaaaaaaaaaaaaaaaaaaaaaaaaaaagctgaaacctgaagacacaagacactacagcagccccattccaggaaagcaggaaccaagaaaatatggaaagaactggaaagtgccagtgagcagactaggaaaggagtttaaactctgagtggggaagaatgaaaactcacccacaaggactggctgcataagaagctgccccacaaggccgctcaccatctgggccaacgaggcattggtacccagaccrgcgccctgctggatagagagcaagggagaayttcagacctgcccttccatgcaccaccacaggagtctctccctagactgttacgcactagaamtccccgacccttgctcaccagtgtcccagagactgggggccctccaggatgggaaggccgagcctgtggaggagtgggccgggcaatcaccacccgggttggagctgttgggaagcctggcacctgctgtcctgtgggtggcagaagagacagaccgaagagggctgagggccaggcccttgccagccagctgccaccatggactgtgccctacctcccaagcctccccttccaggtcattacctgcggccgcggaggcaacagctgccaccatggcctgatgagtgatctggtgggcgacggcgtgcatgaactcagggggcagggagggcagctggatgagggtggagcctggggggcgggtctgatgtaaccttgaacctggaccccttcaacccacccacwcagcccttccctttctctacccagagctcagcctgccctgatgccctcactcttacccagggtttggccatgaccagggggtcccagggggccagtgggagcactcggaacaccaccaggctgtgtgccagaatctgggcagggagacagagacagtggccctgaggtaggtagggccaaggcctaactatatccttctgagatcaggcatacttcaggcccataatcccccaatcagaaagcctgcctttccctccatctaaacagggagaggtactcccttcaccacacaaacacacctccaaagacaaaccaacccccacaccccccacatctgtctacttaagcttctgctctggtccccaggctaccaccaccagcatgtgcctctcccttccccaccctgttccctcacacctcagcatgaacctccctcatcatgctgatcctgctcttctcgccagcaactattctcaccttgaatgttcatgtgcatcatgaccacgggttccacactctggtgggaaatccggatgaccctygggtggctggtggctggcgggggagctggacctggcgggggagccccctcagctgaggactcgacattggtagaagacggagccacggatgaggcctgcccaggaccagggggaggtgcctctgcattgggagttggggggggccgagtcccatttcctgtcatggtcacagtggttcccacattgatctgaaaaagacagatggacaggcagatgtgagaaaaatacaagagcctaaccaagaaaacctcatgataaacctctaaagtatctccagccttcatcaccatgtttccagtctcctcctttcctaacctccttcaggcccagtagctaccctgggtcactctatcaacacccctcactctccctcaggccagactccccctaacccacctgtatgggaatggctgcctgctggagcaccatgggggtggtgtagtgagacataggccggaccacatgcaggtgtcgtgggggcgtgcaggccagattgcagcgcaggtcagacagtgcaacaaaggtgttgcccagcagtcgcaggctctcccctaccaagttgatcaaccgctgatcctcctcccggccctcgtgctgcgcacaaccagccaaacacaaaaaggcagaaaatatcaagctggagtccatctcactaataaaagcaataatgcctactgagaataccatgtcctccaaaactttcagttatatccttggaagtttacatgtagaccaaatctttgcaaataaattatatcttattcacataaggaacatcctattaaaacactactatgaatcagtaagtcatcatatactgatctcctgtactttacattttctaaattcattcaggggcacaaggggtacgatacgaggacagtgcttacagcaaagattatcaccttctctgtaagggaggacaaaatcacttacaggtttagagagaaaytgttttgttgcaatgtgtgtttttttgttttgttttgttttttgagacagtctcgctctgtcacccaggctagagtgcagtagtgcaatctcggctcactgcaaccccctcctcccgagttctagcgattctcctgcctcagcctcctgagtagctgggattacaggtgtgcaccactacatccagctaatgtttatattttcagtagagatggggttgcaccatgttggccaggctggtctcaaactcccgatctcagatgatccgcccaccttggcctcccaaagtgctgggattacaggcgtgagccactgcacctggccctgttgcaatgtttttccagggagggaaagagttatctgyatttcagcctgttctgttttgggagtactggggctgaggagaaagggcagggccatcaaagggctcacattgttattgtagtccgtggtggcagcagcacccagaacctcgtagtagcgctgcaagaagggctggaggcgactctccagccgctgtagctcctggagcacctcgacatactccgcaggggaaggatggctgtggacaaacccaaggggcaatgagccaaagccttcctcagattcccaccctcacagtcaacagggaccacatgtgccctctttctccctggtctcccagagccctggcccaatccttctctggaccagcagagcttctattctcttcaacctccgcctcccaggttcaaacgattctcctgcctctgcctcccaagtagctgggattaagttgcctgccaccacacccggctaatttttgttttttttttttttttttttttttgagacagagtctcgctctatcacccaggctggagtgcagtggtgcgacctcagctcactgcaagctccgtctcctgggttcacaccattctcctgactcagcctcccgagtagctgggactacaggtgcccgccaccatgcccagctaattttttgtatttttagtagagacggggtttcatcatgttagccaggatagtctcgatctcttgacctcatgatccacccgcctcggcctcccaaagtgctgggattacaggcgtgagccactgtgcccggcctgtattttttagtagagacagggtttcaccatgttggccaggctggtctcgaactcctgacctcaggtgatctgcccgcctctgcctcccaaagtgctgagattacaggcatgagccactgcacccagccaaagcttctattctttactcccacccatgagaggatagggagaagaaaatgaactgctcccaccctccccaccacaatcctgcacctacaatggtgaaagactaattctaagaaagagagcaggccttcgtgaactcagaggagaattccgatcaggctcaggagataccatttggatttccttgccatagggagagcagcagttcttctcagctgcctgtcctagcgtcatttacctataccgagagagcccctcctcgcccctcaatgctaacccttcaactaagacctccaagtaatcctttccctcccttgccatggttcatttccttctccccatacttcacttaggattccccacccactaaagattccctccatctctcacttgggtgcatttgtttccggggcaggtgttgggcccgctggggctgggccaggagtgagctccgggttctgggctggggcacgctcctccacttcttctgcctccatgggctcccggggaggtgcttcactttcaactggttctgaygtttgagagctcaaggctactggctccggggtcacagccggtggctgcgggggcggctgactgtgctgcggttggggccctcctcgacactgaaggtaggggagagtcaggataccaaaggcagggtaagactgctgcagaggattactctacaggagactgaacagagaaagtatcctaactagactccctgaaggcatggctctgcaattttatctccgactcgctagcaactagcataagactgacacaaattagatgcataataagcatctgtaatttttttttttttttttgagacagagtctcgctctgttgcccaggctggagtgcagtggcatgatctcagctcactgtaacctccgcctcccaggttcaagaaattctcttgcctcagccttctaagtagccaggcctacaggcgcgtgccaccacacccaactaatttttgtacttgtagtagagacagggtttcaccatgttggccaggctggattggaactcctgaccacacgttatccccctgccatggcgacccaaagtgctgggattacaggcaggagccaccacacccggccacagcatctgtaatatttgtaaataaatttctaacaaagagtagagattgtggtttcctttcctccacaagttggtttcccagcctccacaagttaagagagtagaatcctttaattgaaaagagatgccatgagactaagtctgaaacaaactccccagataccaggcaccaagaggattggcagaaatgagagagcctcacaaagatactttttctgcccaaaagaatgaatactgcagagaagactagattatgaaggccaaaccctgtggatgtggccagtgaagccctaactcccaggctgagagaaaagggagagggagggtggagagagaccctagccagccttgcccacttacctccatccgggatagtaaggtctgtatatccctgatcatgtgctgagccatcaccagccgtacccggggctcactctacaatgagagaaggtttatcagggtaggttrcagatgaagccatgagttctaccacctactaaatcaggtcccagccatctctcagccaggtccaccccacctcccagcctccttctcccagatccccttccctgaccctcggaggcccctcaatacctgaatcggggcctgttccatgttgatgtgaacatccacagcagagccgtcactctggggaaagggtaagggaagttgttctgggagaagccaacactaaggcctccacacctccaattcattccctggagccctacctccttttctccttaaagactgagaccaatagcacaccacagggccccctgaacccaatctaaagatggaagcatctatcttattaattccctggtgctaccacaaccaaagctacccacaaaagccctcccctgtggaacataagcttacaggaagattgaaggttccaaccatgacatagctgttggcattccggtcatgaacagaggccccaggcccccgagtaccagggggggatcccccaccatgagtggctgaggcagaccccgtcccagaagatgccccagaagggaggtgagtctgaggaggagcccgttccaccaggtggataacctttcccccaacatctgcagaaaaatagacacacaccaaaacatagtatgaacaggtaaacccatggcctcagttcatccctccagacagtagccccaacctctgaactgcctccccagcccccttactgtattcctgaagcttcttatcatcttgcagaactcgtccctggtaaatgagccgttgtttttcagatgggatgctgacagaggcagcaatgtgctccttaaactcttttacattcatctgaaaagaagaggcatgcacaggaatggaaagaatggaggaaagaggaagaacaaagacagacaaccgagttgtggaggtgaggggtaaaaaccaccacagaatcactacccgtttgtcttgaccgtgagatcattactgtgcaaacccttaaactaaagtaacagctgtcaaaatacagacaataaatttggcttggcgcggtggctcacacctgtaatcccagcactttgggaggccaaggcaggcagatcacattaggtcaggagttcgagaccagcctggccaacatggtaaaaccccttttttaccaaaaatacaaaaaaataagccaggcatggtggtcgcctgtaatcccagctactagggaggctgaagcaagagaatcacttgaattcgggaggcggaggttgcagtgagccgagatcgcatcactacactctagcctgggtgacagagagggactccatctcaaaaaattaaataaataaacttaatgaagctcaggttatagatccaggaaaaataacacggatgaaaaacaaaaaaaaaacacatggacattatattatctgtctggcatccaagggagtatgtgtctagagacatcagtgacccctttccaaacacaagatgataccagtttatttaccagactctcctgtgatttccaagattaaaaaatggcaaagaagatggggtctggtatcaggttaatgaagaaagactaagaagataagaaagcaaaaaaggtcccagcacagtggctcacacctgtaatcccagcactttgggaggccgaggcaggtggatcacctgaggtcaggagttcaagaccagcctggccaacacggtaaaaccctgtctctactaaaaatacaaaaattagccgggcgtggtagtaggcgtcgtctgtaatcccagatactcaggaggctgaggcaggaaaattgcttgaacccaggaggcagaggttgcagtgagctgagattgcgccccagccctccatcctgggcaacaagagcaaaactccatctcaaaaaaaaaaaaaaaagcaaaaagagaaatatttttcctaactacaaactgactcttgggaagtaccagagtatttatatacatctaatcacaagtctatatatggctttcttatatccaggtaatatcacattttagaaaaccatggaccaccccacatgcaatttgtctccaagtattacaggagtaaagacacagatagctatgtccaaggctttaagctcaagagactcaagctatgccataaaaattagtaatttcactcaacagtctatcaaggacctatctccattatgggttctgatttctaccctttaaaaacacagcatagacctgaccaatgtctatcagtaagacacacttgcttagggttcctgtgctgtttcccttcccaaaggccagagccatgcctgtccctttgggttggggtccacccatgatgatgacacacagattcttccttcctctgtatttccctctgcattaagttctatccatgtggaggacagaacaaaatcagcctcactcacaaaacatcagaaaacgttctactggaatacraacaaagggatcaataaaaagaaaatctgaggccaggtgcggtggctcatgcctgtaataccagcactttgggaggccgaggagggcacatcacctgaggtaaggagttcgagaccagcctgaccaacatggtgaaaccccgtctctactaaaaatacaaaaatcagctgggtatagtggcacacgcctataatcccagctactcaggaggctgagataggaaaatcgcttgaacccaagaggtggaagtttcagtgagtcgagatcgcgccactgcactccagcctggaagacagggcgtgactccatctcaaaaaaaagaaaaaaaaagaaaatctggtgaccagaaaatcaagctcatctctcaggctaaggggcctaaacgaggaaaagctaaaggtgtcttccagaactagtgaggtgtctcacctgggcccccacaataaaggtacgagtttgagagtccaaggtcttcaccaacacctccaagctgtcaggctcctccacagcggtactggtactatcattaggctccatggccgacaggtctctaaagaagaacgaaggaaggaaggcccgctgttgcccagaccagagtgtacccgaaagactccctagcattaatccctgccccaatacctaaaaagtttctcctgcacacacacacattcacacctgtccccatcccccttctgattccggggcacagggagagaaacacaaagggcaggagatcgacggcttagggagctggaggacgagaggtgggaggggctccacgacgccaatcacaataagcagggagccagtcagattaggaaggaagcacgagaccagagactagtgtcatcaccggtcacggcaggacaagcgccccagaggtcggaaaatcctgggacaacgcgaaagcggtggtcgccccacactctgcggagaaagtggtttcgcgcacgcgcgccacgcccatcgaaccctcctaactcactatagacccgaaacggcactcacggggcgacagacctgctagctgactgcccgcgtctactgccttcccacggtgttccagcagaacggcacaactaacccacagccaaacacacacacacacacacacacacacacacacacacacacacccaccaccccgcggctccgcccccgacttccccacggaccgtcacttccggtctcccccaaacctgccaccgacggccacttccgtttccccgatagtatttggggatctcgaagcgatacttccggctccccccaggtccccaagctttacttttgtggggcacgacgagaaagtccgcagccccaaacagtgagtttctgagggcgagtcgggccggggccggcctakgtgggagggagccgagcaccccgaggagccgccaccgctgtcgcccgggggaccgtactacgcctgcgtgcgtcgcactacggatgcgtggacacttaagcatcgccccaccccctcccccctctggcggcgttcacgtctgtgcgcgcgcttgagcgctagaagattgaggtggctaccgtaaatgcctgaaaaacagtcaccagctgggactctaccactgcctcgagaggggctatggacggtcgtatggaccttggactttggagatgggggattatgccacattcatctatgtttaaatcttggcaggctgataatttcaggcggcactgtcctagccagctaaaactcttctccaccctattgccctcgctgcgccctttcttctgtgcctccggaagttactctttcagtaggcgtttgggggcggcactggtcaattttgttctcggttgcttggttgggctagatttcggttctgccgggtgggcgttttaagggctgtgggcgtcacattcgtcggtgtgtggccaaggggacatgacacgttttaggaaaagt

SEQ ID NO: 17794 - DNA, 60844 bp, Homo sapiens
tagccagaaatggacagaagctatactataacctcactcagaggtggctctgaagaacaatggtaaagggaaatactggcagtaggcagagatgggatagtacctttggtcattcgtggactgtatatggaaacaagtggaggtatagatatacatggactcctgggcaggggcctggaaggaacaagactggaaaatcagaggcaaggatatctggggtagaggcatgtggatggacacgatgtatgttaatgtccagtagagaagctctaccacagggaggcctacgactatcaagaggacattagccagcttctctccattggccacatcagtgctggtgcaatgggtggtaggaatggagaccacacatggacagatagttatgagaaccatttcagaagtctgagatcgagtactagttgtccatagtgtggccaaatcaatgaggcatccttttattgactttccttcttttcctatttctcttctctttgttcctcaacctgttccctcggatcgcattcccaaataacctgtcgcaaacaagcccttgttccaggctccatttgagggggaagaggctaagttaagctactacccatttacaattgtaacccctgttcacactcctagcctctcttacacggctctgtttctttttttccatataacctatttattatgtctattgttgattatgtttctctcccactaaaatataagctctgtaaaaacagggatatttgtctgttttggtccgtgtagtgtccccagcacctagaacacagataaagttgtgttgaatgagtgactaagtgattagagctaatgtatgtacatttagatgctaaatatttagaacatggtagaaaattctgggcctcaggaaacacaaggtttggctgtagctggtttggagactgtggtcaggactgagaaatttcgggattcaagagactaaggagtgggtttggcttggcccaggagcagggctggtccaaaatttagagtctcgtagaaccagagcctttcctgcccgtggtgccatgtttcagccaaagcctttatgcttgtaccacaacccacccctgtggttaagagcccagggtcttcatccaaacagacctgagttcagagcctacccctactacttcttagttgtgggatcttgagcaaactacctctctaacttcagtgtcattatctgcaaggctgtgctaaggacacattctacttggttgagttgtaatgagaactgagggttaaggttccatataaagtgtctggcacaataggaagtgctcactaagtacccgtcagcattaaactttcccacgtgccacatggtgagggtggcggcctttcagttctaggtcctctcttccttctggtgggagagtcgggcttccctcagtaatgttgcttattccaatttgttgggtgaaggtcagaagagagatacagtctggatgaaaaactcctgagttctccacagggtgcagagccactgggtgtcccttgcaaattgagttcacaaggtcctgctccaagagttctaaataaaaatgagctcattgatttggacacccagctgggtgcacctttcagcttcatttttgaaacttcgagtctgtgaaacatgggctgcctggggtgtatcatgtcaatccagccccagcaacactcacatcatgctgtcttgcctctacttaccctgtgccctgtcaagagcacccttcccgccaccctacacctgagctacctgctgaaacctaccaacgcttctgtttgtcctattctccctttcatttctttcttttcgtttcctgccctctttggctttacagcaggcttctctccccaacaagttccattttattgttcaactagtttaacatgcatgtttaattgaacaaggtcaaatgctagtcaatattttgccctcccaccaaataatagacctttcccactctgatcactcctcaccaatttgttattgttttatggttctttagttttatctcattttttttttcttttttaatttttttttctttttttttttgagacagagtctcgctctgtcgcccaggctggagtgcagtggtgcagtcttggctcgctgcaacctccacctcccagtttcaagtgattctcctgcctcagcctcctgcatagctgggactacagatgcgagccaccacgcctggctaatttttgtatttttagtagagatggggtttagccgttttggccaagctgttctcaaactcatgacctcaagtgatccaaccacctcagcctcccaaagtgctgggattacaggcatgagccaccatgtccagcctatttcatttttttctaactccacaaagtggacatttttgtaattattttatgctatcagtgcttattaaatccacttctgtgtttacatatttctttgctcaccattcttacttgaatcttagacttttttttctgagattatttttcttgtttttgaagaacatcctttagaattcccttaggtgagagtctgttagctataaatgctctcaattttcatctgaaaatgtgtcttttaaaccttatacttgaaagatagtcaaggttgacagttatttttttattagtactttgagatgttgttccatcgccttctggctttagttattggtattgacatattagctgcccatctacttcatcattcatccatcttctgtctagtgatcagcagttttgctaccaaaaatgtttggtgtagatttctttttatttatcatgcttgggttgggggagcttccagaatctgaggattgtgtctttcatcaagtctagaaattttccattttcttctagaactctaattagacatatttaaatccttgttccttgtctatgtctcttagcctctttcatattttccaccactttgtcctcctgtgctccatcctgggtaaattcttcaaatctattgttcaccccagtagttgtctcttcagccatattaatctgctgtttatttttatgtatgtatttatttatttatttttgagacagagtctcactctcacccaggccggagtgcagtggcacaatctcgactcactgcaatctctgcctcctgggttcaagcaattcttgtgctacagcctcctgagtagctgggactacaggcatgtgccacctcacctggctaatttttgtatttttaatagagacagggtttcactgtgttagccaggctagtcttgaactcctggcctcaagccatcagactgccttagcttcccaaagtgctgagccttaatctactgtttaatctgtacactgggcttctattttcaaaaattatgtttttacataactgcttgctttttttccctcaatcttcctggtcactttaaatagtctcttgttccttatctatactttcaattaccaacttttaattcttgaagcatatgaaacatccttattttatattatatatactgcaattccaacatctgagatgtgttcgaaggtctgcatttttagtttattgcttggtgctcctctcacctaaagcaccttgtgtcctgtgttttatgatttttctgttttacaaacatgtgaactcatgttccatgggagtttttctgtgggatttctttgagtcatgaatataggatgagttactccagagacaatttttatcatttgtttctgccacgtgcctaaggagctattatttaccttactttaaattcttatcttatctttttgtttgtttgttttttgtgtggttgtttttgccacaaagtcaccatgagtttcacctccaggcctattagtgggtagacttgtggtgaggggcattcagggttgacatttatttttctcccactcagagtccatactgagttgggcaagctctgtgtcagctcgctttaaggaatttttctctccgagttctccactgtggatgttgtatttcagtgctctttgtttaaggcagaaattttggattttgtttttcacttcgattttgtttctcagctttaacttttgtccatgttcataagactgaagctcttggtcaactggatcaacagatacttctctgctggctgtgatctctttggatttttgttgtctttatatattaacatatacaaggtctcactctgttgcccaggctggagtacagcagtgcaatcttggcttattaaagccttgacctcctgggctcaagcgatcctcccacctcagcctcctgagtagctgagaccgcaggtgtgtgccaccaaacctggctaattttttgcaccttttgcagagagagggtttcaccatgttgcccaggcttattgtcgtttttgatctctgatgattttcttcatttctcaccacctcagctacacattttaaaagatggtttacaatatttttgtggtgttttgtattaggagaattcttcagcatctgctgtctaccatattgtcagaaatggagtctagccatccttcccggcccatttcaaacgggttcctcttaggaccaggagacctcacattatgtgtgtcctaccttggcctgtggtttggtcacttgtgtgtgtgtgaacttcatcctccttgagggcaggaatatggtttcctctctttcgcttccacagagtcctgtccagagttctgcacaccaagactgtgtaaatgaatggaattgcatctgggagctcgaggcacccatgcaaacctgtgctgccagtgacttccaccagagggcagcggcagcaggtgccggcgctggggcaggactgggaggagtctcactctgggggcgcctggttccccgtggctctaatacttgccgcatcaaatgcatacacccacctttaggaccgaacccaatggaggaggaccgctcctcattccacatgttggggaaatgaagacaagcaaggatgcaggaagtggagggccaggagaggtggacctgggatgggaccaactgaggcagggccaggatttggaaccaaaccccttctggatttgaccacttccagggccctgcttggacaaccaaattatctattccttttctcattcaataaacatttattcacctcctaccatatgctccacagggagtaccatgggaattaaacacgcttggcccctgccttcttcctatagcgtcagtctgctgcagtgcaatggggcaactcggggtttctcaggcagccctgggcttccttccttcagccctttgctcctgctattccttctggcccagaggcctcccatgattgctgtttgtcaaaatcctgctcagccttgtagacccagctcccatgcctgactcccacggaggcatgcccagtctggtacctggagatgggatagctggccccactgtgccatctgacggggcggctcccacaaggccttggcacccttccctgtagaaggacttgtgggatggccatctctcaggcccttcccaatttatatttctctgaggggagacttaggctcttatctccaaaagtgcatcaagaccacaccctccttcccaaccaccattgcacctaaggttaagataaaactcaggatttaatccaagagagccaaattacacagaccgggacaggcaatgggtcattcactccctcttccaatatgtactgattgagcagctactacattatcaattttttcttctgggccaccagaaatgaggcatggctcttccacttcccttcttcttagaagaccctcggggaagtgtgtctgcatggatgcgtgtgcatgcgtgtgtctggctccgtgactcttggggtgcagcctggatgggtgggctcccagcacaggcagctggggctctccccaccagcccctgtaacagcagcccagcttcctgcagaccaaaaccacaagcagaacaagcaggcgtgagacactcacaggttgggtttgatcgcatgcgtgtcggagaggagagagcagagagagacacaggaacaagaacagcaaagggtagagcagacctgcgccaggggcgcacaacggccgtgtccacctcccggccccaagatggtgcttcccacaggcagccacgcgtagcagccagagacagctccagacatgtggctcttcttcgggatcactggattgctgacggcagccctctcaggtaggcccccttccctcatctcctgccactggtgctggaggagccgggtccggccctctcagtcccctttctggttgtttccttgtggtcacttttctaggatcttttagccaagactacactcaggtaccagggaggtccagcatctggggctaggagaggacacaggagcccctcgaggggctggggctgtgcctggaagcctcctggagtgacagaatgtgggaagcatgctttgtgccttaccaatgggtccctagggtgtgaggagggaggtgcctctcccatccttaagctcaggaactcccccatttcctatttcttgccaactcttaagaaggaaccgttcaccttccagagaggcgggaccactgatggtggtactttcaacgccaaagctgaggcttggggtccagcaggcgtaggccaatcacaggagagcaccgcccgaaacaggactcagggaagccagggagagttctggacaaccaggcgctgatggcctcagcacaaccagctggggtagtctagggcataagcgagcatgaaggccacccccacgtctcaagctgcccccaagtgtcaaggcacctggccacctgggccagggaatcagatggccagaaggtttggggcactagactgtgctccccagatacttgctggcccctgttgagtgcagggtccaagctggccagagcggggcaggggcctggagatgcaagagatcctgaccccatcgagctctcacattttgggatttgggaagactggtatggaaacagaattcgggccaggggagtctgggtccaccttgcagccagagagccaagtgctttcattttgtgatggaggagacccaggaagacccagtcaggagggggcatcgagctggtttggaggactgggtacatgtcgcgagactctgggcagggagtgctctcctctctgccttgatctccaggcatgtgttccgagcctgtggcctcatactggttcagggaaagccattcggctctgggaactggagtttgtgtgccttcagctctgtgcatgtagctttgccctgctaactctaccaggagtttctggagcagcagctctggaatttcagctgccttctgcccctgagctgaaacagactgtccgagagtggccccctttcctcttccccatgaagccc[450 bp omitted]ccataagtgaaaggtaaagggaaacataaaaacaaatggtggcaaaacccaatttctattacgctttagcaaaaagtgaaaagatcgtgaagacccagagctcatcccctctgtgaaaggggtgatgaggaggggagaggagatggcctcctagctctagcaggtwttttcttcttgactttgcagaaggactgaaaacaccgtgggcagggaataatttcctcactctgcgatttcagagcattaaacgcggcttctgtaaactctcctgagggttgccaggggtgtatgtcctactgctgaaaaatatggcctctccaggcaggaggaagactgcaccttcaagcagccccttgcccctctccggggctgatgcaagggacactgagctgctacactccaggcctccctgagcttttcttcctctgtgtccagctcagcaggcccaaatgctagcagaacctgacctcagagggcaaggttgacccacatctgcttgtggggagtttgtgttgggccgaccatattggggaaaggagactaggacctccaaggagaaaaagaaggagaaagaaaaatgatggcaaagagggaggaaatggagctgggataatgaagtgcgtgtggaagtttcaggcctttaccccaagaactatttcagggtggggctgcctggctctgccctgggaccacaggcaggtggaatcctgccctcctttgccctggcagacctggctgaaaccttgctgtgctcgggcagacctcccctctccttcttcccccttttattttttaagacagagtctcgctctgttgccaggcttgagtagctgggatgacaggcatgcgccacgacgcccagctaatttttgtatttttagtagagacgtggtttcgccacgttggccaggatggtctcaatctcctgacctcgtgatccacccacctcagcctcccaaagtgctgggattacaggagtgagccaccgcgcccagcctccttcttccctttctaaccctagcacgaggccctatctcctgggcctctgcccaggtggcccgggtgctgggcctggcttggtttgtgttgctgatttctgttgcttagagattcaagcctccagttctccgcctcagtttcctgatcagccaactaaggatgaaggaacagagagaatgaattaggagcccttgacaggggaggctggggtggcatcatgagaccccaggttctgccctggtcccgtctctaattcaccattgactgtgcttcttttcttctcagccatgttttctcatcagtggaaggggggtgctctgtcagacaatctataagaaagcttttgtccagatctgacactatgacgcagtaacaaagccccaggcctttcccgccagggcagtgctgagctccgtgactctaatgccagctgtgctctggctggcgaggtcctcgagggctgcctttgtgtatgaaaaggctgtttgtggctacttttgaaaaaaatagtaattctttaattaacaattttttaataatttgttttttcttaacttgtgagttcaacatactaatcatattttataagccctgtaattttgattaatgactttcgatgggcctttaatatttgagcaaatgaagttgaacagacctagcatccttaaataataaatacccttacaaatgtagctaatcaaactcccttggttctgtgctattccatagggtagcccctacaatcacgcatttaaaatgtgatggtagtccaaattgagatgtgtaaagtgtaaaatatgcaacaggttttgaagatgagtttcaagaaagaatgtaaaatatttcaacaaattttatgtgatttatatgtcgaacttataatatttttgatatgatgggctaaatgaattctattatcacaattaagtttacatattcctttttactttttaaaaatggggtttctggtctggtgtggtagttcacacctgtaatcccagcactttgggaggccaaggcaggaagatcgcttgaacctaggagttcaagaccagctggggaaacatggcaaaaccccgtatctccaaaaaatacaaaattagcctgaagtggtggtacaagcctgttgtcccagctactcggaaggctgaggtaggaggatggtttgagcccgggagtttgaggctgcaatgaatgagccattattgtgccactgcactccagtctgggcgatgaaggagaccctgtctcaataaaaaagtagggggagggttgtcctggaatatttaaaattacatgcgtaacttgcatcatatttatattggataacactgcttttgatattctaagcacatttataaatatgatgaattccatattttatagagcatgaaacaaaatgttcccaagaattttagaaaatgcttttagaactaaaaaactagcataagtgaagtgaatattaagttatttttaaaatttttatagatatgagggtagaagtgcagttttgttacacggatatattacgtagtggtgaagtctgggattgtagtgtacccagcactggagtgttgtacattgtacccaataagtaattttcattcctcactcccctcccatcttcccaccttttggaatctctgatgtctgttactccattctgtatgtccatgtgtgcacgttgtttggctcctacttataagtgagaatgtggtgtttgactttctgtttctgagttattaaagcgaatatcaagttctcttaaatattctaatgtttacagatattgtcaaattctcttaaattttctacttcaaaattgaaccgaagtcaattacctgctcacattcatgaggaactcaatggccaaatgtttttaaatatcacaaatataggactttatgcaactcacggagcttgacccaacttacatttaacaccattggatatatactatgagtgtttgtttatttaatcatctctattttctaaattctaatcttcctgggtttaaaagccacttaccaaggaggaaacaatggcgccattgcaggtaacttgggttatgccaagcaggttgaagtttttccatctcagtggactgagctgaggtcggtgtttttgttgttttgccaaaacataagatatggttcccctgtgttgctgatggatgcgcttgtgccctttttgatagtccgtgccctctaactgggctggctccttgacctatgaactctgaatccaagttatacaaacctaatcccctacatctgccgtgcatctggccttattgtttgattggactgaattaaacacacatgtttacttttctattctgacctcttttcacattcttcctgcctggcaagacttcatctcatagatacataaataatttatgacaggcttctgcatctttctcccggcttagcttggctctctggccacaggtcaatgactgatgacagttagcgtggccttcaccgtattggggccatggaacggggtagctcctagggtgctggagctcgaactttacagagggatctagaatgagtgagaaatgctgcccatggccctcctcattcagaccacatttattaaggctttatttattatatttatagaacactcaagaattaaattcagtacccagctgttagattctgagttaaggaatcagacttctccctggggcaaggaggaataaacaggtggccccaactgtcctttaggacaggagcttggagtgtagacctcccaggtgcgtggccatcctctccctgcctggaccacagatgggacaccatgagctttaacatccatgccatgtgctcaggcctgccctgagcagccccctggtagggctgggatccccaggctgtatctacttcctcagctagcaagacctccaggccctccatcctgtcctcggcactggcccttctccagactcagagcatggtaagttatccagcatagctcttcccggagcactttattccagcccaccttcccagtgttggccaaggtgtcatccagctgacaatttacttaacgtaatttccctcctttttctttctttcttttctttttttttagatggagtctcgctctgtcgcccaggctagaatgcagtggtgcagctcactgcagcttcaaactcctgggctcaagggatcctcccacctcagcctcccaaatagctgggattacaggcgcctgacaccatgcctggctactctttcttaattgatgttttaaaatgcaaatacatttattttgagaagaaactttatatatcactcccttaaatggaaagccattcattataaatcaccatcatgattataatggtgaaaataaacataatggaaataaaacaatgttactaaattctagccagatgcatttgctgctttccctttcctcaaaagggagggctgtagatgtcagagagactttaaagactaaccccatgggagatttcctcctccaagtctgtaattagaaaggctgaaagggaaataaagagtatgcataacttcctcatcatgtaatatagtggtatataatgccaagtcaatgaccacctaaatcaattttgcatagttttgtgtatgtgccctagactttgaaaacactgatccagagaaaggacaaagggggtgggcatggtgtcccctgacaagactgagcctggggacgctgactgctctgcagcctggggttacgtcctacacatgagacccccatttcaggggctccccagtaccctgagaagtccctggattttcccagtgagccctgaggttggggggcacccgagttcacctcccttgattccgctctgggaatctaggcccctgcagcctggggaggagaaggaaccttgaggaggggtgaggtgggtgtggactttgagaactagctctggtcctaacttgctggggaatcttggtcaagttccttcctttctctggccctagtttcctttctggaaaactgggtaaattgaacactaaggacccagcctaaacatgcttgtactttatgtatgttccttgaggctttacaggttatggagcagggcatctggctgtacgcagcagagacccagccactagacacttagccctaggaagggcactgtatcaaccccagccggcatcctgtcgtatagaatcatggaccccggagtcaggcagacgcgggttctgaattgcatctctgcatggccccagggtggtttctttgcctgcatgctagagataaaaatccccaactcaccaaagtgtacaagttaatgtagatgatgcatctgaaaatagccgaacaaaatgcagtgctcagaaatgttagcttataaatgctctacagcaagaccaaagataatcccttgcctatgtgaatacaggactcggtggttaacatagtgctgtttgcacaatgagctccatcacccacatggtgacctcattttatagatgaggaaactgaggtttagcgaggctaagagacttgtcaggacctgagcttgggtctcccagccagcaggctggtgctttttccattgtgtgggagttgcctggcttgtttccagccagctgtcctgtgggctctattctagcatagggtttctcccctaaatgcaaactcctagccttgcagcctcaccactgaatctaggaacagccctgagggacctctgaggtcctagggaccctggaagtcttcttagcaacagatggggtcaagtgtggctgcctccctcatcatggcacgccctcatggggtttgcctgggggttgccctgcaccttggggccagcaggaaggcaaaattaaagaggcaccatgagccaggggagagcttgctgggcagcaggctccatattttgttttgttttcttttttttttttttctttttgagacggagtctcagtctgttacccaagctggagtgcaatgctgcgatctcagctcactgcaacctccgcctcccaggttcaagcaattctcctgcctcagcctcccgagtaaggggaccataggcacccaccaccatgcccagctaatttttttgtatttttagtagagacggggtttcaccattttggcaaggctggtcttgaattcctgacctcaggtgatccacccgcccgcctcagcctcccaaagtgctgggattacaggtgtgagccactgtrcctggcctaggctccatattttcatattcattcagtacctgctgagtaccaggccctgtgctggcactgccataggacatgaaggtttgcccttgaacagtttatagtgttgtggtaagacacaccagcaccaccccgggataggtgtggcaacaggcacaatccagtgacagctgcaaccaccacccattaccagggacttaatattctccaagcaccagctatgcatatgctgttccaccctgacaacaccaggacaatcaccccttttttatgggtggagaaactgaggctcagaaagttatgtattttgtcccaggttggtggctaatgctgaatttaaatccatgtcatgatatgtcaccactgggggaagctgactgatgggtacacaggatttctcttcactattttggcaacttcttatgagtccatagtttgaaaataagaagttaagggggaaaaaaggatttcagccctttctggtggctcacacctgtaattcagcacgttgggaggccgaagtccaagagttccagascagcataggcaacatagtgtgaccccccacgtttacaaaaaattaaaaagttagccggatgtgagattcatgcctgtagtcccagctactcgggaggctgaggcagagaatgacttgagcccaggaggttgaggctgcagtgagccatgatctcaccactgcactccagcctggacaacggagcaagaccttgtctcaaaaaagaaaaaaaaaagtatttcagaaagaaggacccatttgaaggccgggtgcagtggctcacgcctgtaatcccaacactttgggaggtcaagtagggcggatcacttgaggtcaggagtccgagaccagcctggccaatatggcgaaaccccgtccctagtaaagaaatacaaaaattagccgggtgtggttcgggggatggggggcacctgtaatcccagctacccgcaaggctgagggaagagaatcgcttgaaaccgggaggcggaagttacagtgacccaagatcgcaccactgcacttcagcctatgcaacagagtgagactctgtttcaaaataattaattaattaattaaattgaaagaaagacccatttgagcagaaacctggaggtgggacagcctacgagggcccggctgaggggaggtgctgaccagccagtccggctggtcctgttgggtcatgttgggtaggcaggactgaaattcccaaaggagctgaggtccaggctcttttctgcctcctgacccagactggtgtgccatgaggattcaatgagcgccaagcacagggactggcccacggaaggtgcgccacaaaatgtacatttacaagtgttaggcaggcagtacaaggatcacgtcctccagtgcagcactctgcaaatacgtaaacctgccttctcctcgtcacagccctaaggaggtatgcgctactatttaatacttccattttactgagtaagtgacaggctcagagagataaagtgacttttcctagatcgcaccactaatagatgacagatacttggttttacctcatgactccaaatccgttgctttttcccagccctggaattgggtagggtttgggccggggacccctccccactcaagactcctgcaggaaaggtccgcccttcccccagggacttttcacctcacccaccatcagctgggcygtcatggaactttatggagcctgagctctcctccttcaggctgagtggccatgcccagccttcgtttccccggctgtaaagcagggccaacgggagctcagagctgtgtggggctccccagatgttggcggtgacatgcttggagaaatgccaggctccttagggtgttaggagagacctgtggccacagctgctgctccgactgggaccgggcaggcgctcccagggacaacagasggaggcagagggaagcccaggttcccaccctccattttgtaggctcctgcagcccgaacgccttctgcctgaaaatggcggctgagagaggccaggaggcaggatgcagggctgaggaggaagctccggggctgggtctctggtccctgggagatgctgagagatagggagatggccctgtcataggaatgtggtcccctgttttcccttgtatggaagggtgcccctgggtctccaccgtgtgctagggggtgggggcacactcaaaagtccggccaataagtgtccaggccacccccaatctccatcaggaccctgagctgggctgaggtctccgggaggtgccagcagatgccagggtggcggggggggggttctgtgcatggggctggggacagcagatgcccgggtggggggcggtctgtgcatggggctggggacagcagatgcccgagttggcgggggggggggtctgtgcatggggctggggaccagggtcatgtggggacacaggctgtaagagtgacgaggggccttggggctaggggcttcttgggggtcccatctgaggacctcacttctgacttggagtcatgtactgagccctgtggcagggagaaggcagaaatgaagtcactgtgtcctcggagtcagatgcaaagccaagcgtgactctgttcattttacagaaggacagactgaagcccaagagcttaagtaacgccgccagtggctgacagagctgggagcagagtcacttctggtcactggggtttggagggaggatgtttatctgcacttcagtaccctttttgctagggtgttcacctctttcaggaggggtgcctgggagcaggcgggcgcggggagacagagctgaggaagccccccaggcctggaggaggcccgttccccactccayttggtgtgctctcgttttgcctccctccctccttcaaccaaactaaaggatgcacagttgccaaatggattcagctccttggagaaatatgttgctttgccgggatgggattctagaagtatgacaatgtctgagctggaagaaaccccagcgagctgccagccatctcctgtttgtcagaggaggaaagcraggtgcgaagtggggaacgacatgccccagggtcttggagcagggctgagaagcccagtctttccagggcctcttcccacgctgcccagcagggcatggcggggcctgtgtgaaccaggcacaggcttaactaactccccacccccacccctagagagaatgcgggggactgctatggcccagtgtggcctgacatggtctgacatgaacacaggtgaccctgggcagtgacatgctggcttcatgtagctactctgcccagcccctccaacggctcctccagtcctcaggctctgcctcctctttgtttttttacttcactttttttttttttttgacggagtctcactcttgttgcccaggttggagtgcagtgttgtgatctcggctcactgcaacctccacctcccaggttcaagcgattctcgtgcctcagcctcccgagtagctgggactacagtcccgcaccaccacgctagtttttgtatttttagtagagacggggtttcaccatgttggtcaggctggtctttaactcctgacctcaagcgatcctcctgcctcagcttcccaaagtgctgggattacagacgcgagccactgcacctggcctgttttttcacttaacttttaatttcaggctaatttcagacttactgagaagttgcaagaacaatacaaagaatttccccatgctcttccctcagactctccaactgctaacaattttccacatttgctttattatttcctctcaatgtgtctgtttttctattgctttccccctaaactgtttgagagaaggttgtaatgtccctttctcctaaataccccaacgtgtgtttttgttgttgttttttttttttacatacggacattttcttacataaccacagtgtacttatcaaaaccagataattaatgctgatacaattctattggataatcgacagaatttattcagattttgccaatggttccaataatatcttctaagacaaaagaaattttgttcagtatgctgcrtttaattctcgtctctctattctccttgaatctggaatgatttctcagattttctttctctttcatgtcattgatctttttgaagcatagagcagttattctgtaaaatggccctcatctgggttgtctgatggttcttcatggttccatttaagtcatgcctgtttggcaggaatatcacagaagcacgttttgtccttcccagtgaatcatatcaggaggcacatgggctctccatgtcccctctccggtggtctaacttgcttggctaaggtgttgtctgctagatttctctgctgtaaagataatttcctcctttgtaattaacatgtatcttgtgggtagattctttgagaatatgtaaatatcttactcttcctcaaacctttgcccactagttgtaacattattgttgattcttgccggaatcagttattataaggatggttacctggtggtgatattataattccaccattccttcttcattaatagttgctgactcggctctctttgctgcctccgtgggagggaggcaggtggctcagtgcatggcaggctggtactaatgaggccaaggtttgagctccctttccactgtgcctctggtggctgctgtcttgccccgcctcggatattggagtctgggtcagcacctctccaccttagggctagttctccctccatctttacaattttgccattcatttgttgagctactagtatgtgttaggcactttttttcagccactgaggatacgggacaaagtcccggtcttcaagaagcttctattctaatagggaaaatagaccaaaaacataaacacatttttaaaatagtatcatttcagagagggatatgtgcaccaagggaaatcaggcaaagtaaggggactgagagcggttgcactggagacacaggcagaacctcggaggggatatagacctgagtgatgagatgagctgggaatgctgagatcagggagaggacattcccgtcagggggaggagcaggggcggaggccctgaggcaggaatgagattgatttcagactgatggaggagtgaaggagatggagttggagaggctggcagggcttgagggcatagataatagggtttggaattaatccaagggaaatgggagctcatcagagagttttaggtgtagaaggatgtgatttcatttgcccttcatgcatatacaattacttaagaattttgtacatcaactcctttttttctttttttaaacaaagatatagaacgcttcacgaattcacgtgtcatacctgtacaggggtcattctaatcttctctgtattgttccagttttcgtatatgtaccgccgaagcttgcacccactcctttttttttttttttttttttttttgagactgagtttcgctcttgtcgctcaggctggagtgcaatggtgccatcttggctcactgcaacctctgcctcccgggttcaagtgattctcctgcctcagcctcccaagtagctgggattacaggcatgcaccaccattgcctggctaatttttktatttttagtagagacggggtttcgccatgttagccaggctggtctcaaactcctggcctcaggtgatctgcccgtctcagcctcccagagtgctgggattacaggtataagccaccgcacccggccaccctctccttttataaacttaagtttatttgaacttagaaatctgtcactatcatgtatctcaaaccaatactacttaagtaaatagaatatatatatatataaacaaagaaaacactgaaaccaaaagtgtcattaaatagcctgccgtccaagcatgagctgtctctccattcattaagaagtgttaggtggccaggcacagtggctgatgcctgtcatgccagcactttgggaggccaagacaggcaggttgcttgagcccaggagttcaagagcatcctgggcaacattgcatgtccccatctctgcaaaaataaaatttaacaaaaagtgttaggtgttaaagactaagtagcagcacaatgagactttctccttaatgcagtcggacagaaaaattggaaaaggaataatttgtttactgcatgattcagttccatttaatcttatatgttaaactgtctttctgactcagacctgatttgagaagcattttgctaactggtggaaggatttgacaggcccagcccacccatttaaccatggagaaactgaggccttggaacggggcaaggacttacccaaggtcctggtaatagctgctctccattctactcaccctcggtatcactcccacccaatgctagctgaaaattcagatgtgatgtaaacattagtcatccttattgtaaaaacgttataacaaccacattagaaggaatgcaaagagagaaaagaagtctcagccagcaccttcacacaacccggctgtttgttcttgaaggaggaagtttttgagtctgtggagcgtcatgggccttcagtctcaccagcaggaaggtgggtggctgatgggtgccgggctggtgttgatccacacttgtcaggtggctctgagaccagccttgactccaggctccaccacttccgccatgaccttgggcaagttcccaaagctctctgaggtaaaatgggtgtggccatgtcactcttcagcttttgcgctctaggtagatgctaaagccttccctgaagatctstatggaacttttagtcacctgcatctgtgggggctgcctcagccctaaccatgtcaacatagtgttgaaattcagttccgagaaacacttgtgggtttgtagactctatggcatctggaagtgaaagagggacacatctctccctcttacgggttccttcccccgctctcaacgcccctaatccagaatgccctagaagctcttctcagctcccaccttctgccccggaggcagcttttgttgcaggtacacctgtggtttagtttactagagttgctgcaacaaactgagtggccagggcaacagaaatgtattgtctctccctggcgccgtggcgcacagctgtaatccctgcactttgggaggctgaggcgggcagatcacctgaggtcaggagttcaagaccagcctggccaacgtggtgaaaccccgtctctactaaaaatacaaaaactagttgggtgaggtggcacgcgcctgtaatcccggctactcaggaggctcaggcaagggaatcgcttgaacctgggaggcagaggttgcagtgagccgagatggcaccacagtgcgagactccatctcaaaaaaacaaaaacaaaaacaaaaaaaccagaaatgtattgtctcacagttctggaggctcaaagtccaagatcaaagagtcagtgggactggttccttctgagaagctgttctcttctgagcttctggtggcttgctggcaatcttgggcatttcttgacttatagaaacattgccccaatctccgccttatcttaaaatggtgttcttatgtgcatgtgcctgtgtccaaatttcccacttctgtgaggacaacagtcatattgaattggggcctgccctgatggcctcatgctaacttgattgcccctataaagaccctatttccaaataagctcacattctggggtactggaaattaggactgttttaagaggaggggaacaattcaacaactcgtagcaatgtatgtagtgtgtatagggtgtgtgtgtagggtgtgtgtgtgtacatgtatgtatgtgtgtgtggtgtgtgtgtatggtgggggggtatggagaaagaggtgggtcactgccctacttaatctctcctcctagcccactcatcctctggagagatgcaagttagatatctcaggttatttggcaaaggcctggaaagaggtatctttccatcgatttcttacccctgagaactcctactcatcctctaaaacccttcccaattgtcccctgtttcttggagtcagttattccctcctaactctgttttttttccagagtacttagttccaagcccaaggatagcatttataactgatcgtaatcaaccacgagtgcatctgtatcctccaccagggcatggggcctggcccagagcctagctgagagaatggaatgaatgagtggcatctccctgaccaagggttaagatagatgggaactcagaaggactttgagccgcctcagaagcatcctgtaagtgacttgtgaagaggagtaggggacagccgtgtgggctgagagctgagagtgtgagatcagattagagagactggaagtctggctccgcctcttagtaactgtggccttgggcaagtcatttcatgctgcggagcctcagttttctcatctggaacactgagccttcacaggctcctcatggagatgaataagacggtgcgtgctgtatacataaagctggggcacacagtgggcattcagatgttaccttccttccaaggaacccatatttttttcctgaatttgaattcctgaatccactggcactctgagccacgtagatccacatggccattggccgctgtcagcccccagctgttaaggacgcaaggtggccacaaagcattagtctgaacatccctggtgcctcccccaggttctctttgaatctggatttatttaaagagaggaggtgagtggtaggtgaggagggggctgttgttaggacatggatgggcacaggacatgtgtctggtgagcgtagctgccagggccggtccctgacaccccaaggagactttctggtcccagcccagcctacactcccacctgctctggagaggctgtgtttccttccaaggatggatgctgatgatgtctgatggcttctggatgtctgatctcaaggggaccttctcttagggggctttaggccaccctggaaaggtctcagcatcaccccttggagcggggaggattttcaccccttgcccacacacaagctaaaactgcttctgctgcagctctgggagacctagaaccagggcccctcctgagagccagtgggtgggggcaggccccctggaaaatcgctgagagctcagcagtttcagccttcactcccctcctcactcccctcctccagcctgcagaaacctagcccagcctttgcacagagggtcttgctctggggaattctattcttgaatttaataccttgagtgtctagcctggcccaccagcttctgtcccacctccaggtgtttgctcgagctgtgccctctccctagaatgccttcttaactcttgctacttgttgagggtgcctgaagagtagaaagagtgaatctggggaacaaattcaaatttggatttgaattctggctctatcaatgccaggctatgtgaccgtgggctaggaacttaatttccctgagcctctttgtaaaatgggtttcataatagtgtctcctcacaaggtagccatgaggcaacgtctgtaaagcactcagcacagaggaagcactcggcacagaggaagtcctcgggaaatgtggatctgcttcccttgcctcagcgaaatgctccttgactttgaagtcctggcccaaagggcacctccccggcaataccttcctggactcactcaccagccccaccacttgcagagcagccctgtccctcctccaggttcctcaagcatgtctcctgcctctgcacctacctcagagagacaacattcgagtcagctcttaacatctggcctccaggctggaccacgggctctattacctttactttccacggcagagcgcagcatggctcaagaaatgctgcgggaggtgaagtgagttctagggacttccattaataataagagtaactagaatttgttgagcattcacagcacaccctgaggtgtttatcagagcccaggaaaccctctttctgggttcaaatccctgctctgcctcttaggggctctattgtcccagaaagttccttgtctcttgaatcctacatttccccgcctgcacgatagtgataataacagtgcttacttctgagcattgttaaggagattcaagaatttaaaactataaaaacccatggctttcttacccagagaagggcagaaaaatcgttggcagggtgcattgatatgactcggacaatttacaaaggtttttcatatatgcttttattttaaaatttttttgtttttattttgttttattttattttactaaaattttatttagtaaaaatagtacagawtttagaaaatacaaaaacagaaaaatttaaaaatttatcaatagctaccttcaaagataactgttgttactagcctcttgtagaatcttccagacatttcgttagagaggaatattgcaaacatacagaaatgcattgagaatgacatttgtttatttgtttatttgcttttgagatggtgtctcgcactgtcacccaggctggagtgcagtggtgcaatctcggctcactgcaacctttgcctcctgggttcaagtgattctcctgtctcagcctcccaagtagctgggactacaggcacacaccaccacacctggctaatttttgtatttcagtagagatggggtttcaccatgttggtcacactggtcttgaactcctgatctcaagtgatccacttgcctcggccttccaaagtgctgggattacaggcgtgagccaccgcgcctggcctgagaatgttttaatgaacccaatgcgtcctcaccacccagacttagaaaatgtttacacttttgccgtatttgctcagatctatattaataagaaagaaaaccatacagatactgttgaaataattcttatcctttcctccctagaacacacactccaaagtgtggtgtgtgtacccttttctcccacatttttatactcctattacacaaaaagtgtctccatacacaatggatggtattgagacatgtactatattttatataaattgtaccctactggaggctgaggcgggcagatcacctgaggtcaggagttcaagaccagcctggccaacgtggtgaaaccccgtctctactatatatatatatataatttatatataaatttatataaattggaccctattgttctgaaacttattatacttttctccttgttttcaaaatctaaccaagtggatagatatgcatctagttcattcctgcaatggaataatccagcctatgatacaatacagtctgtttatttccagctgatggatggttagagtacttctaattttcttctgttacaaacagttccgcagaaagtatccctgcacacatctgcatgtgaacaattttttctataatttatacaaaagggtatagctttcagatcaaggtatgagcctcttgaaatctatgaggtatcatcagccatttccttttctttctttctttcttttcttttctttttctttctttttttttttttttttttgagacggagtttcactcttgttgtccaggctggagtgcaatggctaaatctcggctcaccgcaacctccacctcctgggttcaagcgattctcctgcctcagcctctcgagtagctaggattgcaggcatgcgccaccatgcctggctaattgttttgtatttttagtagagacagggcttctccatgttggtcaggctgatcttgaactcccaacctcaggtgatacacccgcctcagcctcccaaagtgctgtgattacaggcgtgagccccgcgtttggcctcatcagccatttttctctgcacaatatccataaggctatgatcatcctgaatatgttgtttttcatctgttttttccatctacgatacatatatgcacacatrttcatctttcacgtatttgcaggtatagtcattgattccacaagatcttgggcatttgccatgggccaggtattgggggtttttatggtaatctttccttagccctgtgaggtttttgtttcgttttcattttagaggtggaatctcaccctgttgcccaggctggagtgcagtgatgatcatagcttactgcaacctcgaactcctgggctcaagtgatcctcctgcctcagcctcctcagtagctagaattacaagcatgtgtccagctaatttacttatttatttattcatatatatctatatatatgtatatatatatgtatatatatctatrgagagagacaaaggatctcactctgttgcccaggctggagtgcagtggcaccatcttggctcactgcagcctcaaactcctcggcccaagtgatccaacctcagcctctcgactagctgggaccacaggtgcacaccaccatgtccagctaattttttgaattttggtagagacaaggttttgccttgttgcttaagctggtctcaaattcctgcgctcaagcaatccacccaccttggcctcccaaagtgctgggattacagcgtgagccacagcacccagcctcatttttttatttttaaatttattttgtagagatagggtctcactgtgttgcccaggctgttctcaaactcctggcctcaagcaatcctcctgcctcagccactgaaagtgctgggattacaagtgtgaaccactgtgcccagcttgtgaggctttttttttttatatataactatgaggtgagggaggcaaggggggcatgtgaagagattcgcccagggtcacactatagtaaggaggaagctgggtttctaacccaggcatgtttaatttcaatccagtgttctttctgatgcctatgatgtggtagatggttttttcccaaccaagacctactgaatgggaattctaaaagagggacctgagggccgggcgctgtggctcacacctgtaatcccagcactttgggaggccaaggtgagcagactacctgaggtcaggagttcaagaccagcctggccaacatggtgaaacccggtctctactaaaaatacaaaaattagccgagcatggtggcgtgcacctgtaatcccagctattagggagactgaggcaggagaatcactagaacttgggaggcagaggttgcagtgaaccaagatcgtgccactacactccagcctcggcgacagtgtgagactccgtctccaaaaataaaaaaaaataaaaaaattaaaattaaaataaataaataaataaaagaagcacctgaatattcttctcctcctctcagtggtctaaagtctggcgggggatcaagaagatggggctggtgacatgccagtgtttctggcctgctgtgctctcttggagccaaatccctactcttatcccttgggattttactgagctgcttgcaaccctccatgggaccttctcattttaccacctggtagctggaaagaaggcacggtctggcacgggagcctgagccagccttggagccaggaccccaggagacttttcttttagaggaactcctgttaccacagcaactacagcccacatctcctccctaggaacactggatgtttgcagagccggggaagggtgcagccaagttgagagtctgcagcagctcagataaggttcacaagaaaggcgaggagtgaggaggagagaatgcagccttcagagaaccagaatcacccccttgcagaaaagaaggctaaggagctgtcagagtcatctttctgcctggtatggaatgtagaatcaatagccagctgccgtcccatagctaccaagggccaaacgagagaaaagggatgaaagcctcaggttggaggataataacaacaacagctaccatataccgcrtcctaagcgttttacgaagatcacccacccgtgcactcttcttctgtttggctcatttatcatgcccagtgccaggttaaagatgaaacctagctgggctcagtgactttccctaggtcacacagccagtaatcagcagagatgggtttagatcactgttctatctgtccccagagtccctgtctaagtcatgaaagacgaatttcccgagaatggaggctgtttcccagatgaattggtgcctgggatctcctgctccctcgatcatcccgctcacactcatctccctcatatcatacctgccccagttcccagcatatgcaacaagttcagcagatgttcatggaactgaatgcaggctggcaacagactcatttctcagctttcaggagaacatggctcacgccctctcactttcttgggagaggagggggagtcccagcaattgaacgtacctcaaagcctgttaagtcatgttgatcttatcttttaagttttttacagaggcgagtaggaaacgttgtcttttacttccccttggatttggtgacagagaggaggggagatgaaacctgggcatgcatggaaggtatcacgcaggtgaacatcatctgtcctgtgacataggggcaaaagaaaggtaaaaaggctgaatttctggccgggcgcggtggctcatgcytgtaatcccagcactttgggaggctgaggcagggggattgcttgagcttaggagtttgcgaccagcctgggcaacacggtgaaaccctgtctctagtaaaatacaaaaaattagccaggcgtggtggcacacacctgtagtcccagctactcaggaggctgaggcaggagaattgcttgaacctgggaggcggaggttgcagtaagccgagatcgtgccactgcagtccagcctgggcaacagagtgagactcatcccctccccaacacccccgccaaaaaaaaaaaaaaaaaaaaaaagctgaatttctttgacctgagtgactgcagtcctctggggctgggactctttgagccttaacttccatccgtctctgtcaattgagtaaattgttttatttgtgtccccaagccctgctgtggtataactggggagtgtgaaaacaaaccaaaatcctgtaacataataccaaataatactcactctctttctctttctctctcaagaaaatgaaagcacatgagccaagttctcctgaaagctgagaaatgagtttattaccgatctatgttccgtttcattaacacttgctgaacttgttccacgtgctaggaactgggacaggtattcgggagataagtgtacatgtaaaataataccaaagcaccaaactgctgactttcctctgggcgccaggggagagaagtcactctagccttcctggccttggagagccaagtgggtataagctggtctagtcacagcagccagtcacctctgcaggctaggacagcactgtgtgactgagcctgtgacagcttcagtttcttgacaaagtaaactcagcccaaccgggtgtcacaggctcttcaagtccaagtcccctcaaaggttgaacacatttatcccctcccaattgaattatattayttgtatgagccagcgcatgcgtcttyttttttttctttttctttctttctttttttttttgaaatgaagtcttgctctgtcacccagcctagaatgcagtgctgcaatctcagcacactgcaacctccccctcccggattcaagcgattctcctacctcagcctcctgagtagctgggactrcaggcatgcactaccacatccagctaatttttgtatttttagtagaggctggatttcgccatgttggccaggctgatctcgaactcccgacctyagctagtccacccacctcagcctctcaaagtgctgggattacagatgtgagccaccaggcccagcccgcatctttctaattttaatggaattacaggcgttcccttctttctagttgttttattaattgctcaccattaacaataccaagggcatttctaaaaagaaaatagttaggacagttccagcaccctctcactcagagcttcctcccctaaattcattggccctcctcttccaattggccgatgcatcctcaggccctagacagtgctggagtgagccccatatttgagagcaagtggggaaggggtgggggcagtgcgaggtgagactattaagtctcatcttttccctgctgtgaggtctgtgggatgacacatgccacccaggaccccctgccccggagaaggaaggtttcctagttgttgcttatctttggagtctgggatcttttgggaaatgagtccctggatcttgggttctgagttgtgtcaccattgcgggggaagggtgggttatcatttctaaactcagtgctggttgacacttgcagaggagaaaggagtttggaaagcctccagggttgtcaaaacttcctgcctctcgcccttggcatgatcaccaaagcagaaatcaggatgttggattccaacccgggggagtggtgtggttacgaatgtggcctctgcaagcagacagcctgggttcaattcccagcttggccattttctagccgtgtaatcttargcaagatactaaaccgctctgtgcctcagtttccccatctcgtggtcttgctttgacaattaaatcatactgaataaatgtcagccattactgctgagctgtgccagatttgtgacgggtgctcgacgtgccttggggcctcccctttccctatcagagcagtgggaagcatcacaacatccttcccttatccccctgcactctggaccccagatgcccgagataagtagctrctcccatcagtgtgggttgggagtagaaaactaggagtccatctggctgcttcccaaacctgcaaaccaggaatcccagtccagcttcccggccactgggcaaggggcaggtgagtgtttccggacagctccctgaaccagtcctgctccacttgaatacctggagtctgagccagggcctcgggaggygggcccrccagggttcacgtagcatttgtcatcactgctcgggacaaaaggccagtcttcatacacaagatgcacggtggtctgcaggttagcagggagcacgcctctcccaaggttcggggacactagtcacaagggcctggtgccagtcttgcagagaggcacaccctgccctgtcctggcagtgctccagagcagcagctggactatccgggagatcactgcgctgcactgggagcctgacctccccgtgggccttggggatactcttcctttgggccgcagattttgcaatatttctgacaaaatacttgctgacaaaaagccttctgagagaagcattattaactccagttcatggatgacagtctaaggctcagactggcaaagtgactggccaaaggtcactccactaataaggaacagagctggactccagcccaagcctttgaactcaaggccttgtaaggtacataggtaccttccccccatacagcactgtctgatgtcaatatgtgagtcacatttataattttaaatttttggctgggcatggtggctcatgcctgtaatcccagcactttgggaggccaaagcaggtggatcacctgaggtcagaagttcaagaccagcctggccaacgtggtgaaaccccatctctactaaaagtataaaaaaagtagccaggcatggtggtgcgtgcctatagtcccagctactcagggcgctgaggcaggagaatcgcttgaacctgggagatggaggttgcggtgagcccaagatcataccactgccctccagcctgggtgatagggcgagactccgtctcaaaaaaaaaaaaaataaaataaaataaaataaaaataataaataaataaatttttagcagctgcattttttcaaaaaagtaaaaagaaacagatgaaatttctttaataatatatgttatttaactgaatatatccaaaatatcatttctacacatcaataaaaaaattcttaataagatactttacattctttattcttaccaagtctttgacacacaacctgtacttcacacttaaagcatgtctcaatttggacactcaagtttcaccagaaacattcaatctgtatttagatttcatactagttacaattgaaaaaggagaatcacatatctaacttactctggccatttgaaaaggttttccaatgattgaattgattatgcctttaaaattaaatggaaaacattttgtaaattaaatagaaatgaattgaattaaataaaatgaaattttgagtttctcattggcacgaacccatttcaagtgctcagtagccacacgtggctggtggctattgtactggacaacacagcaccatatgattttccctccgagtggggctgagtgatctctaagcccttcaaatgtatgctcctcccctgcgtttatacagatgagtgctttgtgtaccatgggcccacttccgtgatgataaatggacggtgtaggacagatttcccatctatattgacagcatactgaaaacagtatgctgtagtagttaaaagggtgatttctagagccagactgtccaggttcaaattttgctttgattactgaccagctgggtggccttgggtgatttacttaagctctctatgtcccagttttctcagtgatgacactgggatgatgatattaatagtatgcacctcacagggtggttgtaaggatttgctagtacatgtaatgcacacagataaccgctatcatctatggggcatacagtaagtgctcaagagatgttgcctttcattacatattttatctaattataatcaaagaatgtaaggactggacaagatcaaaatctcatcaatctgtcattatgcaagtgacaaaacggggccagaaagtgaaagaactcattcaaggtcatgtagcaagttaatgatagaaatcaactgtcagctcctgacgcccaacccagtgaccctctccactgtgcccccaacaatgctgacattgccgagaagagacaccctgacctgccagccacatgagctcttcaattcttccctgggaatgagtatggctttagctggcgtggccacactgtctgcccaggtgctctctgcaggctcattggagcagggtgactgggtagtcagtatgaaagctcactgtattagtacttcaagctagcccacatgtccccccaggaaaaaagccctgtgtatttatttggggacttttaatttttatttgatatagaacatttgaaaaaattagaacaacacaaggcagaaaaaaaaaaaaaaaaaaggaaaacaggccaggcacagtggcttatgcctgtaatcccagcattttgggaggccaaggcaggcggatcacctgaggtcaggagttcgagaccagcctggccaacatcgtgaaacccagtctctactaatatatataaattaggcgggcatggtggcacatgcctgtagtcccagctattcaggaggctgaggcaggagaattgcttgaactcrggaggcggaggttgcagtgagttgagatggcaccactgcactccagcctgggtgacagagcaagatagaaaggaaagaaagaaagagcaagaaggaaggaaggaaaacttattaataccatgtgggcatgtattttcttttcctatagtagagattaaatttaatttactgatattcttttagcatctctcctgggcaaggcactgcgcaaggtcctggatatatgggggtgatgcttagaatctagtgagccgatggttgtcagttcatgaccaggatagctatgtaattaaatgtggctgggcccacatgaaaaaaaatctcaggatgcagtgagaggacagaatgggagattgtactcgggctctctgtgggtcctggaaaaccttcagaagcttaaaacatggcggggggtgaggacggggactgaaggggagagtacaaccatacttataacataaccctgtattctgcttctgccacttaacattgtggcataaacttatccccacatcattaaatactccctgtaaatttttttttggcaaatatttttaatgtgctatatttttctaaccaaccccccaatcacttttagacaatccagttgtctccggtttgaatttttttttggtgggtttttatttgtttgtttttattatgctatcagaaacagcacagggtcgggttctgtggctcacgcctgtaatcccagcactttgggagcctgaggtgggcggatcacttgaagccaggcgttcgagatcagcatggccaacatagtgaaaccccatctctactaaaaatataaataaaaaaattagccaggcatggtggcaggcgcctgtaaccccagctactcagkagctgcggcaggagaatcgcttgaatcaggagggtggaggtggcagtgaaccgagatcgcatcactgcactccagcctgggcaacagagggagagtgagactctatggcaaaataaaaataaaaataaatataaatataaatataaaaaaccagcacatcacagcattctggggctccagtggatggaaaagggaatctagaaccatctagttccaaagcatggactttagtctccaggcagtatggtacttgagatagttttatttaggataggttcccagatgtggaattactggattgaaagagcttggtttgctgttgttgttaaggctgttggcatctgtgtttgcaaacactttctgttgatttttttttttaactatacttctagcaggtgacacatgcacctggctgcaccacttgtagattccacctccatgtttccatcgtccctttccaccctgcctctggctctgtacagcatctcttcatccatcatccactcaacgagcattcaggatgcaaccgtgttttcctcagcacctctgacagtgccggaggacagaaagtaacctcaggtgtagctggtgttgaccwgacactggtcactgggcacggccagrgcggcattctggggagtgccttgtttccccaccaggcttgctctgacactgggctggccagcgggaggctcagctttccctcgatgtctatgcctcctttctccacaagtccctcacctctcagatgcccatgggacatctcaggagcctgggtgacacaacaggagtatcagtgtcccgttccgttttctcaaattccaggcaacaaggctctttcgtgccttcattcttcctgtgcttacagtctcctccgcagcccgttccactggagtcttcttcccactaccccattggaggttctgtcccactcggggacttctgcatgggactggcctgaaaaagccgcctccttcctgggctggggtcggcactcccaacctctttcttctcctattctgaaaccagccgctcccctccatcccttccctgtcttgttccatcactttccagaatttgggacacaactagagatgattttcaggggcacacagtataacttcaggtggtaaatgaacttagcattaaataacactgaatcatgtggcaataaaagtttaaataattattatttttcaatgttttgtcattccttctgattctatcagatagtctgatgatgatgtgtctttttttttttttttttttgagacggagtcttgctctgtcgcccaggctagagcgtagtagtggcgtgatctcagctcactgcaacctctgcctcctgggttcaagcgattctctgcctcagcctcccgagtagctggaactacaggcacctgccaccacgcctggctaacttttgtatttttagtagagacagggtttcaccatattggccaggctggtctcgaactctggaccttgtgatccacccaccttggcctcccaaagtgctgggattacaggcatgagccaccgtgcctggccgatgatgtgtcttttaacatctctaacatggctttatttttagtatgcttgtttttacaattaccttctattttaagcaagtcatataaatcgtccctttaggttttaatatcttcttatttttttcatatcaacatacatacctaattttacatacatagaatcatatcatacatgatttttaaagtacagccttttaccttcattgcttgcttttcctccccctatcttccatggctgtgactgtgtcccacgaccagctgcatagtttgcagggcccagtgcaaaacggagatgcagggcctttggttcaacaaatgatgaggaatttcaagatggcaacagcagaggattcaagcaaaggccgggtccttctaagcacggggccctgtgcacagtccaccagcctgtggagctggccctgcttggccccttcccctgaagcccactcttaatttttccattttgattatctgctgtgtgttctcccacacttatcttcatgttcctgcaatcataccagttcacagagggggttttttggccttgcttcacaaaaaaygtatcatattatattctcttctctgcatcttgcttttcctactcaacacagcttggaaatcctgccaacccatctgggtctatttcattctttataaaggctgcataagatgccatgctgtaaatggaccgtaattgattcagccgtttcccctgtgaatgggcattcactctgtttctaacattttgccattcaaaaatctgcagtggactgggtgcggtggctcacacctgtatgcccagcagtttgggaggctgaggcaggcagatcacttgaggtcaggtgttcaagacccaacctggccaacatggagaaaccccatctctaccaaaaatacaaaaaaatttagcagggtgtggtggtgggtgcctgtaatcccagcaacttgggaggctgaggcaggagaattgcttgaacccaggaggtgaaggttgcaatgagccgagatcacgccactgcactccagcctgggtgacagagcaagacactgtttcaaaaaaaaaaatctgcagtgaacatttttatgatcaggtgtctttaatgatgtaaaaaagcaaattcacaggaaagggtaaaagtttgctcttactctgttttgtgttgctataacaaagtaccacagagtgagtaatttaaaaccaaacagaaactttattgtctcatagttctgcaggcgtggaaagcccatagatctaggggccacatctgatgagggccttctctctgcatcataacacaatggaaggcgtcacatggccagagagtgcacgagagacagagcgagggacggtggaactctcacttttacgacaaaaccacttctgcaataaccacacacccctgtgataacagcattaatccgttcatgaaggcagactcctcatgacctaatcaactcttttctttcttttcttttcttttcttttcttttttgagacacagtctcgctctgttggccaggctggagggcagtggcgcaatctcagctcactgcaacctccacctcccaggctcaagcaattctcctgcctcagcctccggagtagctgggattacaggcatgtgccaccacacccgaccaatttttgtatttgtagtagagacagggtttcaccatgttggccaggctggtctcggactcctgacctcaggtaatccacatgccttggcctcccaaagtgttgggcttacaggcgtgagccaccacgcccagccctaatcaattcttaaacatccaacttctcaacacaggtcattgggggattaaatttccaacacatgaaccttggaacacattcaaaccatagcaggctccttttcaaataaatttattgcagcaaaaaagtgaaccaatttaaagaaaagtgtgaggcacagggccaggcaaaagtggtaacaatgggccgggtgtggtggctcacgcctgtaatcccaacaatttgggaggctgaggtgggcagatcacttgagctcaggaatttgagaccagcctgggcaacatgggaaaaccccgtctctacaaaaaatatacaaaaattagccagcatcgtggcaarcgcctgtagtcctagctactcgggaaactgaggcacgagaatcgcttgaacccaggaggtggaggttgcagtgagccgagattgtgccactgcactccagcctgggcgacagagcgagacactgtctcaaaacaaaaaaggtgataatgatgtctgagaaacgctgatcttccattcggccctctgtgaaatgaggcctggatggaaagacggttccaggtaatttctgcttttgttcctgtagcacagaagtcagagaacagagaagccaggttcccttcttgggatagggratgggagaatgcttgacacaaaaataaagccctcgaggttatccgctttcaaccagctgccttggagctggcagctgctgctcactcattcattcagtcaatcaacaaacattgccttggacactgtgggggacacagggctgacccagccatgggccctgccctctagggttttctgatctaggagaacacatttttgtctttatgcatgagaaagtggttttccagacccagagagagagatgatacagagcagagctaaagcccccctgccccacacacatcacattcacacacacagtcgtaatcacatatgcacacagtccctcacacacactcatatgcacacacctcacagtcatacacactgcagccatcattcaatccccctcccccaccccatgtagtaacattgaaaactacgcaggagcactgggacggttgctgtgggaaccgggattctgaaatcctaacttgtgggcatctgaattcttgcgctgaacattctaatacatcagccacagagtttatgctctgaatttggagtcatttctcctccaggggctcaggctgggcagacagccagggagttagcgaggacggcaattagagggctgaagactttctgcctgatgatgaagaggcccacacggtttcctggagagggctgtctgccagggtgtgcacgcgcacatgcacaagctcaggctcagggggtatgtcygtggaatctgctcaggtgaagctccaggaatgtgtagtggtcatgtccgagtcttcaggctctgtatcggtcaggccggactaggcaaggctgtagcaacaaggacacccccaaatcttcatggtttaacatgataagggcttactccttactcacacaaaatccaagctgggtcaacatccccttccctcttgcagttcctccgcaacccagggcctctaatatccttcaacagggaagacgtaaatggaaatggctcactgcctcttccctgctttggctcaaaagcaggcagacgtcttctgcctaggcttcaaccagcccaacctaagtgcaagagaaaccaggaaatgcagaggagttcataggcaaccacaacagtccctgccccagagcctccctttgtgctttgcaagcccaaacatcccagcccagaggggaggcaagtccttggagacagtttaaatccgggctctgcagcttgctcactgggtggcctcaggcccacgcatcagttgggttcccaccaggaaacctagaataggaatttaaaggggacttatttacagaagaactatttacaaagggtaatgcagtaagtagaatctaagagcaacttctggccaaaggagacacaaccagggagtggtcagtgagtccgagtaggagacagtcaaggagaggtcaccttgaataagcaatgtccttcacatgagggacacagcctacccgagggacctcacagggggggccagaggaataagtgtcayatcttcgctctcctcacttctgcctagctctgctaaggctccccattggctgaatctgacagaagccataaggcccaggaagacaggggttaatccaaacagatcagcctcccagggcagaatggatagtagctctggtggaataaatggaccctatctggcagggacaactgatttttgcttttggagcctccttttcctaatctgtaaaataagaatgctaacacctgcctcattgcattgttgaaagtaaatggaataggccggatgcagtggctcatgcctgtaatcccggcactttgggaggctgaggcaggcagatcacctgaggtcaggagttcgagaccagcctgaccaacatggagaaaccccgtctctactaaaaatacaaaattagccaggcgtggtggcgcatgcctgtaatcccagctactcaggaggctgagacaggagaatcgcttgaatccgggaggtggaggttgcggtgagccragatcaagccattgcactccagcctgggcaacaagagcgaaactctgtctcaaaaaaaaaaaaagaaagaaagaaagaaagtaaatggaacaatatatgcaaatatgcaaatacctgtccttcatgaatgctagtttcttagtgtctgaaggcactttgcaatccagtggttcccagtccaggatgtgtcaattattctaaagtctgatatgaaattctcaaacaaattctataaacaaaattttctttttctaaatcactcccactttcgagctttttctatatgtcaagtatttcataggctgtctcatttcagtctcacaatattttcctaagaatcatagctgaaaaattgggactggcacagaaagattaagtcacccattcatggtcacgaagccactttgtgtgtctggccccagtgcccactgcctttcctccctgttctactccgatttctgaagctgtgtgtgcaatgaataggtaaagcggaggatcctgaaatgccaatgtttgagaactttccctaccttgaagggaggccaatgcacccaaagttgaggaccacgtcttttccaaaggcctcatgtagccaccacaggctccaggaagtgccccctgctcatcagggtgtctctgtggtctccaggcctgagctcactcacccaccatgctgctgctggttcatttcaggtcatccatctccagccccacctgaccagctcaacaccagcagtgcagagagtgagctctgggagccaggtgagcaaacattccctctgggggtccatgatcagctttctgtaggtggtcccccagggtaataaagaagggaaatggacatttaggataccagggaggctccctgacttcagacaacacttcttcctgacccatcacctgaagttccactatcaattcactttgaggtcgtagaactaccatttttgagaggacactgataagtcacatacaggtgggcaggtatgcctggagcattttaaggggatttgttgagaacaggctagagttcttggtgggggaggcagggtccttgatttactcagcagacgtttattaaggacctactgtatgcaaagatgcatgctagcactgggggtacaatcctgggctaaaaggggcaggtggttcccatagaaggggttctggggaagtgaggaccaccatcagctgaagcagcccatcatcaaccccatggccagccgcttcacaatcctccaaggttccctagtcactgtgacagcctctaggacagtaccctcagaggagcagaggggccttcaggggaagcatgcgcccactggaccagggcccctgaactcacaactctgcctttctttcacaaacgggtgcccctggagacaggagcaagtgaggagggtttctagggggctggacccctagttgtctgtcacccatcttaacctctagagtcactcccaagccccaccttcggctgactctaaggagaaccacagggtcaggcctcaaggtgggctcagggatgagccagcccggctccattttgcagactggaaagctgagacccctagccaggcagggcgttgtcaaagttcacgcacagagtcagtggcagagcctgggcaaccctctgcccaggccccaccggtcttagctctctggtctgacacttccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcaggtacgagcgcaccccctacacgggcccccacctgccccactccccaggccttcagccactgcccctggctccagaccctggacgcaagcctcgccctccagacctccacccccaccgcctaccagtgcaaacgcaccgggttcccacaccggaggacgacctcgagtcatttccagatctgagcgtttccttggatctggcctccagactccacccccacacttggttcctagtcccacccctgkgttcccaaagctaacccggtctctaaccccacttactgggcccgccgcttccctgtccccgcccgctctgggtctctcctcccctttcgccatatacataaacatgccaggttcacagggtccctaagcgctgtggctcccaggctcccaaacctgccctccaggccccgcccaccaggtctctggtccctcccaccagcctgcggctctacctaacccatctgcagtcctggggggattcccagtcttgcctaccgggctacagccctctcactgggtccacaacacgctcacaactctccggccagtccaaccatcaccccaaccctcccttcctggtcgggtgccccagcatccacaaccccctcccacccctagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcaygcccggccgcgggcctatccaccgggaccaggtgaactgctcgggggccgaagcttacctgtgggactgcccggggctgccaggacagcactactgcggccacaaagaggacgcgggcgyggtgtgctcaggtcagtgggcggagtcgctgaagcccggtcactaccaacactcaccataggcctactgggcgccaagcctggagttagtgccggagaggtggtccctgcccttgagatgtcacagttcaggaggggagatgagactgagacaaacatrattcaggagagaaagtggyaaatgcccccaagaaaggcagtcaggtggagtctagaggcagcagaccatgcggagctgtaggctaaggctgaccacctcccggaagaggtgacattaaaagtgagactcttcccgagtgggagttggccacctgcattcaagcagcaaggggagactgaagggagggaggcctctgaggaggctgttggtctgtccaggtggggccagaaggttctggaccagccagtgcctctctttgataagcaggagatgggggaggtgggggtgttaaaatgtagattctgattcagtaggtctgaggcagagctccagagtctgcgtttctaacaagatcccaggcaatgccgatgctgctgctccacagaccacacttatcacagcagggttggccagagcaaatggggcaggtgacagggggacacagacacaggagggagaagacacaagatctggagaccaaatggctgcattggtgcctgcactggtgggtctgggctggcgggaatttctgcccaaaggattctgacctgactctgtcccctgccccttccctgcagagcaccagtcctggcgcctgacagggggcrctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcarccagtcgctggcagccagggtcctctgctcaggtaccccatcctactccacccccccagatttgagccagaattctacctgaatccatgtcctaaaaacttacagtccaaggaccacaataggcaccagatcggcaatggcacatatggcataagaaggactgttgtccttacggtgcccaggcagacagtgctaattcatcgaggtattttcagatgctccactcagccccagaatgatgaatcatatatgaagacattatatgctaagcaatggttcctcttgactgggattgactcaagagttgacaccaatttgccatcccaggcctggtgatgatagtaaaaataatattagcaggccctagtaataatatcggtgacagcttctggaaccctgatcatatgctaggcattgttaagcactaagtagctcttatttcagctgagcctcatacccactctatgagttgggttccaccatatctcgccaaatctaagatggcattgtttatgtcacaccattattattttatgtaccataaagaagaacgaacactgccaaaataaaccaccaaacgtaatgactgaggccattatcccaatttcagacgtgttaaagtttgaaaaaacgtgagtgttagatagatctgaagaaacatggtatttgcattcttacggcattcagacaccagattacaaattccagctctgccatttacgagcaaggaggcttccgacagtcccttaacctccatgtgtggatgctgatactaggcacttcgcaggatagctgggaaacctgatagtatctgctgagggacttctaagctcatttctttgtgagcctacctgcccaacgggaatgccgattatgataatgaagataatgtccgctcttcatctccctaggctgattaagaacaaactgaaactgaatggaaaacggatttgtggtctgtagcagcttacacagaaagaagggataattctattagccctttattttaaccaaagagccttcccagcatttaatccatgagttcctccttactgtggggggtggggtaggggagggaggtaagtttccttagccacgtgtccctgatgggagcacaaccctagttctgggtcacttgtctgtcccattcagtttctaacycaaggcctggcacacagtaggtgctcagtaacatgcaytgagtgactgggcggtgctttctgacagcttcccggagtttgcacaatctgtccactcccgaagtccctgcaagtgttcagacagtcactataggtaagtgttgctgggtactacgcggtttctcagaagcttggacgtgtgtgtgtgtgtgtgtgtgtgtgtgtgtgtgtgtgtgttcctgtgcacacctgtgttggggtggaggatggtttggtcctcatcctccacctccagccaatggacttgcctccccggggctctctgggtggcatttctgctccttctacatcccctccttgccaagtcagcccatagatcactgagtcctgatacttcctggacagaagtccattcccccactttcctgtgagctgctggagggcagaaggaaagagctggagagagctgataccacctcaagcaggggtcagggtcggggcagcagggggagggtgatcttggcccagctgggtagcgggaatgccrgcacacagccctgtgttcataaccggccagacactgggcctagggctttatagccattatttcccaaccctttaatcctcttggtagccaaatgggagaggtcttattataacccttacatcaagaaaggagctgaggctccgaggctgaagtcacagctagagattgctggccagaactgacaaccaaggctctgaattccagatccattcttggtctacccaccagctgcgtgtagcttggctggcatcagagcagactcccaggactcaactcccagctgtgcctcttgctagctgtgccctgttgggcaactcggaacctctctgagcctcagacacctcaattataaaatgggggtgataagcatayagtactttctcctagcattgctgtgaggctccagtgaattaatttttgtaaagcacttagaacagagcctcaaagacagtaagaactgtccgaaagtctgctgttgctatgagtatttagttcaggcattgagcccctttgcagtcctgggatacccacaggactcccttgctctgcctcctagctctctgtcatcttctctcagacacccagaagcagtgaacaggggtttggggagagggcacagaggccttagccatagatgacagcacagagaggaaatgaaatgtacaactgcacaggctgccgggcaagctcctgccaggccccgcaggcaacctgcacacgctttctcttcctgaggttggagtggggatccacgccatcctggaagggcaaagagtgaagcacaaagagagatccagggaccacaccccggccctyggtccatcagcccctccctcggccaaggccctctgtacccacattcacgggtctccccatggccgcaacacccagcctcactctcacatctgcttcctgctgccagatccagctcccatcctggcccaaacttccccatttgcagacagagaggggagaggagaaaatgaagacggggagaggagaaaatgaagacagggagagggttctctcccaggggaagcagactctgcccccagcaaagaggtctggatgatctcatctccctccccgttgctgtcactactagtcatctagccctgtggtctgctcactccaggaaccctcctcactgacccctgtatccattcttgtgcttcacattcttttaagcagaggggaggctgagggagggggagggcaagaagtcacccctgagtggggctgcagaggtgggagaccctgaatcccagaccccactcccgtcctcatggaggggatgtctggtgggaaggaggggggactcaggcacagctcttctgatggtctgttcactgccagaggtggctcagagtcactgtctctgggaagtcagcgttggtcttccctcacagagaatgaagtgccttttgtagggcctcatgcccccagtgtcgctgttcaaacctccatcacagcgggtgcctcatcatactggactgggttacttattgatctctccgctagacaaagcccctcaaggcctgtgatactgttgtcttatgtgtagccccagggtctagggccaggcacacagcgggtactcaatagttgtctattgaacaaagactacatactgaagagctagcagacagatagatctctgcagcctggtggccagagttctatttcaggcagtaattcatttaatcaattgctcatgcattcaatatgcatttattgagcgcctaatatacaccacacacttaaaagcaatgagaaaattggaaaaaggaagcaaggaggaagataacataaaaagggaagcaggtcagctttacagagaatggaaaggyaagaagaagggtgagtgcccrttcctctttcttcctgaattggaattcttgtttccagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatggtaagtgcaaggttctgggagccatggccatcccagggggatgtgagccttggcagaaccccagcagcagtggcgtggtccagcaatgaccacccggccctggccctggggagatccccaaggtggaaaggattttcccagcatgcccagcagtcatggacgcaccagcggggagaaccagactgtgcatgtgtgtgtgtgcctgtgtttgtgtgtgtgtttgtgcgcgcgcacatgtgcctgcaagtgttgggggaatgaggagggtggtgtgtcgatgagaacagaacggaaccaggtagactgggagagggcaaaaaaatgacttgtagaatttctgcctcccctccctcagccctccccgtaatggtgaaccaccagcacctacccaccaccatcccggcagggagcaatagctatcaaccggtccccatcaccatccccaaagaaggtaggatgtcccccatcctgggtgtgggagggctggggaggacaagaagggtgagctttctggaaggtcagcaccacttaggtccaagacgtacacacagctggagatgagatctgggccagcccactcccggccctgggaccttgagcaggctcaagtcgtccctggacattgaagggcagatgaccttccagttcagtcatgctaggactctatagagttttgagttctggacaaatacaggcaaagcacgttttagatcttggttctcagaggaaagctctgttctgctttgctctgctagttggctagtaggcttgtgatatcatcatccctatcaatgtcctgcccaattggccttgcgaagccccatcaagattctcctagaatgtggttttatttcatagttcatattttctaaacaaaaaaacaaattggggctgggtacagtggctcacgcctgtaatcccagcactttgggaacctgaggtgggcagatcacttgaggtcaggagttggagaccagcctggccaacatggtgaaaccctgtctctacaaaaaatgcaaaaattagacaggtgtggtggcgtgcacctgtaatcccagctacttgggaagctgaggcaggagaatcgcttgaacctgggaggcggaggttgcagtgagccgagatcacgccactgcactccagcctgggcgacagagcaagactctgtctcaaaaaaaaaaaaaaagaaaagggtcagtcattcatcctttatgatatatggatttatacctcttgcagaggaatttgagcttaatcaccttgcattatgaatgtattcaatcacctttatcgsaaagagttcaatgacataaaaaccaatacaaaactcagccaaatattataaatatcctttgcacagagagtccatatatatgaaaagagaatgtgaatacagcatctagcataaggcttagcataaggcagctgctcactgaatagcacagtctagaggtttagagccagactgccggctctgggccaggtaagaacctgtctgtgcctcagttccctccaaggcaaaatggggataataatgtacccacttcacagagttatcatgagggttaaatgaggtaatacttgtaagtgttagaatagtgcctcacatatagtaagtgctgtgttaagcgtttgctaaataaatgtttagttctccatattggaaatgaacgaaggcagcctagaaacttcagactgggtggcttgtacaagatgggctacccaggttgggcacactggtggatgcctgtagtccccgcattttgggaggccgagggggatggatcgcttgagcccaggagtttgagaccagcctgggcaacatggtgaaaacctgtctctacaaaaaattcaaaaattagctgggcgtgatggtgcatgcctgtggtcccagctactcgggaggctgaggtgggaggatcgcctgagcccaggaggtcaatgctgcagtgagctgtgatggcaccactgtactccagcctggacaacagagtgagaccctgtcccagaaaagaaagaaaaaaaaagggggctacttggtgctcccctgctactctgcctctcacctctgcygttcatactctaccatctctccctacgcctttccgcccaccactttgccatgccctcgactctgttctctccccagttttcatgctgcccatccaggtccaggccccgccccctgaggactcagactctgrctcggactcagactatgagcactatgacttcagcgcccagcctcctgtggccctgaccaccttctacagtgagtgcctggccgggctcccgagggcccacctacctgaatctgggagggggccccgaggggaccgtcaggtcagtagtcccacctagtaacccctgcatgatgcagacagaatccccctggttacccactggattgactgtaaatggtcctacactgacgtttgcaccgtgctttgtgaccctggggtcatctcgatgtctcaggacatctccactctgacctctgtctctcccatgtttgtctctggccacgtaaggtcttaagaccaggcctttgacattcacctgaagatggctctctgtgtgagagcgggggagtgcggatgagagacacagttggcaggggttctcgcatgccatatccctcygtgtcccatcctgccctgtctgaccccatcagccccactcacttcctcacctccacgctcttgccagcttgtgcctcatagccagctcttttcattgccttctggggataggaagaggaaagataaygctgaaggcagttccctggcaatgctgggaggttggaatagaccagagcgtcccacaccttattgtggaatcacttgggagcttgtcaaaaattcctgagcccctccccacacctaatgttatcagtcaggatgagaatttggctgtgtgtgacagaaagctccaaatgacagtgtcttgagaggttggcaggggcccaggccccttctttcttgctgctgtgcagtccctaagatgttgccttcatctacatggtccagaatggctcacctccatgtccacattccaggcaagggcaagggaacgatgggatgctggagatggccacagattcccgctcacaacccagcacccagaacgaaaacccactagctgcaagagaggcagggaaacgaaggctctgtcctgggcagctgtgtccagataaaagccagaatggatattggggaacagacagccgtccctgccccrcctgctaacccagggcttctgggggtgggacacggatgattccacttcttctggcctgtggaccagtgtttgggcgccacagggatgaagtgtctgtcgaacctgagattccgagcccaggcatataagatgcaagactgagagtccacagtgctataacattgaaattaaaagtcagtggtacccggttcaaaagagctgactccaagatcccagacactcatatcctcaagactctataaatctctgattctgaaacgtgaaggtgccacagagcctgtgatgcagtgattccagaccatctgggtttcactctaggaaggcttcttgaaggagcaaacatctgtccttctcctgcccagagctgccaggtcacaaggacagaaccaagactcttgatacctctctaagtagcaggagggacagctggggctgggggctggggggttgtagggcactagagtttctgtccccaggctagattaaggcgaaggctctgctggattgggatatgaacctggaatttgatgggaaatgctaagccctctctgcctccggagttgtcctcccaccctattcagcctacccaggccccgggaaatccagcctcttctccaggctcctaaatgatgaggttgagccttcacccctccccaccrccgcctctgcttgcagattcccagcggcatcgggtcacagatgaggaggtccagcaaagcaggttccagatgccacccttggaggaaggtgagtcaggatgggraggggtgtgaatggcagtcccacctccagagagtagctcagctcagcttgagaccttccagcaggaacctccctcaatgagtctttcctgactttcacaaatcctataggcagtaagtgctttctgaagtctgacttaaagccctcttgctgcactgcttctttcgtcaccattctccctttcctgccttaggacttgaagagttgcatgcctcccacatcccaactgccaaccctggacactgcattacagacccgccatccctgggccctcagtatcacccgaggagcaacagtgagtcgagcacctcttcrggggaggattactgcaatagtcccaaaagcaagctgcctccatggaacccccaggtgttttcttcagagaggagttccttcctggagcagcccccaaacttggagctggcyggcacccagccagccttttcaggtaagctgtgcctcccccaaacccccatcccatagccagcctggctggaggaggcataaagctgggagccctgagtcaggctgaggtcaggattctacccagttccgcagccattcgctgtgtgcccttggacacatctcccatctctgggccttcactttgtcatttgccaagctagggacttggctctcgtgagtcacgtgggccccccagctctggcaacttgagaagtggctgtgtgctggcagagggtgactggttctgggggtttccagcagggcccccggctgatgacagctccagcacctcatccggggagtggtaccagaacttccagccaccaccccagcccccttcggaggagcagtttggctgtccaggtgccaatatctggggaagggatgtgggagggggacagagagggactggggagtaaatgagtggggaactattggatgcattcgctcaaggggaaaaggagaaaggaagggtaaaagaagagagggaaagtaactttttaaaaaacaaagcaaggccaggcatggtagctcaagcctgtaatcccagcacaaggcaggaggattgcttgaggccaggaatttacgactagccccgggaacatagcaagaccagtctctacaaaactaaaaactaaatattagccaagggtagcacgtgcctatagtcccagctcctcaggaggctgaggtgggaggatcgtgtgagcccaggagatccaggctgcagtgagctatgatcgtatcactgtgtatcatgcccctgcagggtcagagcaagaccctctttctacaagaaaacaaacacaagcacaacaagaatatgaagaggtggggaaaatggatgtggacgggatggagaaatagtcaaacaggttgctttgataagaagtgagctccctgtcagtggaggcattcaagcagaagcagctggttggctccttgggggagactgtggtagcagaggggcttccaacattcaatcgtccaccgtgtcgtgcagtgtgccattgtggagaccatagccctgaaccagacagacgaggctattccctcagtgctgatgttctagtcagggacatggccggaagcaagatgatcagatggcttcatgcagcatcccacggggatagtgatgtggagccagaaccactcagctccgtcctgtggggcagcagggcaatgactgggtctcccactaatctgggcctctctgcccacagggtcccccagccctcagcctgactccaccgacaacgatgactacgatgacatcagcgcagcctaggccggggccagccgaggctcctggggtggctctgaccctctggcctcctgctctacctactccctttcccctttcccaccctcccagctcacctccccatggagctgagaggcctcccttggagagatggaaggaaacgttataccttgtacccctcggtctccatccatcaagccaaacctgctgccacagccctcccccggccccagatagcagccccagggaggatgctgcctccaagaggtgtgagccctctgtctcggggatgaacaagcagagtctgggctacctcttgacagctggtggaggggagttggggagctggactggatgactctggaggccccttccaaacctcaagtgtccggcgctttgattgcctgagtttctgacacttcagggcccagaggtcctgcgaggggcagaactggacccccatgccagtgctgctgcaggagggcccatatactagggtctgctgagctgttgtcactgatcggtgggcgctgggggggtagggtagcacaccagctgtcccaggctttgctccgggcggtaactgcacttgggcagggaatatagccttcctgggcacaactagctgacaatgacaggttgactgtgtacccccaaccaaggagctggggcccaaggccagtcctgccccagagacactccaagtccgccaggggcacagaccagttctgcagtgactgtccctggacaatgggtctttattctgagtttcctatggtttacaaagagggccccagcccagccccaccacagatcccagagataggggcccagtctccatgggggcaaggagcatagagatgttttccaggaaggggctcagaagctgcactaggccccgagtccccatgtgtctccttgaattgatgaggatgctcctgggagggatgcgtgactatgtggtgttgcacccggggctgcaaacgtctccgtgcagcccccagagagaggcccatgggctcagaccaggctttgttgtcctgctctgagtatcctgagattaaactgaattgctgaatgaaaccagggcgtggaatgacaatttcttaaacctcatagaacccaggctgcatgtgtgtgtgcacgtgtgtgtggcatgtatgtgcatgtgtgtgtgtgtgtgtgtgtggcatatgttggatacaaatgagacaaagagttgagctcaaatcttttatttgggaagtaatcccagggagcagcagtaagaaaatgaggaagaaagagggggaaggaaggaagacaatgttcatgaacaggttgctattatgggcagccagagctcaatggtgctggggacctctgggagacacacctcagaattgtcccaccaagggggcagggagctgggatattgacccaccctctctgcctgtcattggttgaggagacattaacccccagccccagcactaccgagcggcctgtgagtgagctgggcacacgctgtgtcgggagaagccacaggcagagggtcagaggcacatgctataaggaaccatcttccatgggaatggtccaggaaaagcaccaacagcaactgctccatgttcagagtgtgtgtgtgtgtgtgtgcatgtgtgtgtgtgcgtgtcagggagaagtcaggttgtggcaatggtgggggcaactctatctgtttaggaggaaatgctagggaactggaaaacccacggtggctcagcaccataaaaaacactggggaggccgggcaccgtggctcacgcctgtaatctcagcattttgggaggccaaggcaggaggatcactttagcccagaagttcaagaccagcctggacaacatagtgagaccctgtctctaccgaaaaaaaaaattgaaaatcatccagtatggtggtgcacacctgtagtcccagctacttgggaggctgaagcagggaggtcgcttgagcccaggaatttgaggctgcagtgagccatgaatgatcacatcactgcactccagcctgggtgagagtgagactctatctcaaaaacatttttttaacactggggataggaaaacagaacctgacagactgagaggcagggtctatgagaactcaacctcactgcctccctgggctgctccacagcagccctgggctcagcggcaggggttactgcactgaatgagttcccgcctgagcccccaaatcttcaaaggtagtataattccagggagttttatgcttagagttgcctggaaaaggattgcaccaccccagaaggaagtggggatgaggctggtggcgctggaggggactggagcggatccgcactgagaaatcggcattgcctccagtcctctgcccattcagggctatgactttatccctgctgccatggccagtgcccagctctgcctgcggggtgagggttggggctcaggttttctccgagccgtctcgggaggggcggatcatgaaggaggtggggctgtgtggtgggcggggcctgctttccattcacctgtcccagaggtggagagaaagccgcgctccccagggcaaccgtcacaggatgtggttggcagtgttgggccccctcctcgggccctctgaaccctccccagggtggcgggggattcctaggggaggagccacttctggggtaggtggggcagactcagcggcagggggcttgtgaaagcctgtgttcaactccccactccacccctcctggcagtgtggcctcaggcaaatcactcaacatctctgagactttgtttgctgtaagttggtctgtagaatgtgtgggcagtagtgggtaactcacaggtggtggtgagggttagagggttggtagtaaatgaccccgtcattggtagattaatcactgcaggtgagagcgctccttaaaaggagaaaggggaagccaggaggcactcagcagtgcctggggtcttcagtgcgttagtgctgggggcagggcggggcaagggttgggggaacatggagaatgtcttgtcccactctcattttacaggtgaggacactgagacctagggtgggaaaggacctgtccaaggtcactgagagttagtaacagagtcacaattcaatccttccccacctcgtgcccgccccagctcacacagggagatggcaatgccttctgagtcacccccatttccccaacctccccggagctgcctctctcaccccagctctcccacccagggccccccacagtctctgagaaattgggaagctctgccctagccctgggcagtctgaagaaacagcaccacacacagtaggagggctgatcccagctggcccctgtctctatgtctcccagggactcagacctgggacctgcaccttattgagccgacatgggccaggcctgtgctgagactgggaaagctgagatgaatgacagccaggctctgacctgaaggagcaccagcctggcagggaagtcacaaacataagcaggtggcttcccctccactcctgggagacctcattataatacgcctcaaggatctgggacaggaaacacaaagaggctcaatggacttggcagcggaacccagtggttccagaaacattggcgtggggggaaaggctgtgtcccagaacggaagcacccagcaatttgactgacagctctgcaagctcaggcagagagtgatgcacagggaattcctgggaagctgatgcctgatctgggttgtagaggatgaataggagtgaaccaccgacgtggagagggaaaagcattccaggccaagggaatgacacgagcgaagacacagcaagaaactgcacggctcgcgaggtcaagggaggtccagtttgagaggagatgaggctggggatggtcaagtctcacaccaaccccatttcatgggtgagaaaattgaggcccagagaggttaagtaaaaagccaaggtcacacagctaaataatgacagtgctgggacttaaatacagcctagcttcagagtctgagtgttaatcatggctcttccagtgtccctgtgccaccacagccacacagctgggcattattaccagagccccagcctagaatctggagacaccggcctatctgcccaccaacagcacaggcaccggctgcattctgggatacggggttcgggaatgtagaatcatcactaccaggcacccttatagagccagctctgtgctgagctctgggaggcacagaaaggaatggagcctggcccttgccgctggggagtttacaggacctggggcagagagagaccagtaactgccgttcatcaacatggtgatgatgacggtgggtagcatttactatgtgccaggtatgtgttgtttcatacaatcctcataagggcactctgagaaggtattattctccctaattcgtaaatagggcaactgaaaccccgagagattagatgactagccagaagccacacagcttggcaggtagcacaacttttccacctcactgcaaagccccagtgtgaaaacaccacgccgcacagcgagggctcatgataagcatgtttaacccacatgaacttaagtgtgtgctcagcagcaaacagaaagacaaggggcaacccagcccaatatttcccttggttgaacaaacacccaggaggagacagacaggagctgtggagcctccgttccctcagatcctggaagccgttcatcctgtgggtaccttgccatgctgggtgagattttagctgttggggattcatttttcatacacggtgggcctgaaacaaagcccaccatttcaacgagctgctctaatgctgcagggaaaacacctggtttggagccagagcagggcagactcacatgcaggcgtcttcctaagggagtgttctttcctttccctcactccctccctccctgtctgccctcctccctccctttctccctccttccctccctccctccctccttccctaccctccctccctccatcccttccttccttcttctttccttccttcctcccttccttctctttctctctcttttcttttttttttcttttctttttttttttgggatggagtctttctctgtcacccaggctggagtgcagtggcagagtctcatctcactgcaacctccgcctcccaggttcaagcaattctcctgcctctgcctcccgagtagctgggattacaggcacacatcaccacgcccagctaatttttgtatttttagtggagatggggtttcgtcatgttggccaggctagtcttgaactcctgacctcaagtgatcgtcctgcctcagcctccgaaagtgctgggattataggcatgagccactgggcccagccctttctttttttaaaatgggaaataccttaaccgtattaaaactccaacaacatgaattcataccattaaaatcttgccccctccaccctgccccttcctccccacccggcccacccaaggtaaacacaattgtgtctctgatgtagaaagaagcagatgtgaacccctcttgctgcctaccccttcttatacagaaatgacgtccgggcaccctcttgggctccttgcttctttttacttctctggtatcccagataacgttcctaagggaagagtgatgctacccatatttgagtttctcccacatgctgtccaagcagataacttttgcctcatgtagggctccaccacaccactacagaggctgtgtggacagagaggaagaagccactaactgccagggtttagtgggaaaagcatgacaaaagagggaacaatcaagtcggccattgaaggttgtgtaggagtttgctggatggatgagtgaaggatgttctcagtagcaacacgtgcaagtatggtgcatgccgcctgaaggccaggggaaaagggggtgcgcaggtgggaaagaccatggggagcatctccaagggtcttgtgtaacttgacccttgtcattgtcttagacctgctgggagttgcgagcagtttctaaggcagggaagtgatccgatgagacggatgctctagaaaggttgccgctatgaagcggagggaggtttgatggggctggggcctggaggaagggaggccagctggggggtggtcagcactgggagatggagaagagggaacgagttggagacggattcaggacttggagagtgatcacagacatgggagatgattttccaacacagcagcctccagccatgatgacaatatgacggtgacattaatgatagcttcgattcctgagggcacactcagaacctgtgtgtcgggcactgttctgagcacactgcaggtactgactcatgtatgctctcaacagccccatgaagaaccagcatcatccccatcttatgactgaggaaacaggctcaagaatgttcagtttttcccagggctatcagctgaacatggtgtggctgggccctggctgccactgcccctgccctcctcctttccatgtgaaggtacaatccacaccaaaggctcacttctgtgcctcccaatgcccagctggagccacacacagctcttcaggccccacaattaattggcatcctccagacatctgagagagcccaaggggaccaggtcaggagcacgctctggcaggattatcccaccagggcccacatggatgtggctctcaggctccgaggctgctcccagggagcacaggtactggctttccttccttggcagggcatcacctgcgggtccctaaccttgtcccctggaaacctcacctccgacgtacacctgtccatcccccacccctccctatcgccccatctgcggtttccacttccgcccctctcaaagaccctcttcatggttctggtgaacggacagagcggctggagcccgtgtggccacctggcgtggacctctcttggccgccrtccccggccccccgtcctcgcttcgtgaggatgggatggagtctccagagtggggaggtgcaggggagccccagggaagggatgggttgaaagaagcttcagtggaaagttcatctcccgccacatccttca

SEQ ID NO: 17795 - DNA, 40045 bp, Homo sapiens
cccaggttcacgccattctccttcctcagcctccctagtagctgggagctgttacaggtgcccaccaccatgcccggctaatttttttttttgtatttttagtagagacggggtttcactgtgttagccaggatggtctcaatctcctgacctcgtgatcctcccgcctcggcctcccaaagtgctgggattacaggtgtaagccaccgctcccggcccatctcttctaggttttctagtttatgcatgtaatggtgttcatagtagatttgactgatctttttctgtggtgtcagttgtattatctcccgtttcatttctaattgaacttatttggattttattccttcttttcttggttattcttggttaatataatggtctatcaattttatttatcttttcaaagaaccagcttcttgtttcattcatatttaaaacaattttttttgtttcaatttcatttagttctgctctgatcttggttatttcctttcttctgctgggcttaggtttggtttgttcttatttctctagttccttgaggtgtgaccttaaattatctgttggtgctctttcagactttttgatgtaggcctttaggacaatgaactttcctcttagcaccaccttttgctgtatcccagaggttttgataggttatgtcactattgtcattcagttcaaataattttttaatttccatctttcattgttggcccaatgatcattcaggagcaggttatttaatttccatgtatttgcatggttttgaagattccttttggagttaattttcaccttattccactgtggtctgagagagtgtttgacataatttttttttttaatttattgaggctcattttgtggcctatcatatggtctatcttgtagaaagttccatgtgctgatgaatagaatgtatattctgtggttgttgggtagaatcttctgtatatatctgctaagtccatttgtcccagggtatagtttaaatccattttgttgttgttgttgttgttgactttctgtcttggtgacatatctagtgcagtggtatattgaagtcccccactagtattgtgttgctgtctgtctcatttcttaggtctagtagtaattgttttataaatttgggagttccagtgttaggtacatgtataattaagattgtgatattttcctgttggacaaggccttttatcattatataatgtccttctttgtctttcttaactgctgttgctttgaagtttgttttgtctgatataagaatagctactcctgctcacttttggtgtccatttgcatggggtgtcttttttcacccctttaccttaagtttatgtgagtccatatgtgttaggtgagtctcttaaaggcagcagatagttggttggtgaattcttacccattctgcaattctgtatcttttaagtggaacatttaggccatttacattcaacattagtattgaaatgtgaggtaccattccattcatcatgctatttgttgcctgaataccttgattttatttatttaagtatttatttatttactgtatttttgttttatgggtcctgtgaggttcatgctttaatgaagctctgttttgttgtgtttccaggatttgtttcaagatttagagctcttttcagcagttcttgtagtgctggcttggtagtggcaaattctctcagcatttgtttgtctaaaaaagactgtatctttccttcatttatgaagcctagcttttctggatacaaaattcttagctgataattattttttttaaggaggctgaagataggtccccaatcccttctagcttataggatttctgcttagaaatctgctgtgaatctgataggttttcttttgtatgttacctggtgcttttgcctcacagctcttaagattctttcgtcttgacttcagataaactgatgactatgtgcctaggtgaagatttatttatttatttattttgagatggtgtctcgctctgctgccaggctggagtgcagtggcgcgatctcagctcactgcaacctctgcctcctggcttcaagtgattctcttgcctcagcctcctgagtagctaggactacaggcatggcaccacgcccagctaatttttgtatttttagtaaagatggggtttcaccatgttggccaagacggtcttgatctcttgacctcgtgatctgcccacctcatcctcccaaagtgttgagattacaggcataagccaccacacttagctgcaataatcttttttttttttttttgagatggagtcttgctctgtcgccaggctggagtgcagtggcacgatctcaactcactgcaacctccacctcttgggttcaagcaattgccgtgcatcagcctcccacgtagttggggttacaggcatatgccaccatgcccagctaaattttttttttttttttgtattttagtagagacagggtttcaccattttggccaagatggtcttgatttcctgacctcatgatccacctccctcggcctcccaaagtgctgggattacaggcatgagccactgtgcccggccgtaatgatatttttatgatgatttcccaagtgttctttgagcttcttgtgtatggatggctagatttctagcaaggccagggaagtttttttttttcaattatttccctaaatatgttttccaaattttcagatttttcttcttcctcaggaacaccaattattcttaggtttagtcatttaacataatcccaaacttcttggaggctttattcacttaaatttttttctttgtcttttttggattggattacttcgaaaaccttgtcttcaagctctgaagttctttcttctgcttgttttattatattgctgagactttccagtacattttgcttttctctaagtgtgttctttatttcttgaagttgtgactgttttttatttatgctatctatttcactgaagatttctccgctcatatcttgtgtcatttttttgatatccttaagttggatttcacctctctctggtgcctccttgattagcttaataatcaaacttctgaattctttttctggcagttcaggaatttcttcttggtttggatccattgctgatgagctagtgtgatttttgggtggtgttaaagaaccttgttttgtcataataccaaaattgtttttctagttccttctcttttgggtaggctatgtcagaggggagatctggggctcaaggctgctgttcagattcttttgtcccacggggtgctcccttgatgtagtattctcccccttttcctagggatgtgacttcctgagagccaaactgtagtgattattattacttttctggatctagccaccagaagggctaccaggctctgggctggtactgggggttgtctgcatagagtcctgtgatgtaaactgtcttcagttctctcagtcatggataccagcacctgttccagtagaggtggcaggggagtgaaaggaactctgtgagggtccttagttgtagttgtttgatgcactagtttggtgctggttggcctcctgctgagaggtgaagccagctggacttcctgggtcgaatggggacttggagaacttttctgtctagctaaaggattgtaaacacaccaatcagcgctctgtgtctagctaaaggtttgtaaatgcaccaatcagcactttgtaaaaacagaccaaccagcactctgtaaaatgtgccaatcagcgggatgtgggcggagccaaataagggaataaaagctggccacccgagccagccgcagcaacctggtctggtccccttccaggctgtggaaactttgttctttcgctctttgcaataaatcttgctgctgctctctttttgggtctgcactacctttatgagctgtaacactcaccgcgaaggtctgtggcttcactcctgaagtcagcaagacctcgaacccaccaggaggaagaaacaactccggacgcaccatcttttagagctgtaacactcactgtgaaggtctgcggcttcactcctgaagtcagcaagaccaggaacccaccagaaggaagaaactctggacacatctgaacatcagaggaacaaactccggacacaccatctttaaaaactgtaatgctcaccgcaagcgtccgcagcttcattcttgaagtcagcaagaccaagaacccattggaaggaaccaattccagacacactgccatgaggtagtgctttcatgagagcatcagctgtggtatataggggaggatcaggtggtgggtgggacactagaacttccaagagaatatgacctttgtcttcagctaccagggtgggtagggaaggaccatcaggtgggggcagggttaggcatgtctgagctcagagtcttcttgggtggggcttgttgtggctctgtggggaatgggggtgtgattcccaggttaatggagttaccttcccaggaggattatggctgcctcttctgtgtcatgcaggttgtcagggaagtgggggaaagctggcagttacagacctcacccagctctcacacaacccaacaagcaaatctcacttctactgtgttcccccaaaaagcaccgaatttgtttccaggcagtaggggagcaggattgagaacttgccccaggctactagcctcccagcygagaatgcaagccagacttttgtgcctccctacctgttaagtctgcacaccagattcacgccctttcctgagttctggacaggaaagtttgtgttcggttggaattgttactaagttcagctggaggtttccttctccctgtggtcttttcccagttcctccggcagcccctgtgagacaagtcagaaatggcttctctggggacccacagagacgacggggctttaccctttgcttcctctacccctgtatttcgctcagctctctaaattgtctgagctccaggtaaggtcaaatccttctcctgtgatctagaccttcaggttccccaagggtgtgtgttcaggggtggacaatacccctttcacacttttcacagtttgggcattcacagtatgtgggctattttctgggtcatgcaggagcaatgtactttcttcagagggtctgtggattatcttggctttcctgttatatccttgcagcagttcttggagcaaaagttcacaatgcgagtctccacatcctgctctgtccatccaagtgggagctgcaagttagtcctgcctcctatccaccattttttcctattttgtattttaaattaaaactcattagaatgtaaactccatgagggcaataattttaatccagttttttcactgctaaatacctcaaaactgttacatgtgctgccattatcatggacgttctaaacatttctcatgaatgaatgttgatatagcacagtgctgatctcaccacctgccacaaagtaaaaactctctaaatgtcaaacactactattataagtaatactattctatcattgagacaactatggttctgtatctctttaaggagtgcagtctaggcaacaacatatttcaacatcaggtatctgttatctcatgttcctaagttcatctttttacctgatcaatattagtaaagatctatggcctcaagtgaactttactctatgaatttacaattgggaacttaggttgaaaatttacctagtattatttattctgctgctataatttattatttattctgctgctattgttgccctaatcagttatcatgctcttactggactctgacatggtaagtaatgtcaattaatatagttgtgttattttaacattatttcaaaatattttaagtgaaatataagactcgttacaaaaggacttagacagaggttataaattattaactttttcctcaagagaagtattgtgtacttaatgacaagttcctagtgcttagaattgttaaaatctttgtgaagcacaccactgaagatgaggttgaaaaacctgacttttatcatcatattgataatctcaggagaactctatgcagaaggtaaaattaattcttaatattctttattctctaaaacatacaaatggagattctaatatttatacaactcaagttttaatatactcttctatttkcattatcaattttataacatattttataaatataactttttataatatttagaccttttcctttgagcaaaattagtaaagtgttcttacagtagcataagtcagaaaagcaaaacaaaacaaaaacccttgtatctctagggggcataggagaccaggatctaaatacttcgaaaaggttttcaggttaacaatatgtccatttcgaagtcacatgttaactttaattctaaatttatgctagaatccattcctaatactgacaaaacttgtacaattttaattctgttcataaggtgagagtttaatgtgggaaatttgaaaaggaaatagccataaatattttttacttttgagactttgatttttatcacaatgaattattcatttgttggagacattaagtagtgattagtaggtgaaccatataattgcttgtacaaacagggacacttagagagtaaaagaggggctctattaataactgtttggacaacacatgtaaatcaggactttccaaacaaaccaatacctatggactccctattagaaagctttatagtcagattgcccaatgtgtaagattagtgtgcgagtggaagctaggcagtgtacatgggtatgttgttcaggaacattatcaatattatcaggccrtaggatgaagaatccagggaggacacttagcattagcaagagtgaacatacaaagaaggaagctacagcaatacagcttttctaaaataaacatttttgggaatttgttgaaattaaatacataagttttaactgtgttttagttgaatagttaactataaattttctaccaaaacatctataattaaaattataaaagtgaaagacacagaattaatcttattttatacttttaattctataataggatgatttttgcatgaatttcttttgattttatttttctgtctaaatagggaaataccagcagatataattgtctgttatctataccataaagacattgcaatattctagttaattttctaattattataaggttataatgctattttacacaacaaaaaaaaaagtaagctgcttgaagaccaagacaatgattttatttttgcatgcttctctcaactcccattgtgcacttcagggacaagaattgaattaattgtgtttctcatttcatggtatgcaagtattattggcctatgaaaggtctcactcttgctttacttacacattttatccccttattcctaatcttgaagtccatttcccctgggacctactacaatgttttaacatgttactctagctctctcaaccacaaatagctctggaatgaatattgtaatataaccaacttatctttctgtamgaatgtcatcagtctgtattcactcacagatagcattattgagtctattcttgtacttgatttctgtaatgagagattacttttgcagaatggcagttttgaagtatatcatctctgagagaggatgtaaattgttgctcctcatcattctcaccaacacctcatattgtccatttttgtactggttgctatatggttattcataaagtgatatcccatttttatttatttaccattctctgatcagtagtaagtgtgtccatcgcttcatgtactttttttaatatgttcagacatctgtgatttcctggtttatatgtgattagtatattcctcacatttctcattaattttttgtcaggaattcatattctccaaggcattccagctaccttaacaaataatgtgcctatcctggtggtggagggagatgtcccaggacagagagtctttaaagccacaacctaggattgttgtgcagagaatactttgctgcccctccctgacaagcaactgtgcccctcagggaaatttcttgtgtattcaccattgcactgctattttggaagactctttttattgtaaattcctttggtgcttgggtgtgaaaaaatggtgagaataattctcaaggaatggggactatccagcccatgtttttctgtctgctccatcagatagtggaagttttgttgctcatcattccacatccatttccttcaaacctaggctagcactactagtattttatgtctcatagtagcattaaggtatacagtgatcaaccaaggcattgaagccgtagtaatcacactggatcyaggccttcttccatccatgactgcccatgtttcttcccaccacagctcctaggattgttcgagcatttctttcttttaagtgtttttatgactttaagatcttcaacataaagatatatttttaaaatatatgttttatttggagtataacatatccagaaaaatgcaaaaatcacaggatacacttatatagtttttacaaaattttacaccatccagatcaagatatagaacagtgatagtaccccagaaatatgatccttctaaggcactaaaccccaaaggtaaccattctgacttctattatcatggattagtttgttttcttttaaaaagttatgcaaatgtatacattaattcatatgtgattggcttctttcactcaatattatgtttatgagattcaccatttgttcatttctgttgttggataatattccattgtatgcatagtctaaaatgtgtttatcttttctattatttatgggcatttagattgttcccagtttgggactatatgaatactgccactataagcatttttttccatgtcttttggtatacaaatatgtgctttttttattgggtaatatggtttgtacatgttttaccccaatatatattgcaaaggtgttctctcatagagtttggactgatttatactttcagttgtagaaatatgcgagttccagtttcttcacttcttcacaatcattgagatagcttgtctttttcatttcagcagttctattggatatgcagtagtatctcatggtggtttaaattttcatttccctgatgactagtaatgctaagtaccaggtctctaaccatttaaatatcctattttgccaagttcttgccaagtattgctttgttttacttggttgtctgttttttcttttaatgctatttatttcaaaattttttatgagttagcatatgttaaggagaaactttayctattcctgaactgtactgtccaatacagtggccatcagccacatatagctattggagacagtacttaaaatgtcactagttcaagatcagatattctgtaagtataaatatgtagtggattttaaagagttagaaaaaaaaagaatgtaaaatattttcaatatattgggttaaataaaaacctattattaaaactaacttcaattgttccttagtatttttatgaatgtgactattagaaatttttaaattacataagtgacttacaatacatatctattaggaagtgcaggcagggtggagtggttcaagtcttgtaatcctagtgctttgggaggccaaagcagaaggatcctttgagtccaggagtttgagaccagcgtgagcaacagagtgagacccctcatctctacaaaaaataaaacaaaaattagccagatgtggtggcatgtgcctgcagtcctagctacaggagaggaggcttgcttaagcccaggagctcctggtggcagtgagctatatttcagcactgcactgaagcttggataactgaggaagactctgtgtctaggaagaaaaaaaaaagtactgttctacgaagttatgcaaagcttccctgaaaaagtggtctgctaaattttatcatgactgttggatgtttaaagtcatttgcagatcaattatgataaaaggactscttgagttgtcacaaaagtaccttaaaaatttaagtaagaaaaataagtactagttgaagtgtctctaaaaacttttagtttgtattgtcacctgattacaaatttatgtttttagatttgttttyccattttcagcttgacatttactcatttcagagaaaccctgtggttttcctcatgtggaaaatggaagaattgcccaatattactatacttttaaaagcttttactttccartgagcatagacaaaaaattgtcatttttctgcttggctggttataccactgaaagtggaagacaagaagagcaaaccacgtgtacaacagaaggctggtctccagagccaaggtgcttcagtaagtcagctggatatgtcactcaawgtttcaatactcaaagaaatttgtatataaaaataggggtccaataaaaatggaaagcggttaaaccttttagtagataagaacaaaatcactagcaatctgtctttctacaaaatgaaggcataatttgaaatccagtaaataatgcttttacattaaaatgttattttctgtatctgtttttaataatactctgttgaagggaatagggtaataactgaaattatcatattgcaaggcaaagagaggtaatttactttaagtaacaagaaacttattttgataattaagcatargatgccagaaaaatgcttgaaactctggcctctggaagggcaagattgctactctaatgctttatcatttgtaagactcatctctcttcatgtgccaacttctctcatgatacccattgaaaaatgtgtttttcaattttgaattgaaagtttgagttcaaagttgtgagaaggtaatctaattgactcatttcattattttatatcaggctacactatcatcaaactatcaatgatcttccactagggcaggtgacccagagtaaggggctttggttgagccagtttcgtttaaaagaggatgttgaatatggctattgtggttgatatatctagtaaacctatctagaagtagatgtggtaggggtagaaattactataagaactaaaattagtaaatacaaagagagtcagtgttaaattgaatccattttcaaaaaaattatgcagatatttccaaaatgaaatcgccaataataacattatacttttggcttaattttacaatttagtaaaagacaagcttagtttcatcattaagttaaataattttttttcccatagaaaaatgcactaagcctgacctgagtaatggttacatctctgatgtaaagttattgtataaaattcargagaacatgcrttatggttgcgcttcagggtacaaaaccactggagggaaggatgaagaagtggttcaatgtctctctgatggatggtcttctcaaccaacctgtaggaaagaacatggtataagaatcatttcctaaaactgaagataagtgcttatcaagcttatattgaatatattgaagcttatattgatatctattawttaatagaatttatttttcattatgtctacaatgcaggaagttgatattacattgcttttctcaagtactaggtgattccttaatccaaatgttctcaatccctacaacccacctacgccaatagttcctactttgcatcaataaaaggaattggaatggaataaaatgaaagaagctttttctttatatgtcactatttcctttattacagaagaatttaagatcatgtacattattttatattgtgaaccaatgtcagatatacttaaaaatagttcaataatttaaatatatgtatactttgttagtaagttgtttaaattgtaaaaatgcatagacagcacatactttcacaattgctactgcacaagcctttagttgaattttggcctttggtcaagcacttgtagactagaattttaaaaacagaaaactggtagagttaggtcacaaggtgtatgaagaagagaatagaggcaaagaaaaattggggctatttttcaattttgcyaagagttgattttaccatgtattcttaagatttgtraaaccatattttgagattttttataatctaggttattaaaaaagtttataaaataaataatttttataattttagaaacrtgtttggctcctgaattatataatggaaattattccacaacacagaaaacattcaaagtgaaggacaaagtacaatacgaatgtgctactggctactacacagctggaggaaagaagacagaggaggtagaatgtctcacatacggatggtctctcacaccaaaatgtaccagtaggttctcatttggaataaaatctactctcactctgaaagctttttctcatagagaagtgtatataagttgtcatgctcattatgtttcaccttttcatgcatttttgcctttatttttaattatgttgatagcagtctttgataattaaagctctcaagtagaataaatwcattttagctcacagaattaaattagaataagcctaatgatatttaacaaatatataaaatgaattcataagctttttggcaaatttaatttctattctagttatgtcatgtaaatagtgcattttgttgtagcagaaaaaataaacatttgtttgtaattttattcattcttttatttgcagaattaaagtgctcttctttaagattaattgaaaatggttattttcatcctgtaaagcaaacctatgaagaaggagatgtcgttcagtttttctgtcatgaaaaytattatctaagtggatctgatttaattcaatgytataactttggttggtacccagaatctcctgtatgcgaaggtaaatttttaaatttaatactcgcaaaatgccatgtctttatcagctttaatctctattagctctgacaaaattcctgtggtcatatctattttttttcctgagtcctatttttaaaataaatattatcttttaaatcagtgctattttyagcaatctttaatatatcccacctgaataaatcttgttttgtcttagtttgtaaatgactatatcttttaaatttattattttaaaatatctattatacattttaaatcccttattataacgaataacttttcttattgggaattattaggactaattaccccaatctggcagctttgcaaggatattttctcttaatttgccacatatttccagatgtaaaaattaatctccaaaatagtgaggtagaaagcagagaaagcaggaaaagcagaagaataatgcccagaagtgaaaatgggaaaagaggtcatcttgtaaaagctgcccaaaaatgtaatatctatggtcacatttctattactggaagtgtccaaacaggtaatgcaattacctgtcagaagacatccatagttatttaaacaaacctacaatttaatatgaggagggtcctatactagcagaagatatgaaaacagtaattgcagatatgaaaaaaataattgctataatgtgacaaatggtacaatcaactcaggtacaaagtgcaggaataaacattagagattctgattggtatgctgtggaatagcattcacagaagtgatggacaatatttaagttgggtcttaagagataagtagcagtttgagaattgggaggatagggtgaggcaaagggtttgatagtcattttttattttctgtaataygggatataaggtctattgacaggcaggtgaaagacatgaaggtagaacttggaggaaagtggtgaagatttgaaacaggtgctaggggaaacaaatgagggctctgaccatgggtatgcagtgggattgccagaactatcataattccctaaatgcactgtacagtaactttaaagattttatgatttttcatttgtgctcgacatccttggtatagtagtagagaagtagattttttaagcaaatttttttaaagtctattattccttatttattttttatttttttgagatggagtcctgctgtgtcgcctaagctagagtgcagtggcacgatctcagctcactgcaacctccacctcccaggttcaagtgattctcctgcctcagcctcctgagtagctgggactacaggtgtcggccaccatgcccagctaatttttttgtgtttttagtagagacagggttttgccacgttggtcaggctggtcttgaactcctgacctcaggtgatcagcctgcctcagcctctcaaagtgctacttcaaaaataaatggcagacctacttaaggccttttatacccttctcctcttccaaattagccagcatgacaacatgcctgttttttccggtaaacagtcattaggcatacaatggctaatataattcagcccacaacaatataattcagttgtgggctgaattatatctctcttactcctcccaaaatatagccacattctaatactgagaaccattaaaygttaccttacacggtacaagacactttgaggttaacaatcttaaggtaggaatattatctggaactatctatccagactctaaatataatcacaaatgcttttataaaagggaggcagagggagattgactgcagaagaggaagcaggagatgtgacaatggaagccacaggttgaaatgttttgaggaaggggttgtgagccaaggaatacaggtgatttcaagaagctagaaaaggcaaagtagctgattctcctccaaagyctccagcaggaatgtggctctcctgatatctcgattttagtccagtgaaactgactctggacttctggcctctaggactgtaggaggataaatctgtgctgttttaagccactaaattgtaattcatcaaagcagcaataggaaagtagtgtggtcagtattttagagcaggagactttaatttagacagacgtgggttcaagaacagatctgctacatgctattaatttatttacttcataagttttagtttgtctataacatgggagaaataatagttcctacttaataaagttattttaggactaaaagaggtaatgaatgtaaaatgcctgctgtgttagtattctattggtgcgtaacaatgtcaccacaaactcagcagsttaaaacaacacaaagaaattatttcccattgggtgtaggttgggggtctgggtgcggcttaaccgactccttgcatcgatggctatcaaagctgcaatcaagatgttagctggactgcagtctcatctgaggcttgactgggcaagacttcttccaaactcactgtagttattggcagcattcagtgctttgcagactgctgaactgagagcctctgtttcttgtggctgttaactgaaggcagccctctgccccttgccttgcagccgttctgctttggaagctcatgatgtagcctcttgtttcttcaaaaccagcaaggakagagagtctcttggcaagaatggcgttaaaaactgatgttacataattatgtgtgcataatcacgtactaatccatcacctttgctgtattttgtgggctagaagcaagtcacaggtcctactcatggaaaggggtatcacacaaggaagttaacatcaggaggtgaggatcaaaggaatgctcctagaatcagtctgccattctctctatgatgcttgacaygatgaatattttaatttaatctttattattttttgtaattatatgactaaaggtgctgattaattttttccataaggaagaagaaacagatgtcctcctccacctctgcccataaactccaaaattcaaacacattcaacaacttatcgtcatggagaaatagttcatatagaatgtgaacttaattttgagatccatgggtcagcagaaatacgttgtgaagatggaaaatsgacagaacctccaaaatgcattggttagtaacaccttgaagaagctttgctaaaatgaaatctgcatgtgtagctaaatggtcagttctctttcaactgtaccttttcagaaggacaggagaaggtagcctgtgaggaaccacccttcattgaaaatggtgcagcaaatttacrctctaagatttattacaatggggataaagtgacatatgcatgtaaaagcggctaccttctccatggatcgaatgagataacttgtaatcgtggaaaatggacacttcctcctgwgtgtgttggtatgtatgctacatttaccatcagtagctaaacttatggtgtaaaattttccattctgttactttaatctgaatattcctaggaaaagaccactgcttaggcaaattagaaacacattgctacagcacctactcttctgctttgcatgtgtgcatgtgtgtgtgcctgtatgtgtagctatctgtagaatttaagtcaatgtaaagaattcttaaacaaaagttttttttgaacgctagtgctaagcacggttatctgatctgtgtcatgccattacctgtaagttctaaatgacaacacataaatgacgatgtgcttcattagataagtaaataagggcatggtggattgagtgacgggccatgagcattatctacttcttctccccatatgtcctgcaaagttagggtagtgcattctgttcttgaccttgggtaagtcctgctgatattttgcatctggccattctgaaccttatgcccttctgagacatgtccctggtctttcattttactgaaaggcaccaccaggctacactatcattcctggagactactcttcctgtcatctatctcatttcttaatcagatcagagcaacatctccacacacatgtttatctaggatatttattaaataagacaaaagcaatgaaggatgctaaagaaatagataaagtgagagaaagataccaaaaagaggaaaaaaattgatatttccttcatgggtctattgagacctgagatgaagaggaatgaaaaagaagaaaataaaagtggggtaatgccaaagagcaattttagaattgaccataatctttaggttgaagaacagtttctcattctataggtttaagaaatgtgtatatcataattccttcacaattgagaaaagagaaaaatacgtatagttgtttttaggtaacatatttgctgtcaactcttgcttagcaaattttaaaaatatttgagctgaaaaaatttttcatatttgtaatgaatttataaaacaattgtcctaaattatataatacaaatatcgagacactatagtatgagttactatagtatattgttatgagctcatattaattttaaaacaacctcttttcttagaaaataatgagaattgtaagcatcctcctgttgtaatgaatggggctgttgcagacgggatattggcaagctatgcaacaggatcctcagtggaatatagatgcaatgaatattacttactgaggggatcaaaaatatctcgttgcgaacaaggaaartggtcatccccacctgtttkcttgggtaagaaagagaacacatggaatgtctacgtttgtacttttatgtgattttcttacagtgttttatatcatgaaaatgatgattttgtacaaatcttttttcacaagtgttttctctctcatttctttaagtagaaagtccctaaaatattagtgtattttttctattgtggtaaaatatacataacataaaatttaccacygtagctatttttaagtgtacaattcagtggcattaagtatattaacatttttgtgaccaattagcttttgggttgtctttctcctagctgaaattccctccctggtatacagccctcaatatctctgcttgtattgccctcagaatgtcatttcaagaagaataattagtcctattctttccttggtagagtatattgctaatatattatagagtatattatatagagtatattgctaaattttaccaccgcatcctcatctgaatggacacgtttgttacatcttgttgattatataaaagtgtttgctaatgacttagataataaatggtcttctaaatgttttacacacacaagcacacactccacaaaatgctatgatatgatgcagaggtatatatcttagattttttyrctcaaaatatattgtaaacatggtttgtcatacttctacaatatatactttaatggctgcatagtattccataatgcagatatacatatgtaatttaaccagtttattgatggatgtttagtgttcaacatttttatattccaaacagtacactttcaagtaaatctttgtacatgttaaacatatttatttttgttaaaaataattatcatgagatcaggaattttaattctttttctattaattggcaaattgtctatcagaaagtttgttctgctttgttaaccctaccataagtgaattaaagtagtaatcatcctaatctttgttaactttgaatattttaatcttgacattttttgttaagcaggcaagcacaattattttaatttgatttatttaagaattaattaatttggaattttttaactttctagtagccacaggtttttttacatgaattaattattcatagtttagccattttttcatacttataaatctatatataaattattttatccaattgagaatcatgtttattssaattatttttaatttatttttatttatagtgtttttaagtatatataagtgtatgttttaagtcttgagctctttcaaccttttgttagtagtttccacctttcaagtaattcttaggagtcgattcccattcaaattcagatacagatacatattcacatagaattttgctattggtctcatatttttataaatgtttttgatattaagtttttgatgctttggttgatattgcattgagtggagatatagtaatctctaaggacaaagmctagattaaaatatttatggcaaagctggtaatgaaacaagctcataaggaaataacaacatttaaggaaatacatcattctatatctggaacaactgcctcaagagagttaggtttggtcctaatgaatcaaagcaaataccaaatgaagattaatcattgttatcagggcaagagaaaggggctttgtatatcttggtaactattgaaactggaaaggctatcagtacaaattcacaacagtatgataaagcrtagaattttctctgtaggaattattattccagacattaagagtctctctaacctctccatactctcttccctgctctaatcactccagtctttctggtctccttactyttccacaaacaagccaagaatgctctcacttcagggcctttgcactggttgttccctttgcttgggacactctttcataagaaaatgacatggttcactcagtctccttcaagcttttgtgcaaagtccccttcaagcttttttacttcttatttaggcctaccctaatcaccttactgaaaagtgcaacttctcttcacctagctcttttgttaccccctcctgctccagtactctttttttcatctaatttatcttatgctgtagtttaaagatggccactgtgttagtctgttctcatgctgctaataaagacatacctgagactgggtaatttataaaggaaagagatttaatgcactcacagttccacatggctggggaggcctcacaatcatggtagaagacaaaggagaagcatggaacgtcttacaaggtggcaagcaagagagcatgtgcagggaaactcccctttataaaaccatcagatctcatgagacttattcactgtaatgagaacagcatgggaaagacccaccccaggattcaattacctccaaccaggttcctcccatgacatatgggaattatgggagctacaattcaagatgagatttgggtaggcacacagccaaaccatatcagccacaaattatacaattcatgtctttattatatttattatgtattgtaggtgtttctcccagttagaaggtaagctccatgggagcaggagtcttggttttattcattagcaggttttctattattttctacatggtagttaaaggtttttattttatagaaagaaaattattattaatctaactgattgatgcccttaaatagtatttttgatgttttaaattaagtggttttagtttatgacaataatgtatagattcatttgatagtaataaagtatatattttcttatatatatatgtgtgtgagagaagccttaattatgatttcaattataaaatattgcttttgaaacttgtcataatttttgttttaaaaaatatcacttttatatttgtcagacaagtaaagaatttaaaagagcattttgttttacagaaccatgtactgttaatgtggattacatgaacagaaataacatagaaatgaagtggaaatatgaagggaaagtcttacatggagatttaatagattttgtatgtaaacagggatatgacttatctccattaaccccattgtctgaattatctgtgcagtgcaacagaggagaagtgaaatatcctttatgtactagaaaaggtaaaataataatgttctctgcaagtatctttacttgaccaatatctgctacctcggttgaaaatttatttatagtttgttgctatttttcttattattattctttttaattttgttttattttattttattttactttgagttctgagacacaagtgcagaatgtgcaggtttgttacatgggtatacgtgtgccatggtggtttgcaattccagtaatggaattgctgcgtcgaatttcatttctggttctaggtccttgaggaatcaccacactgtcttccacaatggttgaactaatttacattcccatcagcagtgtaaaagcattcctatttctccccagccttaccagcatctattgtttcttggctttttagtaattgccattctgactggtgtgaaatggtgtctcattgtgattacaccttatacaaaaattaactcaagatggattaaagatttaaatgtaaaaaccccaaaccataaaaactctagaagaaaacctaggcaataccattcaggacataggcatgggcaaatacttaatgacgaaaatgccaaaagcaattgcgatgagagccaaaactgacaaatgagatctaattaacctaaagagcttctgcacagcaaaagaaactatcatcagagtgaacaggaaacttacagaatgggagaaaatttttgcaatctgcccatgtgacaaaggtctaatatccagaatctacatggaacttaacacaaatttacaagaaaaaaacgaacaacaccatcaaaaagtaggcaaaggatataaacagtcacttctcaaaagaagacatttatgtggccaacaaacatatgaggaaaaagctcaacatcgctgatctttagagaaaatttatacctatgaccccaattcaccaccatcatattctaatctataaagttgagaggagtgatccaacttccaaacttcaatcagcatatatacctatataggatggccatgctgacatcttttaattccaataagtcaattttatgaagggaaaaaatcaagaggttttataaatgttgccagactatcagagaattgatcaccttcttgtgagcactcaacaacmaacactgtaaagcattgctctacttagggctttctggggacccattgtctcagtactcactggctatagggactattacttttaataaggaagaaaaggaaaataatatatacagaaatcatggcttctagaaaaatcccatatacacttagggagaaataaaatcatgattgttaatactctcatagttttaaatatgcatgtaaacactataacgtgggattctaattataaaaatacattgtatggtataatattattgcaaaaacatcttcaatattttaaaaatatttgagaactgcctaaaaaatggctttatggctaggtgcagtggctcacgcctgtaatcccagcactttgggaggccaaggtgggcagatttcttgagcccaggaattcaagaccaacctgagcaacatagtgagaccctgtctctacaaaagaaaaatgcacctgtagtcccaactagttgggaggctaagacaggaggatcacttgagcctgggaggcagaggttgcagtgagtcatgatcatgccaccatactccagcctgggtgacagagggagactctgtctctgtagcacttataaagtactggatgttcattatagcaattcattgtatactttaaaacttatttttgcagaatctaaaggaatgtgcacatctcctcctcttattaaacatggagtcattattagttcaacagtagacacctmtgaaaatggctcttcagtagaatacagatgttttgatcaccatttcctagaaggatctagggaggcctattgtttagakggaatgtggactacaccaccattgtgtttaggtatgtactactaaatatgcctctaacaaagtaaaactatatatttttaatttgctgtcatttttgagttaacataacactaatataatgctatatttgctacatttgtgttattttattcatgtgcttattttatcactgctttctattctttcctctagatcataaatacctatagttcagtttgttgtaatacatatttttttaaagacaaaccacacatcaggttggtatgggctataagttgaataagccatagtggtgtgagtaaactttaacaattatcattcattgtgattggtactataatagaaaacattagggaaacatgtataatagaaaacaatgcggaaataaagaaatggacaactcaatatggaaagatgaagcaagttaatgttttattagcaaggcatcctagtaagagtaacaacatttactaaggccctcagaggcatgaaatagcacatctgtaaataataagaaaatattttttatttccaattctgacttttatttacttctcttatcttctttcactggctaggacttcagtacaatgttgaatggaagaggtagtggatatctttatttgcttcccattctcataagtaaaacctttgataattcacctctatgtgttgttataaatatttttttaaaaatcaagttaaaggtataaaaacctttctttctattttgccgaaagtatttttaaagaatcttcaatctgtgtttaatttttagcaatatctgttgaaataattacatrattattacttttgttttttcccctgcaaatttaatgaattatattssttcttttgaatgttaaagcatgattctattcccataagaaattccacaaggttgtgataaattatgcatattatatgttatatttttatttatcaatattttactcatctattttcatgagaaagactggttggttattttcctttctggtttgatatcaagtctgtgctgacctcatcccatgaatgggaagtgttccgtcttttctggttctctggattgatgctatttcttcctttataattttaagagttaaccagagaagccatctgggacttgagtttttccgtgaaaagacaaattgacagcttcgatttgtttaacaaataatggtaattatttcttcttctgtcagttttggtagggagtggtttcttgatggttcattacaactacattgtcaaatctactaacataaagtagttatgacatcttcctatcctctttttgatgtttttattgatgtatcttttgttattacttctattaatatgtatctgtcttgacatgccttgctaagggtctatacattttattagtgttttcaaaaaaccaacatttgcatttgttgattcatcaaattttgctttctattttattaattatgctrttatctttattatttcctttcttctatgttcttggatttcttttgttactctttttctggcttgtttagatgaatacatagattactaattttcagcatttatattttttctaatacatgaatttaaaaatagaaatttctctctgagcacaactttaacttcatccaaaccatttttatatcttggatttttactgtcattcagctcaaaaattttatagtattcattttgatatattctctgtgctctgaatcatttagaagtttctttttaaagttctgaatatttaggggattttctagttttcttttggttactgatttctagtttaattcaattaagacatactttgaattatatctgcactttaaaatttgttgatatttgctttataacaagcatgtatttgctttaggtaaaygttcttttchttgaaaagttaactttgtcattgttgggttcactgttttatatatgtgaattggattgagttttgtttttgatgtttaagttaatccaaagctgtactgatttgtgtgtgtttgttttctatcaatcackgagagaagcatgttaaagtctcacttggcattttaaaacattactaattttagttctgtccatttttgcttttgtattttgatactatttcattaggtacacacacaaattgagacactaaatcttcgtatcttggtgtattggcattgtctaattttaaaagacctccttcatatatagtaatgctttgcctttttttttgccttgaggtctcctttagctgcaccaaggggcttttgacaagcattcatgtagtacacatttttccatcccttaactttcaaccttctgggtttttacttttagtgtgcctctcttataagcaatatataccttattttaaaatatacttatgcartttataattttttcccttgtaatggaatagtctatttacatattcatgtaattactaatatatttctgtttatacctaccaaccctaccaactttctatactaggtgtatgttactatactccatgtatatcccattggtcatctccctctttctctctctctctccatataggtgtgtgtgtatatatatatacacatatatatatataatattttaagttctagggtacatatgcacaatgtgcaggtttgttacataggtatacatgtgccatgttggtttgctgcacccatcaactcttcatttacattaggtatttctcctaaagctatccctcccccagacccccacagacaggccctggtgtttgatattccctgccctgtgtccatgtgttctcattcttcaacactcacctatgagtgagaacatgcagtgtttggttttctgtccttgtaatagtttgcttacaatgatggcttccagcttcatccatgtccctgcaaagggyatgaactcatcctttttaatggctgcatagtattccatggtgtgtatgtgccacattttcttaatccagtctatcattgatagacatttgggttggttccaagttttgctattgtgaatagttctgcaaaaaacatatctgtgcatttgtctttatagcagaatgacttataatcctttgggtatatacccagtaatgagatcactaggtcaaatggtatttctagttctagatccttgaggagtcgccacactgtcttccacaatgattgaactagttcatactcccaccaacagtgtaaaagcgctcctatttctccacatcctttccagcatctgctgtttcctgacattttaatgatcgccattgtaactggagtgagatggtctctcattgtggttctgatgaccagtgatgatgagcattttttcatatgtctgttggctgcataaatgtcttcttttgagaagtgtctgttcgtatcctttgcccactttttgatggggttgtttttttctcgtaaactttttaagctctttgtagattctggatggtagctctttgtcagatggatagattgcaaaaattttctcccattctgtaggttgcctgttcactctgatgatcgtttcttttgctgtgcagaagctctttagttcaattaaattccatttgtctattttggcttttgttgccattacttttggtgttttagtcatgaagtacttgccaatgcctatgtcctgaatgatattgcctaggttttcttctagggtttgtatggtgttaggtcttacatttaaatttttaatgcatcttgagttaatttttgtataaggtataaggaagtgatccagtttcagctttctacatatggctagccagttttcccaacaccatttatgaaataggaaatcatttcccatttcttgtttttgtcaggtttgtcaaacatcagatggttgtatgtgtgtgcattatttctgaggcctctgttctgttccattggtctatatatctgttttggtaccagtatcatgctgttttggttactgtagccttgtattatagtttgaagtcaggtagcctgatgcctccagctttgttctttttgcttaggattgtcttggcaatgcgggctcttttttggttccatatgaaytttaaagtagttttgtccaattctgtgaagaaagtcaatggtagtttgatggggatggcattgaatctataaattaccttaggcagcatggccattttcacgatattgattcttcctatccatgagcatggaatgttcttccatttgtttgtgtcatcttttatttcgttgggcagtggttagtagttcttgaagaggtccttcacatcccttgtaagttggattcctaggtattttattctctttgaagtaattgtgaatgggggttcactcataatttggctctctgtttgtctattattgatgtataggaatgcttgtgatttttgccattgattttgtatcctgagactttcctgaaattgtttatcagcttaaggagattttgggctgagacgatggggttttctaaatatataatcatgttatctgcaaacagggacaatttgaattcctcttttcctaatttaataccatttatttctttctcttgacagattgccctggccagaacttccaacactatgttgaataggagtggtgagagagggcatccctgtcttgtgccagttttcaaagcaaatgcttccactttttgcccattcagtaagatattggtggtgggtttgtcatgaacagctcatattattttgaggtacattccctcaataccttgtttattgagagtttttagcatgaagggctgttgaattttgtcgaaggctttttctgaatctattgagataatcatgtggtttttgtcattggtcctgtttatgtcatggattatgtttattgatttgtgtatgttgaaccagcattgcatcccagggatgaagccatcttgatcgtggtggataagctttttgatgtgctgctggatttggtttgccagtattttattgaggattttcacatcgatgttcatcaggaatattggtctaaattctgttttttgttgttgttgtgtctctgccaggctttgatatcaggatgatgctgacttcattaaatgaattagggaggattccctctttttctattgattggaatagtttcagaaggaatggtaccagctcctctttgtacctttggtagaattcggctgtgaatccatctggtcctgggctttttttgatttgtaggctattaattattgcctcaatttcagaccctgttattggtctattcagacattcaacttctttctggtttagtcttggaagggtgtatgtgtccaggaatttgtccatttcttctagattttctagtttatttgcatagagtgtttatagtattctctgatggtagtttgtatttctgtgggattggtggtgatattccctttattatattttattgcatctatttgattcttctctcttttcttctttattagtcttgctctcagtctatgtagtttgtttatcttttttaaaaaaacagttcctggattcattgatttttttgaagggattttttgtgtctctatttccttcagttctgctctgatcttagttatttcttgccttctgctagcgtttgaatgtgtttgctcttgcttctctagttctttcattgtgatgttagggtgtcgattttagatctttcctgcattctcttgtgggcatttagtgctataaatttcccactacacactgctttaaatgtgtcccagagattctggtacgtagtgtctttgtccttactgggttcaaagaacatctttatttctgccttcatttcgttatttatctagtagtcattcaggagtaggctgttcagtttccatgtagttgtgcagttttgagtgagtttcttaatcctgagttctaatttgattgcactgtggtctgagagacagtttgttgtgatttctgttctttttcatttgccaaagagtgttttacttgcagttatgtggtcaattttggaataagtgcagtgtggtgctgagaagaatgtatattcttttgatttggagtggagagttatgcagatgtccattaggtctgcttggtccagagctgagttcaagtcctggatattcttatttaccttctgtctcgttgatctgtctagtattgacagtggggtgttaaagtctcccattattattgtgtgggagtctaaatctctttgcaggtctctaaggacttgctttattaacctgggtgctcctgaattgggtgcatatatatttagaatagttagttcttcttgttgaattgatccctttaccattatgtaatggccttctttgtctcttttgatctttgttggtttaaagtctgttttatcagagactaggattgtaacccctgctcagcaatrgtagacgaccctccccccataacgctgtcgtgtcacaggttgatctcagactgctgagctagcagtgagcaaggctccatgggcgtggaaactgctgagccaggcaagggagggtatctcctggtctgtcggtggctaagaccttgggaaaagcacagtatttggtcaggagtgtaccatttctcactgtgctgcccaggctggagttccttagaaacaaatcagaaacaaatctctccctctctctctttctctctctctctctmtatatatataaatatatatatatatgagttagttccaagatggccgaataggaacagctccggtctgcagctcccagggagatcagtgcaacacaatgagactctctttgtacattttgttcttcaagttagtagcattccttgaaccttgatgtacttgatatccttcatgggttttagaaatgtttggctaatatcttttaaaatgtacatttctcacctcttctgtgatgccatattacatatattacatctttttgctatgccattgtctctttaaatctatattttctctcattttcttcttgtttcactgtagtaattttttggtaattttctcattgtatcatttctttgtttctatttggtaattttcttctagtttaacaatcctctctttagatgtatccaatctgctttaaactcatcttttgagttctcaatttcagttatcatctttgcatttctattttatattttctttttgtagatttgagttatctgatgaaagatcctagcttaacatcaacttcttgaacatataattcatactttttattaaggcttgtctgcaaactccaatatctggatctattttttagccccaaattcttgatatttttgttaacagttgattgaattccaaatattatacgtggaaaatttcaggatgtttggatgatgtcagcttactccaaagaagactyatctcatcctctggctgatgattagtgtagaggcagttggttttaatacaattagaaataaagctttctctatgtttgttttcagacctctgtttgccttttctcacagactgtaactctccagggctctttacagagggtttgttgtgtgtattaaagctttttctccttgactgtctctgatattactgggagactgccaaatgcccactgtaactttttatttactttctgcttggcttctcatcctatgcctctatacaagtcaaggataagcagtaccttagggaaaagctrgtgcagagcctcaaactcatatctctacacttcctatccttctaaattctttattcttcaagtcctggctgctttggtttacygaaattctcatttttctatcttcaactccatgagattttcagaagttctgctggctgtatgcctaagcttaccattctctatcatctaacctctcaggtcagacttagagtcaacaaacacctcaagagaaaaaaatggcacatagaatttttttttttttttagacagtctccttttgttgcccaggctggagtgcagtggtgcgatccctgctcactgcaacctccaccttctaggttcaagagattcttctgcctcagctttcccgagtagctgggattacaggtgcatgccaccatgcccggctattttttttttttttttgtagagatggggtttcaccatgttggccaggctggtctcaaactcctgacctcagatgatccgcccgccttggcctcccaaagtgctgggattacaggtgtgagtcaccacgcccagcctcacatagatgttgaactcacctgaatacattttttccagaaccttacttccttgactaagttccttggaggttttctgatacctcgaaatgcttcctgtttttcagattttctggttcttaatagaagtgctggtttgatataatctcctctgtcatagctgaaagttaaaggtccatgaatcaacttttaaatttattttaatttaaatctcatgttctgtagaacagtgacatcgtaaattatagtgctattcgacttcattttcacaactattttgtaatgagtgtaataattcttgttcattttcatcacctgtagcacttccagcataatgtttgacacataggcatttaataagtagttgttgaagaaagtaactgaacacagtgctctcagctgcggtttcactttctgtggtttcagttacctgctataaactgcagtctgaaaacgttaaattgaaaatttcagaaataaacaacttataaattttaaattatgcacttagtagtataataaaatttcatgccattccatccttcctgccccagatatgctaaaaagaagctgtaaagtgcttcctttaagtgaaagggcggaaattcttaacttaaaaagaaaggaaaaataaatgtatgctgaggttgctaagatccatggtaacaatgagtcttctgtctatgaaagtgtgaagaaggaaaaagaaatccatgctagtttcgttgttgcacctcaaactgcaaaagttacaagccacagtgtataataaatgtttagttgaggtggaagaggcattaaatttgtgggcagaagacatgaacagaaacatgttccaaaagaatgacaacagggtttagcattatctgcgrtttcaggcatgcactggggctcttgaaatgtatcccctgtaggcaatcagggaggggcatactgtaagtaagtttgttaatgtactacaggtatatgattgatatgccatattagcaactctggacctttttacctgtctcagaagttattccttaatgctaggtcatccaggagacaaataaggacataagaaatcccattttctgaaataatttgatatttgatattttagaaatattaatgtttttattctgtaaaaaaaatcgaagaggtttttttgtgtattttaatacatactttaccattctctttggtttaygatacatgggaaaggacacaactatactttgtatgcttagaatttaaaacgtcttaatccagtcttgatatttcttaactagaaatttgaaagagaagtaactgtcaaccattttggatggcatgaggttataaagcttgggtcagtgttgagaatctacatttccataaaatgttatttatacagcaattaataatttgtctcatgagaattttatttgaactttctgaagaaggaaaagggaaaagagcatgatatcaatgaccattagtaactgtcaatgcttccccccaaatacctttttgtttgtttgctatctttgaaaaagctaatgacataaaactaaaataccttttagtttttaaaactggaagaaaataccttttctccaaatccaggaccacagagagaaatggctcactgttttctgtgagatttgaacatattttctgactcaaatattaattctgattaactgacttgctgctcttaggcctgagaattttaaggtcctcatgagtaggcaacacaacgattcctgttcttaccaagatgtaacaagatagttttcttctttttctttctttttttttaaattgttgttcccagagccatgcacattatcttttactgaaatggaaaagaataatttacttctgaaatgggattttgacaayagaccacacattttgcatggtgaatatattgagtttatttgtagaggagatacttatccagctgaattatatattactggatctatacttagaatgcaatgtgacagagggcagttaaaatatccaagatgtattccaagacaaaggtaagaagttttttttttttggtcagattattttttttggtcagattgttattcaacatttcagaaatgttatgttctataccactcatactttatggcaattgcaaagaaaaaataataatattttcttcattttttttacascaaacaaacaactggaagtggtaatcaattcaacaggccttctgaattgtctgaagtgaaagcaacgtttgccatttgatatttgtgacactttggcaaatggaaaaataaaccaatttatacgtgcaatatttcaatgtgcaaaaattaacctatatgttctgtgataaggacaaaaatcacactttctcctacttctcaatataagttcaagcactactaataaaggttggaaaatgtggtatttattttcaggaccacatttttgtgtaacttttggaaattacatactaaagtgtttcctcatatgacagtttaaaaaatatatcctctgctacttacaggaaataatttaacaattttcttagagaaatgttaaaaaagtataataaaatgatgtaaaccattttgtaggatcacaattttaaccctttttgaagacactrtatataaaaaatggaaattatattttttgttcaactaagaatattaaaaatataagtagtggcaaagtgcatgtggtcctgttttaaaaaatgcaaacaatgaactgtatgaactacataaagtcagttttttagatgctttgaccactctagtaaaaaaatatttaaaagacacacaatagtgggaaaaatttttatttttatttctaattgtggtagcatcagggtggaaaaaattttatatgctatttaaatgttttggtacagtatgaatttctcacttttaagagaaaaaggtaaacacgtagaaaatatttaaaaaatcatgagtagtgtagtaaataatattgcatttttaaaagggaactggtggtattatttactaagtaagatcatttattcttattagtacttaataaaaacaatgactcattatatgaaaaattgaaaggctgagattgtaaktaacacctgactgcaattgatgcttatttcaaaaatctctctttttcccctcaagcactctgtcttatcaagaacccttaagaacatagaaatgaatggcagaaagaggagtcatatttcaatacatcatgaaattccttataaaatataattttgaggaaataagttaaaaacttcggagtttttccttgcttaaatatttgaatctaaattatttgtgctgaacatttcrttatttataaatgaaaaccaataaatgtctaatttttagtttgtatgatttgatgtagaacttaatctcttttgtatgtcttccatctgttacaaattaatctacacatcatattttcatttcctaatgcccattgactagactatatagttgttttcaatatactgtatgtgcaaaaatttcacattcacattcgtcatcatctttattaatattaaggcttttgttacccttaattcaaagtttatgtcactattaaagggccaaacacactagagataagaaactatatgctgtattagaggatctgccttattaaaggcagaagagactgcccttcagactttctaaatgtaaaaaacttttaaaattaactgtaatatttgctacaacgttaataaccaaattgtttatgaggtggtgtactaccatatttgaacatgtgctcaaatattgttaaagagacacaattaaagaaagaatgacccttggaattttatttaattttatttatttatttatttatttatttagagacagagtcttgctctgtcgcccagsctagagtgcaatggcatgatcttggctcactgcaatttttgcctcccgtgttcaagcaattctccttcctcagccttccaagtagctgggattacaggcgtgtaccaccacgcccgctacggttttttttttttttttgtatttttagtagagacaaggtttcaccatgttgaccaggctggcctcgaactcctgacctcatgtgatccacccgccttggcctcccaggactcttggcatttttacattttacactttcaagtctttttttatatcaaataatttttggaattatgcagactacaaaatctgaaataagagagttctacaagcatcaaaaaatgagtgtcagtattatcaaggtctgttagagacatgaaacagcaacactgtcactttttcatttgaagtgagagttatacttctaattatttcagctcattcataagcatatgtaatagcactagtacccagatactaggaccccgattaggattggttgttggtattagaacgagttttcctttctagaaactactcagtttttctaactcaagatcttagtttctcattacgatgatattctcaaatgcccaatgtacaattctctactgctgggtatgaaatagcttcttttggaaatgatgccacagctgacctaactctgtggattaaataagtattaattcattcaatgttaaacatgtatatttcagaactgtccttgagttcatattcattattttaattaatctcctgtagtaggttcccacagtggatctcataaaaatggaaatttaattaaaattaaatatcaacagaaaagcattaatctttttaaataaatttcccaatctatcaattaaataacattattgagcacctgctatatcccagggaacatgctgggtagtacaggattcaaaatgattaaaattcacctcgttatttcaaagaactcacaaagtaaaaaactacttacttagtaaaagagataaacttgtactagtgattgcagactcaaaatgggtgatgattgtggcttatctagtgatatttctagtgaactggagatggcatgcactgtttaacctggacaactacttcgctcaaggtgaataattgtcatgggggaatattgtatccagtattgccatatgttctgatttgttaattgtgaaatgcactgatttttatatgttgcgaggagataaaaaattatttaggcagtgcagctcaaagtaaactccacatgctaaagaaataaaaattttgaaaagtgcaacagtggaagcatgtacgaagtaaagtggtggcacaaagtaggtagtatttaacctttttttttttttgtatgaatgtggtataggaagcttcttggaaaaaagttaaagtaaatctgaggtttacaaaactagaaaacacacttcaagtagaaggaatggcatttgcaaagtcaaagctcatactctatgctaggcattacaccgagcactgaaaataaaacaatgaataagacacagactgtttctgctcttgtggagcttgtctctcggagcggaagaaagatataagcaaatccttacaaaataaggcatggcagcaaagacaccatctttgtcagtaaacaccagatgatactgcctagtactgggtgtttaaaaagtcttcagtgaggaagtgatatataagtgacatataggctgagattggatgggagaaatgataagaattcatgtagagaaagaacatgaaatacagcaaagaacatgacatttccaagaagctaataaaaacccagtatggattgagtggaaaggagtgaaggacagagaggagtatgcgaaacttggagaggttggagccctgattgtgaaggcctttgtaggtcaaattaaagattttggaagtcactaaatagaatgcgatgcttactgggaatttttaaaagacatcactgactgtaatatggagagactgatctgaagggcaaaaagtgtgggcaaagagaaatcactgaggaaaacgaggcagtcatctggcaaagataaggtagtcacttacaccggtggcagcagcaggatggtacaaaataggctgaaataagatatttaggatgtgacatcattataatgataattgattagatgtgggggacagtgaggcagagaaaagagttcaggaggactcctaggttttggcttgactaagtggctatctaaatatgataggaagaatggcaaggagaagcaatgggagggagtggggattagcatgaagagttttattaataattttggaaatgtgcttttgaggtatctgtgagataggaaagtgaaaagactaagtaagcacttgatttttttttttttttttttttttttgtagtcagagtctcgctctgtcacccagacagagctggagtgcagtggcaccgtctcagctcactgtaaccttctcttcccaggttcaagtgattcttgaggaagcacttgattcttatggttgatgctttgatgaaccacctagatttccttcagaaacacaaagacttacttttccagctactgggagctctcacttatcagttccctaaaaggggttgcctcagcttaagggagcctctttccctaaggtcatagcttcttcccaggttggcctacactaatgattgatcaacaggacttataaagaaaaggctcctcacccaaactcaggacagttctaaagagtaatttcagcttctgagttcctcatagtattgactggggcctctggttgaaatgacattgcaactcaacttctcccttttgacttccttcgtttcccttccccaggtgtgaagcccaagaatactccctgaaagtcctcttgtctgctaatttccatctcaaggctgacttccctgggtagctcaatctgtaacagttacataagcctgggtatcagaacagagcactaggcataatttggagtcataagtcagtaggtgtttaataaaactaaggtaatagacgagtttttcagggtgaagatagatgtaggcctacttcagggctttgaggcacccaaagtttagtgtttgggaataggacaagatacaacaaaggaaactgataagaaatggccaaactatttgaatgaaaagcagaagagatggggactaaaaatgctgtttggttattattgattaccttgaaagaaagagcatccagtaggaaattgagacgagagtaggatgaggaataaatgtaaggtacaaaaaatcagaaatatgaatgtagtgagcttgccaatatgtgtgacagtgaatggagggatagaaataaaggaggtctgccgggcgctgtggctcaagcctataatcccagcactttgggaggctgaggcaggtgggtcatctgaggtcaggagttcaagaccagcctgaccaatatggtgaaaccctgtctctactaaaaatacaaaaattgggcgtggtagtatgagcctgtaatcccagttactcaggaagctgagacagaagaattgcttgagcttaggaggcagaggttgcagtgagccgagattgagtcactgcattccagcctgggcgacagagcaagattccatctcaaaaaaaaaaaaaaaaaaaaaaagaaagaaaaaagaaatacataaagaagatttttgttttaataaaatgggagaaatttgaacagtttgagcatgtttacattacattagaatgaagaaccaggtggaagatgttgagaaaatattgcataacagattgtagaagattcttgaaaaaataagaagagatgggaccagtgccataagtaaagggatggcccttggctaggaaaagtgaatttgtggcaggaataagcacattcatgtcatgtgttttttatttcccctgtggagggctatcgtgggagacaagttgaaggactgaggagaggggagaaagtttgaaaaagtcatgtagaaagtgagatgatggcagaagtaaaagatagcttgatgaaaaggcacaatctagccaggtgatttggcaaattgtaatagcttcattgaattatcacttcaattagatttgtgagatgttgaaaataatgttacaataattaccattttgctttttaaatagttttattttgtgagataaattttattctgatgaatatgaaagcaaactttgcttagaagatgtgccatccttgtagyataggacactaagtcaaagatcaaagaatcactaacatggtgattgccccagggtattccaaagcttagaaggatgctacctggttctgcccagagaaactttaatttctcaaagagaagttaagaatttattgatatctgtctttttcttcaagaaaaagaaagatcaaaatgctagagaacattacacattaaacccaaattcagggaaaccgagcctgattcctttgagaaaaaatggaggcaatgggaagcgtaaaaagtctaaccaaaactgagaagcagtttgcctaatacacttctcaaatttaaatgaaagactagtttttagacaatatgcaaggtttcaatttgacaggcattttgtcattatgtactttagaaacaatttatgagaaaatacaaattcagttaatgtgtatacttagcatcaagtaaattactctatgacaagatatttttaaaattacaattttaaagtaatttattattttcctaaaataaaggagcagctctttgacattgtaagacaatccaaacaatacaaatgtaaataacattagtgatataatttcccttattctctcaaatacctcagatctacttccttggtcctgagattagcactgtaaagagtttgctctgtttcttcccagatgtaaatatacacacttaaatatgtatttatatacacattggtttttatatataagtgggctatatattatgtatcatagtgtatatattgttgtaggacttatattttcacccaaaataaaataagcaattgtaatgttaacatatacaggttgactttataataactgaatagcattttataagctgggggtaacataatttatttaattattctttcactgatggacttttcaatggttttatcttccttatattctttcttttacttttcttttttctgtccttccttcccttcatttcttccttcataggttataggtgggagtcaaataataaaatttaaagctgaaatagaatagtagaattctaaacatatttaaaagaaccaatataaacaccaagaaacatcttaacattgaataaacttagatgatggaggagttggaaagaaggagacgaaagaaagaagttgtaagccaattttattttattttttatgataacaaatagacattgcccaaaacctgtggaagtaggatattattttaaaataatagcataaataaactacctaaaaatacccttcttcctaaatagcaaaataaatgta

SEQ ID NO: 17796 - DNA, 385320 bp, Homo sapiens
  misc_feature (1)...(385320): n = A,T,C or G, or insertion/deletion polymorphism (see Tables 1-2)
ctgtgtgactggctaaccgtgtagtggggatactcagacaatcttgtgagtcttcatggcctcagccagttttgctttgggagctgtggcttggtatctatcaccgcgagcgagctcattcagccaaccaaccttcatggaaggaatcaagtcaagatgtacaaccaagcacgtgtgcctgcccatccctcctgccctgaagacacggcacaaaagaaacatttatctacagacaggataactgtgcactttgtttacaaatcaggactctagtgagagagaaagggactgccgttgataagtacaataggacaagactgggacccatggccaccctatctacaccctgttttcaaagctgataaacaagaagggtgcccttcatattgaaattatcaagacattccaaaagctagaaaaatccatagaaatggaatgttcgctttattacatgcataacaattattgctgtgtaaaaaattattccccaaagtaatgggtcaaaacaacaaatactcattatctcagggggtttctgtgtgtcaggaatttgggagcagcttagctgaatggttctgccctggggtcttctcataaggctgctgtcatctgaaaatgacgggctgaatgatccacttgcaacgtagctaactcacatggctattggcaggaaacctcattccccacctcagctctactccactggtctgcttgaggctcctcacgacatggcagctggttgcctccagagcgagcaacctgagtcaaggaggaagctgaaatgcctttcatgatttggcctcagaacttacacactgctcacttaggctgcgttttgttagaatgagtcactaattcacaattgtaaagatatggaaccaatctaaatgcccattaaccaatgagtgcataaagaaaatgtggtatatatgcactatggaatactactcagccataaaaaagaataaaatcatgtattttgcagcaacttggatggagctggaggccattattctaagtaactcaagactggaaaaccatatgccatatgttcttacttataagtaggagctaagctatgagtgtgcaaaggcacacagagtggtataatggtctatggagactcagaaggggaaggatgggaggggcatcagggataacatatactacttgggtcccaggtgcactaaaatctcagaattcaccaccatataattcatccatgtaaccaaaaaccacttgtaccacaaaagttattgaaataaaaaaaaaagagtcactaagcccagcccacatgaaaagggaagatgattaagccctcttttttttttttttttttttgagacgtagtctcgctctgttgcccagactggagctggagtgcagtggcacgatctcggctcactgcaagctccgcctcccgggttcacaccattctcctacctcaacctcccgagtagctgggactacagacgcccgccaccacccccggctaattttttgtatttttagtagagacggggtttcaccgtgttggccaggatggtctcgatctcctaacctcgcgatccgcccacctcgacctcccaaagtgctgggattacaggcgtgagccaccgcacccggccagccctatttcttaaatgaagtatcctcaaatgtttggtcattcttgtcatagttcatgtttgtttttgagattccccttttcctttcgctgcgtgctggctttgcactcagcctgcccccgctgatggcgggagagataagcacctggtctaggaggctgtctcagcagctgctgctgctccaggaggtgtctgtttctcttagtactgtcagtcacttggggtacgtaaaatggaatctgggggtgtgtagggaggggcataataagtttcccatcacagtacagtcatgagtcaccaaatgacattttggtcaatcacgtggtacgcacttgagcacttgtaaggatgctcccataaaattataatggagcttctctatccgggtgtaccattttttaaaatcttttccactgtatttttactgtacctttctgcctttttgctgtaccattccctacagtattcagtggagtcatgtgccatacaggttcgtagcctaggagcaacaggttataccataaaacctagatgtgtagtaggcggtaccacctagatgtgtgagtacactctgtgatgttcacacagcgacaaaactgcctaatgatgcatttcttagaatgtatctttgttaagtgaagtatgactgtcacttggttggagaagttgactggtcagtgggtaggtgacatagatgaatatagatggggtgacctttcctgtctcttgtgacacagcgcatcccygagttccttgtccccagccccaggagcattctttctttggcgtttagtgctacttaagtgctaattctgtgcaataatgaaagcatcagagacaagagggtttaatctgcccagaagaggttcactgggggcaggtttctgaggaggtgaaggcatggattcttgaagtgagagatctaggaaaagaaaaatggactacatgttattataatacgccgagaggagcaggagttttcatctctccaagagatagaataaaaatgatttccaagaatcttaatcttggggtgatcacatttgtttacgtttggagtaagccttgggaactgtgcttggagagaggaaagctgttctgcaagcctgtgtctgaagttctgtcaataggtcactctgcaaggaggccggctcttcacttactgcagaaattagcagtggctgcctgtaaattcctggcttaggaaagtttgtctccgtttttcatctgcttgtactcagagcagattgagcttacatgagcttgggtaagaaataagtgccctgttcgttgtgaatgcccaggctgttaaacgaaaatagcacacaggaaacagtattgcaaaggtcaattcttccagaaaggaagggacaaccagccatctatctgaaattttcgtgtgtagatcctggcctctgaccccacaccattacctaacaatccagtattgaatgtgatgtcggcttccatttcctgtgaatgaggaggcagaatttccatccaaagacagaccatctgccagacgcaggatttgctctttgccttagctggctgttattgatgtctatgaaggctttgtggagacagtgtcagcccaggccgcttgcttcacagagatggtgaattacagggttgaaatccagagcttgcagccaggattttatttttcttcatttttcctctgcaatggctgttttctttcgttcagtcagaaacaaatcaaggacagtcttggggcacatttagttctttggaggaagctttgcaacatccaggtttaaaagaaattggacttttacagtcaacattaacaattgaatatgaaagagcgaaaataaattgatcattaagagaaaatgtatacaaggcccccagcccagtgcacagcacatgttaggtccattgtgaataaaccatttaaccagtcagaaggatccgagaggccagtggctgggctcatctgcaagcaaatctggccctttgagctggaagaaaacaatttttaattctcttgcgtcgatgtgtctgaagttctatgggccacaagtatcaggatcacctaagtacttgctaaaacttgtccttcccagacctttctaatgagaatctccagtgcaaacgccagaggaattgaattcttaacagacatcccagggatcaggtgggttgggagacattgcattatttcacctggtgctcacaaccacctgggaggtttgtattttaccttcacttaacagctgctaaaactgaaggttggaactcagccttaaagaaacaggctttatctttaacagatctgaggttgggctctgacctacttcactgtgtggtggtgggaaagctacatctctatgctgcagtttcctcatctgtatattcaggacttaaaaaatgaaataatgcaggtgaaagacgttagcacaatactccgattatacgaggtatgtaatgaattatgaagtagtaaatagtctgttttcgtgctgctgataaagacatacacaagactgggtaaaattatacaggaaaaacgtttaatggacctacatttccacatggctagggcagaagacatgaaggggcaagtcatgtcttacatggatggtagcaggcagaaagtgagagagagcttgtggaggggaactcctctttttaaaaccatcagatcttttgagacttatccactaccatgagaacagcacaggaaagacctgcccccatgattcaattacctcccaccaggtccctcccacaacacatgggaattcaagatgagatttgggtggggacacagccaaaccatatcagtaaacaagcctaatcattattaactaggttaagtaactagctcacactgtccaataatgatgatttatcagtttgatcagaaagaaaagtctttgaaggcaagaggctttctcgtttagtttcccaagttctaacatagggttgctcatgtagattgactgaatgaatgaacaaaagaagtacactgcaacgctggttggtagtacggttagatatgacacagggcttgaaccaggcctggtttccagatctggtactgagatatggcagcattgggaagggggctggagagcctgtgcttcccactaaggttttttaaaaagaaagtcctgcaccttgttaggaggatcgacctgggttttgggaacactgcaaaacctgccgtgggagggaactcctgagaaaactcctctgcagtgggaagagatggtatggaaggcagcttcctcaaatgctggataaccgcctcctaggagtgggtgctccgtcaggaatcggtgcgaggtcgcaggaccaggatggaatttctgcaggtggtcctaggtctgagcagcacagtagaatcacctgaggctttgaaaactattgagctccacgcattgtgggaaactgagttaactggtgtctggggctggcaatgtctttaactcttactattctaataagtccccaaggttgggaatcatggtaacccgcagggtgggcatcagccatcctccatagctccagccatttctgtctgtgcgggccccctcgctgctgcttttcatggtctccctgagggccgagcgaggctgaagaggtggggtcagcccggaacaaggatgagaaggcaaggcgcaccattctttcattggtgtttctccaaacaccctgggctcccctggcctcacagcctggagagtctcattctgaaagcgtaggagggcgcccgggaatctttttaacaagccaacccaggtgcttcttacaatcaggaaagtttggggaacgtcactgtacacccttttctgggtccaggtcatggaatggaaacgtgagccaatctatcaacgtaaaacctaacactgttgatcaaaagtaacgcccaggtgtcttgtgcctgcgagtccaagcttgtttctcgggcgagagatgcccctttgggcgcttagggccgggcggggtcgcgcgccgggctgtgggccgcggtggagacctgacccgcactccgagggttcccagagagccggggagcgagtagcagagtcatcgtttccagcttcagcctgaaaagctggaccgtgccgccgcatgtgcgcttggcagccgggcgccccgggccctgcggccacatcatcctggggcggggacgtgtgcgctccgggcgcccggacgccactgagccacgtctgagccgcccaccctcgggggtgagcgagccgcggctcggggcgggaccctggcggggggacccgagcggtctctaggacccgcgggacgccgccaactggcgggggtgcgggggagacaataatttgttccgcggtaataagaacggtgactgctggccgtggatccatttcacaggcctgccttctctcactaacgctcttcctagtccccgggccaactcggacagtttgctcatttattgcaacggtcaaggctggcttgtgccagaacggcgcgcgcgcgcgcacgcacgcacacacacggggggaaacttttttaaaaatgaaaggctagaagagctcagcggcggcgcgggcgctgcgcgagggctccggagctgactcgccgaggcaggaaatccctccggtcgcgacgcccggccccggctcggcgcccgcgtgggatggtgcagcgctcgccgccgggcccgagagctgctgcactgaaggccggcgacgatggcagcgcgcccgctgcccgtgtcccccgcccgcgccctcctgctcgccctggccggtgctctgctcgcgccctgcgaggcccgaggtaagtcgccgaactagggcggctcgctgcccgccccgccgagggcaccgcacgctgcgcctgggcgcgccgaggtccagggctgccccgaggggcgacgcgccccggcgcatctccggagccccggggcttgcgcttccagcgcggcgagaccgacccccccgcccccaggtgccaattccttggggaagggcgacacttggcccgcagccccacaggagccagtacctgccccggagggcacagcctcgggaccgctcccccgtcctcaccctcttgggtgacatttgcagatgtctctgtatcttgacatttacacgtgtcactcgggacgatgcgtgtcgggtcctcttgctggccctatcccgcagtgaatatccccaccccaggctccgggccagcccttcaccaggtttcctttccagccccgcctcccccgctaacacacttaggggggcgcgcagcggccccgcaggtgaggcagccccctcctccgcaggtgtgcctgctgctctccacagcaggctctattttcataaactgactctcttacctacttctttagtttcctctctgcccctcttcctggcttccaggtcactccctagctgtcagtcgcaggcaaactttagcggaattctccctccttcctccactcagtttctccgccgtaaataatcgcccccatcaacttggtgcacagcgagaacttacttagtttaacgtacttagttttacagacttargttttcccgagttgtagccccttaaaatcgggcacctgtggctcccgtttgcacagtgaggactcacccagcaggtgcctttttaaaaatccggcaacttccccgggtctccgccgccgccgccttctttctgccgcccggggcgctgtcggtccaccgatgaacgacttcccttggccgcaagctctcaagttctgtgattctatataacaggcatttatttttcaacaactggcctaaatcacgaaccgttaccactttatgatacgttttattttgcgattgccactgctgccctccgcccccaccgcgtctactgtaatgtggctaaaacccagttcttgttaaaagccacactgcgaagaccaattcggggataaatgattaaatacaaagattgcacaaagcaatgagaaagtcaagaaagaatcctgctgagggtttaaagaactctacgacctgtagtgaattgtgctttgaaagacttttaaacaaattggtccttttgaatgtttattaagaaagaactttttaaaaaacggaaagtgtctcaaagtgtgcctgacatggtctttaacttggcacgtgctttgtacacataaagagaagtctactgagcagggacaaattttttttttggaagaaaatgtttattaaatccagctaataatgggaaattatttcttgtgtgtgtgggcgggggaggacttttactattttatgagttcagctttggtagagagagtgtttccttaagacagayatgacccaaaatagaaaaccagggaggcctaagcactttgaatgggttacctattgtgatatattccaggattcactgcttgtttacccttagattctcagtatcaagtcttcaatcaatcagtgccccaaatcataccattgaggccgtataaaacgccaaacatataatgaaacatttctttgcattggcaagagaaaaggaggaattactacctgttgagtctgagcatattctgagtttctccctagccttgtctgtaccctgagccctggcacagttgcctacttggtactttctggggcaactcggcctaacaagtccaaaacagaaccctagatcccagactctctagttgcaaatcattccctccccagccttcctgaacccagtaacaacctcctctgccttctccacatgccttgtgctgacatgcaggaagtcatccctgtgtcccyctttttactccgtaagccaccaacctcctaagtatattcccacctacccacttccttacatcccgaagtgtgcctttcccagtccaggccacattataggaaaaatctcttctgcagaagcctcttatccctcttacccaacgggcctactggcttttcaccttatccctgcatggtatattttcctccacaatagagccaaagttattattttcaaacatgagttagagcattcaagtttcctgtctaaaactccccagtggctctctagcacccttaggaaagaaaatccaaacctcagcatgacctaattcctgttttcctttctgatctcctttcttaccattctccctttgctcaccctactccagacacactgccttctcttcttttcaactacccaatatagtagtgccatcattaaaaaaaaattcaatgtttgcactaagaagactttgcaaatacttttcactgttttgccgtgcagtgttttatggcatttcatccctcttgtaactttttgcttttcctagagttaatgattgccttgtcttgatttttgtttgctttattttctgtgcaccaagctgtgatattgtgatataataagaaatatgtctctgcccctggttcctggcacagaactcctaaaatccttggaatctctggggtattaagagtgtcttttgtatgctaatgagcttgttaaggcatgattagagttgggacttttagtgccacctcccttgcaacctccagggaggggagacggattgaaggttgacttgatcgccaatggtgtaattaatcatggctgtgtaattaggcctccataaaccccccaaaggacaaggtttgtagaatttccagattgctgagcaaatcaaagttcctggagggtggcgtatctagagaggacacagaagctctgtatccctttccacattctctgccctttgcatctcttccaactgtttttcatctgtgtccctaattacatccttcattaatataataaactggtaaatataagcaagtgttttctgtggttctgtgagcttacctagcaaattaactgaacctgagaagggggttgtggacccccaacttatagctagttggtcagaagtataggtgtgacaacctactacttgtgattggcatctgacattggggggaagtcttgtgggactgagcccttaacctgtgtgatctgatgctttctccaggtagatagagtcagaatagagttaaattgtaggactcccagttgatctctactgaagaactggtggttggtggggagaaactcccacacatttgggtgaccagaggtgaaacattcggtactgagagtgagagtagggagaatacttggtttttggtttttcccatcccttacgcaacctctattttacttccacactttctggragaactatcaacctcctttcaatatgatccaacacatcaggtagtctagccatgattttttttttcctgatgtcatctttcctagagcccctcatcctcctgttccaatgtgactcacgggttactttttaggcatacattacagctgttatctcaggactacccttattaccaagacgctaagaattcctcttgcatccttcctgtgttgaatcatctgtattctgagcactgtaaatttttcttagttcattcctcatttctgtggagcacgttttccagtaacttcctgaggatgggtgttgggaagatacaacyttttttgataacttgtgaatatgtcagggatgctttcagctgcaaataacaaaaaaacatgacagcagcaatttttacaagctcgtattctttacaagcagttgcaaagtaagtattttggtggctggtgtaactggtgtgtcaggtcastgatgtgatcggggacccaagcactttcttttatttctatctgcgatacgtagatgttgacttttgcctttatgcttacttcctcatggtctcatgatagctgctgtacctcttggcatcatatctgcattccaggcagtaatacagcagaaaggacaaaaggcagaaccagtcaaatctattttcatcaggaaaataatatttccataagcgtttgtagtagattttgtcttagatatcattggctagactgtgacccagggcccctgctagcttgtacagaatactagaaaagtaaatatttttaactatgtacattgctgcttcaaacaaaacagttctgtgagtaaaaacaaaggttggaatgtgtctctggcataccttgtataaaatatrtagataaacacacattcattcattccacccttgattgctagtttgtttaggtataaaattccaagaaagaaatcatattttctcagtattttataaggcatttcttcaatgtctctatggccattactgcttgagaagttgatggtattctgcttgtcaaacctttaaatgtagtctttttttctttttggaagtgattatcttttttcgttgtcactagtatttttgcgttttatgattatgtgctttagcaatgctcttatcagtaattgttaggaactcagtgggccccttcagtttgaatattcatgttgtcaagttttagtatactttcttatattcgttcttcaattatttcttcctcactgtttttaccacagcttttctgaaactgctattagctgaatgtcccagcctcctgaaaacatcctttaattttcttatctatttttcatccctttacatttttgttctactttctgggacagttatttaatttcatttcccaacccttctatttaaattttttggctgggcacggtagctcatgtctgtaattccagcactttgagaggctgaggcaggaggattgcttgagcccaggagttcaagaccagcctgggtaatatagtgagccacaccccccaaccccaccacatctcaacaaaaaatttttaaaaaattaactgggcaaggtgtcacacacctttagttccagctactcaggatgctgaggtgggaggatcacttgagtccaggaggtcaaggctgcagggaaccatgatcatgccgtgctactccagcctcggtgacagaatgagaccctgtatcaaaataaataaataattttaaattttatcctaccacatttaatttccaagaggtttcttgtgcaatgaatgttcttttattcttattatagtgtcctcttcttttttgtaatggatgtaaaattgctattaactctgaatgtgttagtcattacttgttaaacattttttgttcacctctttctcattgttagctttgagattctctttcccccccatttgtttaatatctgtctgactttcttcaaatgtctgatttttggctctctgttgatatttaataacggggcattaaagagctgattagaagttctgtgtacttccacagatggatttactgactgatgaacattcattttgctgagagacgtccacatatcacagactctatttttcttaggctggtcaatttctccaaggaagaatccttcagcttcctgccaaggcgatttcactctggcaatttaagcctggctctagggcctgtgaactgagcaggggaaaagaagatagtgttgccgttaagtatgcttgtattgtttaaacttaatccttttgttttccgtttagcactttgctaacccaccttcacgattcctgggagtccttatgtacagaacttctctacttcagtgtcttcaggaaatacacctcccatgttggtcggagtaggacaggcaacacctagctgtgttggctttgcaggggatctagggctctatcttctccttatacaggttttcagcctcagcctgtattggccttggcccatacagtgccccctgttccagtgcccagtgccccctgttcccaaacctttccagggttctgcttatccatcccaccttctgatggctgccctcctttccaggtcataagttcccattctctcttccctgctaaataggtaacaacttgtccatcccctttccatcttccaaagctttgctgctttgtgttttaattattattattgtttttttttttttgagacagggtcttgcattgtcacccaggctgatgtacagtggtgcaatcatagctcactgcagccttgaccctctgagctcaagtgatcctcctacctcagcctccctagtagctgggactccaggcacacactaccatgcccaactaatttgttcttaatttttaaatttttggtcaagcatggtggctcacacctgtaatcccagcactttgggaggccgaagcagatggatcacttgaggtcaggagtttgagtccagcctggtcaacatgttgaaatcctatctctactaaaaaaaaagatacaaaaattagccagggatggtgtcaggcacctgtaatcccagctactccagaggctgaggcaggagaatcgcttgaacctgggaggcagagcctacagtgagctgagatcgtgccactgtactccagcctgggtgacagagtgagagtctgtctcaaaagtttttttttaaaaaatataatttttaaatttttatacagacagaatctcactctattgcctcaggctggtcttgaactcctgggctcaagcatcctcctgccgcagccccccaaaagtgttggaattacaggcattgaaccatggtacgcagcctattattgttattacaattattcccttatggcagggtttcaggagggcatacagataaacacctgtgactccgccatgtacatttagaatttagccaaggctttgattaccatgctcgacatatagatgtattttctttctctcacttgtcatttggcactttctaactccttccttgtggaaacaaaaattaaactcatttttaaatgtttcaaaactttcttttcaaaatctataaaaactcaaagtcaacatatacctaattagataaatgttgcagctgtggaaactgtaacaaaatttttcttaaggaatgtagctacatcatttaaagaagctaagcacattccttcctggtgtagatgatgctgtaatgaactcatcagagttgcagaaaaaaaattttgtatcagagtgtgtttcagaggcctccttaagctaaatggtttctgcagcgtccatgatttacaaagacaggtgtagaattttcagatgtttcttctgtaccaaatggctaagccctacaaccctttggctgtgtgcccacagggagctatatgaagcagctctggagtatgtccatgctctttaattgtcaggtctctgggctggagaagtgaaattggtataatctagacaatgtttttgagagtagttgctgtgcatttttcatagttgtttcttcatatgtttggttagtatttttttaaacctaaaattgtcataccagcacattgttacttaaaaaggagtttgtcgagtgcgtcagtgccaggagcggtgcgcaggtctttgcgtgcactatctcctgcaattctgctgaaagaatcttgttgttcctgttagtaccctcattctacagaaaaggaaatgatagcctcagatagtgagatcagcagtgtcagaggcaaggcaatctagtctacctcacgctggagactggatcttaacctagctgtggcaaacagttcataacctatctttgccataactatagcagtgagattgtaattagcttggatctcagcagaacggtaatgcagttcaaatgaacattatttgccaattgaaatgtgcacattgaatattacactttctcacaggctgccatttcaatcttcatactttctccagcccatttttcaccstgtttcttttgtgctttgttgaatgcccaatataccttgcctccagttgatagatgggatggaaaagccgagtaattcagcatcatattgatatttttyatcctttaagcttttatgtcattccaaggctacattaagagctcagcttcttggcaactatttaaaaaattggacagcttcattggataacgttttctgtctgtttacctactcctggaagccttgaactgcttaatcagtttagatgatccattcttagaaatgttgaaacaccttgacatgtcttcccctagcaggcatggtgagcactggtctgcaatttggccaaaagattccttgtattatgtgttgctatgtttgtaattaaagccaggataggatggagacattgcttktgagagatatgctcacttgaatctgaatgtgatctgagaatctagtcttgctttaaaaaaaaaaattgaaatactgggagtacatgaaggattgcctagatatatgagcaactttttttaatatactttaagttttggggtacatggsagaacgtgcagttttgttacataggtatacaggtgccatggtggtttgctgcacccatcaacccgtcatctacattaggtatttctcctaatgttatccctcccctagctccccatccccctgacaggcgccccagtgtgtgatgttcccctccctatgtccatgtgttctcattgttcaactcccacttatgggtgagaacatgcggtgtttggttttctgttcttctgatagtttgctgaaaatgatggtttccagcttcatccatgtccctgcaaaggacatgaactcatcctttttcatggctgcatagtattccgtggtgtataagtgccacattttctttatccagtctgttattgatggacatttggattggttccaagtatttgttattgtgaatagtgctgcaataaacatatgtgtgcatgtgtctttatagtggaatgatttataatcctttgggtatatacccagtaatgggattgctgggtcaaatggtatttctagttctagatccttgagaaatcaccacactgtcttccacaatggttgaactaatttacactcccaccaacagtgtaaaagccttcctattttggttttgttttcatcctgggttttttgttgttgttggtagtgttcttcagagcctgcattaggatttagggtctacattatacctcaaaatgcagctgttgtccgcctatggaaaggtacattcctgaaattaagcatactaagtaaaacttttaagctaaaatcattatttcagccaatttcagtataatttgagaatatcatataaaagatgattgaaaaagaaatctggccccatcattcatttctaaaatatgacaattttaaagttgaaaaatggacatagaataagttatacacccatatttttgccagccagattctactatatgtacttcagaactttcaacatttaaagatgtaaaatgttaaagatatatttatagccataccttttctccccacccattcagactattttatctcagtcttccttttgcagaggctatactactgtgaagttggttggttcgtgtgtgtgtacacacacacatacccctaatcaatatctgatamtcttcatgtatttaactgttaagtaaatggtaccctactatatatgacaaccttctgcaactttttaaaaaatcaatatatattttagacttattcatatatgtgcttggttcattccttttaattgaatgactaaatcataatttgtgtactcctctgttgataataaatatgttttccccaactttttgatattgcaatggtgagaggatccttgctatcttaggtatgggtgtaagctctagggaacctattacaagtgaattactaagctgtagagtacacaaattttttactgtaacgtattttgttaagttgctttccaaattggttgtaccaatttatgtgcctacttattggagagctctggttacctatgtggttgttaatacttggtaatttcaggctttttaaatgttgccaagctggatgttaaatatttcattgttttaattggcatttttctcattactaaagactctaagattcttatgtgtttatatgttcttcgtatttcttctttgaattatttatctttatttactcatgtttctttttaagtttagtttaaacaatcctcctctctttcctgagctccgaaataaatgttgataatttcttctaaatttaaaatttttgcttttcgcttttagaataactggaatttaatttttatttcttgtatgagatccatgtctgtttccccccatctggaaaaccaattgctctagtaacatttgttgaatccttttccacttctgataaccagcaagcacacacagatatgcttctgggttctttgtcctactgttctatttacctccgttccagcatcatattgttctcagtatcccgtacttcacaataagccttcagtgtttagattggttggcgtgatggttaagcttgattggattgaaggatgcaaagtattgatcctgggtgtatctgtgagggtgttgccaaaggagattaacatttgagtcagtgggccgggaaaggcagactcacccttaatctggatgggcttcatctaatcagctaccagcatggccagaacataaagcaggcagaaaaaaaaaatgtgaaaagactagactgacttagcctcccagcctacatttttctcctgtgctggatgcttctttcccttgaacatcrgactccrggctcttcagctttgggactcagacgggcttccttgctcctcagcttgcagacagcctattgtgggactttgtgatcatgtgagttaatactccttaataaactcccctttatatacctctctattagttctgtccctctagagaaccctgactaatagagttggtatgtggtggtgcagagggcagacactgaagccagcttgctggagtttgcagatcagctctgccacctggctcctgacatgtgatgttgagaaagtaactaaccatcctgtgtgcccagactttcctaggtttagcactgaagatgacacatcacaggaaacctctcagtgccaggcaaattgggatcgttgctcaccccaaaccttgaacaaactatgtaatctttttctttccccattttcccttgatgaaatggtgataaagatcatatctacctccacagggccgtagtgcaggtgaaatgaaagaatacatatacagtgctttgaacagtgctcagaccatgctaagtattcaataaagtataaagtttaatgtctcctttccttctcccctcctctccttttaaagttatcttgactagccctgaaactttagtgtttccatatgaacttcagaatcttcttgctaagttctgcaaaatactgtatggggacttgtaggctaatttaggggagaattgacatcctcrtgacatcaaggcttcccatcatgaatgtggtgatttctctatttatttgttccctttaatgctattcaataagttttcaataatattctcttcaatgttcttgtgcatctttgtaagatatatttctagatatcctaagtacctaatagatttattgtcactttagatggtatcactatttttaaaagattttaactttttaatatgaaatttttaaacatacacataagtagacagactgcaatcaatacctgtgtttctatcactcagtttcaacaagtgccagttcatggctgttcttgttttatctgtggagtcatttccttattgaaagttgtaattgatgttttcttttcagtgtatatgaatgttacttatttttgtaggttgactttgaattcagaaatcttgctcaatttttttttaatcctgatgattcaaatcataggtaggtgtttgctcaatttttattctaatagtttgtctgtagattgacgtcatagaaattctaagagaataatcacctgaaagggtaagttttgttttttcctatacattccttattcattctacttcctttatttttcttgtttcattgggtagcatatccattacaatgataaacaaaaggattagccaggcccagtgactcatacctgtaatctcagcactttgagaggctggggggtggggaggggggattacttgagcccagaaatttgagaccagcctgagcaacataaggacaccccatttctacaaaaaaaaaaaagtcatatatgtggcatgcacctgtagtcccagctacgcagggaggctaaggtgggaggattgcttgagcccaggaggtcgaggctgctgtgatcttgcactgcactccagcctgggagacacagtgagaccctgaccctgtctcaaaaaagaaagaaaaaaaaaaaagaagaagaagaagtgattgctagtctccttgttttttttttttttaactttaatgaaaataactaacttttgctatctttacacctttcttttctttcttctattgttgtaggattatttatacctactctttcccagttctgttaatttagaggttacatattctgtttccacagttttagtagtaccattaaatttttaacatttgcatttcagacacagagtccaaaggtagtcagtaactttggcctcctcccaaacaattacaagctaaccatggtttagtgcccttcattgtgcctcctgtttttttattattgtctagaattttagttctgccattttgaaacccatctctcatcaaaaaagatagtggggaaatactaggctttgttctgtgctgagcagtccaggcttatgctgatttatccaatgcaactagtttcctttctttcctttctttttctttctttctttctttttttttttttaaccatggcttcttgcaaaccacttccacttctggatccagtcgcttcttattgaagtagtcttcattgaaggtctctgagtagcaaattccctatatttgtttgcctggaaaatgtttttctttttcatgaatgttagtctaggtatgtatggataaccaaaccagaggttggcgatttttttcttttagcagatattacctgttgtatccttgcgtctcctgttgttgttaaggagtctttcatttaatgactgtgcctttgcactaaacctgcctttttctctggttacttttaaggtagttctttggtggtggtggtggagtgtgtgtgtttgtgtatgtgtagttctgtattttattcgtgtgtttttatatggttttatattaaatttgtgtatttctggccttgtggtgcttcttgartccaatcaattatttaaaaaaatgtagcaagcatctctttaattactgccttgccgtttttgcttcatcacttcctttggaacttttgttatatgtagttgggccttataattcagtcctcctgtttttagcttctcttcatctctttatcactctttgctttatattctgggtgatgtctacaagtctaaatttcagtttaccaattctctcttgagctgtgtctaaatgctgtttaaactgtctattgacttcacatttttcaatatctttactttttcacgtatggaagctttgttttgctctttttcaaacttgcctgatcttcttaaaatgtaatattttaaaattatcttttattatcttttctttgtattcttacatgtctttaataatttgggatttatatattgttatccatttcaggttattatttaaagttcttaggatgctgattctgtattactgtggattatctcttccaatgccttgcaattttaaattgtgagttcattttcagcttttttccctccactgctaccctctccatgggagtcctatgtaccctggattagaagagttcctgtggagcagagtctgtttactcatgacagatgcctcagggatttcccttgtctaagcccagttattgtgggaattttacaccacatggctattctaattttggtctccatacccatgtggcaaaggcttgaagtttctatttctcttgcgaaactccctaaccctcaccagatctctggggagacatgtcactttgaagtttccctgtggcatttggtagaggttttctagccctggtgacttgggaagggcagcctgtctgggcttggttttattcaaggatctagctagagttctctgacttgtgtgttcaagatcatacctcctgtyactgaactcatggtttccaggctgaagtcctatgtctgccaggcctttgggattccatgactttggcagtgggtggatgctctggctaggaattccttaattccctgataatttcctttcccttctttctagttcagttatgtaggttgtcacattttatttaacatttttctgtgtttgtagtagaaaggctttctagctgtgtcaactcagtccactgtgttttcagaactagacatctctgrtaatgattctttgggtcttttagtcaacacatttgttggctgcctattgtaatcccagatttgtgccaggaactggggatacagtgttgagaagaacagacaccctcatttcatggcctctagagcgagtggatcataaaaatgtacagaaaataagttgaacccgcttggcagcttgattctcaacttccagtactccaaacactcagtcagaaaagtcagtcagctgctttcctgctggcatgttagtcttggccttggcagctgcaggggtgagatgtgctaatgatggggccaagctgagctttgggggtgaagccatcagctgttcccatctccctctggcggaggcaaaatgagaacagctgggaagcaaggccaacatccactcccagaagccgctcctctgccagcagaggtgtcaacagaattccagtcatgtgagccttccaggagtgtatagtgaattcattccatacttaaacattctagtatacaaagaagattgtacaatggagtaagccaacaatggagacactcatttgtatatttttgtaaccttcagaatgaatgctatgattccatatagattgatttctccactaatttatctacaggaaaatcagacgcctgatttgccactaaaatttggacatgtcagatttagtctattcaattcactaagctttacttccagtttcttagtagggagagtctgctccttggagcataatttattcagctgcaatagatggtactcttgaaacttttttctcacatactttagtctcttttctgtttcttgtctctgctctcctttaaaaaggtgattatcatccttctttctccctcagtgctgctgaagactaagccattggttatagaggctcagtgagaaagcaatttcaaaagagggaggcagaaagggctgggataggatatggtctgtaaagctaaatcaagacaactgttttcaagcacaaaagctcctagtagaagcatctgcttctcttatggacttcagtgacataaaataatgagatttcttcagcttatctcccctgatgttacttccttatggatttagtgggtcaagagtgctgtgtgttctggcgttgtagttataaaattgacaggtggcttggatcatggccagaattctggacttggagtgagaagtggctctgagttctggcttggcctctttatggctgtgtgaccttgaggaacccactaaatctttctgaacttagtttatttgtcaacaatgagcaaggatgcagcctacctccctgggttgtggtgaattccaaatgagggagaggttggggaatgtgttttgtaatttaaggtcttctcttttgatggtacagggggcacatggtatcactgttcatatgttcattcagtgctgaggtttgtcctcatgccttgaacggcacaagttctcagcatccatgagccaccgtccccttctgctcatggtagatgggtrtccaagttaatcccaaagcttgacagagggggtggcagagaattgggagaggaaggcagtttctattcgtttttctcctaccttaaatctcatgtttccatctttgttgtttatcagtctaccattaggggcatctctgttaaccaggactatttgagattgtgttaataatgtgaactctttcaaatatcatttacttatagcacacaaaatggtcaccagtttccttcttctctgctatatgggactcactgtgggctaggcataagggctgtagagaatgaatggtagcagatgcccaggccaggggcatgaattttcctagccttcagcttccactggctttttgagaaagagatgtgggagggaggataagcgtagaatggcaaggcaaataaaatttaacatgcctctcagggtattgggttggcatgaataagaattgctgcagaaataggaacctcacatttgtgggtgaagcagacacataagctcttgacttatatcttaattaccagttagagcaggtgattgcagcagtaaagcccgttaagcactctacatccttgtggctctaaacagtacacatttagaacatccagaatctgacagaaatgttccactctaagaccaaatattggtggtgttttcccaatttacagcaaaacgtaagtgaatggaaagatctctcccacactactaagattgttcatctgaatctttctgaaactaagttgcagctaccattatcttctgacttgcacagcagcaaatgaattttctaaaatgtttactcagttcagtgcatgatcagacaacacccaagggctcctggtgacaggtttatctgtgtacctggaaaacaatcacatttctgagtggtaattgctctttcttcataggatagaattgaggaattccataaagggattttgcctgtgtggtttctgtgctagcactggttcagtagcttctcatacattctcaccatgccctgggaggcaggcactatgaccactctttcttccagataggaaagccaaggctaggacattcagcttgtgcagttatacagctacaaggtgacgcagctgagattatgcacatgaattactgcacaaatagggaatatactagaaatgggacttacacgaataactaatagtgatgacaccggcatttaacaaaacattcagcagactctcgactaatccctttacatgaattatgtggttaaaatatccctatggcccttagaggtatgggccattattatttccattttacagatgaagaaactaaggcatagagaactcatgatttgccttagcccttgcatcttataagaggctgagccaggattgaactaggcagttgattttcagggcccacatgctaaaccactgggctgccaagggaggacctatgatgtccaggaactcttccatactccagaccctttgcagctatctcagcttgtgtttatcttgggacattgggatttgaggagagaacctaggaagacactgagatagaacaatacttgagtctttagctgtgtgaatcccaggaacttgtcctgtgggctctgacctgcaaggactggcaggaaaaacaggactggagacccatttgcagggcctggtatctctgacctttcattttcgcatcaaaggaacatgtggacttaccagctaaaatttattcttcctgaaggagaaacttactgtttaataattaagtatactatcttctgtttcctctcacaaataaaatgcaggactcaacctaataactgctacctatgatggctgtagaaaatacttgtaaacatgataaatgcacatgcatgagtgcatttgttatttattgctgtatgacaaattgccrcaacttagtggcttactatcacacctgtgtacaatctcacagcttttgtgggttacgaatctaggcacaacttatctgggtcctctaattcagcttctttcactggtttcagtcaagatgttagccaggactggatctcattcaaaggctcaactgggaaggatctgctttcaagctcacagaaacatggcagaattcagtcccttgagttgttgaactgaaggtttcagttcctagctggttcccattttcctaatcagtattctctccaatatagaagcttgcttcatcaaggcctgcagactgagaaggcaatataatctgcaaataagacagaatcacaagttgtataatccaatcatggtctgtgaatattgctatagtctactggttaaaaacaagtcactaagtctcttaacctagtgacttgcttaattctaaccctaccagggttacatatgagagtgaataccaggaggcgggggcactgggaaccatctcaacagtctagcacagtgagttaattagataatcagcattgtaaataccaggaatggctttgacaggtgaaagcgtctgttttcagaggtgtccactcactatgtacargtcctggagctggcagcagcatctgattggtaaggtggctctgtttctgcatttttgttgcttagctgtttcatgtccttttactgcagtgtcttcattgcctttgcctgacagttcttttcccactctcactccaacacttggctgaactcctccttggcttagacttcacttcctcacaggcagccggttcttggtccttcccacccaaccccagtcaaggaaaggtccccctgctaaatgytctcaaaatgctatgtctctgtcagagcacttatcacattctaatcaactgtttgtcttctaggttagaatttaagctctgtggtgacagagaccacatccatcttattctctgttgggtcccccgtgcctagcacatcacagctgctcaataaatattggcatgatgagtaaatagtcccacttggtgtgctgctttttcatttcaacaaatgtgattcactaaagctctactcttaaattttttgtgtttgtacaacctttcatgtaaatgaattttcacatttggaaagtctttttgaaaaaaaataccatgtatccaaatatttgatatggaaaaggtagttagtatatattagtgatacgaaaggaacatcttaaaggaacatcttttggaaatactatgatgctgtaatggatgctaattttcatattgggtagaaaatgtgagctgatagtctaataaaaatcgcaagaggtctctattaattttagcttgttcttatctccctgagaaatgtacagatgcgaggatgggcatgaagaactctatgcatttgcttgggtttggatattctatagctagcatttagtgatctggtgatgataaacttaactatatgtttactttttttcctttttatttcctctaccctcattttaaacttttgaagtgattttagcctaaatgagtaaaaattcaattggggaatgaaatgactccttctaaaacagagctcaccttctgcaactacaaaggcaaaaaaaaacaacaacaacaacaaacttacatcaggctgatttgcaaatcacaagttttactttgttttatgctgctttcttacattgaacttggttattttatttacatccacaatggatagtttcagtggtttgatgaaaatcatttttatgtacaaaaattggaagacttaacatgaaaggttattattgataaactcatagtaattttaaaagtacattccttaaagttgtaccctatttgttgttacaatacatttttcttttggtggtttgacttcagtcctttgtaaaaaaaaaaaaaaaaaaaacaaatcacacaatctaagctgggatcataaaacagtgaattaagttatcaaaggaataatgaaatttatgtttctgaagagttttaatataaataacaactgggtagcctgattagttgtagtcctgggaatatgaactatgagacctacctaggtttcacaaattagtatgcccattcatttgttgtttatcctatattatatatacacatacacacatatatatacacacatgcatacatatacttatatgcacacgtttatatatatacacacatacacatgcacacatatacatttatgtacatatagagacagatctgggtttattacctaatattttaaggattttatgtctgtttttataagagatagtgctatttttcttattatattattgtctagttttggtatcagggttatactggcctcataagttaaggttttctcactttctgtattttgtgaaagagttcgtatragattgttattatttctctcttaaatgtctaatagaattattcagtgtagctatctgggcctggagattcaaaaaatacgtccatgtcayctgagttaacaaacatattggcataacatgtttcataatattttcttatcacttaatgcctgtattatctgtaatgacgtacccctctttaattcctaaaattggtaaattatgatttttttctcatttttttcatcctgctaggaatttaacaattttatcaatatttgcaaacaaccaactttggtttcaaagattttyttttgttatttattttattgatttttgctacttattgttgcttttcttctagtttgtctttgatttgctctttagctgcttttggttgatccttacttagaatattaacataacattctcaatttctagtacagccatttggaaatacaaatatccctggtgcagtactcctttagctgaatattacaaatttgtataggttattttttcattatcgtcagtttaaaatattttaaaaaattctttcataatttttttctatgactcgtggcttatttagaaatatgtttttaaatttctgaatatttgagatgttaagatttttgttattaatttctaattttattttattataatcagattatgtcttctttattacttttatctttacatttgttagagagttgttttatactccagcttatagtctttattgatggatattccatgaatggttgaaaggaatgtaaaatctgctgttgttggatagggtaatgtcccgtaaatagcatagttagttgatggtgttatcaratctcatattaagcttactaatattttttgtttgttatttctatcaattattgggagaggagtaacacctttaactgaagttgccaatttatctatttgtactttcagttctgtcagtcttcttgatgtattttgaaactctttttaggtttatacacatctaggattgttatgtcttcttgacgaattgacctgtttatcatgatgaaatttcctctttatctctggtagtaatttctgtcccacagtccactttgactaacattgatatggccacctcagctttcctatgcttagtgtttgcatatgtatgcgcagagcatttttttcattttttaaaattttcagtatatctatatttatgctcaaagtgcattcttttaaacagtgtgtattagctttgcattttaatcttttctgagggtcactaccttttaattgaaatatttattccaattacacttaattattcttatggagaattacgttcattatcttgctgtcttttactgtttgcccagtatgtttttgcttttttcccttcttttcccattttcttttgtactgagtagttttaatatttcccttttttagctgtagttcttcattttattattatattttagtgtttgccataggaattagaatatgtatctttaacttagagagttatagaaaggatcacgcatcctgctgtgacatcctaaaaggctgcatggaattaatatggaagcagtgttttcatacagtagttttatagttttattttttgtatttaaattattcattcatctgtcatttttacacaaaaggtgaggataggaatccattctcttttcagatgactacccagttatgaccactgactgttttatttccattgatttgaaatactaccttgtttattagatttttttatacatatttgtgtcaatttttctcacttttatatacttatattgatctgtctattcttgtacttggactgtatgcttaattattgctatttgataattctaacacctggtagatctaaacctcgtataatattctttcagaattgttctgtaccttcttgattactttccatataaataaactttagaatctaaaagaaatcccaataaatgtaagcaggattgcacttgaaaagcaggtgatttaagacaggagtaagcacctttaaaatttgtgctatgtgttgtaattggctttccaatcgctgtgctccttgatatggtttggctgtgtccccacccaaatctcatcttgaattgtagttcccataatccctatgtgttgtgggagggatctggtgggaggtaattgaatcatgggggcagttgccccgatgctattcttgtgatagtgagtgaattctcatgagatttgatggttttataaggggcttttccccctttgctccacacttctccttcctgcctccctgtgaagaaggtggctttcgtcacctttgccctttgctatgatcacaagtttcctgaggccttcccagccacacggaactgtgagtcaaacctcttttctttataaattacccagtctcgggcatttcttcatagcagcctgagaacagactgatacacccctttatgttcttcctggcctgtttctctgaagcttcttcattcctagctagtggcattattgttaccaattattatcatatttactttgccaattttctaggttaaaatattctaatttgcattttaaatttattgttggggtcttaggagtctattaaacaaactttccttcccctcttaggttcagaagtaaacgatggcaccggaagcagaatgttagagaacaaatgatcagttattaatacacagctgatcatagaatttggctttaggtctttggctgtgtaggcttactactgttttacttccaaatttgagagtcaccaatcatactggataatattaacaatgtagyatcttgcccaacagggtcatatcccttaacatatggcaaagggcagaccagaatgagygtgctgtagacacatccaggatgacagggagatcccagaagaaatgagacacaaaattaagttcctcctttcaaactcttatatacatcactattctttacctgggggagttaggggaagggagggaggcccggaatattaatctaatggaaattcatgtacactaaaacaaggacaaaggtgggatggtgagggaggagttgagggaaggaggttctctttaaattcttaataatgcagtttaatttccccccttatttttatcaataatttttgatttttttaaattgttagttcatatcctttggtcactttgttattgaagatttgtcttcttttaattgatttgttaagagctgtttatatatgagcactacccttttgtgagccataatttggaatgaacagcataccattcatttattacaaagcactttttaggtgttatttttctagttatttttcttyccttgtcattataaatgggatccaattttcaattttattttagtaatgatatatcttgtattagtttatatacacacattctgggactagcctgtttattaaaatgtcttgctggttttagtagatattcagttgactttcttgggtttcctaggtaactaatcatatcacttataaataacttttcttttctaacatttatttccctgaaatgttattgctttattgcagtgtctcaaacataaagaattgctataaaaatgtgtayaaacagcaataattcctcttttgttttgggttttaatggaaggctcctgatatttcaccattgattttaatattgactgttgatttaagatgtgagtttatgattttaagaacctatttctagttttcaaatagatttttttwwaaaaaaaagtattggatactgaattttattaactttttttagacatgtacagaggtaccatatcttgtctctctctttttaaatcttgtgacctgataaaaatattaattgacttattgatataaatattcattcatggatttycccttatcaaaatattcttatatttttgggacacatcctgctctgtcaaggtgtatcatatttttaatatgctgctgaatttaattccctagtgttctaattaagattgtttgcatctatattaggaaggaaagtggtcttagttctctgtttatacaaactcagtggcttaaaacaataaaacccatctttcgctcatgtgtctgtgagtcagggatttaggctgggcaggtctggtctccgttaggcttgctgccatgtttatgggcctgctgagtataatagagtgaccaggcccttctccatgtctctcccatctccgtagcaggctaacccagcatgttctcatagagaaggcagaggcataagaacagacatgtccttagacacaagcccatttcaagcatctgcttgggacccacctgctaacattccattgacatgtcagggaagcaaactggggaaggaggttctacctcttcagagcaggagtggaaaagccatatcccacccccagacaagggactccttggggctcagatagagggatggtaaagtattagagcaattttagcaatcagccataatcctaaagtttcttttatccagtcttttactgtgtgttttttgggacagtaaaaattatatgaaaataatctgtcacattggggctttaaaaaactctctcttaaaattatctggccccaatatctttatggaacataaatcttgtacagatttttgaacttcttacagacttattggttttgctatttcttattgaaccagttgagataacttatcttttcctagaaaatcatttattgtccccatgttttcagattcattagtataaagaacatgtaatacttgattacaatttaatttttgtagcaataattatactcatttctttttttaaaacttatttttattatgagttgacaaattatatggggcccaaattgatgttatgatttataaatacaacatggaataattaaatcaagtgacttaacatatccatcacctcaaatatgtagcttttttgtgttgggagcatttgcagtttatttccttcaagaatttgaaatgtacaacacactgttattagctatattcatgtcactgtgcaatagatctcaaaaaacaaaaaaccttattcctcctgtttaacagaaacttagtaccctttaaccatcatctcctcatttcccccatccccagacttttggtaaccaccattctactctttgtatgagctcgattgttttagattccacatataaatgagaacacacagtatttgtctgtctgtgcctggcttatttcacttagtatgatctccaattccaaacatattgcaaattacagatttttttctttttaaagactgaatagtattccatttgtatatatactacattttctttattcatctgttgacagatgcttgggttaattctrtaacttgactatcgtgaatattgctgcaatgcacatgggagttcagacatctctttgacatactgatttcaaatcttttgggtaaataccgagaagtgggattgctgggtcatatggtaatattgcagggtcatatggtaatattattttgaggaacctctatagagtttttcataatcatcatactaatttacatttccaccaatagtgtacaagtgttttcttttcttcacatcctcgctaacattcgttatcttttgtctttttgataatggccattctgacaggtgtgagataatatctcattgtggttttattggcatttccctaatgattatttaygttggactttttttcatatatctgttggtcatttggagtatgtcttattttgagaaatgtctagtctggtcccttgcccattttaaaatcaggctaatagttttctttctacagaattgtttgaattccttatatattttggatattaactcctattagatgaatggcttgcaaatattttctcccaatgcttacattgtctcttcattctgttaatttttttcttcattgtgtgaaagctttttagtttgatgtaattccatttgcttatttttgcttttattgcctgagcttttgggacaaatctaaaaaaaaattgcctrtagaccaacatcatgtagattttctttgtttccttctagcaatctagtttcagattttatatttaaatctttaatccagttttagttggcttttttgtatatagtgtgagataagtgtccaatttcattctactgcctatgattatccagtttttccaacaccatttattgaagagactgcactttttctatcatgtatccttggcacctttgtcaaaaatcaattgaccgtatatgtttgggttcatttctgggctctctgttctattccattggttgatgtgtctatttttatgcttagtaccatgctattttagttgctatcactttgtagtatagtttgaaattaggtactgtgatgccttcagctttgttctttttgctcagtactgctttggctagtcagggttttttgtgattccatataaattttaggattgttttttctatttctataaaaaatcacattggacttttgatagagattgcattgaatctgtagattgctttgggtagtatggccatgttaacaatactcattctttcaatccatgaacatggactatctttcatttatttatgttttcttcagtttatttaacattttataattttcaatatacaagttctttaactccttgcttaaatttatttctaatattttgtttaatttttatagctattttaaatgggatttgataaggtttggctgtgtccccaccaaaatctcatcttgacttcccacgtgttgtgggaggaacctggtgggaggtaattgaatcatgggggcagatctttctcatgctgttctggtgatagtgaataagcctcacgagatctgatgcttttaaaaatgggagtttccctgcacaacctctctctttgcttgctgccatctgtgtaagacatgacttgctcttccttgccttccaccatgattgtgaggcttccctagccatgtggaactgtaagtccaaattaaacctctttcttttgtaaattgtctagtcttgggtatgtctttatcagcagcatggaaacaaactaatacagtaaattggtaccagtagagtggggcactgctgaaaagatacctgaaaatgtggaagccactttggaactgggcaacaggcaaaggttgaaacagtttggagggctcagaagaagacaggaaaatgtgagaaagtttggaactccctagagacttgttgaattgctttgaccaaaatgctgatagtgatatggacaatgaaatccagactgaggtggtttcagatggagatgaggaactttttaggaactagagtaaaggtgaattttgttaygttttagcaaagacactggtagcattttgcttctgccctagagatttgtggaactttgaacttgagagagatgatttagggtatctggaggaagaaatttctaagcagcatagcattcaagaggtgacttgggtgctgttaaaagcattcagttttaaaagggaagtagagcataaaagtttggaaaatttgcagactgacaatgcaatagataagaaaatcccattttctgaggagaaattcaagccagctgcataaatttgcataagtaatgaggagccaaatgttaatcccaagacaatggggaaaatgtctccagggcaagtcagaggtctacatggcagcccctcccatcacaggcctggagacctagggggaaaagaatggtttcgtgggtcaggcccagggtccctgtgctgtgtgcagcctagggacttggtaccctgcattccagctgctctagccatggctaaaaggtgccaatgtgcagcttgggctgttgtttcagagggtgaagccccaaaccttggcatcttccatgtggtgttgagcctgtgggtacacagaagtcaagaattggggtttgggaacctccagctagatttcagaggatgtatggaaatgcctggatgcccaggcagaagtttgctgcaggggtgagtccttcatggagaatctctgctagggcagtgcgaaagggaaatgtggggttgcagcccccacacagagtccctactggggcaccacctagtagagctgtgagaagagggccgccccatcctccagaccccagaatggtagatccactgacagcttgaactgtgtgcctgaaaaagctgcagacactcaacaccagcccgtgaaagtagccaggagggaggctgtaccctgcaaagtcacaggggtggagctgctcaagaccatgggaacccaactcttgcatcagagtgatctggatgtgagacatggagtcagaggagatcattttggagctttaagatttgactgccctgctggattttgaacttgcgtgggtcctgtagcccctttgttttggtcaatttctcccatttggaatggctgtatttacccaatgcctgtaccctcattgtatctaggaagtaactaacttgcttttgattttacaggctcataggcagaagggacttgccttgtctcggatgagactttggactgttgccttttgagttaatgctgtaatgagttaagactttgggggactgttgggaaggcatgattggttttgaaatgtgaggacatgcgatttcggaggagccaggggcagaatgatagggtttggctgtgtccccacccaaatctcatcttgaattcccatgtgttgtggaaggaacctggtgggaggtaattgaatcatgggtgcaggtcattcccatgctgttctggtgatagtgaataagtctcgtgagatatgatggtttaaaaacaggagtttccctgcacaggctctctctttgcttgctgccatccatttaaaacatgacttgctcctccttgccttccaccataattgtgaggcttccccagccatgtggaactgtaagtacaattaaaccgctttcttttgtaaattgcccagtcttgggtgtctttatcagcagcatgaaaatggactaatacaggattcttctcttgatttcttttttgaagagtctctttttagtatatagaaatgctactgatttttttgtttattttgtatcctgcaattttactgaatktgtttattctaaattctagcagtttttttagagaatctttagaattttttaacatgaagaaacacgtcatcaacaaacagcaacaattttacttcttcctttcctatttgggtgtcttttatctctttctcttgcaaaattgctctggcgaggacttccaacactatgttgaatagaaatggtgagtgtaggcattcttgtcttgttccggatcttagaggaagggctttcaattttttaccattgagtatgatgttagctgtgggcttattatatatggctttattgtgttaaggtacatttcttctatgcctaatttgttgagagtttatcataaaaggatattgaattctgtcaaatgctttctcttcatctaatgagatgatcacatggtttttgtcctatgttctcttaatgtgatgtatcacatttattgatttgtctgtgttgaaacatccttccatctcagggataaatcccacctgatcatgatgaatgatccttttaatgtgtttttgaatttggtgtgctaggtttttgataaggatttttgcatgtatgtttaacaaggatattggcctgtaattttctttacttttttttttttttttgagacggagtctcacggtcacccaggctggagtgcagtggcgcgatctcggctcactgcaggttccaccccccggggttcatgccattctcctgcctcagcctcctgagtagctgggactacaggcacccgccacctcgcccaattttctttacttttgaggtgtttgtctgcctttggcatcagggtaacgcatttggaagtaatctttcctcttcaatttttggaaaagtttggattcatatttgtttttctgtaaatgtttgtagaattcagcagcagtgaagctaatatagcttggctgtgtccctatccaaatctcatcatgaaatgtagttcccataatctccatgtgtcatgggagggacctggtgggaggtaattgaatcatgggggcagttagtcccatgctgctgttcttgtgatagtgagtgagttctcacagatctgatgggtctttttataagggtcttttccccgttttgctcggcacttcttcttgctgctgccatgtaaagaaggatttgtttgcttcgccttctgctatgaycataagtttcctgaggcctcccctgccatgctgaactgtgagtcaattcaacctctttgctttataagttacccagtcttgggtatgtctttattagcagcatgagaatggactaatacagaagccatcaggttctgtattagaaaagccatcaggcttttctttgatgggagactttttattatgcattcaatctctgcttagcttttgtttgtctaggaaagtttttatttgtcccttatttctgaaatacagccttgctgggtaagrtattcctggtagacaggagtttttttttccccctccctcagcactttgaatatatcatcccactctctcctggcctgcaagttttctgctgagtaatgcactgatagtcatattgagacttctttgtatataaagtattttttatcttttgctgctctcacaattttttgtctttaagttttgacrgtttgattaatatgtgttatggtggactcctccttgggttgaatttgattggaaacttctrtgctttcaggacctggatgttggcatctttccccaggttagggaagttttcagccattatttctttaaatgtattatgtggcccctttttctctttcttcttctgaaatttgtattatgcaaaagttaggtcatttgatggtattccataattcccattggcttccttcatttttctgtttgttcctctgattggataattttaaattatctgcttcaattcttttgcatcttgctcaagcctgctgttgaagctttctattrcatttttaaagtttagccattgtattctttatctctagtgtttctrtttgttttttgattgtttctgtttcttcatcaaacttttattcatgtattgttttccaaattttatttgatttttaatctgtagtatcatatagtttacagaatttctttaagaggattattctgaattctttatcactttatagatatccatttctgtagggttcatttttgcagttttgctagtttcttttggtgttgtcatgatttctgaatctttgtaatgctatgttcttgcactggtttttgcgcatttggggagacagtcacctcttctggatgttacaggtgttctttggcagaaatacacctttactatttagtctagcctgtgattccggatgggccaattggtaatgaccccaggcaggcaaagcttgctttccattctctagatggctgggatgctgcctttgctttgagttctggtagagctaagctagctgggctcaggtgtcaggtgagagcactagctgaactctgtaattaggcagaactactggctggtcattgcaatttcctctgattgggctgggctacagggtgtattccttcaccaggtggtacttttatttgaattcttcagttgtacagagttgcaggaggttccctggggttaggtggagtcattgctcaggaaggatgggattatctggtgcttcagtagaaatgtatgcttgaggtttgcgtctttgcctaaccagggccttagggtaggctttgaggttaagctgagtgctgtttgaagttttgggtgttgcagaactagctcttgctcttyaccaaaatgtgtagtcgtggggagctctctccccaggtggagccttcaagtagagcctaaggctgggcctggaagatggctgttgggattcaagccaggcacaacttttcaccacttgggagtgaccatcttggctttgcaggtgtgctatgctgtttgctggtacctctcactgggggctgccactggaagatacacagagatatcaccagtatctgctgtgggccctgtctccttgctttgtttctaactgactccagctggtctcgccatgccgctacctcgagcattctttatgaagtgagactgaggtgggcttcctgggaagcatctcagaatgctagagaagctagatgtctgcttctggttctccctgcccactgcagaaaccatgggccctgaggcatcctctctgtgtggcaccatgctgaatgaaaggatggagggagaagcagtgtggtcaaagtgagaccatttctcctacccttccaatgcagacttcattcatttctgtagtctaggcaggtctctcaggcttattcccaagttttggggttttgacccacatgttcctgtctgtagataattgctagttgaaatttctgtgggtgatagtaaagcctggggccacctgttccactatttttgcccacttctctttatttacaatttatctttccccttgtttagacctgtcggagatttagatatgtatttggcctgtcagaagaatttagtcttggatttattaatcaacactattccttttattcatagcttttaatttagtcatttctggttttatttcttaactcctttgtctttttattgttgtgattttttggccgaatgtttagttcatctatgttcatatttcttgataataaaagcagttaaaactatacattttttgttagtcgagttttggtttcattccatatattttgatgtataaattcactcaacacaattataaaaattttttacctttcaacatttttttcctgtggggaattgctatttgacaattgacataagaactcttgtgggtcagrttttctgtgaactatgaattccaagatcaatgcaagttttaatataaatatgtgaaaagctcccatctccctattttgcctcccctccaacataaaatgagtacagatttagaatttcattggttaaatatatctttgagtattcattaaaaaaaaaacaaactttagcagtggttactcaaaatcttgccatagtcagttctgcagtatccactaaaagacttagatttttatcaaaatttctttccccctaaagtctatktggtggagctttcttttagaatcatcaaccagtttgttcttggcattaaacattatcttttctcattaaagctctaatttttttaaaaaaagctaatgatgaaaattttagttataatttaaatgaaatttgcatgtacarttgtcagtaaggactatgaaacataaacaattacataatttttgagatgcagcagatcctagaaactcactcagtcctgtggttgccaacctttctccatctcccgcagacgttctactgcatgccagataccatgtgcagtaacttctgaatcctctcatccccctacttccagaacacaggactatgagttacttgaaagctgaggcttggtagagggctggagccaattgcgttaaactaactaacattattgcaaaatatattctagggcttttactctaataaaaatgactcctggaactgcagtactatattcttggaaccccaagaaaccaggtgacaacccataaatttaccatcacttttcagatgaggaaggcaaatctggaaggccaaattacttgtccaaagatagacaccaaaccagtaaaggagcaggatttgatggagggaggatgaagtatcaatgaaaaaataagtctaagtaaagaaatgcaaatatctttttctttaaaaaaaaaaaaaaagcttgttaacattataaaaaacatttcaaatatggcatctcaagtttgaattggttaacttcctttagggatttggaattttctgtcaacatgattcccctggccaggattaagacatggtcttgtagacttgtaaaagggtattatccctggaaaatatgctgttcaaaataagggcagctggaagcctacagatgactgtttgtgccagagcagtcaattgattaccgcagggagctttcccttctttttaaggactctggagagttcattatgaaatcttttgaaagatacatgagcaggaccaggctagacctggattccattagctttgtctattcacaaatagtggttagtattagaagagtcataaatctcttatttattttgctatcagagaccttcataaaactcagctctttaataaacaggttgagatactcagcaaactaaatggaaaaaatgataaactaatgtaaacacagcatttgccttgtttatcattgagtgcctgtctgtgcttgttgctttctgaaccttgaatgctgttactgcagaccctccctttgtgcctagtagcctgtgtcccttgggaaacctccttcaccactgtcctctcacttcagccttggctcctttctccagattgtggaagacattctccctgggagctccaccatcttagtatgacactgttgctttccccacttgtaccgtaacatctttcagatctaggcatgtgacctttgattccaacctcaaggacttggcctagcacatagctggtgctaaataaaagctcctggttacacaatgatccatccatgaggttgtgagctcattgatatcagtgttcaagtctccactcatagggtgttacagccatttaagtatagggagtgatggcaattccttttgaatctgtgggctgcatttggtatgcaggagatgctctgatgttccacgaatgggaggaaggatgttctggagcagtggagagaagcctgctttgatcacagtgaggatgcacccacagcaagagcagcctttgtgctttgactttagctggtggtcagagatggttgtttcaaaggctagggtctctgagactgctggtctaccaaatggtctgcactgaaaccattccctgggagcttgttttgaatgtacattcttatatcccaccttgaatctggatcacatcactgccatggtggtgacaccctattgtttattcctgttgtttatggcaaggtccccagcctccaaggctcacttcccacccagcccttcccctgctcagcagaatggggtgaataaaacctactgtgacatctttgtgcactggcgtgaggtgacagatgcaggaaacactttgtaaactgtcaagcgcctggcaactgaaagacatccgacacaagacagccattaagtrattacatgcatagcaacgctgaccagctgtggtccaagcagttcatatagtaccaagtttcctaacttggtgtcatttgagaacttactttcatgactttttaataaatgtatatcacctgtgccatacacaggtttgcttttcttagtttatcttaatttttcttaatttatcttaaactttaagtcagtatacacattttgcttaaatttgtttaagaaggaagttgtacttcaatattctaaataggccagtatcacttgacataaatactataaagataaattgaaggaaaacaaaacaatgttattaaaatgcagccagacaatrgtgtctgttggtgtccctgagcccaagacctgttctctttgtgaaaaagggcagagagccagtggctgggaggttttaggcatggaataccaaatggactttttcctaattagagggcttgacgggaaactgaaaagtgaataatttgttccccccttgaccttatgttaagtgtcagcaccgccgaggacacctccatcaagccagctgggtgtgtctggccctttgaggggtgctgttgagtgctgggttctgaggcttgaggccggaggtcttcagtgaagtccctgaacaactcagtgagtctttgtctaaagcagaggggacgaggccggagtcctatagtgacccgagagtactttctcagtccactcttcctgtgtgtgtccaaaggccagatgagggctgagtgctggagtggggggattataaataacccctgaagccaactagagtctttgggcactcagcacttctcactgggggtgggggtgcagggagagcaatgcacagttgaaggcattgtcttgatgaggaggtttgagatttgttcctggatcctggatccaaacccatcaaccagggggtgttttcatgcaggtcactggagggcttctggacctcccccttctctatcacatctattcagcatgttgatktakcatgtgggaggtccaaggtgcagtgctgggggatccgaggagaggaagcggcagtctctgtcgcaaggagtcagctcccctccagtgtggccaggtagtaagcacatgccatgcatgggctctgtgtcaggcagggaaatccagcaccagagggccagagcaggagggaccatttcttgtaggaggcttcagacagggatccattgtagtgcaagcatgcaggatggtgaccaccagtgaggccaagaactggcctatccagtgggaaccctcttgatttggatagggctggcagaggacagagctsccagaagccagtcacaaccaggacacatctggtgaggtccggacagctgcaggaaagccgagactaaagggggaagttgggacagaagggaagggcagggtggggtgggggagcagggcacatgttgtctggtgccagctttgggctgaacaggtggggtctgggcctccgggctgagggcactgcccgtggacacctctgccacagcctagcttcgcttgaaatcctggccatggcctgctttccacaccctrcttcatttcactatgtgaccgatatgggtacactgtggtgggggaacatggcccagactgatggaagaccagcatgagcaaaggtgccatgcaggagagcctggacaggggaaggggcagggctccgggggtcggcagcagttcaggtcacaggatactctggatctgaggtacccatggcaaggcagagccctggatgtgagcctgagctctgcccactgccagaggcrtgaattctggccaggtgcccggcctccaaggctcacttcccactcaccctatcccctgctcagtagaatgggatgaatcaaacttcctgcagcattcctgtgcaccgatgtgaggtgacacatgtgggaagcactttgtaatctgtcaagtgcctggcaactgggagacatccgacacaagactgccactgacaacagacacagctgctcacacaygcaggtcactgcggaaaatgctccaagagatggacagagtcaggctctggagcaggaacttcctagaatgatggagttgacagggccaggtgagtctagttgtggtggccatgcccaggcagctgtctctgtcccggggctgaattcctctcccctcttcctccctttctcaaagtcagccttgtagagaacttgcttcactcgggcttggccgactctgtgtgtgggtgtgtattttcaagaggagagtttctctccatgtggctctgatttatgctgatactgtcaagttgaaaaacacaaattgcttgattccacagaaaatcaatttgacaatttctttgctccccacccagcccttgacatgaacagtaatctttagggcacactggaaaagttaggaattacaatgtgtgccagtgtgtggatgctgctttgttttagttgtttcarttttttccagtttcttcttggggacagggagagcattgaaatatttataagaatatcattggccggccagtgacaagtaccctcaactctctcttagatggaagctgtgtccacgtgcaatcacagagttgaaggaaagatgaaacaaaggctactatgtggcttcttggctctaaagacaaatatctagatttcaatcatatgcattttccatctagaaatctgtcttctggagaaaacccatacctgaagagcaagccagcatacctgtgtgattctgcccacggagagttccattatgtaatctttttctgcttagcagagataaatgtaatagtatttgcattgttatagatctgatagatctggtgtcgaaacagtttgcctagatggaagagatatgcggattgttgaggctgtaagggacgttgaaagttcatcaaaataggagttgcttcctttgataatttcattctcaattggacctttagagggaagtttcctctttgtataaggaattatgcaaatgtttattttatagtggatatatttggattcctgtctcttattttataacaactgcatactaaaacaggcacctctggcaccagccccctcataaacttagctttctttaacatgttttaaaagcaaataattttggtattgtggtctgctgcatacatcatttgttgttgagccaggatattatttgagaactgcaaagctctctaggtattacctccctatataaaccatgtgttagaaagatataaattcagttttgaaatatttgttagactgcttttggctttcagtccgtgccaaacatgtgctttggtgacagatggagtcatgtgggcccctgaatgaaacactkcattgtgtatagactttgtcttccagcagttgggttgcagaagctgggagataaagaggatccaattgctatgaggtgtgttctccagtgagcataggatccttttccccctcaaatatgtcactaggttatttggtctcaaattctgtgccatagaaaatagtgctgtacactctgaatttatctagaataattaaatgtaaagcattctcatgttaacttcaaattttgaaactagaacatgtttcctaagaatctattgaaacgtattggctttgcgggcctgtaaaccattcaaggaagcatggacctaggattgccagataaaacaggactcccagttgaatctgaatttcagataaacaacgaattttttcttagcgtaattatatcctcagtattgcatgggacatatttatcctaaagaattattcattgtctatctgaaattagattcaactggaagttctatattttgatttgctaaatttgatcattctacttggatcccaatttatggttcgctctcataaacagtgactgtcaaagaacattcctcagtgatgaaggctctgtgagtttgcaagtcyacgtggcacagagacagaggaaatctcagttcagtcatcctgcagaataaaaagagtgttctgttagaacaaagtggacgtagatcacatctactgcacttctgattgggctcggttgaatacttttttctcctcatatgcatccgttctctctcatctccccctcttgcatttgttcccacattgtataggcagagcacggaggtgagggcataactcggaaaggcatgcttgggcccattctctttccatataagaagcttcctttccctcccccatcctcccacgtgaatgcccagatcctgcccattcaaagcctgatatcattggcatccctgttgtgaagacatcctggaccgcctcaactgaatcaggtttctagcccaactccgattgctcttaaaggcactatccctttccgtcttctttaccagactctgtgctcccagtaggcaggatgcagtctaacttaagaaaacacccagggaggagcctccaggctactgacattcagaagaggtttctttttctctcttctctctgtccgtaacttctaattgagcactaaatgtacaggtgctaagacaaaggctttccacaaatcctctcctttctcaattgccccaggggttaagcaccctgtactccaaaggtcccacctttggtgaaaagcagagctcactggaaggtgttgttctagactcccatggaaacctgaaatgctgttgactctcagcctgtaccattggtaccccatttctgagcagcagcagagaattcgtcactggatgtstgactcccagcctccactctcagggcaggattcagggtgacccagaagtttgttttagaaataaacctgtttaatattcttaacacataaagtttcaaataaataagagaaaaacaggctaattaaaaattggcaataaatgtgagcaaacaacccccaaattaagaaataaaaataactgatgaaaatatgaaaaggctcaatttcagtgataagtaaatgcacattgaaacaacaaagaaatttgttttctttataagtggccaaacatcatttgtagggctttctctttataatgattggctattgacaaggcaggccaacattcaaattcaggaaatacagagaacgccacaaagatactcctcaagaagagcaaatccaagacccataattgtcagattcrccaaagttgaaatgaaggaaagaatgttaagggcagccagagagaaaggtcgggttacccacaaagggaagcccatcagactaacagctgatctctcagcagaaactctacaagccagaagggagtgggggccgatattcaacattcttaaagagaagaattttcaacccagaatttcatatccagccaaactaagcttcataagtgaaggagaaataaaatcctttacagacacgcaaatgctgagggattttgtcaccaccagcctgccctaaaagagctcctgaaggaagcactaaacatggaaaggaacaaccggtatcagccactgcaaaaacatgccaaattgtaaagaccattgaggctagcaagaaactgcatcaactaacgagcaaaataagcagctatcatcataatgacaggatcaaattcacacataacaatattaaccttaagtgtaaatgggctaactgctccaattaaaagacacaaactggcaaattggatgaagagtcaagacccatcagtgtgttgtattcaggagacccatctcatgtgcagagacacacataggctcaaaataaagggttggaggaagatctaccaagcaaatggaaaacaaagaaaggcaggggttgcaaacctagtctctgataaaacagactttaaaccaagaaagatcaaaagagacaaagaaggccattacataatggtaaagggatcaattcaacaagaagagctaactatcctaaatatatatgcacccaatacaggagcacccagattcataaagcaagtccttagagacctacaaagagaattagacttccacacaataataatgggagactttaacaccccactgtcaacgttagacagatcaacgagacagaaagttaaaaaggatatccagggattgaactcagctctgcaccaagtggacctaacagacatctacagaactctccaccccaaaccaacagaatatacattcttcttggcaccacatcgcacttattccaaaattgaccacatagttggaagtaaagcactcctcagcaaatgtaaaagaacagaagttataacaaactatctctcagaccacagtgcaatcaaactagaactcaggattaagaaactcactaaaaaccgctcagctacatggaaactgaacaacctgctcctgaatggctactgggtaaataaggaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccttaacatcacatttaaaagaactagagaagcaagagcaaacaaattcaaaagctagcagaaggggcaagaaataactaagatcagagcagaactgaaggagacagagacacaaaaaaaccttcaaaaaatcaatgaatccaggagctggctttttgaaaggatcaacaaaattgatagacctctagcaagactaataagaaaagagaaaagaatcaaatagacgcaataaaaagtgataaaggggatatcaccaccaatcctacagaaatacaaactaccatcagagaatactataaacacctctacacaaataaactagaaaatctagaagaaatggataaattcctcaacacaaacaccctcccaagactaaaccaggaagaagttgaaaccctgaatagaccaataacaggctctgaaattgaggcaataattaatagtctaccaaccaaaaaaagtccaggaccagacggattcgcagccgaattctaccagaggtacaaggaggagctggtaccattccttctgaaactattccaaccaatagaaaaagagggaatcctccctaactcattttatgaggccagcatcatcctgataccaaagccgggcagagacacaacaaaaaaggagaattttagaccaatatccctgataaaatcaatgcaaaaatcctcaataaaatactggcaaaccgaatccagcagcacatcaaaaagtttatctaccatgatcaagtgggcttcatccctgggatgcaaggctggttcaacatacgcaaatcaataaatgtaatccagcatataaacagaaccaaagacaaaaaccacatggttatctcaatagatgcagaaaaggcctttgacaaaattcaacagcccttcatgctaaaaactctcaataaattaggtattgatgggatgtatctcaaaataataagagctatttatgacaaacccatagccaatatcatactgaatgggcaaaaactggaagcattccctttcaaaactggcacaagacagggatgccctctctcaccactcctattcaacatagtgttggaagttctggccagggcaatcaggcaggagaaagaaataaagggtattcagttaggaaaagaggragtcaaattgtccctgtttgcagatgatatgattgtatatttagaaaaccccatcgtctcagccccaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaactcacaagggatgtgaagaacctcttcaaggagaacaacaaaccactgctcaatgaaataaaagaggacacaaacaaatggaagaagattccatgctcatggataggaagaatcaatatcgtaaaaatggccatattgcccaaggtaatttatagattcaatgccacccccatcaaactaccaatgactttcttcacagagttggaaaaaactactttaaagttcatatggaaccaaaaaagagcccacatttccaagtcaatcctaagccaaaagaacaaaactggaggcatcagactacctgacttcaaactatactacaaggctatagtaaccaaaacagcatggtactggtaccaaaacagagataaagaccaatggaacagaacagagccctcagaaataataccacacatctacaaccatccgatctttgacaaacctgacaaaaaacaagaaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacgccaaaagcaatggcaacaaaagccaaaattgacaaatgagatctaattaaactaaagagcttctgcacagcaaaagaaactaccatcagagtgaacaggcaatctacataatgggagaaaatttttgcaatctactcatckgacaaagggctaatatgcagaatctacaaagaattcaaatttacaagaaaaaaacaaccccatcaaaaagtgggtgaaggatatgaacagacacttctcaaaagaagacatttatgcagctaacagacacatgaaaaaatgctcctcatcactggccatcagagaaatgcaaatcaaaaccacaatgagataccatttcacaccagttagaatggtgatcattaaaaagtcgggaaacaacaggtgctggagaggatctggagaaataggaatacttttacactattggtgggactgtaaactagttcaaccattgtgaaagatggtgtggcgattcctcagggatctagaactagaaataccatttgacccagccatcccattactgggtatatacccaaaggattataaatcatgctgctataaagatacatgcatatgtatgtttattgcggcactattcccaatagcaaagacatggaaccaacccaaatgtccaacaatgatagactggactaagaaaatgtggcacatatacaccatggaatactatgcagccataaaaaatgatgagttgatatcctttgtagggacatggatgaaattggaaatcatcattctcagtaaactattgcaaggacaaaaaaccaaacaccgcatgttctcactcataggtgggaattgaacaatgagaacacttggacacaggaaagagaacatcacacaccagggcctgtcgtgggatggggggaggggggagggatagcattaggaggtatacccaatgtaaatgactgacgagttaatgggtgcagcacaccaacatggcacatgtatacatatgtaacaaaccctagaacttaaagtataataataaaaaaagaaaaaaatataatgattggctattgagttgtcaacttgccagtgcctggtcgttgctgaatgaagggaaaccagtcacatttcaggaccagcagagaggaggagggaaccctgcccatgccccacccctccaccctccctccagccctcatcagcggattcaccttgttgatttatggtgctacactgtgtgatcagacgccgaaaggagaaaaactgctcccttggatgacatattaagtgctcatcttgcagagaaatgaaaatccatttagaacaattaatgcatcattagtgtggattttaaaccaaggcagtgttctcagcctacaaatgttcttgctctgataaaagacctgccagccgatactggattggaccagttctcttgtctgtgggaatagatcagaatcaagatgggtattgttgagaggaaattatttagaagttcctaaaatgaacagttttctttactcttttggcttctctatgtaagatgaagcaaggatttaaacagttaagcacagtgtttagtttcaaacactaagaacaaaaaaaattctcattagaattatttaaaatgttcctgggtcaatctatatgcctaataaatatctgtcaaattgaatagaatgaaaagttcttcaggacgctaattctaagttgtaatagttttgtttatcctgtttgactatttaaattatgattgcccatttgggtcctccaaattcaatggccaaagtcaatggctagaaaatcaaaggttgtaaaaatcatgtcagcacctacctctagatagccacactttctccttggccactggaacttaggcaggtgtcccctaactttgtgattccaatcattgcagtgcttgaagtcccaccttattccccatctcaccctattccccacctgcatcctgcccaagccacagtcatccctgcaagtggggaaaaagggaaatgaacattcctgctgtcgggcatggggcataggatgtgccccttcttgttgtcttttggaattcagattctattttcccatgaaaacgcatgaggtttcagatctagaaactattacccacattagaagtcaaagtgcatttttctcatagagaaaatgaaatgttctaaatggtgatrtgaaagtcaactctatgagttaaaaggcatttaagagttaaccttcaaaaactaaccgagtctataaaaaatacatttcaaattcaaatcatcaccctgtgcccactgccttctggtgtgtagccacgtacatgctggggcttagcttcccctcagctaatgaagcaggcatggatccttaaacagagaaggaaatatcaggctactatgatggcaattgctattatggtcmcttagttctctgttctcctcttaatttggcttctcaaggaagctttcctgctgggtagataatgaacaaaatgttttagatgaggactctggttgacttggcagttctttctcattaaaaataagcaaattggaattctggcttataaataaggctcatgtggatttggttgtgtgcatccacctgtgagggatcagacattgcagggtgagctaaaagtcaatcactcatcagagtgtccatgagaacgaagccttggaccccattcctgtctcatcatgatcacaatgaggccatggaaatttttaatttgtttgataataattcattgcacaaatacttgtctgcacatgaagatatagcagtaaatttgatagacgaggcccctacctcttgttattcctatttttgattgaggggtggtagagacagacaaagaggtaaataaataaaacaagatttgatactgatagtggctgtaggcgggataaaggatgacgggccgggaagcaacttgggttgggaggaaaagtatttaaatagggaagactctctgaggggtaacatttgagcagagacttgaataacaaggtttgggggcatgcgaaggtttgagagtagggtattctatgcagagggcacagcaaatgcaaaggctgtggccaggtgcaatggctcacacctgtaatcccagcactttgggaggctgaggcgggtggatcacgagctcaggagttcaagaccagcctggccaagatggtgaaaccccgtctctaccaaaaatacaaaaaattagccaggcgtggtgggggcacctataaacccagctactcgggaggctgaggcagagaattgcttgaacccaggaggtggaggttgcagtgagctgagattgcaccactgcactccagccttggcaacagagtgagactccacctcaaaaaaaaaaaaaaacaggccacgaggtaggacatagctgrgcactattaaggggtcaggaggctggtcagtatggtggcagtagagagaggaagatggtgctatcaggacatgaggttccagaacttaggaaaaaagtctgaatcatactccaagttttcctaatcagcatgagtgtttatttatcacacagtaggattatgagcacagcattctgtaatttggctgtataggtcagccccctggcttcatgatttgtgtgatcctgggcaagttacttaacttctgtgcctcagtttcatcatctatgagatggggataaatatcacagggttgttgttgggtttaaacaaggtaagcttataaaagattagaatggggcttccttgcatagcaattgcttaattagcattcgttgtaatcaataactatttcttgtttatgtaatctatgttcaacactccatgtttgccttatgaatagttctcatttatccattcttcaggctttatacaatccattcttaggcagagaatgtgtccattatgggtcagagttagcctgcttaaaagccctagaacggggctgggcactgtggctcatgcctgtaatcccagcactttgggaagccaaggtgggtggatcacgaggtcaagagatcaagaccatgctggccaaygtggtgaaaccccatctctactaaaaatacaaaaattcactaggtgtggtggtatgcacctgtagtcccagctactccggaggctgaagcaggagaatcgcttgaacctggaagtcagaggttgcagtgagctgagatcrggccactgcactccagcctgggtgagagagcaagactctgtctcaaaaaaaaaaaaaaaaaaaaaaaaagccctagaatggcttcccacttcactcaaataaaatttaatttccctgccttgaaaggcccgccacagtctgagccttgtctaccacctggacttctgctcctccctctctgcatcccatctctcactccatcttagccatactgactgcctggctgttcctggaacccacaaagcactctactgccttggggttttcacattcatgttctcttgatgagaaacctgtcatagatgtttgctcttgttaaaggtccctctcctttaagattgaaagagggagaacctgcaggtgatgaggctatctagaagtattcagttaagtactaggagcatcttttagaagacaaaagaacaaaagcaaagcgcaaaacaccaactggagttttgtaagaagaggactctgccaaagaagtcagtcatccagacacgtggcttaagaaagggcgatgaatgtggatggtattgacaagacgtgtatgattgaaaacgtgttggtttttcgctgggagatgaagattaaaaacctttgatttttaaacacgttgaatttgaggtggtgatggtgacaagacattgaaattaacatgtcctgtagataaaatatagactgtgcttgggtgaagtggccagatgggaagaaaatattgatttgggcaacatcagcttaaaaattaatgagttctctggggaacagtaagggtagaaagggaagatggccaagagctgagacttggggaatgttcaagtggaggaggcaagacctgggcagaggaggggaagaaatccagaatcacagagtgctgcccaagttggtgtgtattttggcagaaggtggtcacagatacccagtgaagcagcagggatgtgagagaatgcctttacatggagctggggctttagtgtagatgcagaatgacttgtttttcactgttgtttaattccatttaataagtttacaggacttaatgacatatacaaggttccattcttgttgttttgctgttaagatccaaaaattattcctaggtgtacattttaacaattagtttcattttccccttacatcatttcttgcaaggtaagcattgaagaattctgaccctctgcaaaagcrttacaaagtgaatgtatgtatttgacatgcaaagggcttgggttttgccattaattccaccatttatattattaggcaactttgagaaaaacctatacaactctatagtttagtctcacagtgtataaaatgggattagtatctcactcaccagtaacggttataaaaatgtaagttacaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgggaacccgggaggcggagcttgcagtgagccgagatcccgccactgcactccagcctgggcgacagagcgagactccgtctcaaaaaaaaaaaaaaaaaaaaaaaatgtaagttactgttgtaagtgactttgctccccacagctgggaggcaccataggcatggacagttatgtttatgtgtagtagagacagctcgtgcttggggtatgaatctatttagacatttatgagaagctataactagctttctttgaatttcaaaatgacacataaaacatcttttccaaattgtaattgttccatagcacttgattgcttttatttccaaatggctctgtcctctaacacgcccaaggctgtgtatctgtggtgccagaagaattgttgttttgtcatcataagtccaaaggatctttttaagtttattttttcatcataaaagtaataatgtgccagttatagaaaagccagaaatacatacaaacataaagaagaaaatcataatgaattcatagccccagcactcaaagaaagccagcaagagcattttggtgtatttctttccaatgactgataaggagtaaacaaaaaaaacaacctaaaccaaatgagatccatgtgtgatggttaatattaggtgtcagcttgactggatggagggttgcctacatggctgataaagtattgtttctgggtgtgtctgggagggtgttgccagaggagattggcatttgagttggactggaagaggaagacccgccctttcccaggctggatgggcagcatcccatgtgctgccagcacagctggaacaaagcaggtggaggaaggtgggatgatctggcttgctgaggcttctgatttccttctttttctgtgctgaatgcttcctcccactcctcctgcccttggacatcagactccaggttctttgacctttggactctgggacttgcaccagtgacttcaaagcaggaagaggaaggtgggataagcttgcttgctgagtcttctggctctcttccttcttcccattcctcctgccctgggacatcagacttcagggactgaagacttcagactgtgggacttacatcagtggcttcccaacctttggctgcagactgaaggctgcactgttggcttccctggttttgaggctttcgggctttgacagagccactaccagcctctgtctttcccagcttgcagacggcctgtcctgggacgtcgccttgtaattgtgtgagccagttcttcctaataaactccctgttttatatacacatattctgttggttctggaaaacctgagtaatacaccatgtacatgtttgcatctatgatctcatttgatcctcttgccggccctctgtggcggatgttgttccatagcccagctccactcaccaaggatctgaatagcaaggaatgcaagcaacttgcccagggtcattgagagcgtgtggtggatgcaggatgcgtcttctgactcaaaatattatgctgcttctcttacacctgcctacatcttcgtaattcagcctgccagcgtggtagctacaatcttaggctctgagagaagctatattctgtattgacgtggttttgtcaatgtgtttgtgtgtgtgtcacttggtgtcaccttcccaaacctagtggcagtttctccctttaacttttctgccatcccagacccttgtagccaatgatgcaaaaaatcttaagtttttatttcaacttgccgtttctgtgttttctagagtatgctggagagtactcagaaggccctttaagctgcttgagaatcaattattttcacatcctctgcctttttctactctaggaatccttgtcagtgacaaggttttagcttgcctgcaggtactgcatcttccgtctgagtaaatagcaatgtcagaagagcagtgaatggcaaacatgccatctttctggtatttggagcccccagtgataaccagtcatccctgagccttttgatatgtactgaactgctccagaatgacatgattattcttgtaaaattcagattaaattttaaaaattattcttagtagacttcatttttagracgattttagagtgacagaaaaattgcaaagctagaacagatggtttccagacacyccacatcccatttcccctattcttaacatcttaccttagtattgtacatttgttacagttagtaaaccaatatttgcatagtattttaaattaggtttatactttattcattggttcttactgagtgcattttttctgttgctcagtcccatccaggatacattacatttagttgtcctgtctccttaggttcatcttgtctgtgacagtacctcagactgtccttgttttttatgatgttgacagttttgacgattactggttggtatattttagagcgtacctctttgggaatttatctcatgattagacgggggctgtgggttttgaagtggaagatcacagatggaagtgggactgtcatcacatcacgtcaagggtcrtaccatccacaggacttatctctgttgatgttgaccttgaccatctggctaaagcagggtttgtcaggtttctctattataaagttacttttttcagcttaacttttgctattggttcttttgtggatccttcacttacgttattttaaaattgcattactaatttacatgtagggagcgtgcagctaaaatgaaagaactacatcattatttggttaagattgaaaatgtgaatctgaaaggaaatcttgctatcatttataggagcatcaccaccatattgccctgagacaaggagctgctcagttctgtaagatttcctttaggtctcggatatttaggggctaaaaaaattgcttcatcagtttccgaagccttgtccctggcttcttggcaaatggctgccccaactttttgctttcacttagatttttcaaaaggatgtttatcttaattctactttttgcacctcagattgattctccattttaaagttcatgtaggtgttgayaatgatttccctttcaagccagaactccaggtgtgatatttaagtttctcttgactaatgatctcatcagagtttattttctcaatggcccactgggtggcttaggaggatgcccactggcatccacttatacactggcattttcaaatgatcaatatggagttgtgatttttgcaccaatagtgtggtttggttaaacagacactgcctcaaagtctagaaacttggattctgatatctaagayggatttcatgcattaagcttttcgaaagcgctttactgtgttgacttatttgagctcccttaacctcatgagaatcttagaggagagaatgcagttttcattttgtagacggtagagcctcagatgtcaggctttgacaaaggaaaataaatcgaggaggagtcaggaccagggtcaggtcttatggctccaagatgtcccctcttcactgtgtatgtcttagagctgctgcatcagtctccacctcttgtgaaatggagcttgcgcggatgtaggcatcagggtggtgtggacttggttatagcctttcctgtttcccttcataagttaccaaaggaaggttggctagagcaaggatggggcaggactcatgcaggcagccaggctctgggtgacatgaggggaggatctggagtcactttgagaggtttcttctttgcctgctttcccataaccttaaaaactttcattgcaatcttgactagcctgaatcagatctgaaaatgacaaactcagacaaggagacaagcaaagcaggcacacacttcccatgggaaagcacaactgatgatcacagcagataactgtcagagatgaacgatctaatatgtgtttttccactytgaggctgaagcaaactggccattttatcaaaactgcaagcagtgtatcaggttacgcagtggcaaaaaagcttcctgcccagtataatctatccacatttcttatttaggtaactatgagttctgttgatgcccaaatatatattatgaaaaataaaatatatgcaaactgtgtattttatagggtcatattttttccccgggtttctcaggcttgaatgtatccatcattcaggtcccgtgtttataatttatcaataagatcactccataaaatatattctgatacctcacagctgtgtataatttattctgtctatccgtgyagtgaaataaaatttttatttgcatcatctaaaagaaataccagtgtataaatacataagaaaasctcataagaaacggtcttctgactacagatattgctgaggggctgttgtgcagccaatgaaaaagctgagagatggcttgattatccatgtacatagataatacataccgtactcagcaaattgtgcagtcactcaatttctcaaaaaggttgcaccacattctacaagggctgccacagcctgcttctaaattctccttcgaatatttggaaataaagcctcttcaaggaaaacatatttgccaaaaagggctccttttggattgagatactggaatatgtaggtgaaacaggaaatgtttcagtggttggaatattttgccttcaggaaactaaataactgtgtctttctcagccactaagagccttggaagaaacagtccagaggatggaggatgttctttacacttggtttctgtagcctcaccctgattatctaacaggaggccccaccaacacctcctgaacttccccaaagtcaaggtgtggagttgctgcctcccctacacccctccctgcaggagcacctgcaaacagttcgactagaagacccggatttcacgcatcatctccttcctcctcacacatacagcttctcaagggaagtctattaagtgcaaagattcttcctccaggcatctgaggcctgggtgaaaaccttccaggccttttggtagtgtggctggaatacccatggaaaccatcccatcctccccattactggggttgggttgggagtgacacaggattctagttttggaactctttctctgcccagtttaacacatccttggcaataggattgatttgtggttattcagtttaacaattcacttgtgttggaaactcagcgctgccaggagtaccttataattaaactggttcgtttatgtggaggatattttaaaatgctcgcgatcgctttgacagttttagctgactttccaaagactacgccaatgcccgtggtaactctcggcgtggtgtggtttttcagcaggtgaagggaaagttcagatggatctccagttttcaccccataaytgctagtattttaaagctgccttaatccaattccaataacatgacagctgtcttataagttcagttaattgcactctgtagtcggcctctgcaggagctgtatagctggatcagaactcactttgtttctctgcattccaacgtgtgaatcccgtggggtcctgagcaagagaccctggtcttggcaaagcttcgagaacagtgccgttgaaaccggccgatgcgtccctcacacatcatgtgatttccctcgggctcaccacgctctgcctcattttacggaaaaggaaagtcttgcgctccctytactgctgtcgatcctcgtggctatatgtgcagctggaggcttctcatcatcagctctcagcttataagctcaccatccccaacaaaaaaggggggctttcctggcctgtccttcagaaataccatccccagccattctgctgtcaccctgtttttcttcttaatttttttttactttgaaataatgtttgattgacaagaaggttgcagttttagcagagttgctgtggtcctkctgtttcacagcacttctggctctctgaaatggtcttcttttcatygtttttctctcccagtacaagaatgcaagtcctgagggcagttttctctacrtccctctstgaaatgcacaggayggagagagaggcaagccttctgggatgaagctgtgttcaagagatgagggtctcagcagtatagacggagggagctggctcactttggggctgctggcttgaagaagaaagaatgggctttttgaatagaaggcatcagatctagagtcactgacaagagtgcctgtcaccaggtagacagttgaatacttggtgagtggtgagtaaacacgtgggacacaactggcccgtggccccgcagctgatgtgtggtagagctggtgctgctgcagggtgcgtcttcctccaaagcctgggctattctgcctttgagcacatggaaggcatgggctcaagcgacaggaggagggagacacacttactcaagatctccatgctgccagtggttgcacccttgcagccaggagaaggacttctgatgcttcccattcagagagtcgactcttttcacctccaagcagccgttcacgggtgtcacagatatcaccatcagagccagcacctccacttgctctgccagaacccttctcgcttgaatgcaggttcatccctgaagactcagcccatccacaccctgaagaccacacgtcctgggcccatagtcccctccctccttccttccccatgcggtcgagggttgcagctcagccctctcccattggctgtatttcggactttcagttcattcctgttccttgtcctcttggtcctcarcacctgagagttttaaacactctgtgaccagcttgagaatttctcagaggctgtttcagacagkgactacgggagtagkaatcctttggtaacctgaatataactgcagacttccacattgagcatgataaaatggtgtggatttaaaagtatttggggaactgtaaaatgtctaggattaaaatttcaataccatttgtgcccaataaatgtgaactctttagtaacttaaaactgtgctattatgactcaggtctgaaaattatgagtcctgcttgaagaaatgggaataacatgtgagggaatctggtcccatccttcaccttgagggatatactgtggtcraaccaaatagcaggagcatgacctcataggagagcaagtccagagaaattagcgtatttgttgagaaagtgatacaccctccagaagagaaaaatgttatactttccgtgaggattgtttatggaaatgggtctaaattgaacctgtgttggtatattaactggttcaacagacaggaccccaagaaacaagatcatataatagtttattgaatgacttgatttttttaaaacataaaccagtctagtcagtctgaactggaaaattaattttgtctatagaatcacttactaaagcatataaaattagactccataagtgcagagaggagaattggcattatgtttaacagattcactgggacttaaataaatggatttagtcttaatacagctaaagccatgtgacttttaatacagagcagatcctaaataaagtatcaattcatcatttcaaaaaagtcacttttgcatttttgttgcttgttgaaggactgaattatatatcttgtctatgataataccccagcacatgttacaggtcttgaaggaacaaattaattaacttytgttttctttaagttacaaaattttcatggttagattgacagagaattcagcagttttaacacttttcatgacttaatgggttctagtgtttccctgggcttatttaacttccaaatattttcactgtgtcatttatgtaataagcttctgatgccaaactcttcctgactagagtgaaatatagggctgttttccttttgattcaggggtgagcttatggaaccaaggaagagctgatgaagttgtcagtgcctctgttsggagtggggacctctggatcccagtgaagagcttcgactccaaggtgagttcctctccttttctcagctttgagactgccgaagcttttaaatcacattagctgctttggtattctctcattcaagggttgtctctactcactttaatgctaactctatccttagagaatggaagctttattcttaagccaaaaatatgcaaaccaattttgatgtgacagtgctgatgagggatccaacattatttgcatctactgaaaattagtttttgaacaaaaaccaggggttacagtcccagatatacaacttccatgttcagtttaactgaatgaatgatgggcatttttctatatttatgtctatttaattaacattgatttcctcgaattgattattgctagaaatatatttatgcaacttaaaaacccatttgtcatgagttttaatgcaatctaaactttatttactttgacatgtttgatttgagccttttatgatgtaaaagaataatataaaataattgaaataatagtgattaaatttaatatcttggtgcgttttatctgctaaactgacatgactttcttaaatttcagtgcttgtaggaacagttggaaagtgataaaaatctatggaaatatgagctctttgaagagatcatacagatggcttggtccttgcattatatagaactatttttagatcatttttcataatagcagattttttgaagagcagttgagattgtgaacatcctctgtcacttcctggaatggttgcagtgggccacctttatatgagtaatgataaggtgatttccatctagggagcttaccttggaaactgagcttttagaaaggttggtggtttgattaaaaggcccaaatgccaaatgtgcacattttttctaactttgttgtttcacagacattgttgcaaattgaatatacaaggtacaagtcaagtatagtggtgttgatattttctggaagaaaaacttaagatattaaagaaaattccatcatgctattggtcagcaaaattaaaaacaacataatagatacagtaaaagaggagtgggctttcgttataaagaagttgatttaaaatattgatatacatgaataatagaaaaatatggaataatctaaagtttcttggatgttgggagccattatgtagactttccctggggttagagttgccagatttagcaagttagaagtacagaatgcctggttaaatttggatttcaaataaacaatgtatttaattttagtgtaaatatgtctcgtgcaatatttgggacatactttttttttttttaagtatttgttgcttatctgaaatgcacatttaactgaatgtgtcctgtcttgtttctgacaaccttccctggagggaatcggagggacaagctgctgagggctatgggcctgccgctggggtggaccagctcaggccttctctggtttgtgacccccagcttcctccttcctaccctccagccacctggcagacatcacaaggcatgttggaggagggactggcacatctactgctggccaagcttaccacctggtgcttgtgggtcacaagcatcatctyttagaagactaggaagaaccatgattattaggtagctgtcccaactcttctgggtttctgtctccagaatgagagccctgtgggtgacaggcatacayctactgcactaaagaattccaggttagtgacgttatgtaggggcatgatgacttaggtaagttgggaacagcattttgttgtaatgccagtgggctcatctcaacatatagtttatggcatcagtgtatggccataaaattacaatatgtactcatatttggtgggtaaccccgaaagcttgtgtgaggagtggtgcatgtcaatgtctgttacgtgtgtgtacctgtttgcaggaattccccatggggaagacgtgtatacatgctgtgggaataggcattctggccaaaggtgtgtatgtgtgtatctgtcctcattaccagtaagtcaagattttcattttgaactgaatcatgcagtatatcttcagtatacaaaacatactcacatgaagaatatttttgcagaacaacggtgcctgctgtgcctcagaatatagacttttagatttgcttctcactccttgcctctttctgttcagccagtttttaactaagcacctattatgtgccaggtgctaggcatacagccaatgcagaaggcagacacgctttctgccacctgcaacttacgttgcagtaagggaaacataattaaataaattcacattgtgataagtgttaagaaaaaaacaacaaagtattctaggggccagcagggaagatggattttgatagtttggccaggaaagccctttctaagaaggaaagatagtttwttcaataagttctaaagagccagccatgagaagagccagagtgtaagaggctggaggagcagggaggaggcaggtgtgtctagagcatggaaaataagacagacttggagtgatgcgggagcaacaggggccaagatttcccacagggctcctcccatgtgtgaactcactgtggaagtagtagcctgtaggaaacagacattcaccctgagatagcgacataaactgtgaccttctttctctggtaaatattctgattttatatgacttaccaaatcataacattaattttttgtgactctttttccccagaggtgacatgcagtgttcacaaccatgaaacacattccttatttatacagaaatgcctagctttttgatttcttcgtattattatttatttatttattttggtagagatgagggggtggggagggggtaggagacaggcctcctttgtcacctaagctggtctcaaactcctgggctcaagcaatcctcctgtctcgatctccccaagtgctgggattataggctgaaccactgtgccctgccagaaatccctaactcttaaacattttatctgatggccatggcaagtccagtaagccagatctggaagtttggccagcaatttctggctgggaatgccatgggaacctaaagaaagggggcctcaaattccaagtcacatcctttctggctttcttccggacagatttccacaactgttttcctaaaatgaagatctaactcatcatgattttccttgaaaacctcagaggcattcctcacatccgcatcctagagtgtgaagacaaactctaggcttggcatgaaaggcacgtcgctctgtgacccagaggcactaaccacagccccacgccatggctccggggctctgactgtccctccattctctcctcatgtgcattcttcttcatcctatggtgccatagcatggggccacccctgtgacctcaggcagcctggtcacctgccccgctgtgctttgtctcaaagcactttgggctaaaaagtggtaacaagttcctgggggttcagtgactcattcccaaatctggattatgtgcctgccatgcacctggtgctggagctgcatctctgccctgagggtggtcaggaaaggcctctctgtggaggtgacatctgaaggtgacctaaatgacatgaagggtgagcctgccatgtggagttctggggaagagcatccaggccgaggaaacagcgacagagggagccaaagagggagcgtgtagagaggtgagcagggccctgacaaggtagaacagccatgagaaggttcctgggggcttggagcaggacgtgcaagtgagttttaacagtgacctctgacagctgtgcccagactgcagtgtagggccctgaatggaaatgaggagagccatggggaatccagtgcaactgtccaggaaggagagggaggcgtccacactctgaccacggacagcaccagaagcgattggactggagacgtactttgaagggaaagtttgttggacttgcccgtggattcaaggtgttaaggacaacccctgtgttttggccctggctacataggtggcaggagcttccatcatatacacccccaaagagaaaggaccccctgtctaatttggtgttcaccacgtcattgacttactatgtatactggttctcaccctagctgcattttagaatcacccagaaacttttacaaataacagtgttcaacctccagttgttgagagttaatttaaatggtttgaggcaggyccatgcagatttcttaaaaaaaaaaaaaatactcccyggtgattttagtgagcacccaaggcttagatccacttggggaaattgatgctgcatccaatgccagattgctggtcaagtcgattcggctgatttaggtaaaattactgtcaagttctctgtctctttctttctgaatgggatgttagaatgtcctttccaaatcaagaatcaagccatcactgccactgataatttagtggaaagagtagagggacaggaaaggaggtgaccttgtgtgtgttggagagcttgcacttttttgttcattggttgttgtctataatgcagggataaacttatctgcattccctccctctaagggtcattgtgagaatgagatgaaacgatggctgtaaaatacgctagaaacttaacactactacagaaatgtaaggtgacactgaaagtttamagtgtctttaggaaccaaattccaatttcatgtcttgaaaaaattaaccgcggaaccagcgaagacatgtcaaaatgtgattgatcgtgagatgacctcacttgagctcggcctttgaatacttcaggaaatgtccaatttccagcttccttgagtgagaatgaagttacagaaagagtataagaaatggaaaatggaaggcaaacccattagaacatgaaaccaaagcttcccttagcatatggcaggtctcaaatatcaaatagcagctaattaaaatgacagaggcacattctactccatacatttccatttgcctttttttacagctgagaaaacggagccctgctctcccctccaataaccatccccattctttccttcacagccagacttcccagaaaggtgatccgcattcactggcttgcctccccccagttccctcccaacccttggtagcagctcccattcccaacatgtcattggaatggcctttgccaaggtcagagatggcttcctaatttccaaagccagcacacacctttcactctttatcttacttatcttgatacccattccctctcctcctytgaamtcctctcttctttgggctcctgagacccygttctcatgtttcttctcrtatgtttttgtttttgcttttcattagctttcctggctctgtccctcattcttggtgtcctctgagtttctttgtggccccacttctgatgaagggtcccgctggtgatgtccctctcaactgtgaccycatggtctacttgcacctaggggctcacataagtgaaaatagcagtgagagctaccacacgtggagttcccactgtgtgaaccgctgtatcaggtgttacgaacaataacttcggcttttgtcatctagcatgcattgacttaaaatccacacctctcattctgctttgacccctgagatttgatcatctacttccaatcaattacaggtacctccagctgaaagttcccaattatgcaaatgtattgtcccccaacgtagactctgcctcccacttaatttaattgtccctagaagataaggttgtcatcttccttctcccctgaaatagtaaggtttgaaacacttcttaactctactggcccagtatcctgacatgtgcttcttctttctgctgtctaccactgccttcattagtcttcctccattctacaaaaggaggtagggtactctgtctaaagcacagatagaacctgttcccttcctgctttccagtccttcggaagtcccggatgacacctgaattcaaagccaggcttcttagcatgatgcccatgggactgggtagcctgggccatctggactctagagcccccacccctacatcttagccatgaagcttgtcagggcagccagttgcctaaataggccacgttctttacaccatgcttgcactatrttctgtccccatgtcccctgactccctcagtcctactcattcttgaagcaccacttaagcactcattcttaaatggcaccttctcttgtgaaacccatcctgaacccctggcctcctggccaaattcttccttcccatacctttgtctttataagttgtccacatctctgtgatgtgcaatcatatcatgcacacatttaattcatgcaaattcagccttgcacatggcagaaacagatgctgcagagacgcaacttaagtgacataggtgatcacatccccttgggtccccaaggagcatgtgggcatctgctgttttcttagttccttctgcctctcatgaggcaascttcttacttcctaagagcagttctagttctttctgttggatatcatgaaatagcgcaacccctaaaataagccaactcgactatgctcaacccaataagcaatgccccagtgctctgtggagaagaaatgctgaacctgtataaaagcatgaaagctgtgaggctttcaaagattaatttggactgtgcctcaggtgccacctctaccttctatactggccttagaccccaaccatgcatgactttgggattcagctctctggcgcgatcacagagtaccatcattattagtttttatccctgcttctcccaaccagcctgtgccctccctcagggcagcagccacagctctgtgcccttccaccttggtgcagtgcttggcacagagtggagtgattgcaggatgcttgttgactgactctgagactttatccgtgcctggatcctgagccttgcaaaccactctgactaccacaactttttagatgtttcctacctccttttggcaactctgggtcctttaaaatcatttggaggctgcgtctagctgatagaatgctaccttcttcactttagtgctatgtggtatcttacctgggacaccgccccaagtgtagctctgtgccaagagcagtgctgttactctacatgggtgggttgacatagccagacctatattttttatctaagggattattcgagtaattgcaggagttgctcaggctagatggtagcacctccagcttggctgaacaggctcaatagttagcctttcagacttaggaagcatctattttacattagcttccaagccagccartggtgtttcctcttaagaatgtaatgactaaaatacctactgtggaatagatatcatcatatgacatgcacagtggctcatggttggaacactgttcccagactctctgggttcctgggtatggtctgtcccactcagtttcttaccttctgtgggaaccccaaccccacccttggcctgacaatcctcatgaagctgtgtctgccacacaggaggctgctggaggccccaactcctgcaccagacctcatataacccatcattatggagagaggatttggagaggtaaaagctggcacccttgtatcttgtctgggagctcagctgtttaaagaatcatttccatgcatggtgggaggagaagaaccgtggatgttggaacctgcagaaatggattcggactccctctgccttgctgtgtggcgttgggcttgtcattcgcccttgctcaggctttgtttccttagctgtaaaggagatggtgatggtggccttgtgacctgatgccatgccctacacatgctggatcctcagcaaatgccagcctctctcctgtccctcaccgggtcctcctatcactgccccagggctggataagcctttgctgtgtgtggggggagggcactggcctgggagttcctggatgtgtagcagcatccctgatacacctgactgatgccagcgccaccctcttctagtcacagatgtctccaggcattgccacgtggcccctggggtgtaaaattgccccgggttgagaaccactgcacggtgagaaaagatgtggaaggacaggaaactggcagttactgggatccccgtcttggccttggacggagccagactggggttctgcagatttttctgggaagagctgaacagtaaatatgttcagcagcacaggtcacaatgatacctgctgaagcgactcaactgggctgttgcgtagaagcagccctagataatacataaatgaatgagcatggctatgttccaataaaacttactggacgttgaaatttgaatttagtatcattttcatgtgtcatgaaaaatctttttaaacaattttagaatatgaaatgagtcttagcttgcaggctgaaccaaaacaggcagtgcattggctttgcccgagggccatagtttataacccctagactagatattccatagatatcagctcgctggatgcccccagcagccctgcaaggtggatgctgttgtgcacatgaggttgctgaagccccccccccsacccccaggtagaaagttaagcgagaagactagcatctgggccaaggcctgtcagatttgaaatccagtattctttgcatattcctctgctacctttcagaaaaatctttaactttctttcccctgggcatcatatcaggactgcttcatacatcttgactccagacagctgaggtcatggttcagggggcagacgtggtgagcactcgccagcgctctctccctccctgtctgtcttgcctccgagggagatctggctttcttcaacaagatgtgattgttgcatcccaactccctgccagggtctttcctgttcactcctcctttttggccaacacacaaagaggagaaagcaggccaaggtattgtacttgtttcaactgtgtccctggcttagggagctctcattcaaccaaggaagggctctgcatttccaacaacactcaccacccactcgcttgtttcttgtgacctcttagcaaggccttaatatcatacttttaaattgtttttattgaatcgggttgtcttagattctgtaccttttccttcccctacaagcttctgtcatcatcattaaactgggtccttttgaaaaaaaaatcatattttaaaataactgaacaaatttggataatgcaggagatatcatgatttaccttcttgagacagaaattgtaaaatatatttttgtaatcctgagtaatgctttttatgtttgactgacatgtagggcttatagttacttgacattaggagagaaggagtttgatgaattctgttttcagttgtacatttgcccaaggacgtatgaatgcttgttgtctttgagacccgaggtcaggttcccaggaagcaaggatgaatgggacccaatcctgcccttgagaagctcacagactgtagtaaatttgaataagtacttagtcagacatatgggattttaaaaaataaacaacttattttaaaaaagttttggatttattgaaaaattgcaaagacattacagagaatttttatatactgcataccttggttccccatttttcacaattatctttgtgtagttcatttgtgacaatatttttttctttttaagcctgacattttttaataagagagagaacattctggggattgaggtcatttggaagaacatataacttccagaaaggattaggattctaaaatcttactttaaactgaagagcttatcttcccaagagatttaatggtattaatgttgcactttataattttatgtcagaggaaagctgaggaagccttcatctacgtgtttactgtggaatttctttgaagttgcaacatataaccagtgaggaccgttccttaataatcactcaataagtagttgtgatagtgatgaagatgtttttgttcaaccaaaatgtaaagttcagatttttttaaatcctcctattctttccctaaaaagtgagaaacatttttatacctatcctgacagtgcctgcaaccacgtatataaaattatattaaaacaacgcttgactacagcaccgttgtagaatgtaacatatgcctgcatagagagccgctgtgggaagaatttccttttggatatatttaasacactcctcatgctcttgtgtcttgcacgtgtccctgagaatgtgaggaagacatgcattgttggtggtgcacactagtgttttaccagcattttttgttaccgcctgcctaaagagaaaaactaaatgaatttaaatttagtttctttctaacaagagaacttgaacactaaggaataagattttattgggttgtgctaagctaaactttggagggtaaaaacctttgtaatagcgaaggttttcgtccccttcctagtaccaattttgctcatccccgttgagaatgcatggtgggcaccacacgtaaatggtcaaaaggaaacacgtgtctcccaagactacatgtgtttagagaaatctgcccattagagatttggggcaaggaagaataaaagtcaattcccacccttccatcctcccaagactgctcttgctagatctttaaaaataagctttttatataagaacaatttttaatttataaaaaaattgcaaagatagtatggttctcatgtacctcacaccaagtctcccctgttgttacacttgtcacaattaacaagcccttatcagtggattattaggagctaatgtccgtaccttattctgattttcttagctttgactcaatgttcgttttctgatggttcatctgggacctcacattatatcgtgttcagtgtcgtgtctctgaaggctcctcttggttgtggcggtttattgggccttccttgtccttgatgacctagacggttttggggagtagagatcaggtgtggcatagactggccctcagctgggattttccagcgtttttctcatgatgggactgggcttgtctgttttgggcagcagatcacagaggcaaattccccatcttgttacaccatatcaaggggacatactgtgcatatgtcttatctgtaggtgcttcagcacctggctgaggttgtgtttgctgggtttctccacttacaaagctcctttttcccccttcccatgctgtgttgcctggaaggaggtcactgtgcgcatcccatacttgaggagtggggagttacgctgcacccctggatggcgaggtagctgcatccattatttggaattctcatgcatgtgagatttgtctgtgctccctatttatgtttttaatcatttaacgacattaatgtggtctyatggttattgatatggtttggcagtgtccccacccaaatcttattttgaattgtaattcccacaatcccccacatgttgtgggagggacctggtgggaggtaatttaattacagaggcaggtctttcccatgctgttctcatgatagtgaataagtctcacgagatctgctggttttttaaagggcagttcccctgaacatgctctcttgcctgccaccatgtaagatgtgtcttgcttccccttcgccttctgccatgattgtgaggcctccccagccatgtggaactgtgagtcaattaaatctccttcctttaaaaattacccagtcttgggtcgtctttattagcagtgtgagagtagactaatacaggtatttattttatactttagaatataatccaatactcttatttattttattgttcaaattgttcctactttggctattgagagttcttttcactggctcctgtgtctctttgacatacacccatggatgcatgtgtgaaggtgtgtgagagagtgtgtgggtgtatgtgagtgtgtgagtgtgaatgtgagtttgagtgtgtgtgaaagtgtgtgttagaatgagtgtgtgagagagtgtggctctgagaatgtgtgaatgtgtgagtgtgaatgtcactgcatgagtttgaatgtatgtgaaagtgtatctgtgtgttagaatgtgtgtgtgtttgtgtatgacagagtgactctgagcttgtggatgtatgcgagtgagagagtgtgaatgtgtgtgagtttgtgtgtgaaagtatatgtgagtgtgtgggtgtacattagtgtgtgagtttgagtgtgtgaaagtgtatgggaatgtataagaatgtgtgagagtgtgtgtgagagagatggtatgactgttgagtgtgtgtgtgtgttctagcacttccttcctttctggcactgcaagctgcactgggttcatctggtatatttcctgtacctgtcctaaagtcagccatttctccacgagccygattccttggagaatggtattagagactctaggtactagataggctcactgctactgggcagtcattgcttctaggccttctcagctgacagagtgtgggaaatatatgtgtatgtctgctgtgggtagattataaaagaaacagatctcaagtgctggctcatggctgagacacaccctatcttttcacataattaatttaaaatggcataaaattgggaggctgaagcaggagaattgcttgaactcaggaggcggaggttgcagtgagccaacattgcaccactgcactccagtatgggtgacagagcaaaactccatctcaaaaaataataaaataaaatggtataaaaggaaatatgccaggaatttggctctttatggatgtacctatagacataaataaaatagctatgttcaataagttaaatcaattacttagaaacctaatcattaggctcttttccctgggggaaaaaaaacatttcttaaaaaaattaattcccaactcttcagtatttgacctagctctggtatttcacattccttgcattgatccatgcctcaaggctgcctttctgctaattacttgaaattaaattgacccttttctaaagttggcacacaaaatgtttcattcagctggcataatgtctgccatatgcactttttactcagcagaggtactaagggtcttctttttgcttgaacctactaattttccaagcatattgtttaaagatttggtcaaaaacccaaaacagagttggtgagagcacagagctactgagatccagggttgtggattgggtctctattaagatttcccgtttccatgggagccattagcttggctgtgttcctcggcctcacctggcaggtcccaccccagaggtgtctcaggaaggactcctcagaagggctgtgggtggattcgctcaattgcagaaacatcacaggtacagcacttcccatcattgatggactcgcggtgatgtttctgtatatggaggcaacatagtttgcatccatgtttctcaaacttcagtcacccaggacccaccagcgtgaatttaacctaattataaaagcaatcacatcattaatattacagcttatcatatgaatagcttatacatgcttgagatacttagtgattttttttctcaaacactaaaactgattaaaatgaagtgtgctgtatacctcttaaaatgtatttgtctgtcatgggggaacacattataccacttggaaaatgctattttagctattgtagacttttaacaattttcttttcttttttttttttttttttgagatagggtctcactctgtcaccaatgctggagtgcagtggcacaatcagtgcaccatcacccctggctaatttaaaaaattattttttgtggagataggtttttgccatgttgctgaggctggtctcaaactcctgagctcaagcgatccacctgcctcagcctcccaaagtgctgagataacagtcatgaaccaccgtgcccaaccaatttctttaatttttccaccttgaacacctcatcaggtgtatgttttcatcaatttacatgtatagccatgtaaattgagccctgcgcaacttggggcttagagttgaatggctctaaacctgctcagctgctgagggcggaggccctgcctaggatactattgggtggaattatctccatgagttttgacttaacacttttgagggggaagaaattacgattagagattaccctgcttttctgttgagtcctttctgtatattcatttaatcaacaaatatttattgagaatcctttatgtgccaggccctgtgctaagtgatagagatattttgcccttttaaaaactgcattaaaactggccatttcatttcagagctactttgcaacttgctcaaacagaactcttagaaatgttaactcctcctgcactacaaacataaggaagagttaagagcccatcaggggtaaaaaatkctatcatatctcctttgaaatccagctccttcttttgtagttcaaaacaagaccacgggggcatataatctctggtcgtgcctattcagctaataggaatgcgtttgcattgccaaaagttattgctggttttagtgttccttgacacaggcaaatctcataagtggacttcgtgggaatgcatcggatcgctgggagctgtcggtcagccagacactagctgcccatgtctgtgtctttgcttataaagagcattgagagtgggcatttgctgtcctgcgattttcatgtctggatctgctgtggaaaagtgaagaatcacacatctacagacacccttgccttgcagttttaagtaaaaagagaagggagctttgtgaggttgatctccagaacggtctcggtggagctccagagactgagtttccagcctgctgtttcattggcaggtactgagcctcgtctggttcagtctggaagtgtttctgggaatgcagctgccatgggaaacgcctgtgatgggcaaaacacaaactggtcatcctcccagctccaaggatcaaactaatattctgatttttatgccacatacttcagttgcccagacagggttataaggagccatcggttggaaaggacagaaacagcatccttaagtcaaatacaaaagattggatgcatttttgttggttataacagacaggaacacggagacgttcttttggctccagcaggcattacgaggaaagagctggcgagcagagttggcaggtggggaaatgagttggagaaactttaaagatcttttcctataaaataaatgtccagaagctgtggaaacgtacgtctttagttaagtaaataccctcgaagacaacacatgtacatttttcagtgaaagctgactagctacaactgccatgttttcagattccaagaatttcagcacacatagaattgacctatcatgctcattaacctcagagcaactcctttcaagaagctcttgcaaccatgacggcaaatgagtttaactgtttcatttcaaatgcagtgacttggagcggcatgcttaccgtttccttgccctgcatctcaggcccaaatgagaaggaacgttaattaccttaccagtcctagcttctgtacaaactggggcagtctgctgaaacccccgcttctccctttccttccatagaaagcctcatagcaggggttttgaacgaggctctgcattgactgtgctctgagaggcaagttccagtcctctgtttatgtttgcaagtgactattaagtacctattccagctagatttggggttgggttgaggagttttcagattaaacaaggccctgaatatcatgctgggggcttgacttcaattctgaaggcaatggggagccactgaaggtttctgagtagtcaagtgacattttgggggtgtaattttagacaaggtttgaaaatagagtattgaaaattttatatagacaatgggctctcagacaaatcttyttttcctgaaaatgtccatgtcgtatctcttgattgatttgagtgtgtctcatttatgagtggagggtgctcccaaaatttgtcccaaattcaaagcagaacttcttaatgtgtggccccattgaggtgatgttccaaagggcagccagacgttggcctgcagccctaacactccctgtgccctactctgtctgcattgaaactccctttggagcacccccctcacaccatatcctcaccccacagcatccccagctggtttctgctctccctcaccagggacacctggtctcctctctaacaatcgagctggctacttttcccatggttgtgggacttgcgtccatgtccctctctccaagcttacttcctgccccaccctcagctcctccagcagtcctcagaccacgctactcctgccaacctgctcaggtcggtggtgatgcctcatcctccacacttggcttctcatcttattcctggcttggctcctcctctggcttttgtccaggagagccctgggaatgtccttgggaatgcctgttcctgacctccatccgtgagtgcctacagcaccccatctagttgcatggtgaatgagtcccttctcgtctctgccttaaaaccccttccttagggaagtcttccttccctcattatctcatttaagcagatgcccactcgcttggttgctgtaattattctttgtttcttccacgctctgcctcaccattttctttatctgtttatgtcctcgtttaatgtctgcctttcagccttaactgtccatcccatgaggagagagacttatcttttttattcaccactttttcctagagttgaccacagaagcttctgtgataaataccagtgatatatgtgtaggtggatagawgggcaggtgggaagacagacagacagatcgacggatggacagatggatagatggctggatggacagatggacagatggatggatggggctcacaccttgaagcaggtggtgttgatgaggtgtatgtattctcttccacccttttatatggtcatcttatatgtctggctattccatatgagatcttaaaatgttctgtttcccaggtgggagactttgaccccatactttgcattttcaaagttraattcaagggctttgtgatagccagcttccaaggtgatccttgcccttccaaggccctctcctttgtgaggcagggttggtctgggtcaccaatagaagaaggcagaagtgtgtgaccttgaggttaagtcataggagacattgtacttttcaccttggtttcttggccctctcaactggtgggggaaaccagctgctgagccatgaagatacttaaacagccctgtggagataccatatggaaagccgacagccagcgctgacttgccaggcatactagggtgccatcttgcagtgggtcctttcatcccagccaagctgcaggctcaggtgatgactgcaccctcatgagagaccctcaggctgggacctttcagccaagctgctctgcatttctgctgcaaagaaactgtaagcaaagtagcaacgtgtgatgttgtctcttcatctgaaccaacatggctaatttatgcaagtaagtaataatgtatyactgaaaagtaaaagaagaaactgcaaaatctgaagacttgaccataactacctgttagctttggcgatgtggctcacatatgttcacgtgcatatgtggctgcgatgagagggcatcrttcctggtttgtcagcrcctgagatgtgctgatgtccccgggtttgacggcaccattgtctaacaagagaagagaaggcagttgcttgctgctgaagaagggcaaagwctacaacataaacagtatttaataaagccagccacaatcttgatatcatgtttggcttagtgtttaggtttaattacaacgaattcagagagacttctgcctatttatgttctcctcctccttaaaggctccccacaggcctgcctcctccctgaagctttccctgaccacccagactccactgaccacayggcatccatatctcattaaccacatartcaggaccatccagccacacacagcatttcttctcttgtgtttggtttgttgaagggagacaactacctaaattaagtcacattcatccagaggcacggccaggttctcacttcaggacttgctgttctggagcttgtggaagacagaacccaggtgttggagagggaaggagcaggtgtgcttggaaggccccgctgtcgggttccctctgcacccatcttgtgtcccccgctggtgctctgccatgggtttctcacagcctctctgacgtcgtctcattgcagctgtacagaaaatgcaaaccgtggtcttgacgcttatacttcacttctggtcaccaaacgtgggttttttttttttttttttttcccacaccaaccaattctccaactttggacaccagttgggtgtcctacagttcagttatgatgctgactacctggagttagcaccgaccccacaggcaaagggttccatcccacaagatgctccacttcagacgccaattgcaaatagagggtccccaggtgacccacacttctctctgacttggctacaagtgaaggggtcccatgacccccttgtcaggctcaataatttgctataatgactcgggactcacttatttacttagtcttgctactttattataaaatatatggtaaaggacaccaatgagcagccagatgaagaggtgcctatagagcagggtctagagggtcctgagcgtgggagctgctgtccccgtggagttgcagtgcaccaccctcctggcacatggatgtgttcaccactctgaaacctgaatctcctcttttcaggatgtttatggaggcttcatcactttggcattatcgatttttaactccagctccagctcctctcccctccccagaggatgggggtggrctggaagttcccagcttctaatcatggctcagtctttctggtgaccagcccccatccaggagcccaccaagagtcaccttattagaacaaaagacgttcctgtcacccgagaaattacaggggttttagaagttctgttccaggaacagggggcagagaccagatacatgttccttatgccacaaaggtctcatctgctctgccagtgctgtgccctaagcactgtgctacttttttataattgttttttggagattagatttaaaaagaattattttcctctcccaggtttctcctcccactccagccccagttatacttctgtatttattcagcaaacatgcatggaatgtggcattgccaaataaaatataggatgcccggttaaatttaaatttcagaaaaccaatgaggagtctttgagtatatctcatgcagcttgtgtgcgtgcaggtktgtgtgtgtgtgtgtgtgtgtgtgtgtgtgtgtgtgtgtgtatttgtgtgtatgtataatgaggaagacccataacccactaaaaaggtgggcrggagatttagtattagctcagctcagaggaggcatcctagagattttccctgcaacgacccttaatgaagactggcattccctaaaggcagggacttctttcctgctccttagggtccaccatatccccttgcacaataaatgcttaacaaaaatgtatcatccctctcatagtgcacaatttcatrttttggtcccattctcaccaaacagctatgagactatgttaataatttccctgtacctgtgctactctgcattacaaccttcttttatttactgagaaagttcttttgtaccttcccattgataatgagacacatcccacccagtgatccataattaaaaacaatatgatggtatttacataattttgagagttagcactccagtttccatactgttacctctgcacccacctgcctttctgcccctacctcagccaccaggcatctcagaggcagctgattgcttttagtggctgctgtgtaccatgggttttgctgtgtaactattgcagcctggttctaccctaccacttgcttggaacatcttttggcaaggtcaataatgccttggtaaataccttgcttctcttacattctctggggtctttaattattggtatttgtcattggtgatttctttctcttacttgcaattgctgcccctggatttcttggtcccaggttttgccttgttctcctccgacccctttgaccactctactagcttcttttcccactcctgttctccaccagccttctaaatgtatgcaactcccagggttctgtcttctgtctgcttgttttttactgcattgcatctctggaccctttcagaatactccaaaatatcatctatcacttttttttttttttttgagacagagtctcactctgtcacccaggctggagtgcagtggctcagtcttgtctcagcacatcctccrcctcctgggttcaagcgattctcctgcctcagcgtcctgagcagctgggattacaggcgcatgccactatgcctgggtaatttttgtatttttagtagagatggggtttcaccatgttggcccggctggtcttgaacttctgacctcaagtgatctgcccacctcagcctcccaaagtgctgggattacctgcgtgagccactgcacccagcccatttcatctgtcgcttctgttaacatgacacaaaatctttacctgcagttctaatattttgcaaggctgaagtccatatttacaactgtcttagatcatctcaatctgattatttaactattctctctaactgctagtccagcccctaaaactgcatttctctgctcctccaaagcttagtggcttattgatgtccatatttgcattgtgacagagccaactcccaagaatggattcccactcagtgtaatgcaataggagcactttaattttatctccattttctggacccagtgcatcattctagcccttttttcttggaatgaagtctggctgagaatgatgatccattagtaagaattacttaataaatcaactcttggttatgagtggcagaaaactaaagccggcttatgttacattggaatttgttttctgtttacaatacccaaagtccaggggcattttctggctttagatatgagagactccagtgactcaacaagtgttcccaagactggaatttattctttctgttgtctctgccctcagagagagccgaccttcatcatggcaagatggctgacaacagctacagtcttgtctccccttctcaacaaccccagctgcaaacattgtcttcctcaacgatgtaaatagaagtcctcaaatagagtctctgagatctcatttaggtcatgtgccctcatttgaaacgatcaatgtagtcaaaaggtgtagaatacggtgattggccaagcctgggccatgtgtccactcttggcatagggggaaggagatagtccactgaaatcacaggactgggtgggagaaccgtggttccccaaaataactctgggttctgggatgatataagaggtgaatagaaggcaagcaggcaaaaatggcagatatctactcagttgtataaatgcatctctctacttgtcccagaaggggcttcatgacagctgacacatacatcattcttggactggtaagggataagatctgaccttcaacaatggatacgatattaaagggtctccaagacatcacagctgttacttgcagttgctaactatgagatgataatgcctcttatctgagatgagatgttcagttttcttctaccacaaagcacaccaggcatcggccaagttgcaatgaatatttttaaacttctaagatatagtttgagggcatttcctcaaatagaaaatcacaatttgaaaaaatagtcaaaacatcacttaagatttgagttaattttaaatagtggctgtgtaaaagtttgcttttatactatcaaacaatattaagtcagtcaatagtaaaagcaatatgtctatggtgatgcttaaagtgttaatagtgaaaaaagaaaagacttgtgttgaaagtttgcttgacaaagtagtataaatttacatataatttctggcatcatttaggaggctgaggtactgggtgagaaaggcagagtgaaatcttccacaatctgctggtaacttgggagacaaggtccagcaagaggaatggggcttgcaacaaacacataactagtctcccatgtcatgtttcctgcccaagttgcatgggcaagaaagctaaagagtacgcttctagtttgcaaagataaaactgaacttcatctgtagtcttttgtagtgtttgtgggccaaaaagacagatactccagaycctaaattaaaagcctaggatggtcaccgtcaaggaaccatccttgaggatgagccttactaaggcttggactgagccttactagaagtgcagcccaaccctgacccagctcaattcctggcaagtgagagactgatcacatcagtccaattttcctacagatgaaaggctgtgctctctctggtgggaaaatcatctggatcctttatggcactgccatacacagtgtctagcataaaataaaaagtagctagacatgttttcaaaagcaggcatgagggccaggcacgctggctcatgcaagtaattccagcacttttggaggccaaggcaggcagatcatttaaggtcagaagtttgagaccagcctggctaacatggcgaaactctgtatctacaaaaaatacaaaaattccccagcctggccaacatagtgaaaccctgtctctactaaaatacaaaaattagctgggcatggtggcatgcacctgaagtcccagctactcaggaagctaaggtaggagaatcgcttgaacctgggaggcggaggttgtggtgagccgagatcgcgccactgcactccagcctgggcaacagaacagagtgagactctgtttcaaaraaaagaaaagaaaagaaaaaaatacaaaaattgtcggatgtggttgtgcatgcctggaatctcagctagttgggaggctgaggcatgagaatcgcttgaaccccagaggcagaggttgcaatgagtggagattgtgccattgcactccagcctgggtgacrgagcaagactccatctcaaaaaaaggcaggcaggaaactgtgactgacaagagaaaaaaayagagccaccaatatataaatattgaaattagctgagaaggacttgaagctaattagcattggtgtggtaaaacagcaaaaacgaaaaacaaaatctctgaaatggagaaaaatatgcagaatttcagtagtgacctggattctacaaatatgattctataactgaataatatgatcaatatctaaaattaagtactcattggaatggaaacagaagttgttgggaatagtgaacttgaagacagatcaatagacatgaaacacagtagacatgaatggaaggaacagaacagagcacagaagccacatggaacggtgaaaagtgtaactacatataactggaatcctataaggaaaggagtgagagagactgggaaagaagcaatgtctaaggagataatggctgagaatttttcaaaagttatgactaatagttaattataatttcaaactcatttagccccaattagagtaaatgcaaagaaaacttcatctgagcccgtgataatcaaactgttgaaagtcaaagtccaagagaaaatctattaaacattcagaggaaaaaagactttcaaaggagcaaagttaagactggtggttgacatttcaatagaaaccgccagaagaaaatggaaagatatcttggaaggtcaagatgtaagaaaaactgccaatgcagaattcaaactgggagaaaatwctcttaaaaatggaggaaaaataaagatatttaaaaaccaaaagcaggtgataaaattcgtctctaacagaatcaaactgtaagagctatgaaaggatgtccttcaggttgaaggaaaacgatgccagatagaagcatagaactatagaaagagcataagaatgtaaacatattggtaaatataacactattaactctttaaaacaataatgcaagatatttagggctttacaacatatggataagtaaactatgaatagcacaaagggaggaacaaatagagctcaactattataatatttttgcttattctgaaaacagtaaagatactaagttaataataagtctgggatcctcatttttatctccaaagtaggcactgaaaggatgacagtaagatataagaagctgctataagagaaagatgaaataataaaaatataaagtttattttaaaaaaacaggaaaaataaaatactaatacacaagaaaataagtagaaggatgccagacttaaacccagctctgcaggaattatagtaaaattaaatggaaaaattaaaaaacaaggattatcagatggggttaagaaaccaaactccctgtatatgatttacaagagatacactttaaatgtcaatacatacagaaatgaagtatatataaatatagaacttcctacaggaatcaagtaaaaggagagaaaaatatatatgccatgcaagcaaacacatcaaaatgaagctgaccagctgtaacaatattaaatatagtcgatttaagacaggaagtttgatgagaaatagtcctatctcataataataaaatgagtctactagcctggtcataattctactcagtatcattttccttcaatctgaaacacttgctttagrattttttcaaaatatataccatagaaatttgtagaattaaaaagagagaaaaccatatcacagtggagatttttgtaaaaataaactttgaagtaaaacaataaaaagataaaatacacataagtggacagtttaatgaattttgacaagtatatacacccacgtaaccgtcacccaaatcaagacattaaatatttccctcatcccaaaaatatttcttcatagtcagttcctttgtagtgttccttttcaatcagtctttcttatcaactctggcttcaagtaacgaccaatctgttttatagcactaaagattagatttctctcttctagaaactcatatgtacgaaatcatgtgattgtactcttttgtgtctggctccttttgattaacataatgcttttgaaattcatttgtgttgttggtatcaggagtccatttcttgttattgcttgagtagtaactcattgttggatattctgcagtttgctcatacattcccctgttgatggatatttgggttgattcaagttttgagctattaagagtaaagctgttataattaactctgtgtaagtcactgtgtagaaatatatttttatttcatttgggaatatacccaggaatggaattcctgtttcaagtgtttagctttctaagaaattgccaaattgtctcccaaagtctaccattttactttcccgccagaaatatatatgtgttctattgtttctatcctcaccaaggtatacattatatgtcggtggtggtggtgatttataatttacacttggtatattcagtcttcttcaactcaaccattataatggttggatattggtatctcattgtggttttagttcacatttccctgatatttcatgaaattgaccatgtttacatggaacttattggccattcaaatatattttttttttgtaaacgttcagattttttttacccatttttacgtgcgttaaggtggttaacagttctttatatattctggatacaagtcgattgtgtagcaaatgttttcttcaacactgtggcttaactttatattttcttaatggtgtattttgatcagcagaattttaaaattttgaagtccaatttatcaaatagtatttcatcttctataatatatcatttactgctctttgctctttcagttttaatctatatgcattgttatacttatagtgggtttcttgctgacagcgtgtagttaagtcttcctttttcactgcctgtgaccatctctgccttttattttggagtatttagatcatttatctttaatgtaattattaatatggttggcttttttgaagttgctgttctttattttctacttttccatctgtttgggttttttgtttttctccctccctccctccctccctcccttccttctttccttccttccttctttcacttcctttttgttacctggttttggatttttaaaaaatcagtattctagttttctgtatgttggtttcttagctctttgtctctattgtattatttatttgttaactaatttattacttttgggtgtttgtgtgaggcacggcctttcttagagtgtttcatcgtaatcacagaagacagagaaaaatgattgagtgtctttctcaattctcccaaggatgatgcataagtaacaccattctaaatgcataggagagacattaattcatcatatatgatggatgtgttaaggtattacagctcaatctctggaggaggtctgatcaagaaagactgtgaaatttatagtatggttctataatgtattcatagtctactgtcaaataataktataccacagtgggagaatttaaaaatatcttcagtctaggatctttgcccttctgtgaaccagccaatttggtgtataatatgatggtgttctcacaattaggacaaacaaggtgaggcatcaccttacaatgaattaaggaagccaaacccaccacaggtaaagagaggctttgctatgcagggttaatctgtctcaaagctgctctgtggctaggccaggattcaaacatattgcttatttccctgtcctgtgaccttctaaagcctgtgcaaaaatkattttcctttaccacattccctggttttgctcaaagcatatctcacttcaaaaatgcccaagagccaggaatagggtgattttcttaattgccctgaatgctctgtgtgaatcttctcctctcggaaagtaatttaatgacctgtcttgggaaatggactgggatccctgtacaggctattacattactctttctaataggatttctacagcgatttaactcttcccactaatcacaaacaaccaatttaataaaagggaaaatgacagttttgcttagaaagctgtacaaacatgtttgcgcttttccagcacaatgacagcagcaataaaaacagctgttgttacattggtgatatacataggatagtatgagcaactggaaataccaaaaggattgaaagctcccagtgatgaatggggattttacgcatgtaaaaaggaatatcgatgcttcccaaaacagcaatggatcacattgtactttaacactactttcaagtaggtaaaaatgtttcacacatcaaatatcaaaaatgatcaaatcagtcctgtctcccttattttcctctgggtgtcagtgtcctcccaggcacccagctccctactttgctccattcttgagttcttttttatccttaatgcccagcctgttccaaaaccatgccccctcttcctttgttcccttcttttaaaagtcacttcttttctggcgtcactgccattgtgctcaactagtgaaaactggaagtactaaagtctttactgcattatgcctcaaaaatacacacagggcatttatcattctgaaatgacacaattttggtaatggtacgtgtagcctatttccaaaaccttttcctttctttctaaatgttatttttcaggagtgatttataatttagcataatgaaacatcctcaccattggtggtttccttttaaaaaacaattgaatacaaactgactctagacaggagacaactgtgcttttgttttaaacttgcagagatcacttcaagctcttcagacgtcctccccttccaccctcctgtagcttagacccctgctcattatcctaagtgtcctcacgaaaggggtgaaatcttcccatctatctgtgttcttctttctttcttctcgtcatcatttctgtttttgccgaaacacattgatcccattcaaagtatmgtataataaaagaccaattactttctaaaaaatgctgactttccattttagtccaaatgccttgagatcacacacaaaaggaacacagattagaagcacatctgggatcacaacaggaacaagttagtgagaatttaatctgagcccccatcttgtaaaaggatagtccaaaggctgaaggcttaacttgcagaatttggcacagaaacagacttggtgaagcaaaatgaacagtttggacggacaaaaccctgggggtggggttggtggggtttgaggaacaaagagrgaaagccaaacgattatttgatttaagcatcagaattggatgaccctgagaatccctctggagaacacactaaagattgtttctccagagaatgtcgaaattttagataagaccaggatgtttttgtatacgatttggacttgaaagttttattaagtggctcaakctgtcccacggtcatgatacatgctacccatrtatgttccatgaatttgaaaagattaagtaattaggccccaggctcagagtataaattatgatttaaggaggcagagtattaactaygcctggaagttagggaggatgtaagagtatgtataaagggcaatgtctgcaatctggatgggaagagagtagaccaatgtgtttttgtcttctgagtatttcttagtggactcgtaatggttgctgcctttttattgcttgggattaaatataacctttgatgatcatcctcaaagcttcttaccagctggtcacatcctacaagtcttgacctcctataaatacaacctscttctccaaaaatccactgattcagctatgtcagccaccccaccccttaccccatgttcctcatttagcctagaaatgtggaggttcttctttccttattcttcctttaaacaagaactgaaggcctaactctcaggaaacctccccatattaaatgcactgccacctaatttccagtgtgtcttcatttggggactgaatgaaactatgctcaccctgacatagattgaatgtaattacattttggcaagttttcttccattcaaaggtggtcttaaaaagaacataacacatctgtttgcatatataaataaaataacaagggtgggagctgtgtaagccagtgtgttgttagcacttacaaggttatagaccatctggttaaatgcarctattcaagaagaaaaatttaaaccagggtttcttagcratgacactgttaacatttggactgggttattctgtgctggggagagggagrgtactgtcctgtgcattgtacaatgtttagcggcacccctggactctacccactggttgccagtagcatctttcaccctgttgagacaaccaaaaatgtccctagacattgccacatgttccctggggggcaaaatcgccccaagttgaaaccactgatttcaaccaacctatttaagtcgttgcttattttgaatacttgttttacattaagcaaatcaaactgaaaagacctgaggacagaaagcttcaagctgccttagaagttggtctttctcatcatgatatactagtggaatctcgtggaatactccggcaatgttaatctgtggacatgggaagagttaacgcactcaacctatgtagccttttacgtcagggttttaaaggttacattaatttttctgtgcaggattttattctccagtagggtcaggtttttgtgtttcctattaattaaaaaaagaaaagtgaggtcatatggtaataagctctgtggtaaataaaattgggctgttatgttaatagcagagataatgaaacagtactttcatttaacaaaaccgtctttttaaaatgtgtcttggccgtaaattatctatacacccatgattgattattgctgtatagatataatttttcctgcaagttgttaaacagtaatgcagatatatgcagaattattgccagggtttaggaggataactcttagcttggaggtactgaatttggtaaggggaagaaggaaggagagtggtctggctgcagagccccatggatactatcaaaattggcctcttcccccctgtttatcagtgggggaccagtgcccaggtcctgtcaggtgggatgggatcaggcaggtggagcaaagtggtagcctccttccttctttcctgggccacattagagctttagctttgaccctgaccccagttcttggccagggcaagaggacagtagctgtgtatgatttgggtagcatcattaaatggttgaaaattccagtgggattcttctaactgcagaacgttgcatgctcgcatcttaagaaatagaaggtcacacgatccatttatgaattcaagatatttttattctacaaaggtaaaaataataggaaagaaagtgaaaaggaatacttcgaagatggtgaagagactgacggtgatatgaggatgtcagagaaaaaaagttgagtggggctgggccaggtggctcacccctgtaatcccagcactttgggaggctgagacaggcagatcaactgaggtcaggagttcaagaccagcctggccaacatggcgaaaccccgtctctactaaaaatacaaaaattagccaggcgtggtggtgggcacctataatcccaggtacttggaaggctgaggcaggagaattgtttgaacccaggaggcggagtttgcagtgagccgacattgcgccactgcactccagcctgggcaacagagtgagactgttaaaaaaagaaaaaaaaaagctgaatggtaatagcaataaaatattagacagtaacatgggtaaattcaacatgagcattcatgtatgtgactttttaggggtgggggagtcaaggttgcttagtagaaaattcctggcaaggaaatagatccagggtttggctctgccatgtaggagccaggtaaccttgggcaagttgctgaacttctctgagttttccttctttgcctataaaatgagtgtcttcatctctgtggccccagaactctgtatagtgccttgcccataatagatgctcaacagatttgttgaaaaaatgagagaaaagaataaagtggacgtagctagaagaaatctgggctaaatccctagtgactgaagttccaggcaggcatgccgaggcctggggtcatggaatcttcttccagttaaaaaatatgttcctggaaatgaaggcattgaaagtggatatgtgctgtgtttaaactgttgtaaacttattcactgggttctgtttacctcctctctttctcatttctgtaccatgcctttaatattcatttagaggttcccacatgttaaccttaccgcttcattccttcctacaatctccaagcagctgtcaaaagtaatattcctctctcctgaagaaaagtccttagtatttctttaatgcaatctgcggctgctgaattctctcaatttttgcttgtctgcaaatatctttatttcacctttaatgttaagaatatttcattttttaaaggatatttcattttcaattttaatcatacagaactttaggtgacaattgtttctttgaaccatatagtatattcttttgtcttctgtggtgtcatttgtcagttattattgctctttttaatataccgcatctttcttttctttgtctctgtttttcagcaatgttactatgattcttctaggtgtggcttttctttttcatttataatactttggattcgtgattttttttataaaagtatgtgacttgatatctcttcccaattttgaaaaattcttattttctcttcaaatattgcttctgaggttttctcttacctcctttgctgggtctctaattacatatacctttcaccatgtcccatatgtctctgaagcttttttctgaactttccagccttttatctctttatgcttttgtcctgcatattttcttcagaccgatttttcactctacgatttcttccttcagctgtgtttaaaatgccattgaacctattcattgagttgtattttccagtttttagaatttccatgtggctctagttctctgctgacttttctgtttttcaatttcttgaacatatgaagtgtggcattttaaattttaaattcygcttctgagttcctttaactgcatctcctataggtcagtttctattgcctgtggtttttttcttgtatttcagtcttatcttctcggtgttcacttatgcctggttatttttggagtgtcagacattgtatatgggcagcttaaagacaaattgagccgctagatgatgtcatatggttggttggtgcctaagctaggggcacttgtgatcagtgactgaacaggtctcaggctttgtgaagactgatctacttctcattcgccctctctccttgggtatagcattttgagatcccaacccaaaccctggagtggggagttatcaatactgcctcttcgcaggccctcatttctggattttgtcttccttgccttgtgagtctgtgggaagttctggtgaggttttttggcctctcagctgcctctcctaatagctgcagattccttgagtgggacagttacctccccattttgggatcataccttctgttttcttctccatctgggtcatggtcccataatactttattactttggaaatgctacattgctttcaaataccatttttgtatattttccctagcttttctagttgtttttagtgggaagttaggtctaaatgactcaaactgtcattaccagaaacaaaacccctccatttgtgtaccatcagcttaatgactgtggaatatcacatcgtgtggttcccacgttgttttgctgtttttcattcctgagacagggccttgctccctcacccaggctggagtgcagtggcacaattctagctcactgcagccttaaactcttgagctcaagtgatcctcctggcttcagcctcctgagtagccgagactatagacacatgccaccaagcctggctaatatattttttaaaattttttgtagagatgggtttttgctatgttgcccaggctggtctcgaattgctgtcatcaagtgatcctcctgccttggcctcccaaagtgctgggattacaggcgcttatgttttttcatttttaaccattgccctgagttggacatagaagaggtgttttctgacttcactgtgaattatgctgaatgtctttctgcttatatctgtgcatacttttctagttatttcctttagatgacttcttagaagtggaattgttgaatcaaagctatgcacatttttaaggagtaggaaaactgtttccagactgccttatggaaagctgtaccaatttgcacttttaccagctgtgtgtggaagtgcccatttcttgacatctcaccaacaccagcatctcatgcttttaataagcctagcacagcccctggcagctaccagcttggctgaaggaatcccagctttaaaagtcctcaacaggttggaactgtgtgtcaaaattcacagaataagttgttaggtaaaatgaaaaggcctgcagttcaaacaaacaaacaaaaaactagctaagcagatccccgatmgggaaacctggtataatagcagttcatattaaaaagagtgaggggtcattttagatgacaagtgaatgcactcctggactggatttgtagaccttgaaggtacagaaatggaaacatggggtctcagtgaactctaaattaggtggctcatatctgaaatactccaaccatggttacattttaagaagtctgtgacatgcttccagagcagaatatagaaagaggctggtctgtaaccacgtggcagggagaacagctgagggaacaggggtgtgtgtccctcacaaaagatgtgtttgggggaagaaatgaatttgcatgactttgaaaagattgttcttctcgactacatttaaaaatatttaaaaggctgggcacagtggctcacacctgtaatcctagtgctttgggaggctgaatggggaggatcgcttgaagccagaagttcaagagcagcctggacaacatagcaagaccctgtctctactaaaaaattagtcaggcatggtggcatgtgcctgtagtgccagctactcaggaaactgaggtgggaagattgcttgagcccagaaattcaaagtggcagtgagccatgattgtaccactatactccaggcctgggcaacagaacatctcaaaataaaaataaggaacaggcagttacctaccaaatattttattttaaaaaatgttttggtgcacatttcctgatggtccccacgcacggggatggacatgagcctgctcttctctccagttactgcccttcatggactgttcctgccagaacttggaattggttgtagcgtagggtagatgcctgattgcctgatttacccatggggtgtgtgtgtttatgtgtgtgtgtgtttatgtgtgtgtgtgtgtgtgtttgtgtgtgtgtgtctgttgttcgatacttcatgacagtggttcatttttagctttgatcatcagaggaagaaagatgggcttgccttctctctactttacattccataattttgttttattttgtttttctttattaacagcaagcaataggccaccaaaaagtccaggcatattggggacaaaagagtgtgcatggttttyatggtaaaggatagagtcccccagagttattgagaagacatttattaacttttcttattcaggtaactatgattgtcagtttggatgaacttcttatgagtgattctttttctcacttccaataggagaacagagatgtgtgtgtgtgtgtgtgtgtgtatgtgtgtgtgtgtgtatttttgtggtaagatgttatggtttgcagcaaaatgaaaattcaattgtaagaacagtagtgttttcctggattgcagggcaacggaaatatattcttagacaaaaggagcagaggtatgaccaatacaaatggcagtgtggtgtaatccttattgtcagtcacatgaagtgcttcttatgtgccatccctgtccaagttgtgatagaaactatgtcatttagtcctcccagctggcatagtatgacttacctgtgagggacactgggctcagagaggctaacaatgaccaaagcatcacacagctagtaagtgatggagcttagatttgaccccagatctatgtgattctattttttggggggagagggagaggaagctataatattaaaaaaaaatgagttatagtttcctctgaagctctgatgggtttaactgaccacttccttttattttccactgagcctggattttccatttgtaaaaaattagcaaggaaacctttcatttaagcttgatgatcatgtaacagtttttggatttccttattccattgcaactttaggtaagaccctactgtatacttagggagaatacacacaggcacacacacacatmcacacacacacacacatctacacacaattttgtttatacaaaatttcttctagttaataatgcatcagaaatcttttctgaactattttctctgaaatcattacaaataaaagatttgtctgtaggagttcaggaatctctgtatgacatgatatctctagaaaataatggaattttggttcttactggttgtaaatcatgttggtcagttgtaagttattcacacccacgtgctacgtctgttagctgtcttgactcttcctctgttttcctttttttcaagtccacattagttttatagtccaagtaagttgattatttacccagtttttcatcatttaagtcaggtcattcttaggaatggagcaatcctttcctcttcctagcagaacagggaggaaacctgaacagccgagactgtcgcgggagaaatcctgcagtttccacagtgaccccttaaatgctgtgacattttcactcctgtggtttagtttcagttgggatcatccacgaaggctgaaaatacgctaaggttttggtgatcacacacttctgatcattccagcctcatcctcagcaaggactacattttctattttggtctgaaattcatctgtgttaagggtgaatttaaatactttgtcagcaaatcaacagccaaaattctagtatatccacttattccatgtaatgatgactttgactttgtagcaaaaatcaagattgactctcagggtggacagccygtacttagcacagtgtcaggttctgccctgtcagcatctgatgaagggatgagcgcattttatgaggcattaatacagttgatccaaaaacacattgatttcatactttctatatacaaagaagcaatgcttgaggcacattgatgggtcttcaaagttgcctgaggcctcaagaggcttgaagcccagtgggtagacagtgtttgtgagtaaacagaaataactacatttcaggtaaaatgtggcagtatagttagaagagcagagattggagagaagagctctacctgggccttcatggagagttttaaaggccagggcatctgaaggggccttgtrgaagatggggagtattttaggaactagaaggaagggcaaaagaagaaatgggaggccgaggtgggtgggtcacctgaggtcaggagttcaagaccagcctggccaacatggtgcaaccctgtctgtactaaaaaacaacaaaaattggccaggcgtggtgacatgcacctgcaatctcagctactcaggaggctgaggcaggagaattgcttgaacttgggaggtggaggttgcagtgagccaaggtcacaccactgcactccagtctgggtgaagagtgagactccatctctcaaaaaacaaaataaataaaaataaatggggtgctcattcacttgtttcatgtgtatcccacatcatcatcctgtttgacttgaggccagggattgtgaagtcaatacctgtaggggccaggccagggttacaaactagtgaagctagccagacataagatgacaggtaagctttgccccttgggctccatgtgtggatcccatagggcaggtggggctgggagaattggtggcctctagttagttttagccaactgttaccattgaagtagaaaccaagggttgccatttttcctggtatttctcccctcccagaagctgcacatccagatttgtctgagaattctcctgactcttaggtgttagcaacttaatcaaattgacagcactggatggcgcccactttggggccatgccagtgatagagctacaggctgaaggagccttgtgggttgctggcctgtgaaacttggtcgagcaacaatggttctgcaatgtggtccccagaccagcagcatcagcatcacctgggaacttgctagaaatgcaaatgcttgggccccacccagatcatctgaattggaaacttgaggtgggcgcaatgatatctgttgtaataagcactccaggcgattttgatgctttcctgtgtttgagattttttatttttattttttttacctttttaaatgactggagaaaaaaattcaaaagaatatttcgtaacacataaaatgatgggaaattcaaattttggtgtacatcaataaagtttgactggaacacagccacattcatttatatgatctatgactgcttttgcactgcagtggcagagttgagcagtcatgacagggactgtatggctaacaaagcttaatgtatttattatctgttccattacagaaaatgtgcatcaaccctgctctagagcactgaatgggrtggaggaagaggaggcaggtggaggagcctgggatgctcaggaaccttggctttgtacccaactttggctttatatatgaagggcagaagaattatttgagccctgcattaataaaacagctcagggaacaatatacaggwctggctgatgaaagagtagccaggggagagctggaatgagggccatgttgcaggaatagaaggaactgtggaggtactccagagaaggaattgcaaaactcagccactaattcaacattggaaccgagaggaaaaagagagtcagaagagggtaccaatgggagccaaaaggatgatgatgacaataggaaaaacaagggggtcacaaaatgaggaatgcactcgggggagtcgggagaaatgtgaaatgagctggtgagttttcagcactgtagcctttgagttgccagggagagatctgctgattgtggcttgtggggcatttgcaatgcatgtgctgggctcaagagagcagtcagagctggagatttggcgtcgagcatcttctacatagaggaccaagtttttcataagtangtctgggcttcatgactggctgatttttctaatgtttcaacgggaaaaaaaaaaagctgaaccccaattttcattagcaaagtgtacagattgaggatgtctctgtcccagagccagactgggttgaaatggaaagttatacccataaaggttgcaaagccctgcaagcctggtgaagtgatagtctggttaacgtggtggctccaaggggccacacagccagatgacccccagtccttctcaagtccttcatctgcttttgccttgagtcctcaatcccagagctgcatccatcaccccccgagccctgggctttctgactccatctcccaactccagtggagcttctcctccagcctcagcgtgcacctctgtcccattcctcccgtgccatctccctcctgatgctgaggctctcatgaatgcctcaagacacagccaggcaggcaagcaaagggaagagcaagtgacactctaacttcaatttttgtctgcagccatgaaatgagaattctctttgcaagatctttatgaggcttgtagtgtgtgttttcatggtgcaatttgaatgtgttttctaaaaagttagcaattagctgtaattctgtttgtaatagaaaaacttgtttgcattcggcctcagtacatagtgacttgcggtgcctctgtgatcgatagcaggattactctttaaagggcttagtatattctgctaatgtttatttgaaagacattacagtgatgctttataaatggattttagtcaacatatgaatggggtatttttctagaagacagcttgcatgcaaacaaactagcaacttaagctaacttcccctgactgacagttttgaaatgtgttgtaggaaaaaaaaatggtacatgaatgtttccagacatcaaattagttatataaatgcactttgaatgggaagcaagctttctggttaataaacacagtccatgctattctaccactggctgtgtcttagaaggcctcagaggccactccaaaaacaatgctctgtgcttttataatattttaatgtccctggttatatcagtaagcatacattagaaagtattagcttaaaacattctacaccaaaatgaagtacattcacatattttgtgctgcatcttacaggtyttctagtaccttctatccccttctatgattggtcgtacacatagtacgtaagagcctcttcccatatagaagaagggggaaagctaagctgctttcagctatcaacccaggactggacccagtgcctggctcataaataggccctcagttaataaatgtataatattcctttttgaaaaatttttgaagygtcatttattatgcccattttgatctaactataaaaagcatgaaaagggtgcaatttgggaaattagcaatcgataataagtgaaacggtatcttgtcactgtcatgctgtgcagtagcagtttgatttgtgattggatttctgtaataagcatgcattttcattttgtcacgcatgatggtttccaaacagcctttttaccatttgaatctcatagcgatcatactaattaagtcagttgtctagtgctgctataacaaatcacaccagtttaagtggcttaaaatgacacccatttattatctcacagtcaaaatctcaaggtcagaagcccagtgggcatggttggattctctgcttcaaatctcaccaggttaaaaacaaagtgtccacaggacttccttcttggtggaggctctgggggagaacccatttcctgctccttgacgcactggcggaattcagttctaygtggtggtaggaacatggttcctattttcttgctggcggttgagggcggttcccagcttctggagacaccaggttccttggctcatggctcccttctggcaccttcagagtaagcacagtgggtcaagcccycttgtcacatctttctgaccccagtcatgaaagattctctgccttcaggaacgcttgtgattacattgggcccatctgaataatccagggtgaggtccctgtccttaaccttaattgcatcttcacagtcccttttgccaagtaaggtaacatatgcacacattccaagsgttagcacatctttggggactgtcatttctatgaccacaatgataggaaaagcgttttgttatcccattttccttgtaagaaaactgaggtcyagcagagttaaaagattggccctcagtccatggcccacagctgccgtctgaccgtagccttctagcctgaggcccctcctactgtagcctcttaaatggaaaaatgctacatttccaaaatgaaatagttctttgttgcttaaaattattgttcctttgcagtcaaaagaggaggaattgytgcatctccataaactttcaacctaggatgctcctagaaattgatcagggtgttccaagacctggggtggtccgaggatgctgaaatgaactgggtcttggaacccagcctaggccttcttcccatggtgagcacacctcctcatcagccctgctttccagtgcagctggcatcgacactgaacgttgcaaggggctggtacccgtggatgtggatgccaggcacatggcactggggctaccagtggtccttatgagcccaggtggtacgtggctgacaggaaagactcatcccggcctcggccttctgcctccccgccttggcatctgatggtcctcagcaggcagccaggtgctggcagagatgcctggaagtgggagagggcacggggcagcagaggtctgaggaggtggtcccacagcctggcagggtttggtgtcagctggggcctggtcagaggctgacttcagcaacatgatgtcaacacactatccagcccccaggcaccaagtcaccacatggtcctgtccccaagccattgtgtcaccacacggtcctgtccctgggccaccgtgtcaccacatggtccttttctctggccatcatgtcaccacacaatcttattcctgggtcaccatgtcactatatggtcctgtccccaagccatcatgtgaccatgtggtcctatcctcagggctaccatgtcatcatgcggtcctgtccccaggccatcatgccaccctgtggtcatgtccttaggggtaactatattaccacatgatcctttcccctgggccactatgtcaccactttcctgtccctgggccaccrtgtcaccatgtggtcaggtccttagagtcactgtaccaccacatagtcctgtccctgggccattatgtcaccacacggtcctgtccctagggccactatgtcaccacacggtcctgtccctggatcaccacgtcaccgcatgatcctgtccttagggcyaccatgtcaccacatggtcctgtccttggggccactatgtcaccacactgttctgttcctgargccaccacatcaccacacagtcctatccccaggccatcatgtcaccacacccacctccactctttaccttgtattttgcattgattcagattttatcaaaagtcctgctgctgctgctgctcttgctgctgccgcctcaccctgtctgccctattttggattttttttgtcacgaagatccaaataaactgagcaggaggatgtggaatcctctccggagagctgagggtgctgggacccagcctgggaacatgcattcattggtcatttgtatagtcccaagtacaaatgtaagaaattcagctcacagggcaagccctgcctactctcctcagaagaacagaatggaagtccattttcaaagtccagggtttccctgctccttgtacagggatccttgtacagccacttgtgtcccacagaggacgttggcctcctagggtgaggcaagcagacagcccgcaggtcagaggaccctctgcttgtgacagtgtgtgacaggtgaggagggactggaggccactgttatacctcctcaggggacctttgcagctttggggtctcctctccgccccccagttagtgttcctcctgcatccccgactcctcctgcctgtacccttcatcctacagaggcatctcggtggccctgctccgggtgtggggactgtaatgtggagcacgctgacaaattctttgtccttgggaagtttctattttgccgagggagatagactgtaaacaagtaaaagaaaaacaacaaatcatcacaaatgaggaactttgctaggaagagacagaacagggtgtgtgagaaccaacarcccccttaggaggccgggacttctctgaggtggtgatgtccaggccagtgcctggaggttaagccacacaaagggcccagggaagatgttttggcagagagtcagcagccacaaggacccagaagcttcgggaacaagcaagtgatgacatccaagtgaggtgccaggtgagcagacgccagagccttcacagcgtgaaggccgtggttttgttctaagcacatcaggttgccattgaagggtcttaagaaagggcatcactaagctcaggaattctggaggaaagccagggtggattttctccaacctcccctctgtcgtggatcaggggtgatggagggagatggtcaaataaaagctgaattttagctgtgttaagtttgagaaatccatgtcatagtgttttccaggttgctttctgataagtcatgttttcatttccctcttccaacccaatagtaagctcaagaaaggaacagagtaatgtcgtctgcttcagaattggccattgtcctcagacagatgcacgtgcctggtggactgtcattctatagcattcagatgcacagaagcagaccagaagtatttcagtgcataaataaggctttaagatgctctggctatagctaaagtaatctaaaatgaaaatctaaaatgtttgctgcaaatctgaggattaacaatcacaccggtagcgacgggacaaagaacttgagctaagagcatcacgaggaccaaaggtgatgtgatggtgccttttcctgcagggagggagaagcaagctgaaaaaccaagactctatcatgctgcagaaacacagtgagaagatcctgtgcttaaaataatccaacgtttgaacacacaaacttccaactgcattataaacctaaggataatacatgccatcctgtacatagcattttaacaggttgttggctaaagttaattatccatcggaaaaattgtcagtaactcaagaataaacattatcattatttatgtartaacaaacaggccccaatccagggacaccccattataatgctgccgtgccttaattcctgactgtgttatactgcagttaattcaattttgtcctctctaaattccacagtgcgcatatcttccaggctgtggaagtagcacactgatattaaagtggtaatcaagattgcctctaaatattcatagcaataaatgactccctcgtgccccgtgaatgccaaggctgcagcctgaagcatttatttagtgccggagagggatctagttattttagagttcccttgaatgcaatattttaattttgttgttctkcttgaaaaattagatccctctgagcttccagtattgatggttgagatgaatgactttggctctggctgaccatggtctttggaaggataatctcagagttgtgatgggagtggacttggctgttgaccccaaatcttactttttggatggtaattccctcctgcctgccagacctgctgccgttccactgccacattaattcaccctcagaatcagggcagatgtttctaagctgttgaaaatttcttgttctctaaagagagaaaaacaccaaggacctgatgctgtgtgtcatcccgtccttcagggaaaataatgagcaccctacaaccatgcaaagctacatttatggactcgaggtattttgtgttcattatgggtgaaatgatttaaagtcaagtttggatcagcctccaatcgcacacattaaagaagggtagcacgacatggatagcaccaaaaaaaaaaaaaaaatagggaaatcaatctaatcagccaatcaatcaatcatcactttttgcacatctgtttgtacagccagttcactgkgatgccctagccaagtgcattgtgggaaacctctgagagaacacaggcacctgggggccctagaggtgggcagctgggtcctggccgcacccgtctttgcagatttgcctgggcttgccatctyaaggggagtctgccaaaaaagcctttctgtgaggaaggcacttgcctcctgtgagcacatgtgcactgaggatagagtgtctgatgagttttgcccaacgacaaagcttccctcctaggaggaaagagggatttggagtaaatgcagtatcagtcttggggtttatctccaagcctacatgccctaaagagggaacttagatctgactcctagatggaactgagagtgaagtataagtacaaatagcaagagctatttcatgaaaaattctataataaactgggacatcagcccaggtcccataatacasttacacacaaaagcaagtgttcatgcacatgcctgcatgcatacaggtaaatagggatatcaataaatgtcagtgccttatggcctaagaggcagtgtagtagataaaaatatatcgattcacttgaactttcaaacttaaaaagatattttcttatgactttggrggaaacaggaagctgttgaactttgccatgactttttttgtcacctttgttgaggagagcttgcctccaaattataatgcttctcttgcagcagaaccctttccttctctcctacccagcatcccataggaagtggtcctttcctctctagaatgtccattccacagacctctgtccagtctctcagtctgtagcccttttttggccagcacctaccggctcctcttacctgctggctccctcacctccagcctgtattctcccctggccttcggccactcttggcctgcacagtctccaatcttgggtcacacccttaaccctacctaccttttccaacctgccattgagccctgaacgctgcaaaagacagacaagtgtgtatgggtgaataagaaataaaacagccccagtgaagagagtaagggagcatcctttctccaaggaggacaaatcaaagtgaacaaataaaacaaaattcacacccagacatacaatggccacactgccaaacatggaagaaaaaagatcacaaaagcagctgcagagaagagatgggtcacctgcccaaggaggctgaggactgacttctcagcaacaagaatggaaaccaagtcatccrtgatcgctcgagcctgtagtcccagctacttgagaggctgaggcaggaggattgcttgaggataggagtttgagaccagcctgggtaacatattgagacctcatttttataaaaaagaaatagaaacagaagacagtggagcaatcccagggtgctgagatagtagaggtgagaagactcaccaaacatcaggactcagagtaaagctgtagtaattaacacagggtggcattagtgcatggacagacaatgagacacatggtattagctcagaaacagatctccacatggctgctacagatacggtggaaggataggtcttttttttttttttttttttttttttgagatggagtcttgctctgtcatccaggctggagtgcagtgacgtgatctcagctcactgcaacctctgcctcccgggttcaagtgattctcctgcctcagcctcccgagtagctaggattacaggagcacagcaccatacccagctaatttttgtatttttagtagagacggggtttcaccatattggccaggctggtctcaaaggcctgacctcagatgatccacccacattggcctcccaaagtgctgggattacaggaatgagacaccgtgcccagccaggaaggatagacttttaacaaatggtgctggaacaattggttaatcacattttctctaaagtagagttggactcctacttggtactggacacaaaaatcaagtctggatgggacttaaatgtgaaaggcaraattatgaaacatttagaagataacacagtctgctttttgatcttggagtagggaaggatttctcaaataaggcacaaagactttaaaccatgaaggattttattaaaattaaggcattctgttcatgagaacacacttaagaggatgaaaagccaaagcccaaactgggagaagatatttgtcacacattaaacagagaaaagcatagcttccagaatgtagaaataactacaaattcacaakgacaagagaaagggaggaggaagaaagcaggaaaggaaatggtcagaaaacatgagcaagtatttcacaggagaagaaaatcaaatgttccataaacataagcaaaggtgctctgtcttgctactgaggagggaggcgtaaaggaaaaccccagtgagccgcagttgcacagtcagcagattggggctgcccgcctttttaaatttttgccagatattcatgagactatggaatgagagaaacatttataacccatttgtactttggaaaacaatttaaagatccctggtaragtcaaacatgtgcaaactacaccacccagagtttccatcccagattagccagggaaactcatatctgtccagcaaggcaggggtccccaacccctgtagcctaggaaccaggtcacacggcagcaggcgaggtgagctgcaggctgagaagctacatctgtatttagagcagctccccaccactcacatcactgcctgagttccgcctcccgtcagattagcggaggcactgggttctcataggagcacaaaccctattgtgaactgtgcacgtgagggatctaggttgtgggctccttatgagaatctaacgcctgatgatctgtcactgtcttccatcacccccatatgggaccatctagttgcagaaaaataatctcagggctcccactgatgctacattatggtgagttgtatttcattatgtattacaatgtaatgacgatagaaataaagtacacagtaagtaataataatgtgcttgaatcatcccgaaaccatcccccacccccagccccagttccatggaaaaattgtcttccacaaaaccggccactggtggcaaaaatgttggggactgctgtagtaggagacatgtacacaggaacatgcataacagcattttaagagcaaaaaggggtggagagaaagaatgccaaagtccacctgtaggagaaaggacttacacattgtttgtgcaatagaatactacatagcaatgaaaatagatggactacagctgtatacaaccatatgtataaatctaacaaatataagattaagtaaaagaaaccagtcatagaagaatggacaaagtatgaggccatttttgtaaggttcaaaacagggtaaaactaaacagtgtattgcttaggaatatgtacactagaaayaaaactgtagaggaaatcaagataatgattaatagaaacttcagcataatggttaccactggttgggaataagggaaatgtaataatgaatttagcatgagaaagtgtatgagatgaatttcctctcccttccccccagcaaattcctgtattgacatcctaaccccggtaccttagaatgtgactgtatttggagaaaggccctttaaaaaggcaattaaggtgaaatgaggtcatatgtgtggcccctaatcttatatggctggtgtccttataagaagagatcaggacacagacatacaaaaggccatctgtggacacagtaagaaggcaactgtctcaaagccaaggaaagcggcctcagaagaaaccaaacctgccaatgccttcatcttggacatctagctccaaagctataagataaatttctgttgtttaagccacacagtctctggtgtgtgttatgacagccccaccaaactaatacgggggcttctaagattatagaaatagtctgctttttcagctgggtagtaggtgccctggtgtttattttaatcgttgtttttcaaattgtacttatacattttatatactcttggatgtactttcccaattaaaataatagagcagcaattactgccaaaacatttctggcccattgattagcakttaattgatttattcagcaggtacagttctttaagcattcaataaaagacacagttccattagggtaatcaatatatcatttttaagaaaaggaatgccgtattttaccggtactacttcatcatctccaatgggtaacaatcaaaagaaaatggaatgaatacatgcttttaagaagtctaaggcaattagtggtcttcaattaaagtagctgtctgttctccctctctattgrtttctcctttactagtcatacctcaactaatgtacataaagatcttccctgaaggaaaatatgttcttctgcaagatgttgacattggactctcctaacacttctagtactttatgtggaattactacaaatgttaatgcttaaactacctcaattctttgggggaaaagggatattgcaaataatatatttttattcacatatagaattgtcaggatttccatttaaggtatgtgatctgtgcattgatatcttaggcaaacactatttgtaactaaagtaactaagttacttatatatacatacatatgaaacatgtagttatacacacatgtatacatacatatggtgtgtttgggcacattttgacagaatattgagacatattttgttctaatattttattgtaaatataattaataatcttgttcttcacacatataattaatgggtacatattacaaaccctgaagagaacattatggaagtgtttgtagttcaacccgggtgtcagcaagtataggcaaatatgcaggagtccctgtgatggactcgaaagcaaatacctgtaagggcataagaacactttgacacactacactacaaagaaatggtgcatgtttcttggcatgtagratccaatagattaattttcaaagtcgagtaacactcagaaatgcacacagttcttataaacaccagacagtatcaaaatatataaatttggtatgtttttgtactcttttgctagagtaaatccatcaaaaacaaggcctgtgtaaacccagaaaagatacgtaagaatttcatatatctggaaattcaccaatttaactctcaagtttaaataactatttaaagtaatatcatccatcagtgaaaaytgagaaagaacctccttgaagctcataaggaaaaaacccttgagtttgtacctaattttacctcctgaaggccctgatatttaaaataatctaattctcaggtggcaattggatgatgtaagttttaggtctttatcactgactcagagctgtccaatagaacattccatgatgatagaaatgctctatatctgtgctgtcccacagtggtagccacctgtcacaccaagttattgagtctggcaatgtgtccagtatgactggtgaactaatttttaaatttcatttcattttaattaacttaaatagccatatgcggctaatggctaccatgagagacacagaaagactagaagaagatatgcaaagggctgccctaaaaataaagcaaataatgtttcagcctttgtgactctaccccagttatatggccttagttaagtcatgttttgccttaactcatttttttttcccaaaactcatgtgaccttcagttgttatgggttttctttaaattctgttttactttaactaattattttcatgttggacatttggaacccacaatccatttcatcttaaagtgtagtggcatgtggttagttaagtcatggtatagctgaaacattatatatattgtgaaaagatctttcgagctctggagttataagactgactttcaaatatgaaatattagaaaagtatgtataaacttctcattctcatgcgttcatacaagcctagtaccgaaataactgacaaagcaaaggcagacgaagtcagcgtaactgaaggaagcactaattgagtgtggtggtgatcatgtctcagcaagactgagtctccactttctgcactcatgcaatgctgaccaggaagaatgaggtctccttgagtttgtggtgcctgttctgtgggatgacccaactctccctccactcttgtcttcttcttctttttttgtttttttgagacgaagtttcsctcttgttgcccaggctggagtgcaatggtgcaatcttggctcactacaacctcggcctcccgggttcaagcgattctcctgcttcagcctcctgagtagctgggattacaggggtgtgccaccacaccaggctaattttttgtatttttaatagagatggggtttcaccatattggccaggctggtcttgaacttctgacctcaggtgatccacccccaccccacccccacccctcggcctcccaaagtgctgggattacaggcttgttttcttttttttttgagacagagtctcactctgccacccaggctggagtgcagtggcgtgaccatagctcactgcagcctcgaactcctaggctcaagtgatctctcgcctcagccacccaagtagctaggaccacaggcacaaactaccacccctggctaatattctgattttttttatttttactttttgtagagatagggtctcactgtgttgcccacctaggctggtctcaaactcctggactcaagcaatcctctggtgcctggccttcactgctctttttaagctgctaagaaaccttcatttatacactgcattgtgatggcatttggctctttcttaggttgaccrcatcgtttattccctcatttgactacgcctgtgggtcttattcagctatttgcaaatcaaagccaagcgtttttcaactgacttttgttgtttatctttcagaatcatccagaagtgctgaatattcgactacaacgggaaagcaaagaactgatcataaatctggaaagaaatgagtaagttaattcttgtttattgcatgataggagaaagttaagacaccatggacagaaaagtgctctgtgatttatgttggggtttagaaacaaagaacgaaatgcatggatttgtaatccaaatttggatttgaggtgagaattaactttaaaaaattatctaatggaaaaataaagaattttatcactctattaaggaactttataactcaacrctattttttcatagttctgatgttttattttttcagtgcctggttgttcaaagatttaatttaagcatccctgtactgttcaaataacagagtttcataattagttgacttttgacaactcctggattatattaggggaaacagcttcaaactgatagaaattatcttctccctgagaaataccaagagtttattttatctttcaaagcttatctccagtgatttggactatttctgtcatcttcttatttttaaaaattggtccttttgtggaaaaattatataaatttccagaaaatggcattatggctttttctgggccgcttggatactattatacattttgtgtgccttactagcagaaaactttgtctgcctccaaccgtaagacaaacaactcgttttcttattctttgcaccctggctatccccacagattcctcagatctaaaggactccttaatattctatttcattagtaccataaaagaagagcttattagttcttctaataagcaatctgtatgtaaagatagaactcaattttccaagtcctgcttggtcaaaatagcagtttctctcttccaaaagtactggttcctgttcctcacccatcagcaggatggtgattttttctgaaacaagagtagaggtcgcaggccctcactgggatgagttctgtcagggatgtggagtcccagmacctgactcaacatctccctgtaaacaactcagatcatttacttgtgttggtgctttgatttgagcattttaagcaagacagacgaaagacagtcaatcaacagccagcccgaaagttcggtatctaatgctgcaatatataaaaatgtatacaaaaatcacactacctgctccctgggatctgcaacctgcctcttttgtgttttttttcttacattcttactgctcaccattaaatagatcagaagctttggaaacaagaaatgaggtgtttttagcttttcttgtgacttgctcttaaaatagagattcagacacatgtattatataatcaggaatctgaagagaaaactgtatattgcttttgatccgtctcccttagcaaagtacatattttcatactctatttctttacataagaatatcgaggggcacacatttttgtacatttttaggtatggttttgaaaatatctcaatggaagaagctaggcattccctgaaagatcaaaagcatctaaggctgctggtggtgatgcattttctcgatggggttgttgtggtgggcagctggatttaggagtgtyctttattgcacctgctcccattgttaggctgttggaagaaacgtggtgcacagcatgaggggaggctaatcctgaatgttttatggagcattacgactgcaggtagagaagcaaaaatcgacctcataaaaaccttaagttgtttttactatgaaaacaatatacatacccagtgaagaaaactgaacattataggggggaagggaacaaataaccctaacattttttaaaaagtacttttaccaccaaacacaatcctgtttaagattctggtgaattatatagatggattttttttcttataaataagcctttgtttcttttgtcttcttagttgatatcacagtctgtatgcaattttataccctgctacttcatttagcttcataatggacacacatttccatagataaataatttcttagagcccgtctggttgtctgagtttgtaatgtgacttaatagccttgtccatggttccccctgaaaatgatgtaccttccattactgcagatactataatacacgttgactgctagagagtagctaatttgtataaatatcgttttaaaaggtgacttaatttgttccctttcaattctgagtctttcatgagataatctcaaaattataaaagttgaaaacaaaactatctttttaatttatttctctctttgcaacctcactgtcagactgcattttcaaaaatacatagaaaatgtttcatatgttcctatgatatgctataattttaattgtattacttgtaccaattttagaaattccattatatgaaaagtaacattttcataataagaggatgccaatattactattttaatgatgcattaccaaaaatacttcagtataacaatttttttgcaaaaggttacatacctattccaaattaactatacctttgacgcaatgaatactaaaaacaaaaaaaatcaagtagagtgaaatgcttgtgcactactagcatgtratgctgttagacaccaaaggcaatcaatcatttagtatataatagaattttaaatttgcatagccattggcccaatagagtcaagtccgagagtttttacaagtgaaactataagaacccagagataaaaatataagcagagaccatttacatgtttaacaatgagtacaataaagggcctgatcaatcaggatgaacagctgaccaatcagaaggcaagctggttagtataccgctccaacaccttcagccccagagtcagccctgtgcttaaagatgttttacctaaaagtacatcaataggagactgattcaataatcagctatgaaacaggatacsatacaacaatttaaaatgatgagacttttattataaaaaattcatggtataatcaatgtaactagcatgttagaaaatagttgtttcctgctagtgtttgttttctaaaaaatgaaaatagtttacatagtattcaatttttattttaaaattatacacatgacatgtatctctgagtaggaagattatagaggatatttactttctttattgtattaatgtttcgcaaaaataaaatattacttttaaaattaggaaaaaacattttcttttgaaggaaaaaaactattgtaaaaacttgataatggttgaaaagaagattgctaacgtatttattattcctaaaaagaaaatgataaaagttattttgagaggcctctggaaggcctctggtgacttttaaagagcaaaaaatatctactcattgaatattgggtctttaaatatccagaagtttactgtaattgaaaaacctgcttagaaaccacaacctaaattaaagcrgtcccagtctcttaagtctatagctaatgctgagagtcatctaattaatcctactcaaaatgcttctgtggtgaaccgattcttcatggcacagggctgaatttttattaaatagtttttcagggaatctcttttatttaccttctaacatccctaatttatgaaaagattggatgctgttcacttaaaatctgtatttgtatagcccctgagaagcattttgcrcaatattgctgtctgcctatggacctgtagaaaccaggttgataactttcatacttctactagatccctgtggactctcaggccatcccttacataggtattctgtgaaattgtatctttgatcaaaatgttttattggacaggctggccagctttggcatcagcttttccagtttaggataatgaagagtgatggcagtagatcacgttccttacatctctcaatcccagcatgccttcaagttctgttcccatcactgattgaaggcacttgccatgggaagtccatagcccattgaatttatgtttggggtatctctgggatagaataacttcagcactgacttattttgcctagaacgattccagacatctcttacagggcaactttaattagtattcactctagaacaataacagaaagggcattttaaaatggctaaacatgggtataaatatttggaaaggcatttatcttagatcatctctcagaatatcatggtacagaatggagaaatgtaaccagtgtggagatggcattagatggtttagttggctgaatcaccatccagaggatatcaagccattgttccccttgacccaacccatgttgaagagggcgactgaggttgctgccggtggccttagggctgtgtgcatggccttgtcctggcccacagtttcatggaccatctcgatgaagatataaaaagtgctctcatcacatttcctggcaatgcagagctagggggaataactgtgcttggcacggcaaaatctggattatgaagatttcagcagttcggatcaatgggccaaaactaacaaggtgagatttaatggggataaatgtaaaatcctgtgcttgggttaacaaaaaaataaatgttgcaagttcagaaggaaatttgttagtagttcttgtgaatgagacctgcatactcaagcccctgaggcaatgtggctgctaaaaaggtgactgccacctgagcgtgtgggggtatatgtggtgggtcctaggcagsggaggtcattcttctgctacacagggtggggcacagccaaaaccctgcatccttcgccgttgcaagcctgacatcagagagccacctgccacttcattctcatttccaccattggatgcttctttcctttcctcttccgccaaccatgacatccttacggtcaggggtaggacagcgtggctcatcataggcatcgatragcactcctcaaatgagtggatgatggagtctggacaacctggaccaagccagaagtgagttcccaggaggtcgaaggtcacttgggtggggtgagaaacaattcaaggagaaaaccttccagaaaggaacacaggatttggagttaggagcccaggctttgaaagcagcattgctcccaacagcaagttactgatattctctccacttccttcatggcctccagcgatctgcccaccttggcctccttgtctgcaaaatggaataagcatctgtgtccagtcaatgcaggaagattatagctcatgttaattttgatgatcaggtttgaatgactcaataacatttctctgtggatccagcaatcttaattattttaccgaattatattatgttctgtttcagcgtttctaaattaatggaaatcaggttatgcctactctttacctctaattcttggtgatggccaaacatctcaatgctcacaagacctggaacagacacgccaggctggtccttcgggatccagctgctgtagggttcttacctttacaatcttgacatgcccagggattggacttttaaaatctttgagtgtagagtgctattcccttttacttcttctcttgcagaagaagcctagactgtttacyccctccccacccaccatcttttttttttaagaagttaaacttttattttcactgcccaaccatcagtcaatatactgggcaaaccagcagaagcccttgccatagccctgttgttgtacacactgaacgtgaacgattccttggaaaaggcatttggctccttcagggtcacaagttccctttcctgtggtctgtccataaagaccaaatggcagacagagtttttcttcactgattgtgcctgttctgtccaatgtttgctaatcaagataaggactggcacatgggatattctttcatcagtcattaaagcattgagctcctctttggattccaggatctgaggacaatctgcacagtaacccagaaaggcaatcccatttgttgctgggagatcactgttccaaawccaacgtgtttgcttatgccccagaagatcaaaagtygtaaaagccaggctagcagttgtcagctctgctgatggcagaggtcgtgttggagcctgttggcccaatccaccatctttgagcatatgaggaagaatggtttcatccacattgtcccaacccaagagaacaagttttctagatttcttgtagagtcctagaaactggagcacactgtagaagccattgtagatccactcacagatgaaagacattattaatgctgaccatagcctgaggggctcccctggaggcagcacatggcctggaccctccctcagagcacacagaccagcagcacccggaccaacagtgactcaccaggtggacatcacaccccctccctgaagcctgcccttaggaatggggagttctaaactggctggtgattctaattagtgactaaacaaatgtcgatggaaccatatctcagaaattatagtctcatgtttccagctctcagcttcccttctactattaactgatctttatcagaatctttattaatatcttattaataattatctttactaaacattaataattaataaagctaattaagacaaygtgcttgctcatgcctcccaagatcaaaagttataaaagtcatgtcaacaattgtcagctcttctgatgtcagaggtcatgttggaaaacattggcctaatctgccatctttaatgattatcatctgtcatattaattatctttattaattaatctttattgatgtgttaaatcacttgctcattcacttcttcacctggttatttattcacaaatatgtgtttaataccagrcagtataattgaccctggagggagagtagtgaataagataaagttcctgtcctcttagaatttagtcaaggagcccaacactaagcagatcattacaaaaacagtaactggatgactgcattgctcagtgctcaggaggggaaggtatggggccaatgcctggtctggggagggaaaatgtagaatgaagcagctcttaagctgtgcacacagagggaagagcccagtcaaggagggcaggaggtagagagagaaagaagagcagaagtaaatgtccagcttctcagattctagaaggtctttgtactgatgaccaagaaggagagagacagaggaagccaggccatacaggggttgtgtgtcctgataaggatcttgactttattcctaaatacagtggcatgccatagaagaaaaggcctgtaggcagaacaatgacatgataagattctgcttttcatttgtttgagacagggtctcactctgttgcctaggctggagtgcatttgtggaatcacagctcactgcagccttgactgctctgggctcaggtgatcctcccacctcagcctccctagtagctgggactacaggcatgcgctgcaatatccagctagtttttctattttttgtagagaccgggtttcaccatgttgcccagaccagtcttgagctcctggcctcaagcaatttgcctacctcggcctcccaaaggcatgagctactgctctccaccaaaattcagtcttttaaagtccatctggctgcctgtgaagactagctgggagggtagagcgggtgtggtcaagggactgcatattgctgctgtccagggagagctgatgatggcttgagccaagagagtattggtgggaaggagtaagtagttaagaaatgttaagtaggcagaatggacagaacatgatgaatgatggaatgtgtgggatcatggaaaggaaggcatacaattcttacctgagatgccaggagaacagtgatgccttcgatgagaatagagaaccctggaaaaggaccaagaacttgtcctttgagcagtggccagagacacaaagatgtgggtcatggtaggcatggtcctgagagtctgggaggggctgaatattgggtttcacagaattcactctggaggtgacctgtggagggcccttgtagaactgggcatggcatttttgaagggggtgttcatggatgtttgccgctgaccagtggctggcagctatgagctggagatcaggagccggcagtgggcagaacatggagaggcatcagctgtggccctgacggtatctaaatagctgtcacaacccaaggcaatgtcagtgctccactgaattctaagctggagcctagtgggtgagcctctggcctctaggatcgctcccaggccctattccatatccttcctatagtctgtctccatgcagtgggtgttccccactaccaggagctcacacatggactcctgccctccttgaagtctagagcattgcttcaagaccaccagcatcaggaccacctggagcgcttgttaaaaggggcaatgcctggcgccaccgctatttaaccagaatccccagccatagggcctgagggtctatatttttaacacattctgctasgagttatattcacactttacttagagagccactagccacatgtggctatttaaattaagtttaatttaaataaaattgaaattttagttccttgctcaaactagccacagttcaagtattcaatagccacgtgtggctagacggacatttccatcatcatagaaatttctgttggacagcactggggctagcagggaaattccagcccattggatccttctgtgagaatttgggatatctgtcttagstgatgcatcgcccacrggaatgttctttcctacagggagtgaccacacctcttcagcttgcctaatgcctgcagtgtaaaaagccccatcccctgccttggagaatccggtgctaccagaggggtcatctctgcccactttgatgaaagggtgatggtgcagtcaaaaattctctaagcatgactatagactcagggaattaactcaagctacatgcacttcggcaatctaactagaccaaactccttcagatttaagttaaaatctctcaaccttaacatttaagatctttttaattgagctaaattttgtttcctgagtaagagctaaattcccttgagcttctcccctcatttcattctttgaagttgtatagacgttgaaraaggtcagaacaccatttttagagctttttgttcctcaacccgagttaacttgaaagtgcctaaactggttaagatcaacctttttaaaacaggcccctctgggttgtgatttgagagtgtggcgtccttgagtgaactctttgaagctggaagaatgagagagggcatttgagatggagatggagttccacatttcattacatcccttgcactccttcccttctgacactgcagactcagggttttctgacgaaaatcctcctgcagccttaagctcctttccccaactctgtatcccaagaggacagtaatggctgtcctggctcttcccaggaggtctctagcagtggagaggctgatgccatcttagtggctgtcattgcaccttccctctcctggtgcgaccgggatggttacgtgcagatactgtgcaggctggggtcgttatggcctgtctcttctggattttttctagttgttgtgtcctcaaaagaaagaccatgatgctttcattgattgcttatgacaataaaactaactctctggaaagcttgaaagttttgttagaggcgtttgaaccagagcaactccatcttgaataggagcygggtaaaatgaggctgaaacctactgggctgccttcctagacagttaaggcattctaagtcacaggatgagaaggatgttggcacaaaatacaggtcataaagaccttgctggtaaaacagcttgcagtaaagaagctggctaaaacccaccaaaactaaaatggtcacgagagtgacccctagtcatcctcactgctaccctcccaccagcaccatgacagtttacaaatgccgtggcaacgtcaggaagttaccctatatggtctaaaaaggggaggcatgaataatccaccccttgtttagcatatcatcaagaaataaccataaaaatggataaccagcggttctcggggctgctgtgtctatggagtagccattcttattcctttactttcttaataaacttgcttttgccttgaactgtggacttaccctgaattctttcttgtgtaagatccaagaaccctcttttggggtctggatcgggaacctttcctgtaactctttgacataattttgctgagttcataaacacagattctgctacattcttacagtatcatgccccaggaggccaaaatcctagattactgttttcagaagtgtttacttcaaactcgttatcttgagtggagttgagccctgtctgtgattggccatgtttcataacatgcatgggaaaactgcaactgatagtcacagctctgttttcttgaggccttcttactggtttcttacttctattgttttcacagttcattagtgatgacaaagagctgcaacgtaactgtatttaccattagctcatttgttgcatgctgacagtatgtggcatatctttattcctcatcataggtagcatcatcattamaaagctgggcttcatcagggacttacagagagatttgtacacccacattcgtrgcagcggcattcacaatggccaaaaggtgggaacaacccaagtgttcatcgacagatgaatcagtmcacaaaatgtggcatacatgaaatgaaattttattcagycttcaaaaggaatgacattctgacacatgccatcacatgaactttgaagacattatgctaagtgaaatgactcagacactaaaggacaaatattatgcgattctatttacatgaggtgtactttgaayaggcaaaattcgaataggcaaaatcatagaaacagaaagtagaatggtggttaccggggsctggagggttagggagtgaggcgtttggtgggcaaagtttctgtttgggatgatgaaagacttatggagatggatgtcagtgatggttgyacaaaattgtgaatgtgcttaacgccactgaattatrcaattgcaaatggttaaaattataaattttatrttatgtgtattttgccccagttaaaaaacaaagctgggctcctggtttgtttttattatctaacaaaaggtctccctccctgtcctcctccatgaaggtacatagtgtagaggaagacggtgatagtttcttctaaatccacccccmccgccccccacctctcttttttgtaactctaagaaaatcacaatcctccagctccatttaggctaggggtccccaataccctctctgaygtgctctccccaacccttaggaactgggccacacagcaggggatgagtatctgatgagtgagtgaagcttcatgtgtatttacggctgctccccatcactcagattactgcctgagctccgccccctgtcagatcagtggcggcattagattctcataggagaatgaaccctcttgtgaactgcgcatgggagggatctaggctgcctgctccttatgagaatctaatgcctgatgatctgtcgctgtctcccatcacccccagatgggatcgtctagttgcagaaaaagcagctcagggttcccactgattctacrtgatggtgagttgtataattatttcattatatattacaatgtaataatagaaataaagtgcacaataaatgcaatgtgctggaatcatcctgaaagcatcccctgcccccacccctggtccatggaaaaattgtcttccatgaaaccggtctcaggtgccaaaaagtttggggaccactgattgaggtgactcttckgagctaatgaataagggtgtaactgtgattcaacagcaaaacccaatctgacttccctggactctttctagagctgcttccgtatccctatcagaggagatgattgacagtgttaggatttggatttggatttgggtatcaggctgcttggagacaagccacstcagctcctccattctaaaatggagagtaagaccttcctcccaggttgttaggacaacacagtgatatggtttggatctgtgtcccatcaaatctcctgttyggttgtaatccccagtgttggaggtggagcctggtgggaggtgattggatcatggaagaggtttcttctgcgtggtttagcggcatccccctagtgctgttctcgtggtggacttctcgtgaaatcgggttgtttagaagtgtgtggaacctcccacctttctctcttcctcctgctctgaccatgtgagatgattgctcccactctgccatccaccatgattgaaagctccctgaggcctcctcagaagccgagcagaagctgtcatgcttcttgtacagcttgcagaaccatgagccaattaaacctcttttcttcttaaattacccagactcaggcatttctttgtaacagtgcgagaacggactaatacataagggatatggtattcagtgtgcttgacactgcactgccattcacagcatgagtgctgttctgctgccattgctcttgcattatctccctcctcaccctggccgcttctgtctgcaggaaaaggaatcacatgctcaggtctcatcatcttccttcctgcaagcagcttcctgtgactgcccctattcctgctttcctcacccatctttctcttcctccttcattttgatggtyagaccaggtcaatcccagtaccctgcctcgtcccaccctgcacctgctgctcttgtcacctgaaggtttagatacccccatttccattctccccagcatcagcartgggagggcccccaagtcacctgtgtgctgtgggtggaggtgggccaggaggtgcagtgcaattctgtaggcctgtggagcccagggaccacctgtttggctggcctggctacagattaggtgaggtgcatgcaacagttaattgctatgtacccatcgcctgtgtgcaacaattaccatgcaattatcagactcccccacccccagacatcacgtcatttcacctgcaaattctgacatatgtattgctaaaaaaagaattatttttatcacacctaaaagataaaaattttatagtactatcaaatgtccagccagtattcatgtttcccagattttatatctctccatttttttcttggcagttggattgcttgaacttggttataaacacagtccccacgttgtatgtgtctgctacatttttaatgtgtcttttaatatataggttccctatccttccttttaattcttgcaattaaaatcttgcagtccttacaaatgaaaccagatttttatactcagtagaattttccacactctcaatttgctgatttcatcctcttggtgctgtctagcctgttcctctgkgccctgtgttttctgtttactggtaggtaattcagtgtacaggcttgtgcagattgaggtactggttttaggcaggatgacattgcaggtggtcctcgttcttctcttgtgccatgtcaatagttctgtgacctctgattgtcttgttttgtgatgacaggttgaccactgagtttggggtcactctgatgcttccattagaaaagtctgcctgagacttcacccaccaggttcagtggccattaacaatcagtgcctagatctgttctttccttgggtcctgcaaaatggcagtgttctatcattctttcttcttttattagctgaaatgctcctatagagaagaactttccctcatcaattattggtttccctgagatatgagataaaaagcaagataaatttttcttagagaccacctctacttatcactctgcctttgccagtgggtagccactgtattccccaaatttagcatctcacatttggtgatatgctgcacagccccctgctgagggtccacatttgtaaaaggttctgtggggataacgaggtgcaccacagcctgtcctggagtagcttcttatactctgtaaacacttcttgatccaaaagccttgtattttcacattgaaccataaattacccatatagatattacacaaatctttttatttagagtgctggataaaaggctgactttgaaactgctctacagagacctaattttcttgctgtttttaaagacaaaggcatcctcacatctggcacggaggtagatgctggggtgagaacagggaagcaggaactggttccagtgttgctagtaggaaaagcaggggtctggattgcgtctagacatagcctgtcccttggaggactgtttccattccaatggcaatggcaagttaaaaaaaacaaaaaacaaaaaaacaacgtttcattcacaagcaggcttagtcccactgaaggaaaatcgccgtaattggcaaagaccaaagccagagaagacacagaggctaaccctacttcttcagggacccgcgagaaaaacaaaacgagggcgtttgtctaaaaatgttatgaaatactcacttctttcttctcagtatgctggtggatttcactgtgggatgaggtagattcaacataagtggagaacaaggctttctttattttcttctatgattttcttccttatgaaaaacatgtggtcagatagaagatgatacaaaaccaagcccccacaggagggttatctggggagacgatttatttagaaagagttattttcacagcccttctaaggccacttcttcagyttcaactggcctagaggattttgttggtcagtttcatggttttctttgaaaatctgacaggctccagtggagaagcctctcgtgctgtgtccacagccggccagcacccattaagcaaatatcagcatcacagaagttccttgggagttgtgggaaatggtttttacatgtggttttcgtaaaatgaaaacaattattcattaatattttcactaaagttttgatggtattgtacattcatatcaacaaaatatatagaatgttaggttggttaaatgaaaaaatatgaagtgacattaaaaacttactaaaaatactagccctacaattcaataaatatgtttaaaattcatttatattttggagcaaattcattatcttaccaaatagggtaatgattatgactggataacatcacttcttatattctgtaagtacttcctgatccaaaagccttgtatttttatattggaccataaattacctgtatagatattacataaatctctttttatctagaaaattatttaagacagctgctttttccaaagtaattttacatgtaggaactgaaatcactgatgtagatggaaatatgttattcaatcagttaattggtttttaccctatcatattatagaaaagattcaaggttactgaaggacacataaattaattagtaaactttttccagatgtgtaaaatacgcccccctccccgcccaccaacaaactaacatgtctgcattttactgttttcagagcagcagttctagttcatattgaataraaatgatgaagaccatttgaggaagtatgatgcatgcctgttactgctttacttaaacaaacaaaaaaacagcaaagaggatctagtgtgatataggggagaagcactgagccaagggaaaggaaacatgaaatctctggtatttgtaagctctgtgactttaggcaaattaagtaacctctctggtcctgagttctctcatctataatctgaagttaagcctcctcagcttggagactggatcagatgrttttctggggctccatttccactctaagatgttcrgcctcagtaattttctgcattcaagtatgttctcactttaaccagaggaatgcttaaactgatcctactggcagaaatcatgcttacaacactagatgaggaatcatgcagggcaygtggcattcaagcatcaaaacaaattaaacaattcctacgagagccaaggtttcttatctcattgtatttcagtgaaccaggaaaccctgagcgagtggctccttccacatggtgctgagtgctgttccttggaaacctgagaatcccaggatgcatctcagtgcccagagcagtccattttgttgggagatttaaatgtctgagattcctcatctgggggaagtgtgtgctctagggacatccctcgccaacatgatgaagccagcatggagtaccccacctgtgggwtggaggcagggtgggaagtgcccttggcctgaggagtgggtggcatttgataaaagctagatgccttcatgatactcttatatataatggcaaccttgacttccttaaaggcttttaaaacaatttttaaagcagttatgatagaagaaaggcactgggaagcctctgggactctagttatgtcctattttttaagccaagtgatgaggacatgggtgtttattttagtgttcatttttccacattcttttatgtgttcactgtaggtcacaaaaataaaacattattttttggtagcaaaacctggcaaatatttttgtccaaaaaggggtaatcatactgctctttttgaacacatttgttttcttcttcccctctgacctgcttggctaggaatcctgactgatttgcagatttgcagaggacattgtcattggaatgagtttaaggaaagtggccactctttgttgccaaagacaaaacttggctaaatattttgatgaatcggcatctttttttcctatgatcattggcatggaattcctataagtggaaatagtgaaaaccaacacaaatactatataaaaagtaggatttctcagaatgtatttgtaattaaatttcagtactgatatgaagatacataaatatatgtacatactctacatatactatatattatatgatattacaaaatacaggtcattatgcttagaatgcaatgactcattttattaggttgagccaataacaaatatattatgtttagaaaaatatgttagttcaacctatactattgatgacttttcaaarattctactgcagtacaaacatggcttatgccctaaaaataatctataggttttgatttagaagtagaattccttccaacatttaaatgttgggtattaaaaatactatcctgggaggctgaggcaggagaatgacatgaacccgggaggcagagcttgcagtgagcggagatcgcgccrctgcactccagcctgggtgacacagcgagactccatctcaaaaaaaaaaaaaaaatactatccatccatccttattaagagagaaaaggccttttaatctgtggggtgtttttgccgttttcrttttttacatttggacattgaagtgcttgatgccatactgcatattctgttcatctattcatgtttgttcatttgcttattcatttaacaaactgtgttccagatagtgtattggggtttgagacacagagatgaataacacacggttcctgcccttcacaaggcctaaatccaccaccgttttacacagtcgcaaaggataggcttgtctgaattgatttatarcaaatactcactatagggtatcactgaactagattgccaattaataggaaaattagataatatactgctcttcctatcccaatctttgccatgtctttactcccaaaaaattcagtaatttttgcttttttctaagtatagtcttaattgctaagtgttttctcaatttttcaaaatgagaaccagatgaaatgcagcccgttcgttgtttcaatctcctgtcctcagatgaagcattcttggttcccatatagaatttttaaacataccagtgtgtgtgtgtgtgcacagtcgtgccttggtatctgaaggagattagctccagaacccctcatgggtaccaaaattcaaatatgctcatgtccctaatataaaatggcatagtatttgcatataacctactgtatactttaaatcctcctgtatactttaaatcatctctagattgcttataatacctaatacaatgtaaatgctatgtaaatagttgttatcctgtatatttttaaatttgtatcatttttattgctgcattattattttttgttttctcccccaattattttcaatctgcaattggttgaaactgagagtagggaaccccaggatgcggagggccaattgtatggacataaatataaagctcaatatatatgtcacatcatacaagtatattttttggtgtaatctatgggtggtctgtttctgtcacagtgctttggggtggacatgatagacacacatgtcattacggtggcactgccacggcacaccccttctgtcttaagattgatggtctctggttttcagtggcaatgtttctcttaagtgccgtggctgtcatcactcaccctctgtccacttttcacattaccttcttcacagcctgacaagttatctgaacaattaactggccttaaggaaagtttcaacctctgtatgttcagaatgagggacctgcttgcctgtaaacatttattttgcttcctatttttgtttttrctcttwtccccagtagtccaatttttctaaataagaagcagatgaagagcagcccattggttcctccaatctcttgtcctcagatgaaggtttctgggttcccatatagaaattttaagtgtttggggctggctcaacagctttccctttggaccctgttgtaaacatcgaccacttttgatttatgagaatcccagccaggaacagagggcagcttttaaattgctaatttgtatccatgtttgcctgtgagtatggatagtctagcaggcagcgtgaagcgctggctcccggtcatttgtcctgttgtcccaggacagatctgaagaaccaagtgaagactacttggcaccagccatgggtaggtaggtaatgtgtatggtaatgtgtatggtaatgtgtatggaagaaatgctggggcccttgtaggcaggtgggacccaggtgtcacttgaggtggtggctgaccttgcaggcagtactgtcacctctgggagatcatcccagctttgcacatccacaaatcattcttgacggaactcaagaggtctgactcacaatgaccaaactcccatgtgacagacacctaaaccagactcatcactgtcatatatgcatcatttccctatcaccatccatgagctgactcgatttccctcagttttctttaaagaaagaatttcagtgttagatgtttggcccaccaaaccttactgagcgttttggaactttttttaggagtgatcatcagttgggttgattgccccggtttagttctcagagagtgactttattccctcatgtgtggagaagatgtactttctctctctaacccatgcrtggatgatgaatgatagctcaaagcgtttgtagtagagaacaaaggaaatcaggacatcaaattcccacctaagtatcaaatattagaattgcattttcccatagtaaaatattttgctgtgtcagaccagatcaggtgcctgagaccttttgagtgaacaaagaaatgagtggcctttatttttgttagtaagaaagcatgtgatcgytcttttcagtaaacaaactttgcaaaaatattgaaaagagacttttttaagccacaagggctatagctcatattgtaaacktattataactttgcagagcttgactttcctctcaaagctccttgaagcttttttaagaagggtttttcgtctgtatcacatttgcttggatatctaagaaggttatttatttcactaggtaaattgagagcactgagctgggaatctgataatcccaggtgaaagctgcactctgccgtgtgaatttaggaactgagctgtgtaagcctcagtttgacgtctgttagatacagaccaccaagatcctactgttgttttaggaattaaatacaawaatccataaaaccatttactacagagtctaaggcataggaaatatcccacaaaggttagctggtgctgctgttataaattcaaccattatttttgacctcctggtatataacaagcattgaacaacacactggggacacggtagggaacaggggggaaacagcccttgacctcaaagagcttgcaggctagtggagctgtgagatgccaaagagatgatcttacaaataatggattatgctgttacgtgcactggaagtgcttacgggcatgggcaatgagggaaagaaaggtgtcttgggtggcagccagggaaggcccacaggctagaagtactgtcacctgtgggagtcagccaggtgcagagaggaggaagagtttcaggccaagcaagcagtgcaagtaaaggcccaggtgggtgaggagcttgtggcatggaggctctggccgaatgccagggcatgggctgagagagtaataaaaaagggagaccaaggggctaccaaagaccagactagatctggccaggtttcagacgccaccctgcaccaggggaagccactgaaggttggtaagtagggcatggatggattgaaatgggtgttttaagaatggcttcctgaatgaaacaaaaagtatcaagagcagaggtcggaggccactgggagaccattacactggtggggcgtgtggggcacgggtggggcgtgtggggcacggaggcagtggggatgagtgaggtggaggaatttaagaaataattagggaaaaatcctgaatccagagacatttagatgcaggtgaaagtgatagtctagaaaactgtgagatgactcagactctaatgaggacaaagacagattgcaaataaaagtgtttttgtaagatatgagagtgcagaacgcaatctgaataaacttatgcttacattattttaaatgtgtgcctgaattggccaattaaatattgtcagtagacagtggattgttccccactgtgtccctagcatattattctatgcttgatatatagcaggaggtgaaaattgaatataaatatagggacacagatataaaatggccaaaaatccttttggtatcttctcattgtgaaaattgagaggccaattctatttgaggttgccaaatagagtaggcacctatcttactagttatttccaggcatggtgcctgtaaagacaccaccgttgtccagaaatccatgacctctggttaggaactcacctgcttctaagtgcctggagtcatttgcgctgctgagcctttcctgagcccttggcaaggctgactggttttataattctaacctctgcttttatatattcttatctttatctttgttcttacctctataaaatgaggatggttatatttccttgcccatctccacggttgatggatgcaagttatttcatgaagcgattgtagtattttatctgcratgtaaatttttatgcgattgtgtgacaggtcatatttccccattttcctttatagttgtggatagagttttatttaaagagtcaataaaatgtttttcttttaaatacagcgtagaaatgcatgaccactttcgtgcacctgagaaagttggtgaaaagaatagattatcacatgcttgagaagttcctctttgttctaagttgtattgagtcagatcgagttcctttgctaaactcagtgcaaytcctgcattctctcagcagcgaagaggccatctcaatacaaatggaacattttgatcgcagaacagaagaccatgtgcacgttccagggctacttaggtgttttggtgaggattgggcatacctggtgtctgggctttaggacatcactgcctgacatcattccttcccggtactgtctttggagggtaactgtgtgtgtcattgtgttttgcagagcacatgtagggttaggtggttgctgtcaagtgaaagggaatccaggctggcagtacacatacaggtggtgtcagtgttcagggaggaaggggctgagagtgggcactgcaggccttatgcaggatgcagaagtggactggggagcccccaggtggccagtgggtgggctactgctaagagtggatggtcaaatgctctgcaaaatatgaaaagctgcaaaaccacagaagtccctccatcatcatcatcatcatcatcatyattattattattcccatccaaaggtgcaggaacagtatttcttaggaatatatatgcaatatagtacttaaagaaccagcctttgcaatgttggtgttaatataaaagagatttctggataaacctactatctccccatcctctagggctcctatctcatctgtctccattcttttgaagccctccagagtgattcagggaaaattttctccagttcctctgcttttgagttggtatagtctctgcttctctgcactgggctattgtccagataaatgaagtagactcctggatttgtagactttctaagtggaagtagatggaagtgaggatgtctgctggaaggtaagctcctgaaggccccagggctgaatccccacctcccagaccagagtctgacacacagcgacggctcaaggtagtagaacctctatcaatgcagagggaatgaagggacctcagagatcactgtggccacgtcacccattttacagatggagactggaagagcagggaggtttagacacttgcccaagatcccgtagttgttggtagagttagaaactaaaacaaagggtccaggtcataaacccagagttgtttcctaatacattggccttctactgttacagagccataggactctgcattcatgtttacccattcattcacaaactaagcgttcattcatacaatgtgattggtagatcttagaccaatggctttcgttctgcttggacattagaatcacctggagcaaaaaccaaagttgccaggtaggggggtgatttgatttacttttacctggacataagtatttttcttaagtgtcccaggtgatctgcagaagcaacagggttgagcaccaccgtggcagacttggctggtcctaactaccagccgtggtgggcgagtgaagatattcctttggctgggtggtaagtgccctgacgagatgcccatgggcacccacctccttccctgcaccgttcctgatgccgaaggcccttggacagcctgcactagctggatctggctccggtagaggcgagggaaggataacaccataatgaccaggcgtgtgcctcggctgtctgctgcctctgtgcagacatctctgagactagctgcaatggggccagttagctttgccatccccccttcagagtatcattcagttgtcctggagacaaccctcatggagccaggtgctttgttggggattcaaagaaaggtaagacgaagtccccatcaggagggaccctccgtgggcaggaggaagtgtgttttgatattagtataaagcgaggttgtactattttgtttaatgctaggatttaaaaatcagttttcctggaaacctttgctgtttgctttttacaaaatttaatagtatggccatgatgacatcatcaatgtttaaactgccttattggaccctcctagtcctcctgccatgaaggggctgcgttctaagggtgagtgtgtgaggtggagccgtggggaggaagctgggactgaatgcgaacgagagctggactcgggacaccatctgagattgccacacacctgaggcttctttttgaggtacaaaaggagcagtttcttacttcccaaagtaagtcaaaacctgagtctgttcagttctcaggcctcacaaactttcattgagtgtagcaaaaggaagacaggaagaaacctgtacttatcaccacctgacatcagcctgagtgccagctggccggcgacaccactgggagctgggactgctagtgtggaacccacagagggtggcattgcaggacaagtcagcagatgggctcacgacaggaatgccccaaagctgtccaagctgaccccacttcgggtgcaggaaagccgtgctccgagggtggcccctgtccaaatgccaccgggggctggtgaccggggcgaactatggccagaacatgagacttctgtggtttgtaaagggggactgatgtcagggaagagagatggtgccctaattgtcttaattatggtttatgtcaagagagatgacgttttaatggttctaatgacagttccaggctgtcagtacactcttaagtcctattgtcttgaagcaatttctgaacaggtgaagaaacccctgcaaaacagaggggcctccccagcgatggcgactgttgcacagttcagaggaggcctgggagcatgtgagcagagyggtcagtggcctttgtcctcactacggtggtggctccatggatgctctggatcctagggaaggaaggaaggaagaacagcagttcaggagggccaaggaaagggcctcccgcctggaccgggtgtggaattgacgctgagtaacacacctgtgcaggtggactctgtgagcaaggcaagaggagatgaggagagcatccgcaggggaagaggccaagactgcatcctgagaaggaagttttgtcagttgctcttgctggggtgaagctgaccagaccgcaggttcttcctggagccagtgacaatgccgacagctgacacagagggagcacatgacttgcgcttggcattttcacctgcattatcttgtttattcctcacatcaaccctataaggtatgtgccattactgtccttgtcttccagccaaggaaactgaggcacagccctatcaaatgactcccaccaggtcacgcagctgataggtgccagagctggctgcagacccagggaggctgcctgcagaccccaagctacaaacctgttctaatggctgagagctgaacacacctccggagcctcccaagggaaaggaagggatgagctgggaagatggacagtgctgcccaggaggggactggggaagggtagcagaggggccataggaccttggaggatggccactgaatggctctgactgaagatagcactgggctgggtgagccggcagagacatagcgccctggaagtctggccttcagcatcctgtgctgtaattgctcaactccaggtacaggatggggcatggcaggcctgccagtgaagagaaacggggagggcttagggctcacctcactcatccttgaggcttctctcatggagcctgtgccagctcaggccaggcaagaaccgcatctcattccctgcttatcccaggctctgccctggtycctacaagccctctgggaggaagagtgggacagtatgaggaggagagcagaagccctcccccsacccaacccacaaagatctgctcaagcaaagtgagtccaggagctgtcagaggagcagggttttctctggggggtgggtgttccccctcttagcccaagctctgccayacgagaagcagatgtcttgttctaatcttcaagtgggatgattcgtggacactgccattagctagttttcttaacatgaagagacagctgcttagtggctatttctatgtgggctgagctcattcagtagagcagctttcccctctggagaasaagagaatgataagcgagcataaatcatgctaaaaggaacgactcctcatcatgagtcattaggacacatgccacattggcgagcagatgaaaaacctttgatgaagaccagttgtaaaagcacaagctaatgctggagaaatgcatcatggtgacttgaaagtgtaatatatgcatgctcacgctttcggtcttaaaaaaaaaaattgcagtaaatgtcaagagtggtcagaaaccatttcctgtgctggaccctgcagggagaggttcagggaagggtgggtttggaagaatacttcaaatcagtgagtgctaagcatattttggcacagtccttctggaatggcatcaggaatgtgaaccacagtcctaaacaggtatgtcctgttatgtgacagtagctataatagaacgtcacttcagggtttcgagagcacatatcagagcatggttgaaaaatcatccagagaaattccaaagaagaccatgaagttgcaagtgccacctttgtccctttctacaaggagcaggaggcagtatgccagggctaaggcatcagctctgcacccaggcaacctgctcagtgtccctgttctaccacttcatagctgtgtgactgtggtggttaatttaggtgtcaacttgactgggttaacagacaccgagaaagcgggtaaagcattatgtatggatgtatccatgaggagggtgtttctggaagagatcagcatttgaattggtgaactgagtaagaaagatcccccgtaacccaatgtgggtgggcaccatccagtcagttgagggcctggatagaacaaaaatagaggaaaagtgaatttgcccactttctcttctggagctgggacactcatcttctcctgcccttggttgaacatcagaactccaggtctccagcctttagactctggcctcccaggtcctcagacctttggccttagacagagttacatcatcagctcccttnnnnnnnnnnnnnnnnnnnnccatcccatccatcccacccatctatcctatccatccatctatccatcctgtccatcccatccattcatcccatccatcgcatcgattccatctgtccatcccatccatcccatccatccatccatctatcctattggttctgtttctctggagaattttgaccaagacagtgaccttgggcaagttctttaacttctttaagcctgcttcctcatctaaataaagaataataacatgctacccactctctggacaggtttctttgattgcaggcaagacaaatgcacactgctgacttaagcagagaggaaatgtttaggaaggaactggaggaaagcacaacgaaccaggtctcagaaaggtcgaggaccagrccacttggggatcttggaaaaagaaccgatggacacgctcagcagggtctgccaaggactgtccttgtgtcatctggtcatgttcctaccccttggccagaggagaacaagccactttgatgtgagccagtgagagaggcagagtttctattcccagaagaaagaagcaagaatcttatggggattgattaacatcatgtgtgtcaagttcttagcaccatgcctagtacatcataagagctgaaaaatcagccgttgcatattaacaattataaattggaatggctgatagcagatcaataatgtaaactattccaaataaaaagctaatgatgcatacacataaatgagtgtaataaaaattagaaataygaataagattgttggactgtatcagtgtcaatatcctggttgtgaaattacactagaggcttgcaaaatctttccactggaggaaattgggcaaggtggacagagattttccctgtattatttcttaataaacacatgtgaatctacaatggtctcaacaaaaatttcggttaacaatgtaaagctaatgatggcttcagaatcccaagaagtgttttgtccccattgcggttccttgttttaattccccaagccacaaaacaataatcagaaaaatgttgtttacatgtaagagtcttgatggattaaaaattatttttaaaggcttgagagaaacttaagatacgataaacgagcagggccaggtcagaatattccctgcctaaaaatgttcattattaggcatatggtaaacttgactacacacacacacgctcacacactccttccctcccaataaacatgtgaacaaaatgtcagcctggtttgtccccagtggtttatcttagagagcactgtttgttctcaaatcttatctataaatgttagtttatttaagtaaaggtgggccccagtgagtgtcagctctggagggatatttgttgggtttattgagtccttgagtccctgtttatatactctgggattatgctgggggaagaaacctcatgcgaggactttgaagggccttgcggtcggtatgccctggcttgcagctttctgtggtagtcccggatgggttggagtcttgctttggtggaaggggaatctagccatgcaccagatttttgctkactccttttctttcccctttctttttcttctagccagtgtttatcagtggcctacttattgtgtatgagtccctgtgctaagtagtgaggatactaagacccagttctccctttaaggaatttgcagcttgacagaggaccatggtgtgtgctccaataatgagcagtcagggaagtgggtctgtatgtcttatgcatgtaacaaagtgctagatgaactcaagaaaagaagaaaagcaaattcagccatgaattctaaatcagaattcctgcaatttaaattacattgcaggcaagggctgcatgttggtgtcagttttctttttgtttttcttttttttgagacggagtctggcagactggagtgcagtggcgtgatctcggctcactgcaagctccgcctcccgggttgacgccattctcctgcctcagcctcccaagtagctgagactacaggcacaggcgcccgccaccacacgcggctaattttttgtatttttactagagacgggtttcacggtgttagccaggatggtcttgatctcctgacctcgtgatcctcccgcctcggcctcccgaagtgctgggattacaggcatgagccatggcgccccgcctggtgttggttttctaaggcactttggctaatttgtaaggcgtctgcttcccctcacagacataaatgcactccccatcaccaccaacccccacctagactgccctctttgtggtctagaggtagtggagagtagagtgtttgcattggattctattggccattagctgtgtggctacattttagtaggggaaattgattacagaataaaaaatatcttccagagttaattagaaagagaggatgagaacattttagcctagaggaggcaagacttaggagaaacataagctgtgtggcctcaggtagagtacttaatttctctgtgcctcagtttcctccaactgtaaagtaaggataataattttactctatagttggttctggaaatgaaataggtaaatacttgcgaaggccagacatggtggctcatgcctgtaatcccagcacttcaggaggccgaacggggcagatcacttgaggtcaggagttcgagaccagcctgaccaacatcatgaaaacccatctctactaaaaatacaaaaattagccaggtacgatggcgcctgtctgtagtcccagctactcgggaggctgaggcaggagaatcacttgaacccaggaggcggaggttacagtgagccaaggtcgcaccactgcacttcagcctgggcgacagagactctgtctcaaaataaataaataaataaataaataaataaataaataaatacatacatacatachtacatacatacatacatacatacctgtgaggctcctaaaacaatacctagctcatggtatgcattcgataattgtcaagagtactgaaatgtgtttgcttgttgatgaacctgtcacatggcagagacatctgtttggccaccaaggacgagaacagaccagtgagaagccaaagcagcacaatcagctctaaaacaaaagtcacgttgcctcgaggggtggcaaggcctgtgtttgggagggcccagccatgacttagtggcagttgtgtgtcctggttgagagtcagaagcctaaggagagacaaaaatggttgtttgttatatgccaggctctgtgctaagtgctctcatatcaggggcgggggccttgcaagttttgctcatttccgagttcatttgttcattccgagtacctagacaaattcctgacatgtgaagtcggcatcaccctggaaagaatacgtgaattatggcctttaattcttcccactacccagtgatgcatagggggtatgactgccacactcaatctgcagatgaggacactgaggcctagagaaggaagtcatgtcacccgagtaatttcagcaatgagctgtgccaccagcaggtgcagggccagagacttgaacccacatctgataccttctccagcaatcttccaacagcactactgccttcacggcccacagacaccattctgattctccagtctttggtttgaagaaattacgaaattcaaagagcatcttactccgtcattggctcgtggagccacaggatcccaggaggcaggctttgtttttatttcttggcgttttagtgagtggcttgacagaggaggaggtgaagttatggccactgtgtgctgactgtattatctgtttgttgccaccatgctgatttgagaggtatttttagagtcatacgttcattattcatggctgacatttttactattaccaaaaactagataacagcgaagaattcctggttggtgacttagtctcaagattgacgccaagccctgttttaaatgattcactcttttctttggctgtggaatgccatcgggtccttatgactcagggccagaaagcacatgagtttctcaggactgagccgggcgctgggattgcccatacgtcacagatggcaggctctctcctaaatatctaacaataattgttgagtggacaagggtttccaagttcctgctactactgtgatacatgagtgaaatttggttagtggctctgttgctgggaagtttgcctcgttgctggttttgttgacattgcacttgagtggaatcgaaactattttgtctaggaaaagggtgagaagagttaatattatacataaacattttatgcagtgatattttcagactctctctaaaggcagcaatgtttaagtaaaggacgcatttgattctccttcrattttctagcaatggccttcatgttttagcaaagttgatttgagatagatacactaaggttgacatggaaaggattttcttagaaaccactctcagatactttacaggataattggaattattttccaacaagaagtaattttatacaattttgaaaccatttgtatttaaataacaagttacatttcttcttttagagaaataaaagtttaagcaacttttgggctgaaactatggggtttgctagaaatagatatagaatcatgttgtctgctaacgggaatagtttgatttctgctcttcgtatttggatgccctttaatactttctcttgcctgattgccctgcccagaacttccaatactatgctgaataggagtggtgagagagggcatccttgtcttgtgctagttttcaaagggaatgcttccagcttttgcccattcattatgttggctgtgggtttgtcatagatggctcttattattttgaggtgtgttccttcaatacctagtttattgaaagtttttaacatgagggggtgttgaattttatcaaaagccttttctgcgtcttttgaaatgatcatgtggtttttgtcctcagttctgtttatgtgatgaatcacatctattgttttgcatatgttgaaccaactttgcatcccagggatgaagcctacttgattgtggtggataagcttttcgatgtgctgctggattctgtttgccagtattttcttgaggatttttgcattgatgttcatcaaggatattggcctgaagttttctttttttgttgtgtctctgccaggttttggtatataccttgtggatggctggatattcgcagtttaccttaggttgtctatggctattttcctgaggataaaactataaaatctggggcattttacaacaggttcaaaataaattggagagtcaagtaattactcataactttacatccacagatcaatatctcagtcttttcatccttctcccagtttctgagaaagagggttatctttttgtccccaaagccatttgttcacctgtatcttaggccctatttattcctgcctttctcctccagaatgcaagggttttgtgtccctcattattttctttgtctttaccatttttcctaggcccttccctgtgtactccttcctttccacctctcaatatgctctgatgtctccaccattttttaaaaggtcaatccaactattttctctgtctttctagctatctgttcatccatccattcccagtcaaattttctcctttatcttgcagccaaaccgtacacacctgtaggctctgctaccctctcacttcttcatccattcctctctcctgtcaccccatcctctccgtgacctttgctttcagacaacccaaagaaagggccactttcttgccaaatccaatgctttcttctcaatctacttcctccttgtcatctgacgctgccgttcatgctccccttgaggagccccctgccctgactcccatgataactttttcctggtgctcccaacctctccaatggcaaatccccttcactgcctttccttcctcctaagtgtgggtggatgccagggtgcctggtccttggccctggggtctggattctttaggcttcctctgggacctatctcccactcccattgattccaaaggcagtgcctctagccccgacctcctgcccactgcccagtccttcaggatggtccccctatcttctaaagccatcctctccaactgggagctcctggtgtcccccatgcctccatagtgggctgcagttcccaattgtgcgcattcctttctcaagctggcaggactctctcctttcaccatctaggtttagtctaagttccatgttcttcagcgtctctgggggatgtgtccttcctcttccttgcctggctgcaggttcacgtcaggtcccacctggattatttgtctcctcaatgacctttcagaaacaccctgccaccagtttgtcttacagagacaagtgccctttccaaagcacagactggagcatgccaatgtgatgctcactctcccttgagggttccccgaggctggcgaggggatgtcctggtgccttcaggtgactccaacatctctgtgtcatgccccagccttgctgtttgcatttgctcctgcttaccatcttccttctccttggtgcaagcccctcccctgatcatgtaccctactccccatcttcaaacatagctggatgttgacatctctatgtcttggcttctcctgttctcttgtctggaatgccattttctcctttgcttggtgaatgtctactcatttgctaatgtacaactccaatatcatcttctcttaaagcttttgctgttcaatttctagtcccccattcctgtccccactcaagtagcattttccttcctctttcattccatacaactttacatctctctttatcatagcatgtacactttattagatctattaataggtctgcttatactaatggtgcatgagctccctgagatatgacatttagtgtcctctctctgtctccccagcaccacacctgtgaattaatagctgtcagtatatactgattgaattagattttaagtgacactttcctgctgaaggaagaggatacgatcttgttaattggcatctctagtctaaacttcccaccatgtctaccatgatcccccaacagtcagtcagtcagtcagagttttctggaaatgcctaaaccccattctcacatttctcatcctgagccctcccttctctgctgctccagagtctgtctcccctttctcaccatctgtaycttctcctctcttccatgcaggctgtggttgccttcaaataccggcagtgcactgtgtggtcacggacccaagcatgaaccctcggctggttttccccgattgtctgatctctcagagttctgtatgagccagatgaaggcagaggctggccattcgcttcctttgaatacaactcatgttgkattcatactttgcccatagttgtacatcagaaacttgatgagttgtttagatatcttagatttcattgccaagtattcaagaccatcaaacccacagttttatggctaaatccatgtgctctaatcacagagttgccaaaacatgagtaggcagtctggaaatgactagaatttgagaaacagaaacctttctcccccagtctgatccagttggtgcaatgtcatcccccggattttgatagagatgcaaatcttttccgaactgatttattctagaattgttaaaagcgtatagaggacagtcactgaggttaagcctcacattccccgttgtcaatgtctgtgccatcccacgacaatcagaagccctcctacctctgaaaaatagccatggtctagttccattgtgaaagacatcagaagctgcttccatttggctggttctctaaaatgtctagatagttgcgtataaacacctacaaagcagggtatgctgtctcattagtattctactcagaaagcagctatctgcaagaataccacttttatccccctaaaagaagtcaataaaaatgtattcaccctgaaagtgaaaaacacatcccataagtgttttaacttgtcctgaatggcctacacacacacccataagtgttttaacttgtcctgaatgacctmcacacacacacacacacacacacacacacacatacacacacacacacagagttgctccccactggtctacacagaagataatgttagtccctgcctcctggggaactgagagaattaagtaagatgcatgagaaggcctgagaacagagtaagagatcaataaaggtttgctctggttaaaattacacactcaaaattgatatccatagttattatcaatttcactgttatgctgcctaaacacccaagagtcagacataagacatctggcaagggctggctgttggcatcagcaacttggggcaggatcctcaggctaagggtcccctgcagccagggcggcctccrtgctgcctgctcagcagctgcacgcccaggaacatggtaacactggcctgcttccagcaacacgatgcagccatcacagctgctctgcacrcgctgacagggtgaatgtgtctagagggaaaaagaaaaaggatgaagtcattgctagttccatatgggtggatgggtggccaccccttgggcttgtattcacatgtctcttgtgtcacagccttggctagatcatatccctttcaggggacagttttaatgcggagaatggaagaatctcttatacgagatcataaaagtccacagccctttgtgatgtcaaaaccagacactggaaagagccagcaagagctctgtctcaccatgtgmacccagagctgggaggcagacctgtgtccacttctttctccccagatgtggacatcttgaaatcctgaggagcctgggaccctggccatggctttgtttgttatttgtgtcagaaactcagagagagcacttccgtacctattccaactcaaataaagcacaattggtcttcattaaaagggtttgctcagcctgtgtcaggggcgttgtggaggacccactgtggacgggccaggagacgcccacgctctgtgaagtgctgccttcgcacaatctcatggaagggaagtaaccctcagacaccacctcyctactcctgtcttgggccagaattgcttacatgttcttaattttccatcattttgccttgattttgaaagtctttggggaatttcaatggaaaatgagcaagcctgtttagtgtttactgctgaaccataaatacaattctattccctgctggtagaaaagccttaggaataaacgtctgattttacaaaatagtaagttaggagttccttaaaatgtcaagggggttttaaagtatgtttttacaacttgacagagtctggggagaaaacagtcttaaaactaaagtgttaggatctgctgccaactgaaaatcaatcacaaatgaagataaatcacccctgaacatayaatatggaacaatgggaaaatattatcagaattgtaaaaatwtgatttgcatgcaatttttcagaaacatagctttgcaagcataaattgaaacaagcagagtgattcatataatggggggaaaatcagtctaagattccaaacatgtatgtcaggagatgattatttgatgtgttaaaaaaaaaaaaaaagctctgttttacaaagtgtaccccactagctctttctttgccatggagaattccaaatagcatttataaaatggaytaactacaaatgtactaatttataaaatatactgtcaagaccctgtaaagtattgatagcactrttaataacaccatttattaagcatctgctgcttatatttatcccatgcacatgtcatttctaatacttacagtgatgtccttgcaaacattcttgtccccgttttatacgtgaggacactgtgcagagcattcacacagcttgctgcaggccacaaagctattaagtggcaaatcagcgttcaggctcagtttgccctggccttaaacacacctgctttgtcatggcctcaacatgtcttataaacagaaaattgagcattggcccaatagaggcataaggcttgttggaaggcagagacctcatccagagagaaattctgccagtttgagcgcaagtcatgatttctgagactgaaggaaacaatttactgaatgacatatttttttagaagtcagttttatttttctggttacgattcttctaattgagatgtgattcacataacataaaattcaccattttaaagggtacagtttcagtgggttctgctatattcacaatgttgtacagctgtcaccactatctaattccagaacatttccatcctctccaaaaacaacccccaaacctgttaaagtcacttcctattctccgtttgcccatctctctgaagcttctggcaaatgctcacctttaggtctctatggattggcctattttagacatctggtgtcagtgcagttatatagtacatgtccycttgtgtcagctcctttcacttagcatgaggttttcaggttcatccatgtgtttgtagcatgtaccagaacttccttgctttttatggctggaacacattccattaagacattatggacatgccccattcatctgttactgaatgacatttcaatgacactctagattttatttcaaggagtttggcctatgccatagcaagctacagaaggaaggtctttcgctgcagggtagatacctgatagtgatacagcaaaaagtggagctcccggggggctctgtgttgttctcagaaggacccggcgtctcctgactgtgaccttccaggccggcgtgccctgctatcggcctgcatctctgacctcagtcagatcactctttcactgagttccagctgctgtttgttcaattctcaagcacgtggtctctttcaccgcaggatcacttgtgttctgttctctgcctggaagtctctgcctccagctccagcctgcctggtagctccttctcagccttcaggtctcagcccagatactcagagcacagctgacygcctgtgtgaaataggcctgcctaaccctcagtctttcctagcattttctttctttccctttaaactgcatctcctcatttatgattctgcacttgtcgtgtgtttactcgttttatgtaggtctcctccactatgcttaatgccattgacagggactgattcygctcctgttgctttgtctccaaggcccagctgaagcacagattagcacaggtgcaacttctgtcacgctcttaggggctgatgccccccagagcatcgcctgtgccacaatgcccagagcttaatgagtgctgtggaatgaatattttaaagggtgtgcctgtcttggttgtatagttccccttcggctggtgaagagtcctcagctatgtacacactgagtgggaggcaaggacagtgctcagccaggtctctgccctcgggctggtcatcacacaatggatacagcacttcactgctgagcactgcgtgcaccaatgggcagtgtagacgcaatgctacagcaagccagkagggagctgagtcgactccgggcagagcaggacagatgtgctgcctgagcttggcacggaaggatggaggaggagggcagggggcacggcagtggacacccagtgattgggtgtaagaccccagtttggaagccacaccaaccagagctcacctaggacctactatatggattccacctgcccatcatggggcaagatgctggccttcctttagaaaggggccaaatttcaattcccaccagaaaatcaagaatacataatcagatagttctgaatcamgtgaatggttctctttcaacctcacaagattttgagagtctaatattaggatttgtgatcaaaaagttgcaaacgtgcactatgtcataattccttagatccgacaataaaggattctgttgtaattctccatcttaagatgatttttttttctcttggaggaartaacgacctaaataaatgtcacgtgcttgaatttctgaaaggaaaatgttaccccatacccatttattttagaaaggtcggatttgttcccctgtcaacaaaagctttgagctgtacattggtctagacacccccaagtactccagaaagttgagggttaaaaatccaagacagattttataaatgtaggactgacgaaattttcaacaaaaaattcactgttatgtcatatcctataggaaaggctttatccacacatgccttcttgatattctatgctatggtttcatccagtagtacattggttcttatagatacatggaaacaatgaggttctttttcctatataatttttatttctgtaggttacatatcccacctgttatctagaaaacattgttcagttatatgtacatgtggtgttacttgaattagttcagaatcaaaagctaatctttaacactggcattattgctggaagtggttctcccttactgcmtgctaaaaaacttgttgacatcatttttacttcttaattttggtttatttcagctcccaagatgcctacttagtagtcaatgtgatcaaactcatagaacctgaggcctaactattttagtccctgaaaccttctctcttttatctctttctctatgaataattcatttgtctgcattgcctctgaagcaaatcctctttataaaaaagaaagacagggaaaaatgtagcagagcagaatgagtgcccatgaaatctcaggtttaccctcagaaacaggctaagattttgagggagtttctgtttcctgtgacttcttagctggcagagaactatggatttattttatgagctgttgcctggaagaagtaatgacatcaatatttaagcataataytgtacgtgttcttggtctgggtattacattccatgttcttgtgttaatttctagaatggtctatatgttttttgacatacaacttttaaaaataaattttattttgtatattgaaagtacgcaacatgcagttttgggatgcatatagrtagtaaaatggttacacataggtttagaacttgaactctcaggatttaattaattaattaattaaattttgtttgtttgtttgtttgagatggagttttgctcttatctcccaggctgagtacaatggcacaatctcggctcactgcaatctccgcctcctgggttcaagcgattctcctgccccagcctgtcactagctaggataacaggtgtgcatcaccacgcccggctaatttttgtatttttagtagagatggggtttscccatgttggcmaggctggtcttgaactcctcacctcaggtgatccacctgccttggcctcacaatgtggtgagattacaggcgtgagccaccctgcccggccaggatttaatttaaaatacagttgtaggaagcgttttgaaggaccttattttacgcaatgtatgtactcctaaaacagaatgaaagttgcacttttacaaataaaaccattttaatgatctttttttaaagaaatgctttggataatattttgcgtagctaacaattgtcgttgctttgttttcttccgtaccatcgcagggccaacactttcacccattcttttatcattcatccctaaattcaacaaacggtgtgtcactcctgagttcagtgcactgtgctgggcactgttgagagcacagaatgacacaccttgatctttatgtcatcctagcttgtcccaagctctttataccccatcactctagggctggagagaggatttgcattagagttctttccagtgggggcctctgaagctgtgcagtgcttaacctgggccatcatatgcaatgggctgattgtcagcgtgtgattgggaacgttttgctacaaacgtatgattttcatttaggctctacctataaccaaatattatttgaagtggcacagccaaaataataaggatcacagcccagtataaagatgaaaaccaagtagaaagaaaaagggaaggaggaggacaaaaatatatgaagatattgtagataagaaatgttttgaaagcagaacttttgctgaagtgtttccagtgaagatatctgggatttgcttcaaaataattcagtgagaggaagggggagcgggtgctgccatagatgaaatgaggtcggccccaagttaatgatagttgaattggggtgatgggtataggggagtcccctctatttttctgagaataatagaatagaatagaatagaataatagaagtcctctctatttccctattatttgaaaattttcaaattaattttaagttgccaggccaacaaacacacaaaagattcccatagagttctaacaggcaaggcaaagaataaaataaggggttacgtatctcatagtccagaaaagggaacacagcagttttaaagaaaatatctgaattagatgtgtcatgagggtatttatttgaagagtgctagaaaacatgttaattaacgtagacgcatctggggaaatggggggaggggttgtgggcgaggctggcccaggcagggaggagagcattatcactgatgttgtttagaatgggcaatgcatggtgataataaaaagcaggaggcttctggtcagctctgtattgttttacattctctgcaggcaatgtcatgctgcctgcccatgcccagggtggatggctcctgtcaccccttcctccaggaggcggccctgccccttggctttgggggtgctgtccccaggggtttctccatcctcagagatctgttggttccttcatgggctccttcctgcgggtgctccttcctgtgatgctccttcctgtaggtgctccttcctgtgagtactccttcctgcaggtgctccttcctgtgagtgctctttcctacaggtgctccttcctatgagtgctccttcctatgggtgttccttcctgtgagtgctccttcctgtgggtgctccttcctgtgagtgctccttcctgtgagtgctcattcagctccccccgcagagccgtgcttgctttcctttccacactctcccatgcagtatccacctctgtggcccaggctgtgatttatctggagttccagatgagtctgacaatttccagaaaccaggctgtccatattcagctgtcctataggcatctgagactcagcaaatcccagcctgagctcgcaggtttgctctcctgctccccacttatcccgggggcttccccatcgcaggccctggcatctccatctgaccagtggccccagccagacactcgagagttgcagggtctgccccagccttcccccagggcaccaggcctgttgatgccacctgggcatagctctggataaccttggataaccttccttttcttgtctccacggacactctctgggctgagctccagcatcccctggcttctttgctcccaagtgagggcattcccttctaactcgcaaatgtgttcttcctccttccgcgctggtggcctgtccttttcaggttggaacccaaagccctggcagagcctcagcgcctgcccaagatgccctctccagcccagctctgtctccctgtctgccaggccctgggctgccctcgcctctgctcccccagccccttggtccraccaggtcctgcgcagcccatggtacagccaccccctcctccgtgtgttccccttgacccagatccctgtgtaccccacaccctgcttcttgcttacccagccagttgccaggccctgcgatttggcccttttgttcctaacactgccactctcctcgaacacgaccattatttttcttggaaaccaatggtttgtaagcagatttgtaaacaatggagccctttcttcccttgaaatctggagcagaaagtgggaggagagcagaaagggatgaggaggctggagaaggagacacgcatcctggtggcatcttctgagtgtggctgggctggacggtgtgccgctgctgcctttccaacagccccgtgagatagctcgagcccgcctcacagatgcaggcacgctcctgcagcaagttcaagtccctcgaggaaggccagaaggccagtgagggcagagccaggactcacacccaggggcccgactkggagcccagcggtccgcactccctggttctcatctctcccagagcctcttcctgtcgtcctccagatgtgtcctctcttgctctggagtagccaggtttgtgcttttgttgtgttgctgcctggaggcaatggagcctcctccgacacacccaggcctgaggttcatccggtgactaagcccactctccctcaaggccgtggtcaccggtcagtcaggccaggtccctccctggggggtggcttcctgatgggtcacctgaggcagatgccacagagcagcaggtgcctgggcttccagggtggccccaacctgcggtggcctggcctggactcatcgacctgtgaggagtctggccttgtgtgccacgtggagacgaccctttccacccctctgccagcttccccaactcttccatctcctcccatgtccatccagtcctagtcccaggaggcctgtctcaactccccacctgcagcatcagacctgggagacctgccttggtttctgcctgcagtgtgatgccttgttcatgccaccttacgatttgtaggtctctccacgtgcccctttgaccctgagatggggaactgcttggcacctcagccatcactggtagcagttgggctttccttggttattgcctggtgtgagcgttggcctgatccatcctccctccatttggagttattcctgttttccggatcactggctcagcaccattcttgcctctccaactcctcacacagatggaagcaaatacagatctgcattttcaaggctgagcatccacataggtggacactgtcaggatgcgtgtgtgtttctgtttctcgccaggcaagttctgagtttgatactacactgcacctctctccatatcctcctccatacccaactcattactgggcagagcaggcacatgggaagtaagaaaggagtcgtcttgttgaactagaaacgttgtaactgatctgttttctaagcctgtgtttggatattagatgcagcgttaatctgcatttgtatatttgagatttggcaacaggaatctaactggctttcaaacaaacaaacagtactgaactgctttgtgtctgcttaaagaatacttatgagtttttattaacatatgcagttttaattgtaactattattgcttttcttattacaaatgcagcccatgataattacataaaaattaagcacaagtaagccaagagaaaaaaaaagaagaaatgacgcagaatctcattccattttgatagccttccttcccatcttttttctttgacatgctcgaactcctccctggtggttttctttgtataggagtggtgtgcctgtccatgagcttgggaatttctgtactccgcctgctgtgtattttcagcctcttcattactttcctcgggaggcccggctayagccagcttatgctatctttactgtaaaataggtgcctgtttattttcccatcatacacacgcaaagataacaatgatatattgccggttccttaatctcttctcttttcctttatagaaccttaggggatacaaaattatgcatacaaaggatcataaaataccaagtgcaatgtaaacacagttgccacttacttcatctgttatcataratcaaagactgcttctacagtaagagaagcgcatttccaattcaggtgggactcaccttaaaatatgcgagtggagggagtccccttattagaaacatttggttcacaagtgtccagtaattgcagagcactcccacgagtgcagaaagctcccacgagatggttgaggcttatggagagccaggctcaatcctcctatctcctgcagaacatgtctgtctccagcctctccctccttcctagctcccatgcagcccacaacatataccagccttaaaactatgcctcctttccccaaccgcccacccaaaccatgtgggccctgcggtgcctctctacttttctctctttctccactcctggtccccgctggttcttatccccatcactgctacttgcacaccctcctcccccagcaggaccttgtctgaggctgacttgatgtggactccactgtatccggcacagtccctcaggttctccttctttaacactctccttacctggttctgtgacgaggctcttctagcatcctctctgtcactcctcaggggtcctctcccacctcttccagactgctccttctccactcaggtctgaaatgctggtgccctccgggttctgcccttggctgttcttctcccgcacaccctgcatcatggggacccatccttgaactcccacctcttcactgatgaagcccaagtgtacatctcccacatacatctgtccccaaagcccagccccaggccccttgaattgactgtggtaggggatgctcttctgcctggacgtcttccacgcacaccccaaatgcaatagaaacatatcgagatgccacatctttccccaccgactctccctactgcccccgtccttccttcctctgcctccatcagtgaccccacctacctactcactcctctttgtccccatcctgtggaatttctgttctaaatatttttaatattccttatcttcctccctagtcctaccactatttgtctagttctaaccctcrtcattttcacctgggctccagtcatggctgcctaactatataatatgtcatcttcacaagtcactcgttttgctgcacatgtgccagctgagcatgtatttattggatatctaagagaaaaagactgatgaaaggttgatatctaagatgctggcctgagaagatgaggggacagtgcaggtgtcagttgagaaggaggagaacaaagagagagcagattgcttggctccatgtggggttttctggtggtgctggtgaacgtgtcattttcctattttgctgctctaaaaaaatcactacaaacttcatggcttcaaacaacatcaacttattgtcataccattctggaggtcagaagtccaaaagaatcctagtgtctcactaggatacaaccaaggtgtgggtggggctgtgttccttctggagcctctcaggaaaatcctatttctttgacttttttagcttttagaagctgcctgcataccctggttcttgacctcatcctccgttttcaaagccagcagtgtggcatcttctaatttctctctctgactctgaccctcctgcttgtctcttataaggacctttgtggttacgttgggcccacccagatcatccccttcatctccagctccttcaygtaatcacatcagcaaagtccttttggtaaatgaagtaacagattcacaggttccaggaattagaatgtgtacatctttggggaggccagtattcagcccattacaggaaacaatggggtgagggacactcatgtccagaattcctttcagttatataaagtttgcagtgtctgctggacattcgagtagaaatgtcagaaaggcaattggttatgtctagaattcaggctgagaaagaacagttggggatcaaaagaatctacactgaggctagaccgagtcacctaaagagagaagacatggaagacaagtgggtcaaggaccaatcccgttcatccctttgtatctcctccacagcccaacacactgaggttgggaagaggaggaggcgccaacagagagcagccgccccgaggcaggaggcagttcaggacctaaggcattgccaggaggagagagtggtgggctggccttgtgctaatgtggggagaataagatcaggaaaagaactggtctttccatgtgaccagagcaggtaatgggtgaccttggtgacatccctattagagacaggagtcctgcgccagggcaaggagaggatggaaggtaagaaaagcagcacatcacgaccactcatgggagggagttgctatagatggcgcagtagctagaattagggagggtggcagttttgctttaagggtagatattattaagacattcgtatggtataaaggacccaatagctggtgcttttttttttttcctactaatcttctatttctgttgccttatttcctccctcctaagatttcaaagttcctaagaagacatcgttgttataaaaaccctggaaaaagaaagccaaatgttccaacacagagaagaaaaaaatatagtaaataagtttctcgcaaactttaaataatcttaatgggctgtactattctggcaaacctcggcctctagtagattgaagaaatcatttttaaaactaaagctattaaagtacaagaatatatagatttacagtatatggcaggcaaaagtcaataggggcctcagaagatgcttccatttacaggacaatgcaatgaagaagtccctttaaattgatgtcttacgttcttaataaaatgtttttggttgctaaaattgaacttataaccttctaaagcacaagttttataatttacataggacacaattcccttagatttaatgcatgtcctwgcttaacgtaaaggtaaagggaaaaaactctaagggataagactgcaatagttaatagttaatctgtaagttaaaaatgtttgtttttattaaaatatccaaatcaaggacaaggagcacatgatacaatggaaaaaatattggcagcataaatatagtgaatatatcatgagcttttacaaatcaggaagcaaaagacgttcacactgaatttaaaaagggcttaagacaatcacaaagaaagtacaaatgactaatgaatatgtgggaaaacattccaattgatttatacttaaatgaaaattcaaatgaggtcatatttttcatctatcagattggcaaagcttttaaaaactacaattcggtgttgatggagtttcaggagagtgggtgggttcttacacagtttggaagagtggaaatggatacaccctttggtagagcagtttagaaatacatattaagaatattaaacatacagcattcgactcagcagtttcacatcagggatttatcctcaggaaagtatagtgtatcccaaggcatatgcaaaagtatattcattgcagtgtggtcatgataggcattgaagatgttgtattgaacgtcagataaatgccaggagcagtgttagctgcaggaaatataaggtgtgaggggcgggtagaaacagatccagtccctgacccctctacgagtgtaccctgcatctgaggtacagataagtaatttggccataagagcccaatgccatgagtgctttgggggctggaagatcacacagaaaaggaaccttccctgggcttggtaagacaggaaaggagagtaccacaagaaggcttcctggaggaagttgcagctcagccaaaatggaaggakcagtaagaattagccacatataaagggcaggtaggaattggccaagccaaggatgtggactgacaccttaagggccaaacactgctggagaagcacaactccagttgagcacctgcatgtgggatactagagtgcggcagcggccaggtcacaagggccttgagagtcttcaatagaaagcgcagaagcatgacatcagtaagagattaacaatcatgccttcgagcatttactggaatacggggcagagctccatctgaacagcaggcatgaacagagcacgaagggggttcccaaaggaaaagtgaggtttgcaactggaggaaggagaaagagtgagtggaaggtagggaaggaggcgggagagataaagagaataggactggagggagacagtgggggggaagaggaagagaggggggagagggagggggagggagagggagagaatgcacatgtatagggaaagaatggaaggaaatagatacattcaatgctaattaatattttctaatgtgttttattggagacttgaaatttattctttataattttctcaagttaatatatataacttttttattctacaaacaattttaaaaggctcttacaattatgcagccattaaaatgaatgaaagtcttcaaatgcatcaaacataatttatcctcagaactgccatgcccagacaaacccagaattgaggctgagaagtcacaggagtcaaacaggattggaatttggttcctacaggctttttctcaaaaggcaaattaagaactttcaggccaattgataatatttcccctcctagattcccctccctccaccggaagcccctgcccacctcctggttcctctccctccaccggaagcccctgcccgcctcctgggaaggggaggctctgagggcatctgcacrtgtgatcacttgggtaaagaaatccccaggctccctgcagaagtgtttccaytagcgtggtcatctcaggtttttctcttttgttttgttcttttcctggtaaacaggggaaccacaaaaaggtattggattttctttctttccataccaattgattttatattgtctgacaaccctctgtacacactgccagtaagawttttttttaaccttratctataaaatcttactgcatttaatcactggatttacatttggtttrttttatacttgcaaagaaaacagccacttttatttaaagaaaagaggaggcttgaacatatcagaagcttcagctacatgggtgggaggcctggcccatgtctactgcagagcatggtttgggggcagaaggatgaatttaragtccaccccttcctcctgataatcagaacttaaaagctccaggaggaaggacaaaaatgtgcaacaaagtgtttcatttagtaggaaattgtcttatatttccagagtgtaaaaataycctactagaaacatgatttctaattatctgatttcattctggtatgaaatagacttatgagtaggatgttttctatttaagtatttcaaaaaacatatgtttaaaaatacaactaaaccttcttagggttttataaaaattaaatccttctatctgagcccaacattgtacatttgaagttactttttgaaaatctgtttcacttctgttctttcagcacccagttcttggtcttatatgaaacgatctcttggaatcatgcatttaatggaagttgaatggggaaaaaatatcttaggatgcactttatggatcaaaaactcttacattccaagtgttaagcctttgttaataccaatcgtttgttggcatattggggggtacagttacgactttgtgaactttcagaaaatgttgatttgcttttgtcaatgggacttgattttcattccagaacccaagcattgttaggggtgcaggcttccccatcagatgtcctatctgctttcaagtgaggactggcagtgtctggggccgtccttgaccccttttccctcccctggcttctggaagctcgtctccacccagacataccctgatccaggggaatcatcacaggaaggtccccactgtctcctccctagggactccaggatatgaatggtatgaaaggcatggctctggggggcgctgccagctcgccacctgtcatgactcagctccctcctcactgtcctctccactcccagctctctctctgcctcacaaaaatattgccatttttttctgcctctttgttttcttggcctagtgaggttgtcagaaggattgttcagtggggtccctgggaaggaaaaggaggggaaagagaaaggtgatgggggtactctctccaaagcagtcactttctgctgagacacggtgccttcctgaatgccatcttcttatctgggccagggcttctcaaacgtgagcatgcctgcaaagcactggggataatgctgacatgcagattctgaatcggtgggtctggtgcggactgagaatttatgtttctaacaagctcctgtgtgtcgtacctgctgctggcccatgctgtcatgaaaaaagtgtgctacttgaacatcaatgagatcgtctatgtagggggcttaacaaagggcctggcaaatactaagtgcctcacaatgtgcgtgaagttgatgatgaagagaaaatgatgatggtggcaatagtgaagatgatgatgataacagcggtgatgtggttatgatgacaggtggtgatggcaatgatgatggtgataatagtgatgatggtgacgatgatgatggtaatgatggcgatggtgatgatgtggtaatcatggtaatagtggtgggcatgatggtgatggtggtggtgttagtgataatggtgatatggtgattatgatcatggtgatggtagtgacaatggtgataatgatggtgatggtaatggtggtggtgatgttggtgataatgatagtgatggtggtggtgacagggcaagtattgatgatagtgatggtggtaatgctggtggtagcaggaaacacttatcttcatagaaatgttattgttgaatctgctgtacgataagcagttattttcagagaacaagcatcaaggagaacagagagcaaaacaggaattggttcacttggccagtatatatgttcatatttccacccagaaatttagtgcagtttgcaaaacagccttagtccttcaggccataagctctgagggcataactgagtcagtcatcattgtcctgtgtcctggcacccggtaaagtgcctggcacatagtaatcgctcagtaaatgttggctcctgtcctcaattactgaacatttactatttctgtcctcaattactgaacacttactacaagccaagctctctacatgcatttttctcatttagccttcacaacaaacttgaatgggaggtataattattaaccttaatttgcaggtatgaaaaactaagtcttgcctaaggtccctcagctggccggaggcagagccagaattcaggctcaggcccgtcagagtcgacagcccaatcccagtcctcttgtgatgacatgtgattctggagcagcgccaccattgcatgcatgtcagccgtgcccatgttgccttcacaccccttgccaacgcagggctgcacacgcatcccctccacacagaagctcctcaccaggcaaggcatgtgcccaccagccacgcccatgcccacccggcttctcctcttattcctgctcctgaactcgtgcattctttccacatggttctgattctgtcctggagagatttgctcaggctgacatccagtggctgaaagaacagcactcccaccccactccccccgccccctccccccaccaccacctttccccagggattatgcagagcacccggtttcattgctgggccgtcacctttaacccatctgtaccatgtgcctagagcaccatcctggcttgcacgggtggtctgtgccagacatcttaggtctgcagctgttcccccataagatgcctgtccctgctgccctttgagggtactcaagttgaaccccagatgcccatttcatgtttgataaactttgctccgcactcccatttctgttaaagctgcgaaaggcttcgactttgttccatttggaagggaggctggagttaccacgctctgggctcttacatcctgtcgtaacatcgttgtaagggttgcgttgtgactgcaggaattcccagttgcagttccaggaaggtcagagaggagcaaygttcccagccacagttctgtgagctatggttcagactgaagtcttttgcttattttggtgataaaagctgaacatggtttgtgctgaagttccagctggttatcggagtggctgaccaggtcagtctgctttgtgaaggggaatccaggcccctcttgccctcattttgcagcctgaacacatgctcactttccactcccacgtgtgaagcatgaacacacgcacacctccgcccagttatgcagtcgggctcacggctaaaaaccgattttccaaatgatcgggcaggatcacgcatggatgacggaagctctggctctgcccccacactaattgccgtgcgatcccgtgcaggtttctttacttctctgggcgtgtttcctcaccggcaaaatgggaacacttaacgaggaaactttgcagagagcattcagctttcaaactctgactccccaagygtgtgacatattttttaataactcctttctcattatttcccttttacctccttgctttgaatcttgagacacaacagaaaacatatacatggtgctttagcaaaggcagccagctcctggccaccctttccaggggtcgggcagaggtgtatgtggtacaaatggtcaggaatgtttttcatccttgaaaaaagccttcttgcccttctgccaccagcacagcctcctctgaaagcagtcgaaacagtgggctcagaggatcccgccctcttcgggggtgccccctttctaaagagttgcttctcactcccaaacctgactcagaggyggcaggagcagtatctgtgactgacaacaaaagccgttcacgtagaggaggagggtggcgggactggcttggctctgatgcttccctgatgtccacttttcccgagtaattgctccctcgtctcctgctgcagcacctgcctgggatcctccatgaaacagctggctggggctgcagagtgcctccagacacgcccctctcctgtgtcccttcctgctcacttgtaggtggcaacagacgtttgacctgacatcgtgacagtggctctttggcagtccagggccaaggtgagccagggaaggcaggaagcagaggggctctggagctggtatgttgtgattcaggtgaagccacgggctaaagactgcagtattatgggaagatgcccttggaacctcccttcgtgacaagggccgtgcaacgcccccaccgccacccaggcacctccccaggcccctccccaagagtccatcccctagagccttctaagagccagaagagccactgtccatccttcctgtgcttgtttctccctctcctgcctgggggacctcttctccagaaaggccctggggaaagagtccagcagctgcaagctcccagctccaggaaggcaagacagggccctggtggaaggagatgcccagagctggaggtgtgtccagctggagctcttctttctcctgggactcccctcaccagcatggccccagcttggagcctgcaggacctgtctaagaatggaggagctgaacatgagggtggctctaaccccggagacagggaaggacaggaggaggggccccaagtcaggccctctctgggctcccctgagggcagtcagctccatatcacaccagagacccacctggaagctgcctttcccgcatctctccccaggccccctccccaggagtccagatgtctggagccccacagccttagctggtgggggtcatgagttccactctgagaggacagtgccgggttcaaatccaagtcccacgttttatgggccgtactatcctggtcagtcatccagcatctcttaggtagcagtttcctcatctataagtctgggcacgaacccccagggatgctgggatggctctagctggtgtagtaccagcattggcctcacataaagcacaggtccaggcatgaaagcactcatgcccaatgcacagctttcccctccctctggcaactggagtgttgctgctgaggctcagtaattgtgaccaaagaccgtggagaattttctttcatgccacagtgcttctgtcctgcatgtgtctgtccctgagcctggcatcggcccacgtcctacaccatgaagtggtgaggaagggccacgcgggctgctcttctcgtactatagaggcatgtgctgggaggtgctgctgaggatgttctcctaacattgcttgcttataattccttctcaattttgagtggtggccttttaaaaattttatatagatgcctattaggctctcagctcaagcattcaagggcattcaaaatagaaggttgttcttcattttattgtgtgtgttatgtatggcaaaggcagacagcagaatcatttccttggagaaatggctcccatccacaaatagtgttcatctccttggtgcttagaacctcagctgatttgagggagcagaagaatgtgacaggcagaagctgaaatatgagaaatacttctttgaaatcaacttcgaatctatgtcagagcattatactttagacttattaaggaagcaaaaacaactagattgaataacacaagtttatttagaattgtgcttattataagcaaaagtcttcccccaaattgtatcctaagtagaaggacttgtgaaaacttacaggctataaattgataggaaaaacgataggcaaaatgaagactatttttcatgtttgaataaagcattttcagtagatttggcagagctgtgctttctaaatctccaaagaacgcaggaacaattagtaagtatgatgaatcagctgacataggcttttttcccttggccctgtgtgaaacaatggaaaattttctattgcaagtctaatttcccaagaaattggactacgcattggataaaggctgagatctctaaggagagtcagaaagcagcttgggatgagagagtatatggagccaggaagactagatgctttttatctactgactctggatctataaaagtgtgaaattgcagattctcagcagcctctgctatcaccaactattcctgaaaattgaaatcagtaccatgatgcctgtcttctttacggttagaaaacaccccggaaacgcaggatgagagccccaaatggaagctttaggcaactctctggatcagcatgctgatcagagccaccaaaggacccccagtgagtctgttgtataccagctggcgtgctcggttctggggccaccaggaagccagggatgccactttgcaagaagagatgatatctggtatgccgagcactcactgggagtcagagactgtgccgggctcttcctccaaccaccccgtgggataagtgagacttgtccctgtttttcagatgagaaaactgactcacagagaggctaacagattttcccaaagatacacagtgaggaatggcaccatgctttatgaacctgccaattcaatttcacgtgagacctcaaaggcgaattgccctgaatgaggtgctttttttttatagaaataaatgttctaacccagcgtcctctctgcaaacaaaagctttatgcagaaacccagaatatgccatcagtaatcctaaaggctagccacctatgagcagtccctgtaactgagtaccttccagagaagaacggtgcccatggttccgtgtaatgcctatgttcacgtgtgacgtgtaggtagcatcatagttcaaagtgggccaaactcagctgctgaggacctcaggagacagccatctggagagggggacttctgatggacagccagtgggtggtctagaacaagatgacttcttgtgacctaacctggcactctggttctgagggtctatgacagtttggtggtttagagggaagcattggcctcaagatgccaccattgggcacgtttaatgagtgacagctttggttactcttttaacatagtagagtttcgtagcacctggttcagccctgtcattctttggggagaatgagaaggatctaatctcctgggagaaggaggattccagctcctttgaatttcagacctgcttcttgccccctgtgacagatttcagcacctctgtctcctcggtgttggatgcgaacaatgaatgagtagcaacttgctggccaaattcctattccttaagtgagagagaagacagatggtgaagagatttttaagcattttaaccttgtccacatgttataatataaaaaaagtagaagctcgctatgttaaaatcacccacaagtcaataacctgagaataataattgttagtttatcttttgtatgcatgttacatccaaatgtcaacagtactttgcctctttttctttttcttctctttctttctttctttcttttttttttttttttttgagacagagtcttgctctgttgcccaggctggagtccagtgacacaatctcagctcactgcaacctccgcctccacctctcaggttcaagtgattctgctgcctcagactgccaagtagctgggattacaggcatgtgccaccacacctgactaatttttgtatttttagtagagacggggtttcaccatattggccaggctggtctcgaactcctgacctcaagtgacctgcctgcctcagcttcccaaagtgctgggattacaagtgtgagccaccgcacccagcctccttctcttctaaatctacctcatacatttcctgtgttgttccatcatcttcaaaactgaagtcttccatgactgagaactgcccatcaagtgccccaatgatgtggagaggctttgtttcgtcccctaacggggtgggatcagaatgtgttctggaagcctctgggcctccatgtggcctgctggagatgcgggtttccctgccccaaggcactgatcccaggaacccacaggtgccccagagaaaggacctgaagttgctaagagggacacagatgctgccagatttgtgtctgggaggagcggctcctaataggtgacaattattcctagactttccaactgctcacattgggtaagactttcaaagccaattattttataagcaaagcattcataactttggaacccatcattagcatcacagagaagggaggacactaaggattgcgatgtctagcaaatgcaaatatgggatgcccattgaaacctgaatttcagattaaaaaatcatttttataagtatgttccaaatggtacacaagacatacttcagcaacaacaacaaaaatcattttagaatgaattgattttggggtgaattttgacttgtatttcctcatttgaaattcaaatttaactaggcatcctgtgttttatccagctctcctctccaggcacaacaaacatgacacagcaccctcattaagggtgagggctaataagccttgagccagttccttgcattccctgacctctgtttcccagctatacacaggactgtagtatcagcacctacttcagaaagtgctgtgtggtgctcggcacctcgtgagtactcaacaaatatttaccgtcactattgttatcgtgaatcaagaatccagctcttcagagagttaactaagccctagtcacgtttcacattgccacgcacagacacacatgtctctgaagagtggaggcttccgaatggctggctggccctgtgggcatgtgtcatccttgaaggagacctctcagcctcctcctacaggggctgagtctctgctgagattcagagacgtcctacttggtacggcgaggagctgctttatgaccactgcaaaatccagaattttccagctcctgtctccccattggttccatctcatttccaattcccagtggccttgtttggacaaatatgattcaggtagattcccattgattgtctagttcaatgaagaaagcccatttcctattttgcctacaaactgacaataattttttttacttgcccagaattgtctgataataagaggaaagtctatccaaaaacaaatgtttctttaaataggtggcattaattaatgtacccgttaaatggatggtttaactaacagcatctaaatttactcattgtctcacagaacctaaactttgtgagaaaagttggcttctagacaattgcaacatatctatgtcaattataaactattatattcaactaaggttgttcaactataaggattttcaccagaaacctctgagttgttaaaatataatagcgtagtaacacttacaattggatttatggacattccttttctctataaaatgtggacattttatagctctgccaatcttaaaagaaaaagaccactgatgtctgtgttgcacatagctaaagagattaatgtaagtcctgattagcaaaggttccctgctggcccacggggagaaaaggcatgggggcctgaggtgatgtggctgtcacaccaatggttcaatctgagcagagcctcccgaagcaggtcaccaggacctctgttcgaggcgctaaggacgactgcaacaggccctcatctcagaggtcacacgtcgtcaggcatgacatctggggtaataaatcctttggaagttgtagcaatggatttttgtttttgttattttttatccaagagcaaaccccaaatagcctgagccatgagagttgtacaactacagagcaaagcatgggacctgtgaagttctccaggcctggcaccacattctggccctgttagttactgcctgcaatctctgtctcatttgcttcacctgtaaattgagggtaacattaccttgcaggcctgggaggcttcaacgtgatgtctgtaaagcatcaagcacgaggtcaggcgtgatgcagctgtgcagttgatgggagggaggcattggcatcaatatttatcacaaatatctaaatgtctcacttttatcataaccccggacatctctacagatcctaatttggcagctgcccttcttatcctaatgccacatgagaactggggtagaacagtacattctgcctctggagggtttgtttctggggttcacttttgtgtccagacattggatatcctttgaacatggataaagcaaatatgaagccagtgttgtgggatgggtgtgtgaggccctggcaaggcagacccattgcccagcacctttgtgctccccttcccacagtacctgttctcaggccctttcacagagaatgaaggttttgccatctgttctgcctcgggtacctcacagacccaagcacctgcagggaggaagtaccaagatgccctcagtatgtctcttgttggctgagtctgcccagaaaagtcaatgcatagcagtcagttccaagcccagctgttctgttcaccagctgtgtgaccttgaacaagccttggtttccccctctgcaaaatgggcataagaatacctaccttggtgagttgatgtggakttaggtgaacaacatagttagaaggaatacgtgtccatgtttacctgtgatrgcccaagttaygcctgttgtcggggcacgtgtattatagtgtcccttctcactccaaatgtatctcagtgtggatgatagtyaccaccccctgcccccccacacacacactcaacaactgtattttgcttttgttgctgataatgattaatgattataatcacaatcatgtcactgttattcmtagcagctcagtgtgactgaagtacctagtaccaaaaaatccttatttacgttatacttccatgtaattaaaagcttcttgtatttccaattagaaaatagtgtaatcttttttttttttttgagagacagagtcttgctctgttacccaggctggagtgcagtgacgtgatcttggctcactacaacctctacctcccgggttcaagcaattctcctgcctcagcttcccaagtagctgggactacaggcctgtgccaccacgctcagctaattttcatattttttagtagagatgaggtttcgctatatgttggccaggctggtctcgaactcctgacctcaggtgatccacctgccttggcctcccaaagtgctgggattacaggcgtgagccaccatgcctggccaaaatattgtaatttactcttcaccacggggctggaggtcgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgagccaagatcgcgccattgcactccagcctggtcaacaagagcgaaactccgtctcaaaaaaaaaaaaaaagttccaaatgcacaggcttttctgttttcctatgataacttcataaatttgaggtatttatttttcttccttgtagaaagctatgggactgattattttttctcagtaacctttgctctcttctgggtaaactttagttcatcttttcaaagatcacaatgtatttaggacattcattaggtaactaatggttagccttttatagtgattattataaaagtgcattcatcttaatcagttttcttataaaaaatattctcactctcatggttttactaattaaacattgttttattaatgtaccaggatttgtttgctgacatccctgattcttgagctcagagttggaaagatgagcaccaagaaaacaggagaaacagaaaaatattctccttaattgtcatgtgggatttcaggcaaaaccacagtgcatgggaagttatagggaaaaggcctcaagaactgaagattcagggtgtgcatgtggatgagaagccctttgggggtacctcatggatcatctttcaaaatctggaattttctgtttggccccaaggcaatgtcctctggccttctgccggggtcaccctggtggcctggctaagttccaggcagggagggaggccacctccctgacctacgaagccccctgggcttttgatatacattcaacattccaaatggtcaaaaccaaaggcatcattaataaaggatgcgtcggaaggaacatttgaagcagtgtgatgcgtttcacatgacggtcaggagagaagatttatgatcccggaggataagcccttttcctggagttactcagacctaacagtttcttgaggctgaaacaacagatctatcacaagctgtgatttatgtagaaggctctgatggaatacatcttggcaggggcgaaattgagagctttcgagctctgtaacagttgggaaacaaatggccaagcctcagcaggctgacttgtgcctgcctggagtttgctttttaatctttatgggaattctttgaagttcgaagtgggctttgctgttgtaggaaaggctgtagctcatcctcattggctagggcgaagttttatcttcccaatttcattacagtgttttgcacaaagtagtcacttaaatactgctgggatggagtgaggattgggacccttagcaggaacaactaagacatgtctacagagggcacatcagtgtgtgatttagggagtttcrctatcttctctgtaatctctcagactgttttaaaagaagcaagctgtgagcaaaagctttttaacaccaaatggcaaagcaaaccctcgaaaggggaaaacaaaaggccacagtcatatgacttggggaaagggaatattgctgcctccctggggtgggttcatggctatgacaataatacagatgtcttcaaggaatgcaagcataaagcctttagccagaaaacaagggcaactcgtgagctctcactagtcaaaatattgatgccatttgcgaataccatgaaccttggctaacacccctgatttttttgtgctgtttacacaagtccttaaagctgttgttgtgccgggggtgacaaatacacaatttactgtcactggtacacattctgcttttgaaaaatggcttatttttcattgcaggcttgagttttgcatttgaactgagtctttgtcttcctcattgagttctgccctccaccttccaatggatgtgcctgctctcttctcctgcacctttccagtttcctcctggcctcagtttacctatcatgtatcactttttatataaaggttttcctaatggcctagtccttggttagcacacttccctcacagattcccacacagaacctaagcccttgattactctattaagggctgtgatttcgggggggccctgagctgaactacaaattcctcaaggggaaggccctgtcctgtggcctcccccagatatttaacatggattgaaaccctgagttatggaagggcagccagagccagggagaggccacaggaaagaggaaggcaccatgggattgtccctgtgccgaggatgtacctccttcccccaccacccctgtcagtagtgctggtggggagtgttatccctgcatgccagaaagggaaaggccatccaggccgtacagccagtaccttcaggagcagagctggtttggacccaggtagaccagaaccacagctgagtgcccctcacagaagtcacagatgtgagcaggaagtgtgggtatggggaggctggcctggacagatgggtgtggtcagacaagctagaggacctccaaagccagccccaggggcttggaccaggtgccatgggaaaatgggtgtcagagaaggctttgggacaggaaaatggcccagcgaggggctgactctcccaggtggatgagagtcaccaaggtgagggtaagggatgaggcgtggaggcctgggaggcgagcagccgagtggcatcctaatccagccagcgggcgtgagaggtgggctgggccgagggtcccattccagaaagctgctattctagagtcaaaaatggtctgtgcatagccacctgtgattaactaggactccaagctgagtcataaygaacatcatagatactcttctcaaaaacgtttgctctcattagtggcccaatttcttcattttctaaaaatttggtgctttttcccatgaaacaaatgcacacagaaactcaatcactgcaaaagggtactgtcaatcagtgaatcttcctctgaccatctactcccacaccctccagaatcttcttttagaggcagccactgcttccagtctctcatatacatttccagagacagcccatgcatatattaacacggctgtgttctgctactgcttataatgatggtgatgagaatagtagcaaatatttatataataggtactatatgtcaggcaccattctaagtgctttataaatgttatctcagaggagcaccttgtagcaaccctacagggtagaaactcttaccctcccccacgttacagatagagaaacagagggaggggagggacttgactaactcacgtggctaatgaagggtcgagccaggatgtgaccacataatccttgtcattctgcatctggtgttctgcgcatacgaccacggccaacaatcattccttagtagctgtaagcttcttccttcttgttttaatgctcacacagaatgccacatgttcaatgaaccctcattcatctaaccagcttcttattgatgcttcttgttgcattatagtggtttccagtgtcctgattttagccatatttttgaagtgatttattgggtcacgttataaaattgtacttttgtaatcagtatgttattttctacagagtggtagcaaaacctttgctaagcctggaattcatctcagtttggaaagctgctttctaatagaaggaacttgctttaatttgcttttgctatgtctatggaaggtcaagtcagcagatggtccctgctttaaggggtaaaccaaacaagagttcgttctagcattttggcagggaaattttcaaggacattgttaaaacacctgcttggtgcttcagtctgaatgcttttggcatcactgggagctttttgaaatatgtattttcacttataacagtaattagttttagtcacatggagatttaaggataagaatattcagttttgtgttgatgggtaatttagcctgtgcatatttttataccccaaaattgttctgcaagcctcatagagaaagtggtttgggtatattcagtgggtggcttagttatttcaacaagttggcaaattctagcatataatttcaaagagttccatttgaaacaaatgtttgatcaattattagcttcttgttttcctgcttgtcttgctaaaacactcaattaaaaattgttcaacagattccttctggcatataatctggggatcatctctcaaatttcttargctgaaattagataaaacgagtgtgttctatctaaagaacgaaccatatgcacatcccctcatggatgatctaaatttatgttgtcaagtgaaaacgaaaacctatagcattttattgtttataaaattctggtttatgatgcttttgccagaacacaaataaggttactatatttagtagatcttggagctaagccctctcctaaaagaatgggtacattccttctacaggtatttattgagcacttattatctgctcaacactgtgctggatacgacaggaaagaaattgtgaaccaaatgtgagtcttgtagagctcttggaaggcttcgaagggtgggggtgcacttactaaagatccctcccacaattctatgaatgtagtaraaaccaccaaattatgtgcattcaaaggctgtgttttatggtatgtgaagcatatctcaataatgctgttatttagaaaaaaaaagttactctgactgcatgagagagaatacacaaaaggcaggtggtaggaccaagctcaggagtccagacacattcttaagcatttaatcataacaagggagaaaagcctttgcttactgtgatagcaaaattgaagagaatccatctctccataatcaaagctgctcttttaattaaattcagaagaattcaaatgctcatgcttaagagatacctgtatcagtggctaaagatgataaaattagattagcaaggcaagactgagaaaccaagatagcccagttttcttcatatatgtaggaatagaagggattgacccaaataaaataaaataaaataaaataaagaggaatgaagagctgctgcttaactctctatcaagttttatttgcatttcaagatagttaccaaaagataaaccaatgtttaatcaagataagtacatcttaattttttcacaaagctgaggggcaggatacatttagaatataccttttattccttggttcaagataaaattagtagattttggtcacttggaaaatgacagcatcatgatcattattagaacaaatcattcttgtttccaaattctaattaaccccagctgtgttgattcaatatgggcaccatactcagattgaattttcacatctatagatgaaactttttttggagtttgtggatgagtatgcataaaagaggagaaaatcctcatttggaaagtgggagtctgcccctgaatcttaatcaccagtgcggtacctggcatggcaatgtacagccaggctggtgagctgcgcagcagtcacgcctgggagtgaacaagacccaaattcacaacctttccaggcaatgatgaaaccccaggtaagtccttattccctccccatcacccacattctgcctcccactctggacttcacaactgctccagtctaagcatattatttggacagatttgtttcaagtaacagaaaacccaactcaaaataactgaagcacagagggtgtttatcgactcacgcggtctccctcactctactgaactttcctctgcatagttttcattatccatctggatctgtccacaggaagcagagatgactattggcaggtccagcatcacatggttcaggaggcagagatgactatttgcggrttcagcatcacatggtccaggaggcagagataactattggcaggtccaggatcacatggttcaggaagcagagaaggctattagtgggttcagactcacatggttcaagaggtagagatgactactggagggtccaggatcacatgatccagaaggcagagatgactactagcgggtccaggatgacatggtccaggacccagagatggctactggcaggtcgaggatcacgtggtccaggaggcagagatggctactggcaggtccaggatcccatggttcttaagttctttctcctttgagaatatgtgaactctcttttccaatgtccttggcaaccactgaaagaagaacttaagtgaagcacccagctcttgaggaccaattgctgagcccgggagggtggggtatgccgcctgcctagctccatttggcaaaagaacaggggaacaaacacacttcaggcaagttttgatgcagctatttgatatctcaatgatgggttctgtatacctggacagggagtgccctgaagggaagctccaccttcattctttctatggcatcacctccagccacccctgtgcacaccctgtggttgcaaatggcgagagcagctcccataactcacattctaatgccacagccccaaacagaggaagagagaggcagctccttacaccacagtgtaaggtgcctgagtggcaccaagaccccacccttggtggagtcaactccaccaaaggacaaagattgaaaataggaaaaaggcaattactcagaggaaaatatggaggatattggcagaaaacagggaccaaagtgccacctacctggaagccacccataaatgaccctcgtaacctttccatgatttcctagtctgccagacttctcacagccttgctcctgccctatcagcctcccttaatgtccagaaaagccccacttctgggtcaacccagccctctgctctcctgctctgtctcctccagtgcaggtttcactggtggaaggaacctttccctaggcatatggctgaatctcatcctgggctctctggtgaccttcctcgtggcccagtcatcatcgtccatatccatgttcatctcctccaccaccttcttcactggacttcttttattcaacagtcaggaggactcactcacgtcctgtcagccaggaagccatccacgacattctctctgtggccctgcccctaccccacttgttccaccttgctctttccacctagcatctgacatgctgtgtggtcattgcctcctcctggattgggacctgccagggtcgggtgctaggtgactcacacggggctgatgtccagagcagtgaggaagaaattgctgtaggggctgtctctctctcaggctgaggacctggggaggagtagatgcaataacatttataacatttatagaatgaccagcacggcgcctgacacagaggaaagcattggtcaacaggagctgctgctagtccagctttgtcacgtgctatttctggaagaatgaaatggagttcaccacgcagagatgaaaggaaggaccttccccatagagggtcagcccaggaggaagggagcaggcatgaatgtacctggcagttggggaaagatgggagattcagtcatcgagttgagtgttgcatctggaaagtccaaaaaccaagcctgagagttaacgtagtacccggaggatcccgagatgtagttatgtgagtctgcattaataaaatgattaaggagaataagttacacatgaggagtgatcagcagtcgactgttcccagtgaagttgtgtgctagctaggataatcagctgtatcttgagcttttcatgggtccagacctctaaatctattgagtcgtgttctgctgtcgaacttagtgctcataggcttgggagttayggtaaaggaaaagtaaagaacttcttgttttacaaaatctttttcttggatcctctgtggtttgaaacctgcattcaatataacaatataggccttgttttgtcaccctctttctgaaaactttttatatctaaaaatagctgctgacagaatgcagctaaaatatttggattatttcaatcatcatgtgatcattgccctaaactcaacagagtttgtaaaatctgactcctgtgtttgtcgccagcaaagctgtgacaaatcatcatattatggttattaggacaaattctaataaattctgtgtgacaataggacaccccagtgatttatttttctcaccatcaattatccttataaattctaaagaataatctctgcttaagacagttttgtctttcctgccaagacaagaaaggaacagcactatggatcaggtaattgttaggcatttttatcagtttgaaacaatttacatatctaacagaattttatagaggtgtctaaaaaatttatactcagggatgctacaataataaagttttcagaagcagcattagctttttaccccttttcatcaagatgtgaacagtctacattttctggaagtagccataagaagcaattagaagatgaaaatatccctcctatgttgataggattttggcttgctgccaagattcccaacagtgaattgacagcgttcttctttcctttggaattctgattttcattgctctcttgctggtctcaattttgacagcagaataatgagtaatagaaaagtttcattaattctgaaaagagatgtcttgtcatttgacrattctcagagaacattcttacgataagaagttggcacgtaactgaggaaaaagctcaatttgtataggctaggggatgtgatcaccagaaagatgtgggtggtaacaggaaaaaaaaaaaaaaaactttcttttttctcctttctatcccgcagtgtaagagtttctgatggatatgatttaaagaagtgtgcttactccattgggcttcatagcattttcctgcaagtgtcaaatgatcattttaatcaggttaccagatggttctgtttctgctcagtcttcctgtcttgtgagtttccattctcttctacctgaattttggagtgtagattttatcccccaataaacatgaaatagatttcctgatggccagtcagctgccgttgaaaagtaaagataaatcctacttttatttatttttctttacctttacttcattaagaaatctatgtgtggtgtgcttatcctgtgcctcccacatttatttgtgcttgtgtacaattgcatatgaatttttaagagctctgaaagccatctgaccaaccaagaaccagtgtctgatgaagcttgaacaggtttcttaccctcagccctattgactcttgcagaggaggggataattctttgttgctgggggctgcactgggcattgtaggatgtttggcagcatccctgtcstctgcccacagtctgctcccctgattgtgacaaccaaaagtatctgcagatattgccagtgtcccctggggtggggcacaaaatcaccctacgctccattaagaaccactgatttaaaattaagaaccttttatggtggcttctttaaatctcccagggaattctttcccttatctcagtcagctgatagaagtatttcctttatcagagcagcataaatcccacatcaagaaacagagtttgaaaatggatataatcccctacataaaatctaattctgtgaataataactttctttatttaaaatgtacattatcagaaaaaaattacagaaatcattgaaatatgttgttccttgcaaggctggctgtctactatttttccttttagtgtttttcatattgaaacatgtaagggtttctgtatatttttgtaatcttatcaacaatatatcctggaattgaatctctaattcctgagagatgatgataaagagatgagtgaaacaagaatctggaagaatattggtgttcgagcaaccatttaaataaataacagcagctgtaatcttcttagtatcagtaagtaatctcaaataatataaactttgaaagttttacaaaaatgttagccacaaaagcaattatatcttagtaaccaattgctatatgagtcagtataattggagcagaagcaatcgtattttatattgagcttattagtaacagacaaggtcctgggcagagtcttcaataccaatagcatttcaaaactgagaaaataacattggaattgcacagatgtatcatgagcactctttgagaatgttctcttaaatcattttaatgtgctttcacataaaatatcagaccttaattataatagcttgcgtaatttgcactataacttagctaagattataagaaaagatcccaatgcatgatcatttcttagtgatgaaatcaaaagtgtggcaactctaccaatatgttgggagccattgcattctgccaatgaggcacagtaaamccctttcccttttctgtgtcctgtctccccattccattgtttcccccaagctttctcatctgtgatctcaagatgttcatctgaggtgacttctagtttatgttctttatccttgctttctgtgttagtccgttttcatgctgctaataaagacatacccaagactggacaatttacaaaagaaagaggtttaatagactcagttccacatggctggggaggccacacaatcatggcggacggtgaaaggcacatctcacatggcagcagacgagagaaaagagagcttgtgcagggaaactcccctttataaaaccatcagatcttgtgagacttattcactatcaggagaacagaaagggaaagatctgcccccatgattcaattacctcccactggctcccccccccccckacaacacatgggaattcagggagctacaactcaagatgacatttgggtggggacacagccaaaccgtatcactttccttcctccctgcctgcagagaactgcaaagccttcaggagaaagaagaccctcctactgcaacatacttagaactcagagcatgattcttgcatgtttctttcttgaaatgttggtacttgccagccacgtaatcttataattgcctggtgtttggtcttagcagatacagataaacatcccgtaatagaaaacgatgtactttttgagtgagatgtgttgtgtttgtcagtgttggatatgaatacacrcattctagaggcagcagactgggggtttctctttgctcatgggatattatgattaacttaattccctgcttgagtgccgaggagtcacctcttttactttgacgcttgtgtttgaaaatattttcaaaattgattcatctgtctccctagactaagcaggatagtgtcccacctgagtatactttaatcgtctatcgttttgggatttaggaacttgaagcctctcagagtcagaatttctggtgtgtagggcaagtacttttagaaagggtcagaaagattcatgtccatgtggtagttctatagactagttgctttgccttgcaattgttttcttacaatgtgtttctcctgaataaagaaagcttaacagcaaaacaacatcagagggttttgtggtctagttatttgagttcaggttagacccagctttgctatacacaagataatttgtttaggtgctagaaaaaaaattggacatttttccagacacataaagtctagctaagcaggccagataatagccttcccaccaagatttttagactatgatgtgttattttttatgtggttgagtgtatgtactagtgtgcattattagaatttattcagataccagtgatgttttgtctataaaataaatcatatgaccagactaactcaaatttaaaaagatatcaactgaaaaacaataaaaagaaaaatctccaggatataccgatcagtctttcacagacagtaacatgttatacatcatctggaactaaagagtcatgagtaatggaagggcagagatacaagaagtctgcaaaatttgagataagattctatatcttagcctgggttttgtctttacttttggaaactgcaatgagtgcatatttcagccacctgatgctaagcattcacttgtcctgtggaagcctatccctttcagaaggatattctatgtgacagacagatcaggtttaagaaatatacagatcctgagctggcatgggctgagttgagcttcaagaaatggtaacaagccagtggatttgggagatttttcattttaggttttacaactcttgctgacattaaattaagacttttgccatcttatataaagtgtattccagtgattcagctattctaacttaagaggagtgaagttggcctaaagtacacagggttggttgttttttttttttaaacatactttcagaattcttttggttttaagtgacagaaaaccaactcaaactgctaaaagaaaaggtaaagagattttgtgccacataactgggaagcaaggtacaacctgcttcaggtgtggcctgatccaggggctcagagtgtcatcatggctctggctctctggttgtctcttggtcaggctctcctgctatgctgtatgacaaaagccattggcatccacagatcacacagtattagctatggaactccaggggaaaggtaccatctttcccaagtaccttctggaaagacttggtggtgtccaaatggcctggcttccgtcaggtgcctakccccgagccaatccaccctggccaagaacctggggttactcttggcaaacgtggttctcatgcccattcttgtgactgtgggtgggttccaacctatctaatctacttagaatagcgcagagttgggtagttgtgacaaagactgtgaggcctggaaagcctgtaatatttatgatctggccttttacagaaaaaatgtgctacccatttggtaggtaagataagcccgtaaatagggccaccttcatgaatgtgcagtccgagtggtcacacaaggcctcacagctagaagggcccatggttggtttaatgctctgctatcaccgtctttaaattcttaacaatttatgaacaaaggtgccacrttttcatttgcggtctcttgagttactcatagactaaacgttgagggatgagagggatttcccagaggaaaatgccctgaagaaagggcatgaagcgggaatctgctttctgttccatgtgagtaacagaatacctgacccagagtgactcagcaatgaggagcttattgtctcacaracacagtcacccagaggtggcactgctaggtgaggctaatttagcagctgacagcacctgcatcctgggccagcctttctgcaattctctgggctttctcctagtcacaggtgatggaaagctccagttccaagcatcacatcttcacccaacaatgtctaatggaggggaaagggaagccatgtttcctcccttgtattacgcttcttgttagggaagaaaatgtttctagaaagtttcccagcagatccactgactggagctggctgccaggggtggggagatttccatttctagcctctgaagtaggaggtggcttctccatgaggaaccaggggctggagataggagctgggggttcagcagccaaagcattcgccactggcagccttgcattggcagctcctactgtgaataatttgttgcagaattccttcaactcctgggtgaacttctggggacattgaaaagatgacttagtttggttcacacacacacacacacacrcgcgcgcgcgcgcactcactctgatttgcttgatttctccaagaatacatctaccacagagagtgaagtccaccacagagggtgaagtccatcacaggcagccacactcccaacacagaactgggccatagcacagtctctgtgggtcacactctcacattgcccaaagttatgaaacttatttttttaaatagttctgctaagcagtttctgaagaatttgtgggagtaggaaggaaaattttacctcaaaagatatttgatcagatcctgtcagataagcaaagggtatttagggtatgtttgtgaaacatgatttcttatctaaaaattgaacagctcttcagtaaaatggtatttgatgctttgatagagtttatgcccaaatcatttttcttcctgacttctgtatttctgcgtgtttatgcttctatatttattcaaaaagaacgtctgaaatgtgtaaaacataatttttcttggctgaagcacctccattccacacaggaatttcactatacttgctttttataaaataaaacgtctgttgcaatatttaccttaaatatgattttagtaacaactgaaccaagctatttcttctccttcagactataattctttccaataggtgttggtaggaaggcatatgacatattaatatgcatgtcaaataaagaatactttctagtttcttataggaaattactactacaatccctatagattaaataaaatgtacactctgattagttattaaggtaagaaactttcagtttagaaataaaggttttttgtggtttttactgaattaaaaacctgaccatcgctgtctccataattcattcttccttccttactccttcgctgatgacaactagttgggcacctgaactttcacaaaagatgtccagttaaaaggarccagtatggaactttgtacacaatttcccctgtattctactatctgcaacaatgtgaaactttttaattttaatttttaatttcaatgtgaaataaaaagtcttgaaaggagacatttttttctttcggtggtttraagatcgagtctcactttgaccttcggaaaaatgttagagcatttcagagacacgtacgtctgcgaacctgcagtgatttggggactttatacaacttgaagccacttgagttctgtagacactcagagattatgagaattctgttgatatgaagctcttttgcctcttggccccggcaaaattgtacgttgtgagtagtttgtatttttagttgaaggttttgctttggagttcaactgcaattttactttcgttgtcatcttaaatctgtaattttgagagaaagtttttaaaaatatcttcaatccactgcagcaattattctgactgcagagtgacctttatcttcttctggttaaagagagagagagagagagagagaagtagtagagcattttggggtttttcaaaccctcggattacagggtaggacacctcaagatacaaaagcaagattttcagacttcgtaatgtcattggatagtcattaaatttatacaaaattacagttcagtgaacttaaggataggctgaaaaaggtaaaagtggtaatartcaraaaggctgaaatctggaatcaattaactgaaaacaaattaaccaacaattatggtatgccctgtttatttttctaaagatcttgaaataaagcaraagttttccacaggtactaatagctagaaacccatgggaataagtttcggagtagaacttccccacatggggtggatctccagccacagtggaagaagaatcgactgagatgtttggaagttttaattgccaaggcattaagacaagagtgaatggaagtggacaaggaggcctggcactggtgctgtacatcctgtgcgttgcagccccagagcctttccactggacgagctctgaccttgcaaaaagaaggcccgcccattctttccctggacgttctttmtgtgaacgacaacgytgctgaactagcctgctgcctctctctggggcaggcctctctgctcgaggtagaaggtcttgctcagagccaacacctctctgtttttgtttctgcctggtctttctttctatcaatgggagcacctcggttctctgggttcttaccacttccctttttctttcttcatttcaccgttgtatctccaggtctttgatccactctaagaatggcttctcagctctgttccttgtcaccaccactctctcatctggtgactacatcatgtcttccctgtacattgccagttccccatctcccagggctgctgtaatgaagcaccacaaactgagtggcttcaaacaacagaaactcggtctctcgcagctctggaaggcagaaatcctaaatccaggacttgtgacttctggcagggccacgttccctcccaaggctctgggaggaacccttcctcgcctcttccagcttctggtgcttgcctggggttccctggcgtttttggctcgtggcaacaacactccagtctctgcctcccttgtcacttggccttttcccctgtttctcttctgtatctctgtttcgtctcatggcagcctcctctctgcgtgcctgtgttcaaatttccctctccttgtaaggcccacactactccagtatgacctcaacttagcttggttacgtctgcaaagaacctatttttaaataaagtcaccatcacaggtgccgggaagtaggagttaaacgtatctttttggaaggacggttcaacccacggcacacatcatgttatsctttctcaaatgatccctttttctcactccgttgttcaataaccatttggcctgtggaagaaattctgactactttagcctgatgctcatactcttttccagcctggacaaccccacctttctaggatcacgtcctattacctcccatatgagaaatttatgccctgcccagactggtctactgtttctagaacattccatgtgccatttacaatatctgtgcctttgcttacagcatctctgttgctttgatttaaccaccaccaccaccctgcccccatcacgtacacaaaatctaagtcctaacaactctccaacgtccatctcaaaccacatcctgggctctttctctagagtcttggagactccaacctattgagaatcctctctcctttgaacattctgaaccatttagagcttctcatctggtgctttgttgctgctgatgttgctcttgccataaatagctaacgttcctggagagttcactgggcaccgtaactgagctctttgcacacattatcttattggcaccccacggcagctccacrgtgtgggaaccattatatcgtggtgttgtcgattaagatgctgaggctgagggaggcaaatcccttgcccaagatctcaccaagtagtgggagatggagacaggagtcgtgctgatttttctgactccaaaattctggtttttaacctccaaatgctcctgcttttattggtgttggttactgttcaatttcattttcataattagagcataaacttcctgagccttgagaccatacttgaaggcatctgatcgtgtttggggatcaatgtcatggttattaatctgttactccattttcaaagacaaaaaccattgagttaactgaagacctaggaagtctggagtccttcctgctccctcctagtgccctcagaccatccagtccccgtgtgagctgcacttcttgccaaccttaacagcttgcacctgttccacctcattatgtggcccaggtcagaccctgcatggaaataccaattcatagaatattctaattaatagaacagygaatattaaagagcatctcgtaggtggtaattgtctggtaactagtgtgtaagtcactgtccttccttctgttgatggactatatacatagrtcatggtgcgtgtggaagaccccattgagtgcctgtattttgtgccagtgggcttttgtttttgttagtcaatcatttgaccaaaaagcattgctttgatcaggtgcacactgtctatgtttgttaatagaacaaaccttaatgcctttctcaaggtcatgcacaatctcaattagctagagagacagggataggatgacttattttaaaagaatgcatccttattctttcattatcagggaatattactgacatgtacagaaactttatatgtattycatttgtaattctaaatgtttatttttctctgatttagtaaaataactcactgaagtctaaaaatgaaaacctggttttgtttagatgtgtaagacggtccgagacacactctgggaagcagcagcagcttcccacagacagggtcacatgatgcatggggctgatgacacttgatgagcagaggtttatgggagcgtttctgcggtagaatcccaacgcattagctggaggccaggaggggctgcgaacttgacaatatggctgagtcatgggtagtcgttgaaattggctggtggccgttatgcctaaaatgactcatgcactgcaagcagatatgattgttggcatgacttgaaatgaacaccggccatttcagcgggatggtcaggcccgctgatctcgatggtgattaggtggataagttttcagcagggctgggttgcctcatcctcctgtcattgtccaaggctttgaaatcactttttcttacactttactgaatcatctagataattgccccaaacgaaaccttcattcaggtggttagtctaaacttattggggtcttcaacctggtaagcaggtagttttaaagtgagactgaggacttgactacataacttaaattccttattcctagggccccaaaagcacaaagctcaccataaaaagacacagatgccctgaaagaaatttctggaatctacaggccttctgctcaagcctaccttccttactctttgatatcagatagtggtaataaaatgggacatatttctgatatactgggaaaagtcatttcttcccctcttgaaaaatgttctcctcttttctcaccacagctgggagtttctaatatgaataaagtgccaggaatttggcagtaacagtatwttcataaatacacatgaaatttggtggggtttaaagaaaaataaaatggaaagagcatattgtcaggtttaagcacagacctaccttgagatgaaaactgagtctgtttgtaatggttgttcatttgctttgcaaggatgcgtgccaggcactcagcctcatccagaggtgcaggcagagatccccggcacccacagctgggtaggagcagcaggggaggtgctggatctctgtcttcaggcccagaaacagaagctgcaggattcacacgagctaaaggctacactggccctggttgcacattttgcgtccacaaaccagatagcaaatatttcactgcaagagccggtgaaatgcagaacatatggcccctcccaatggctccaggagctggagacaaatccagcatgtgggtgatgagacttgccgggcccttctggtctctctcctggttgtgtaaattctgtcgtcttacacttcattagaccagaaaaaggtacagaccttcctgatagcgtgacctcccctctgccatggcagggttgagattcagtctttgaaatgtgtctactgatgccrgagagcatgggcgtctgcaacggtgactgacccctctcctgtcctgcatctgcacctcccacagggggctttccagggagggccgtggactcaagggaggagagcaaggcccgtagtggctgtccatcttgactgaacaccagccccaacccatgaggagatacctggtttgcatcttcacgcttcttaggaaacagtgatgttaatttggaacacatgtctttgtgtggaatgaagaactgtaatttcacattgaagccccagtcccttccctctcccattcctgcagttcacggaggtgatgtcaccccatgcgtggtggagacttaggccttccacgtrccacccgctgtctggggctttcaggcctgtgaagcattttcttgcttcttctccactcataacctccctcccttcccaaagatgtccctaccagcatcacttctctctgtcacatggccacctaagtatctttacttcagcctccaaattcattgactatttgttgggcaccagtgatatataaataccaaatgcagccaggcaggctcctgcatgccaaacccaggtctgtttctcaggcttacctctgtgtcctcagatgctcaaccatccggccttccttaaatcagtcatttagttcccagcaatgagaaattccctgacttccattccatctttgtgctgctcctcttcggactcctggcttggttgtgcttcctctgcaaccccaggagggaagcacacgactgtcctctcccacagggtcactcacagtcttgctgtggacctcctgtggtgcacagcctccaggctgcatcaccaaaaccctcaacttgcctcccttccgctcaagcctgggacatgtatcccgagcttgttctatgttctgggcaccaggctcggcctcagggattcgaggacagatcagatgcagctggcttcttccagagttcaccaatggactttgtccaaaagatgccttgtcactccctgtaggggccctagtcagtgccctttccaaccagctcatctttgcttcgtcatctctaagtctgtctttacaaatagctcctcacctagccatgtcttccacaccacccctgcctccacctgggaccgtgtcttctttatctcaggtctggattgcacggcagatttctacttctttctcttcttcccatcttaaagccacagcagctccctcttacccaaaatgatgggtcaaatttgtcagcccggcttccaaggcctctataccctagatcccctgccctatctgaatttttcctttgtcccctagtctcccactgaagccaaacgacattccctgattttccctgactgacatttttgaaaagttaaaatcaaattccccactttttttttattttacaagaagcaacagatgctccttacagaaaattacagaaaggaaaggaggaaatctttaagtattcataatctcacccaccagcaactaactataactaatcaggcagttaccatgaactatgacttttactacacaaatttatttctgagcacgtgtattatgtattgtagttatttgagtggatgagttattttctgtcaaccccagttcttacccactcttgtatcccacctagcatccaacatgactcagcgacatagaaggggcccagtaggtcattgagccaatcagagttgctcagtaaatgtgtcttcaatcaaatgtagacaaataagttatgtcaaagcacaaacttcagaaagttaaagccatggctctcacataaacctatagtgagcatctgtcaaaggtttatgcagctgattgatgagggaaccagcaggatgccaaagcaggctcagggagaacaaggaaggttgagagaagcctgctagctcacatccagaaccggctcatgttcttccaggcaatgaaaccatcactttagcgctttatcttttctgcctgacagatatcacttgccatttctcagtcttctgcaagttaacatctaactttacagaatcaggtccctaatcaatagcaaatggtaaatcaacccaaatagcatcccctagaatgagggtctacaaacgttttctgtgaagggccagttattaaacatctcagactttgcagaccatgcagtctctgttgcagttaccccactctttttgccacaacacaaaagctgccataagcaacacgttaagtagctgcattcctataaaactttataagaaacaggcccctggaggccatccgctaacccctgccccacttagatgcattctaggccagcttgtgagacggtgatcgggttttactttgaaagcagacatagtgagcttttcaccttatttccaagttttaggtaacttaacagtttcatggacccctgtcttttagatatcagttcccaagtttatcatataaattgtatcatataaatagagtagtcacatttaaaaatggtgtctaagaattcaacaatatttaagattgatacataatgcagatttttaaaattgtattttttattgaaaaatttaagaatcatatatatcatatacatgttgttttgaaatatgtatatattgttgaagggcttaactggtctaattaacgtatgttggtttttgtttttgttcttgttttttgggtgggggatggagttttgctcttattgcccaggctggagtgcaatggtgcgatttggctcactgcaacctctgcctcccgggttcaagcgattctcctgtctcaacttcccgagtagctgggattacaagcacacaccaccacacctggctaatttttctatttttagtagagatggggtttcaccatgttggccaagccaatctcgaacccctgatctgaggtgatccacccacctgggcctcccaaggtgctgggattatacacatgagccaccacacctgaccaacatatgtattatttcacacatttttgtgtgtatgtggtgagaacacttaaaatctattcttttagcaattttccagaatgtgatacactggtattaactgtagttaccatattgcacagtagatcttgaacttattcctcctaaccgaaattttgtgtcctttgacccacatctctccacccccaagcccyccacccctggtaagctctgcttttaagagttaactttttaagattctacatataaaggagaacaatatttaaggcagatacgtaattagtgcagattttttaatactacaatcatgcgaccttagcttaaagtaacaagactatcaaattctacctcactgccataggcattcaagcgttgcctgccagcagaattttgggggccacatgaggtctgattatcccgttgagacaaagttttgaagatgttcctagcattctgtgttacatacrtatgtcaacagacattatacaagggtacgattacaggcaaatacagaaacattcactgcagacccagaaccagggttgcaactttctaccctgaagctctgaatgagcaattttgcttccacaaaaccacattacccattaggctgaattaatatccttcaattgagtggtcttgggttggtaatttactctgtatttcatttgtgaatttgttttgattggtgtgttatacacatacatttatatttcattttattcttgcatacatttaaatactattgggataaaaatattgtaagtcaacaccaggggtctctgagaattggagactttctctacgtgtgagaaatgctacattaaatcacgttttatttgtcactggctcagccagattacccaagtctgcttcccgataaatggtgaggtgtacacttccctttgattccttgccttttatttgtctcagaaagcttaaaggattcttctctagtctgcacacaggtgggctgacagtgtccagaaagctttttttttttttttttttttttgagcatatgaacttatttgatgtctgtgactgctggcaagggacagaagcaccgaggatatttagttgtttgaaactgagccactccaaagtttgatttaacatttacttacataacacgctgtatttaaagtcttatgtatatttttgattatcttctcctaataagcacctggagcgtttcttgaatggtgctctcttcatttcacaagtgtaacttttccaggaagaacatcactgcttccaacgcatttcaggctgtacaacagcagtctctctgtttccaaatcaacccctcaactttggtttctcatatcaggcctctctcacatgtttattttattttattttattttattttattttattttatttcattttatttcatgagacagagtctcactcggttgcccaggctggagtgcaatgacatgagctcactacaacttctgcctcccgaattcaagagrttctcctgcctcagcctaccgagtagctgggactacaggcgcacgccaccacatgcagctaatttttgtatttttagtagaggtgggattttgccatgttggccaggctggtctcgaacccctgacctcatgtgatccactcgcttcagcttcccaaagttctgggattacaggcgtgagccaccgcacctggccctctctcatatgtttaaaaggtgtgataatgccattgttgtttctttatcttttgaaagaaagaatctaccccttctctgggtttcatagcttagttttatttaaagtgcccagtttaaaccacacaataaattaatccagtaagcacatttctctaatgtatttgaccagtggcaggaatcaaatagattttgtccatcattgccatcagattacagtgactttgcaaattaagcaaaaccttaactgtcatactggttacctgagttcattgtcttctggaaatgtttatttagtcttgtctattgcatatggtttgtctttttttttttttttttttttttttttgagatggagtctcgctctgtcgcctaggctggagttcagtggcacaatctcggctcactgcaacctctgccttctgggttcaagtgattctcttgcctcagcctcctgaatagccaagaccacaggcacaggccatcacacccggctaattttttatatttctagtagagacggggtttcaccatgttagccaggatggtcttgatctcctgaccttgtgatccacccaccttggtcttccaaagtgctgggattacaggcatgagccactgcgcccagaggtctgtccttttcaaaaagattaaaaaattaaaaatccattacaatgcccctttggcaaaggctggcgactctctcccattggagtaagctgaatgtttctgcctcttgcagaattacatggtagaaaccygcagctctagaccagtcaaggccatttgaggaggaccagakagtcacatgctgaaatgggtctttggcatatctttcaaaatttcactggcctccatgctttaatttgatcttttcaagtattctttaaccacttcagaagttttgtaatcaactggtagtgaaggacattttcaaaatattcccgagggggatcccatctactgaagtacaaacagagatttagaattgtaagttaagtatgtgcgatggatgaatatagacatctttgtggttgattcccatgtcacatttctcttggaatcctgttattcttctttctgtgtaataatgtggtcattggctgacacaaggagtaactaaagatrtattttatgaacaaatctgtgtttattactcccattgaacataagcctttggaaggtaaagctgaygtccctgtgtccctttgcactcaggacaggggtgcctccagcagacagggtgctcaatgtatgtttgttgttagtaataactataacttattgggtgatggccattatttactatgtaccaggcactattctacacattttatgtatgtatattaactcatgcagttctcataaggaccacaaaaagattgtcctcatttttaaaatgaaaaaagcagtcacagagaagttaagcaactttcccaaaggcacatagctagtgatatggtttggatctgtgtccccacscaaatcttatgtcaaattgtaatccccaacttggaggtggagactagtgggaggtgattggatggrgccgggggcagactttccccttggtgctgttcttgtgatagtgaataagtgctcaccagatcaggtttaaaagtgtgtagccctccccattctctctcttcctcatccagccatgtaagacgtgcctgcttccccctcaccttctgccagggttgtaagttttctgaggcctcccagccatgcttcctgtacagcctgtagaaccatgagccaattaaacctattttytttataaattatccagtctcaggcatttctttatagcagtgtgagagtggactaatagagctagttattagtagagccaagatttaaattcgagcttgctggctcccgagttctactttctcaaaccctatgttaagctattgtccacagcattcaacattgttgaattatctttgtcaactaaccttggaagtcttaaattttgtcctaatcctgtcccctattccccccaccttagtcttctccatcactcaaaccagaacattaggaatcctctctttccttacccaccccctctgatccatctccttctatacacatcaatcctgaatccatccagctcctccttcccagtgaccctgcgctgaaccagtccaaaccatcatcacctttcatctggactcatgcggtcacctgctgacttcctccaggcttcccctcctgctgctcacccccatctatcctccactcagcagctggaaggattaacgcataaactaaacaatggtaatcctggtttataaccccataaaggctcctcatagactgggcccggtgactcaatcccagcactttgagaggctgaggcaggcagatcacttgagggcaggagttcaataccagcctgactaacatggcaaaactccatctctactaaaaatacaaaaattagccgggcgtggtggcaggcgcctgtaatcccagctactcagaaggctgaggcatgagaatcacttggacccaggaggcggaggttgcagtgagcagagattgtgctactgcactccagcctgggtgacagagcaagactctgtctgaaaaaaaaaaaaaaaaaaaaaaaaaaaaaagacaaaactcctcatggcaactcaaacaaaacccaaactctcccagactcttcaccctggcatttgcctggcctgtcaacctctccagcattatcttgtgcctcccacctgctgcgtgctctaaccccactatcttatttctattcctgggctgctctgctctttcctgcctctgccctgtgtgggaacattcctccccaaacctgtccacaaggccagcaccttccagctttgctctcagccaccatagcatcacttcaaagaggtctgttcctcaccaccttctcattttcagtctcccattagtgtgtttgtcrctttcatagacaaaacagcacaggctgtaatgtacactcttcacgttttgtctgcttcccaccagactttgaacctcccaaagggcagaagcatacacatgaattttggtgaaattcccagcctccagcacagctggctggaggcttttgctaaatgaatgaattggggccgggtgtggtgtctcatgcctgtaatcccaccactttgggaagcagaggcaggtggactacttgaggtcaggagtttgagaccagcctggccaacatggtgaaacccatctctactaagaatacaaaagttagccaggtgtggtggtgcaagagtagttgagtaatcccaactactcaggagccagaggcgggagaattgcttgaasccrgaagtggaggttgcagtgagctgagatcaygccactgcactccaggctgggtracagagtgagactccgtctaaaaaaaaaagaaaaaaaaaaagagtgaattgggcagatgtagaagcaggcacgctacacgctagtcccctctgccccaacctgagaaggctggatagacagatgggatgtctcaacaggtggggaagcctggccccggtccttagtgactgcctgccatcgaggctgcactcagcacaaccatttggaagagtgagctcaggatcccattcacaatgctgggtcttcagtgaccatctyctgaaaagagacaaacgtctacaggattaagaactgagtgatgatgtgcacctgagatacagartgaaatgagctgctgcacacacggcctagggagtccgagggttggggattaccgcaatgccgtcttcaggaaggttctgcaggaggctcagccttgcagagcagaggctggacatatgaaagatcaagcagagagaagggagccactgaggcgagggacagcttgtggggcttaaagcatgggctccacagcaagcctgcctgcaggtagattccggtgcccctgagtgccagctctgtagcccaggacagggagcccaatctgtcctcactttgtcatctgtaaagtgggaatcacaacagtatctacccatagcttattttgaggcataaacatggcaatgcatgtttagcacatgcctggcacgtagtcagcactcaaaaaacagtcctaagagttggtggtatccgtagagtagagcagccgtacttgtggctgctgttgtcctgatgataaatgaggatagaacaaaggacaaggaagaagaggagttggaagctgactctggcatttgaagcccttcacattctggccccaactggtccttttgcctcagtccttcctacactccccaccgtataccccattcttcatccccactgaacttctccccattcctggaatgttccatgctctttcctgctttggtttctttccacgtgctgttcccactgtctaaacaccttgctcggttttctatgcctggtgagcccttgtccttcatcatgatccttctctatgcaacttggtctgtgggaccttccttcattccttaagtccagggctccttcttcagtgctcctaaagctctcattgtatctgcatttgtctccctactctaggatgtgggcttcttgagaaaagggacgtttgtgcaacagggctcacactgcacctgatgcttagaacatgttcatggatggatggatggtgaatggatagatggatggtgaatagatggatgatgaatggatgggtggataataaatagatgatgcatggatgagtgatggacagatagatgaatgaaaggatgaaggatgggcgacaaatagatgaatggattatggatggatgattgatggatggatgataaatggcttgatgggggatggatggatgaaaggatgatggatagatggatggataaatggataaataatgaatgattaattgtaatagttaaaatgcaattgaaaaaaagattcccaaaggtaagatgaggggattaaagggcgtacaaagatatgtcatgggatcaaataaaagaaaaatgattccactcacagaagatgcctgtgactgattaagttccctgaaattaggaaataagaatgctatctaacactgagctgtaagttcacacacagacaaggcctttgtttgttttcttccttgtgcccaccaaatgcatgaggcataataggtttaaagtaaccctgaaggaaaaaaacagatggaccattctgcaggtgccccactcagtgaggttggaaaagaaggaatttcgatgcacgttttatgtgtgggcaacagaatgagaccacactgagtcttgaaggctttttcaacagtgatgtggccaaagaattagagcacacccagtggtacacatggagtctagcaaaggtccacagaaactcaggggctttgctttgagttgtaaaagcttagattccactttgaggctttggactctgctctcaacatatttttgcccttatgagccagacttgtcagaggaaagaagctgacatgggaacctgagttgggaggaagaggacagcaaacagtgagaacaagctgcagtgtccagaagttctttgtcacatagggtggactgggctgtcattgccccttcacagcctggctttccagtggcctctcctgggaacctgcacttcctctttgcagatcccttaggtgtctgattagccagcactctgacctaaagcagacatgtgcttctttcttggatgctcatctcacactcccagtcatctgcaggaatgtcaggctcaggggacagcgtcatctggtactcagagtagcatgtgatgccatgtgcacatttaccctggacctagtggaacataaggaggtcttcaaaactcctttcattttagctcatcaagtaattccagcaagatattaaaacctgtgcactgtggccagcgtgctgtgccttgcatattcccacctggtgccctctctgtgcccaccctgcagctccgcctcttcctttagacagcctctgtgaagtcactttgaagtagcctagggttggattgccttaacaccaccctctaggggcaggagcaatgtagccccaggggtggagtttccagccagggcatcccacaacaccgacctgggctcccacctcatgatgactccagacctgagccttctgcctacagacatcaaatacagccacttgctgggcaccccggcgcctgtgtgtcagcattttgatttccttggctttaagaagaagctagaaggaaggttgaaatcatttactgaaatgcccccagcagcaaaaagccgcttggtattttatttgcaacatkaaatttgttttttttttatttcatttccttcacagttggggagaacttaaaaaacagaggtaataagaacaataaaaatcatgcagagacgatcagagtggacaagtcctcagaggatgcctgtcctgtattgtatctgtattttaagaagaagtatgaaagttttactgatgtagtaattcccacgatacagagatttttatatataaacagcacctaaacgttggaatgaaagaagaaattagttactctgtcattcatgtaattagcttaaaactggggcagagaggagctgcaagacagtgaaagacacaggggaagaccatgcaatttggaatccaaagttggagattgatctagttagtgactgtgtgtcctcaggaaagcatatttgctbatgatgactcagattccccatctataaaacaaagatggtagtgcctgcttcccagagctgcttgagagatcaaagaaaaataatatggatgaaagtgttgttygctgtccatcctgcagaaatgtcaatttcacaagaaacttaaaagtcatcttctgtccatccgcgatgcattctgcttcttccagccccggccacctctgtcattggtcttctctgctcttgatgacctgcytcttgccccctccctaaggctccagccccttcctgttgtctgctggtccagacactgtgcgattcctgcccccctctatggcccactgcccccacactcagccaaatgtcacacagaatggccttttccatcttcccattcatccccatgtccctagaactacaaaattgagtgcagaaataaatgacctttgttcaagtgaatacagtgtgttgggctgaacttttccctgggactcagatgctgctcccttgtttgaggagttggagtgatagctccaagggaggccaaagctcttctattcagattactgcccagccaggcagacscagacagaaattttccttcaaccaagcaccacattgctccacattgctgttctccggcaatagactctcactttttcttccttattggctaaatggtcctctcaaaggtcacagttgctaagtatattgatygatagggtttttctgccccgcggggattacaacatggtaagcctagtgactgaacactgcacactgtccagttagaaggyagcagtcaaggaagacacagagatgggttttctgaagcatccccaccggctcctgctaacgggcacccttgccacaacccttggggacacaggacaggcacagtcccctctcttagtgctttagctctcattggcctgagtggttgtcattccggatagaggtcagtgacttctagcaacagcacaagtctagacagaacatttaaacaaaatatcatcaaactttggaattacaagtgacgtttttggtcatctagttcatttccctggctaatcttcagatatttttgaaaacattccctcaggagttgattcataactggggccaggagaatgtgctctcgtttgagatggtctgtttcctgagacagtcatgatgatggtaaaattattgcttgcattgggctgcccaggccggtgtagctccagccactgtgcattggtctgctctttctcactcaaatcatctctgtttctctaattgctccccatgggtggtgtgtcttactctcttgccatcctagatgttgtcccccaaatgcactgttgcttgtcaaactccatcttttgggaagcttttttgctatagtttccacttgtaatctcacccattaagcatataatagaccacaattggccccattatgtactttctaaaaattactttccctctatccaaaaaaaaaacagatgttaacagaaatcaagatattccagcaacccttgactcttgcaaagtgggagcattgtgttcagaaaaggttgctgtcatttgcccctctaagatgatcagagtcatttcactaaggctatagggcatagccctgtgtggcaaagagaaattccacaaaagaaagctgaagagtaagttcagaccctttttattttacaccattgttaaaaaatgaaaatatgtttgaaagatgcaatgcaatagcaacgtctttctttcttcatggacctcaaaaggaaagaattctgtgacttagatgaagcaacaaccccacagcatttgttacccacagaggtaagccaggactcagctttgtgctacaaaatccagaccatgtgcaagacggtcctgaaaggatatatggccccgaaagagagaaaagatgaaactccaacccgtgctttcattagatgggtaggtttaatccaataagagatcacggtcagggtgccatgttggcttggtctctaaatccatcaggatgtgccctttccacctcagttttccccacacaggatggtgatggtcactaaagttttgattccagtcctcatggagtcccgaagaaataaggcagggctcgtgacgtcctcgtacccttgttgtacacttgcagagggaaaggcaggatttgaactctggtcctctcaggtggatcttgtgtatgttctgctgctgtgtgctggggttcatttttcctgcaacatggttgtcaacagaccaagcacaaacacaagagacagaactgaagcgtggcagccgtcggaaaggtcatcaggttgtgaaggtgcccaaatactaaattttgacaaaaccatgaaaaattgaactttagcactgaatcccttaattctagtctagaaaatgccatctgcaatttgcaaaatacggcacagcttttgccacttcatcataagaattggagtacttaagtctaaataaattatatttggaagactaatgtactaatgaaggtttaagcatgaaatccaagcaggattaacaagctttgcgccatattaaaaatttgagrtcacttttatgtaacactcaagagctgggggctttctgctgagcattcttttattacttatgaaaaataataaaacctatgagaggttaatttgctcatattaatgttatctaaaagttgctgatattacaaaaccgaatgtaayggcaccgaaatatcactttgcatttcacttttatctggtatttcaattctgatatgctctggattgacactgggaagacccaaggtactgggggagaagaaggtgctgagtgcttcttggaaggrgctgaaatatttctgctttcaatgggacacagtcttggttctggtacacatttggtaggactaggtccagattccttggctcagagttatgacgttattagatatttcacacttttttgaagaaaatcaagtaaaatataaggatcataataatgtaagaaaagattattagatatttcattgtgttacataaacatttattaagtgtggacttagtttttagtgttcgtcacagaattcagtaatagattcttctgcagttacacggaaatcgccattgacatctccgtgtttggatttcaaaaccttctataatttactcacttttccatccattcatgacatatcagtgggtgcccattttgtggctctaggagaaaagatgtcacaggctcctgtggttgtactttggggaaagatgaagccatgactctttattactgtcatactcaaagcacttaggataatgtgtgggaacagaggagacatccaaaaaacatttatatgaattaagaattttattttagaagtgcggaygacatgttgacttatcagctatgccttcaaaaagcctgcacttcaccacttgccccagatggctgtttcacctgttctgcttttccaggaaggtgtgtaaatggcatggcaggaggtgaagctcacctgtctgcagtagccatcctgggactggggcgaggtgttttacaatgtgacgccctgctcgcacacgggtggtgttctagtgcagtggtccccaacccttctagcaccagggaccagttttgtggaagacactttttccatggaatggggttgagggggtggtttggggatgattcaagcttattacatttattatgcactttatttctattattattacgttgtaatatataatgaaataattatacaactcataatatgtagaatcagcgggagccctgagcttgttttcctgtaactagacggtcccatctgggggtgatgggaagcagtgacagatcaccaggccttagrttctcgtaaggaacatgcaacctagatccctcgcatgcacagttcacattagggttcaaactcttgtgagaatctagtgcttcttctgatctgacaggagttggagctctggcagtaatgtaagcaatgaggagtggctgtaaatacagatgaagcttcactcacctcctgctgtgtggcccagttcctaacaggccacggacaggtatcggtctgtggcccgggggtttgggacccctgttctagtggattgcacgcttgcgtgccaggaggcgggaaaattaactcttcttatgtttatgtaaatccccatagtcccgagaattagactgggggtcatccaagtagaagagacgctagggacgcaaaaccttctgctacactcctcaagcccacctccactgacctcacggatgtttatttctgccccaccatgatcaatatttgctttgaatccccgcagcaacttacatgaaatctgggctcttcacatcctggcacaggctctctctctctctcatgtgcctgataagtcctatacctccagtgacattttaaacttccccaaggcagaatctgctattttcatgcttttacgtcttttgtctacaaaggatactttgaaaagatcaagaatttaataaactttcattaaataagtgaacacatccagaagaaaaatttatagtgagtgttttttttgtttgtttgttttgctggacaaatcttggtccctggttaaggaaattccatttgtacgagactataaatgtgtttttagtcccttaatgttttttattagatgtctttatgtcttagatactgcaaataagtatgctgtgctgtgatagatatctggccctcaacatcagacttctgattgtaccacatactccctctacatgttcatgtttttggtatataattctgacaaggcatctcaaaggaaactcaccagccaccaggcagaggggcacctggcagcagggccgctgttacctggcgtgccatacgtcagtggttacttcctgggatgcactgcgttgccggtgctgtgtgagggtgaacttccatcttttatttgtttccctaatcatgtgctttacgtgtcttctgaaggatgtcctctgctaccatctgagaaacaaaggcattgtgtaggcagcagactaatggatgctgaccgggccatgcaattaaagaccccagaaatcatgtaatctcccggtggatctcagctccctccacaccaggaggggctcctgcggctattggtcggtccagaaggactgctgccaaaggcctgatcttctgactgtcaacagctggcttgcttgcagaagaagtggtgtaatgccagtgaaggcaaacacaaagctgcaattttaaccaactgagaaawggaggtggaatcccacagtatgcctctcttctgcctctctccttcctctgaaggttgttctttcattcgcttgtttcatttgtctttcactgcccaagacggcacctgacacttagcaggctcgtaattaatgtttcttgagtggctgggtggctgaatgtgtggatggctgggtgggtggacagatatgtacacagatactatacttatgaaatagtaataatcacaaattgagtaggacatggtatcatgtaatatatatcagtataactataaaactatcaatataattattgtaattattttgaggcattcataaagctatgatcaaaatccctgtgtaggcttggcgtgatggctcatgcctataatcccagcactttggaaaaccgagggtgttggatcacttgaggtcaggagttggaggtcagcctcgccaacatggtgaaaccccatctctactaaaaatacaaaaattagctgagcatggtggtatgtgcctgtagtcctagctactcaggaggctgaggcaagagaattgcttgaacccaggaggyggaggttgcagtgagccaagatcatgccactgcactccagcctgggcaacagagggagactgtgtctcaaaaaaaaaaaaaaaaatccctatgtagcacaagctgcttttatatctgctagattctttattagttatttatgttaatcagctagtataacattgtccatgaaatagcattgactgttgaaattatcaggctaaaagcaatatctgaactttcctccttcagacttgtacttcttcctcytctagaatgtgtgtggctgattgttaaataatgaaagtgtattagtataattgcagtaacgatggccctctctccagaagcacagtgccacggtgggaagtgaaaatcaacaaaataacaaatttggtgttcattaacttcctttctaagaagcttctttgtacgtgataaggttttgtaattgaagagggaaaaggayygataacttccaatgcaaaagcaaattaaaacttcataaatatttatctgaggaaaatrgggcacttctgctgcttggttttaaatccttgtgaaacaggtgctagacagacagacactggggcttatcttttttttagaaaaaataraagatgcatacttttggaattatcaagcttaccttttacagtcaggtttctcgtactgtcttcgtttaacatttcaatgctttttcatgagcatagcaataaacgttacatgccacccacgtacagagatcacatgaacacacgtgagtaccgaatcaacctcatggctcctgaggtcggttgctggggggcccctccagaatcacagagcctggctctcgagctcttgaatgcagaatactcggaaaggtcttccttgctgttgctcagaccttgacctctgcagtcagaaagctcggattcaaaccttaatycggctggttactaagcggatgaccttccggacattcttgatctgcgttcatcttcatgtataaatttggataytaatagtacctggggttgttggaagattaaaaactccttaatacagtgcctgggacatggccatcatcccaaataattactgttatttctgatgatattgtctgtattgtatcartattatatrgatgggtattgtatggaccttgtagcctaaataatagttttctttgaagaatacgttgggttttttgcattggtttattgtaaaaattgggaaagaccttctttgaaggcaaacaagaagacttaggagaagcattggtgtgcggtcaccacatccaggaagccgtccttagctctcactcccgtctctattctgcctgcctagtgacagccgactacttcctctttcaaccttgcrtgccatgcatgaactgctaccccagcatcaataactatttatttatactttcttacctcttgatcacccacacgagaccagaaggaccatggagtatgtgaaccatggtctaacccatgttggtttccccagtacccagcctggcatttatcggcactcagtgtttattgaattaattaacaaattaatccaagatcacctacataatgttgaacatagtcaaaagacaggcaggtagtacctgtggctgagtaacattttttagcatccaaaaggtatgacccatttttcttcacaagggcaaaacagttctaaattgcatgaactttctctctagaattgactttgttttatcagagtggccattaccactcttggtggaagaaatagaaatttggttctgaccaatcagaccagctcattttgagcccaatgtgtaaagaaagtggtgccgattgattgtatcctgtgggatgacttgattgcaaacacaagaagccagaattgaaacagactgaaagcacagttacctgcagcggctctaatgctaactacagaggtgccagagcaaacagcagagggggaagaggagcagctaacccgcttcacttaaccaatatttacgaaaactttgggcacagctgatgggagattcccacacactccgcttttgttcatgaaataaactacagtcacgttgatagggactgcttgagtgcttgagtggatattttctttttcttcttttttttttctttctttttttaagataagagtctcactgtgttgcccaagctggagtgcagtggcacaatcttggctcaccgcagcctccgcctcctgggttcaagcaattctcctgcctcagcctctcgagtagctggggttataggcatgcaccaccacacctggctaatttttgtatttttaatagagatggggtttcaccacgttggccaggctggtcttgaactcctgacctcaggtgaaccacccacctcggcctcctaaagtgctgggattacaggcgtgagccactgcgcccggcctgcttgagtggattttgacagctgtgtgttatgttttcccattcacatgcaatggagacatttgctcgtttacttttctacaaagtacctccaagagcattttgtgaagagttttggtttcatctttttgtctcctttgattttttttctctctgaagcctgtttctgttgtgttctagtactttcaatctcattaaagaaagagtaagaaataaacaattatttttacaagcatacaaagaaatwtattgctcttttatatgaaagagagtttgacaatttgtgtaatgtttcaattgctacttataaaactatctgaaagatgtttatccaaaaaaaaaaaaaaaaaaaaaaaagatgtcctccaatgaggactaaggtaagccaaaaaggaaatataagtatttctcgattttcctacctgttttattaatttgagtttaaggtgcaaaattctctttataaaaaatgtgacttgaagaacacatgtgtcacaaaccaaattcctctggtaagaagctttgtaactacaatatggggatttttttttttgactgtttgagaccatgtttattctctacataagagaatagttcccatttatatagaagggagtttttaaatgactgtgatgattgactttgtctaatgtagatgctaagatattgacacagccattttcacatcaacaatcacataaataaaacacaaaactttcccggttactgttttaaaaaattccaaaattgagttagagrctaacattttattcagaattgaggttaataaactaagttaaatgagcgcatggagattcttccctaatgaagctgaacaaagatgccagaggcttgagtgacacgttgctcgctccagctacctccattcaaatgcaaagccttcctttctttttggccaaaagcctgatagtgaagaaggacttcagccgcagttaattcccattctttgttgcaatgtaagaaagcaggggcaactcttgattgtattatttaactttatcttgaattcactgcattggattcatttttttgttgttgttcatttgccgatttgtatcygcattcttccctgggctttcttcccacattcttaaaccaaaatgttgtttacttttgtcttttaaataaccaaaaccaagcaaaacaaaatctatycctatcatcgtcacaaatcttcagtaggaaaccttgaaactgattctggagtcagactgatttaggtcccagtctggtatctctaatttattagctgtgtggtcttaagctatgtaatctctttgtgtcttagttgtctgttccacaaaatggtcagattcatgagaccttctaagtctttttaagtactaaatgagagagtgcttattaaatattagcatgacacataggggttccataaacggtggccgtcatcattattctgtaattatcagtgtttcacatctcactggcatcaaatctcctgtttctcatctcattgctttttttttttccatttacaatctaatgttatcttctrttttcctcctgrtaaagtaattgtccatttttcttagtcttttcttgacaacctggcctctcctttcataaaaggctctaataagcatttcctatagcacacctgcagccatgtacagccataaatgaataataccaagtgtattatgaccaggaaaccgtgtgtgtgtgcgtgtgtgtgtgctctcttcttttttcttttttttttcttctgttctttgctcttttcttttcctttttttttcttttcttttctgtttttttttgttctcttttgtctttttgtttttgctttttgtttttttttttccttttttttctttttttttcctttttgttttttttctcggttcttgcttcgtttctttttcgtgttctgtttcggtgcttcctctctgctttgccttctgtctgtcctcctctttggtcttgcttttcttactcctctcgcgtccgctctgtttccgcctctcttctcgtcttttcttccttccttgctttcttgctcttagcctctcgcctcttgaccttttttttcactcttgcttcgttcgcgctgtctcgtccatagctccgtacttacgagtctttctagctttcttctgttgtgttgggctgtccccgtgtctctcgctctcgctttgcctttcgccgtgtttggtctcttggcttcttcttcctccctctgccgcctcctcaacttcttctaccgcttcacgtctcaaccctcccgctcccctcggcttctctcgcctccagaccgacccgccgatcgtccttccttctctttccaggccgtgttagcttgctttgcttgtctaccagtacctccgctcctattatgcattctagcctcttgttttcacttcctattgtcttcctattctcgtcttctcctcgtcatcactcaccctgcctggagccgttggtcgacgcgcannnnnnnnnnnnnnnnnnnnacactcctgcttaaaaaggtgacccaatgacagattcactatggctgtatacaaacagggcagctctttttcaaatgaagggagcccttttctgaaagttcaggagtcccagttgccaatttctctccatgctttttctctctctcaggcttcggcagtaaacccttagagggaagctcctgcagtccccagacatcacgtggaagagtcacctgacatttaaccacacacgtctccacgctttgggagacaatgagagattttgttcagagccgttaggaattaagtttttatttgaatttattttttaaggtcattatttttaggctaaaagagtatcatattttagttacactgttgcttcctatgccactgaaacaaaagaattgtattactctgtgaaatacaaataatatgggatgtacttgatttaactatttacgtattctgagcacaagatagactatgccctagatgagtgattcagagttcttgcaatggcaatgtcttgccatttctggttttatatttcctctcctcgaaatgtgtcttaaatttcacctagtgtctttatttaaaatgacggtaaactctatttcatatcacctataaatgaataccctaggaggcctcatgataacgcatcccaccctgaaggatcccaaagccagcattttgaatcatggccttggccgagagcagtgtttaccctcttggtgagctgtgagctctttgagccaaaggccgcaggaccagagaaggccttgaacgcatgttaattcatggtatgttttccatcagagtccctgagaatattctttacttgggatcgttctgcagttgttatgtgtgctcagtaacttcccggaactcagtgcctgatctcttttgttttattagcctcctggttctctgaccccctgaggatcgcagtgacctgactctcttggaacagatctttctctgtggtgtgcagggtgagggcgaggcagcctttctttatgctgagctagcacacacacaatgttgatttccatcacacagcttcagggagagaccttacgagacccatatttccaaaagaggggaacagcagatcacacctgcctctggggcttaaatgctgactgggctctcttgcatgaggcttgaacccccagggaagtccagagtggtaagggagagcctttcccctccttccaagagcagcttgcagggcagccaccggctgggcttgttttgcaaagtgcagtggaagcccctgctcttctgggcattccgatggaacgagcagactctttcccaactgcccccagcacgacacttacgtggcacccacatcacatcacgtccctctctcgccactcgaatgaaacgactaggttatgcttcagaactccttgtaccrttcctcgattgtttttgatgagagaaaaaaatgtagggcatgtataggcagtttccaaagcaagtcatgtacacagaaaaaggaaaatcgacttgatgctgtgttttttggcactcaccactgactgttttagaaacatatgtttaaaataaaacctgtagaagtctcgtcttggtgttccaatggttttgcctgttttgagttttattttccgagcaattgttattgttatgagtaaataataataatattttgtaaggttgccccgccagcaggcaggccattgtggaggtgagttgcaactcctggcacctggctgtgtggcccagtggcctccacgcacactggtcttccggtgctgtgtgtttctctyggcagcgttcttcgcttatttgtaaatacaccacctcctcgtgtgtgctgtgctgttcagcttggctgcaggtccttgtgaagccattgtttctggctcttctcgcaggattctggctctgaaggtggtcccaaggaaatagcagacaaactcaaaattgttttaataaaaatgggtggccgggcgcggtggctcatgcctgtaatcccagcactttgggaggccgaggtggrcggatcacgaggtcaggagatcgagaccatcctggctaacacrgtgaaaccccgtccctactaaaaatgcaaacaaaaaattagccgggcgtggtggcaggtgcctgtagtcccagctactcgggaggctgaggcaggagaatggcgtgaacccggaaggcggagcttgcagtgagccgagatcaagccactgcactccagcctgggtgacagagtgagactcagtctcaaaaaaaaaaaaagggggggtgaggactgtggtcctcaaatatgtcattatcataggagataaaagcagtggaaatgtctcattccaagagactaagggtagtgagtatagggtaaagggcacggggagatggaatatcctaaaatcatcttgtggtagatggtggcaccaccctgaatagggtaaaaaacatgcaattgtacatcttcagtgtgccagttgtctggtacgggaatagtgtcttaaagttgttaataaaaatatagggaaaatggacacgacaccctaatgcaagccccggccctgaactcggcctgggaggaggaaagacatgccgcaaagctcacagctgggtcagggacagccttgagtgtggctgagaagcgaggaactgcctggatgtgacatttgccracttggatagccgggccatgatgcgtaggagaatatctgcttataggaaatatgcaatgaagtatttggtgggaaagggccatggtgtatatcacttatcctcagatggtttagcaaaaacwctstgtgtgtttgtaaagattgggaggygggcagtggggggaagggggaggaggggaacaacgtataaagcaaatggaataaaatatcgtcccagctactcaggaggctgaggcaggagaatggcttgaaaccgggaggcgggaggttgcagtgagccaagatcactccagcctggtgacagagtgagactctatctcaaaaaaaaaaaaaaaaaaaaaaaaaaaatcaacaacagatgaatctggataaaaggtgtataggcatatatatgttgtttgtatgatttttatttttgcaatttttctgtaagtttgaaattatttccaaatattaatgctctttaaaaaaaaatgcccattcctagcccccagacccctgcgatgctgactcccttggcctgaggtggtttctgacaccaaggtcccagaccggcctgagaaattctctggagttggggcctctggtctcggggccccaggcagactctgctatactcctcaggaagattttccaaaccacaaaagagactgaattagcattgtgatttttcacacttttgttcctccattgactttaaaacttgcgctctgaaacttaaaaaaaaaatctatattcaaaagaagaggaaatagtatattaatccctcctacataccagcagttctcaactgagggtgattttgccccacagaggacagttggctgtgtctggggacagttttggttgggagagagttaccrgcatcttgggggtggaggccagggatattgctaaacaccctccattacacaggacagccccccagcacagaatcatctgcaccgattgtcagctgagctgaggttgagaagcccagattcagccggtgttaagattcgccgcgtttgctgtttctgtggttctcccctttctgaggtcacctcaaacagacttcatgccattgcycctcttaacacttcaatttgtgtttttattattattatactttaagttctggggtacatgtgcagaacgtgcaggttcgttacataggtatacacgtgccatggtggtttgctgcacccatcaactcatcatctacattaggtatttatcctaatgctatccctcccctagcctcccaccctgtgacaggccccagtgtgtgatgttcacctccctatgtccatgtgttctcattgttcaactcccacttatgagtgagaacatgtggtgtgggttttctgttcttgtgttagtttgctaagaatgatggtttctagcttcatccatgtccccacaaaggacatgagctcawccttttttatggctgcatagtattccatggtgtatatgtgccacattttctttatccagtctatcattgatgggcatttgggttggttccaagtctttgctattgtgaacaatgctgcagtaaacatacgtgtgcatgtgtctttatagtagaatgatttataatcctttgggtatatacccagtaatgggattgctgggtcaaatggcattkctggttctagatccttgaggaatcgccacacttttcttctacaatggttgaactaatttacactcccaccaacagtgtaaaagcattcctatttctccacatcctctccagcatctgttgtttcctgactttttaatgattgccattctaactggcatgagatggtatctcatcatggttttgatttgcatttctctaatgatcagtgatgatgagcttttttttgtatgtttgttggcaacataaatgtcttcttttgagaaatatctgttcatatccttcgcccactttttgatggggttgtttttttcttgtaaattttaaaataacacaccgtgccattgttacacccaagaaaattagtaatgattcctcaggaccctctaataaccagagtctgaagttccaggtcaaacaatgctctgacccattgagaactgaaatgtgattgtttaattttggaaatctcagcctttatgggaaagataaagaacagtaactccacattttatctactttctggttggatccattgcctcagtctttgagtgtacaggagtgcacttaatacataattgttttctgaccccaagaagtgttgattaattcagtaagtttggagatcataatagtattttttaaaatgaaacttttaggagggattactgaggctgatcattataaattacatcttttagtcattaaattgggcctccctcctcctcaacrtattagctatttttttccccagacacatggaaagctttcagcttctaatgaagaactcctttctggagcatgtttctagaatatgagtttagcagcacacatgatgtcatcctaattcccaactttgcgtgcaagattgttgtgtgaaaatgaaaccataaatcccatctgaattctacttgctgggtccttttacaggaagtattcttctgttttccttttctaaagaaaccacaacagtgtcatctgagtaacagatccacgactgggaagccagaaatactggaagcatgttcatctttttctggccaaagcccatccagagaagtgaagtcatgttttgggatgggtgcattgagtaggtatctggttttgtcccatacgcaagacaccgtggagacttagcggtgaacaagccacaaggaaaaggtgctaactctagcctagtgctgtaagattgcttgttgcctaatgccagcagctttttaaaaatgcaatccaagtaagtaatacrttagaatgcctggacagcaaatgaactctaaagatttcataaatgtaatgaattactgcttcaatcaaatatgaaccaactaaccacccctgccacggttttttaagtaattttacaatttgagaccatgatgcttattaaagatctctatttttcatgacccagggtaatattttgtcgtgtattgcattacttaattaaatmaacaaggtaattcataagaattaccctgcctagccgaagcataatgaaagcmgcmtaaaatattcccaaccatcattctgactraactatttaagcgcttatggaaaattagctgttagaattagccaaactcttttgtaacctaggaggctggaattgaataagaaattaaggcactggggaaaatgtcmatttacccttggagagtccatatggaggaagcaaatagttcaaaggcccagctgtaagaatattgattgrtgtggcctttatcctggagagaaatccatcaatgaatggcccactgtcactgacatctgtcctttggttcttctctagggttctcgacagcmttagatcttaatgyaaaatgctcccagttttgtattgttttgttttgttttttgaagcccagttgctgatcagatagtaaatcaactaagcacttggagaatcgttactgggaaacagaaatattcagcatgggtattacaagtacttcttgttgtagtttctttaaaacaaagaaaacagaagactacttcatataaagaacccaacagcgagaattcagatgggattaatggttttattttacaattttatattttacaatccttccttgtcccagacacggtgcttttctaacagctctgttgcaggcagtggtgtctgcatggggctggcacaacccayggctttttttggatcctcctgactcagcctaggggattggagcaggcaaactcagtgggccttcgcagaaaagagggtgtgctttaactgattatgcctctgtacacctgggttcacacacagggactccccccccgccctctttttttttttaaaggaaaaacacatccatttcaaaatccaggcacatttcatggtagcctcagcaagaggaattgaaccgctccgtgggccaatttagaacacttcagaaagtgaaggtcctcttcsccgccccgratccctgctggtgtctgtctcctggccacgatggtayggaaatttgcagagcatgaccctctctgagcaagcagagaggagcaaatttgatctaacacacattctacgggtttggttcaatgtaggtcaatttttaagagagctcagctggccagtctgcaagtctgccagggagctggctggctggctggcttccgccacggccaagaaaatccccttctgcctcaaagcaccaattaatacaagttcttcaccgagctgggtgggtaaaggaaacrggctgaaatgcatmcagctttctgtgaaaccacttacraggtcatcagccccratatcttgcaggaccccctgctttgggctaggcggaagatgccaatctacatcagaagactctgagataccagctggtgtgaggaggggacaygcatacaccaggtcattttatttttaaagtgtaaagctgtgtgtccaaggagtcaaaggtatttggttcaatggttccaaataagtcggctgaacttttttttaattctggaagttaaggaaatgccatttgaagatgtatcttgtaaagtatattttctattctaccttatgaactaaaaamcagatatattttaggtggtagaacttctaaggatcaacgtgtcttttaccagtcagtgttttgtgggattgggtggtgttggtggttttattttattttattttttttagagtagaaagaastcctcatatcctaaaatagcagcaagtcaataatgattctattatgtatgagtgcttttgccatatttttctcattctcagttattccattcattctacaagtgtttattgagcatctactaagttccagacattaatgtaagggctggggagggacccagacagactctgccctaatgggggaaacatacctcaaatgacagagcaaataaatgagaaatggcactatgtgctcaaggaacagggcagaaccttgcgagagcagcgaacaaggagaaccgcatttaggaaggggcaggcagggaagattgctgcagatactgtcattttggatgggrgttactaagagttggcgaggcagagaaagtgggaagaatgttccagaccaagataagaagggtggtggacttgggaaaccaaagsgaggccacagagcctaagtgggatgaattgagcaggtagagggggtgggcctggtccmcactaaggaatgtgttttttgctttttgggttttttttcgagacggagtcccactctgtggcccaggctggagtgcactggtgcgatctcggctcactacaatctctgcctctcggattcacacaaatctcctgcctcagcttcctgagtagctgggattacaggcacgtgccaccatacccggctaatttttgtattgttagtagagatggagtttcaccatgttggccaggctggtctcgaactcctgacctcaagtgatccgcccgcctcagcctcccaaagtgctaggattcccgtgtgagccaccgcgcctggccgtgcgctaaggaattagaattctgctctgggttctgtaaggagcagtgcagtgttttaagtggagaagtgacatgatccgttttcgttttaaaaacttcacactggctggtgtatgaaaaacagacctaaatgtttcaagagtgaaaacaggagtctggctaatctattatggaaggttaggtgaggggaaatggtggctgggaccggagaaatggtaggtgagacgaatggaagccagcggacttattaataataataattgcttccatttgctgagtacataatatgggttyggcatgtttatcatctatagcatatattaacttcccatatagtgtccctgtgaggcaggcactatcattctcattttatatgaggaaaytccagcatgaggtcggatttcatrttcaaagtcataaaagaagaaaatggcagaatgagatttgttcttccactgttgctrtactactgctrgagatatattttgaaggtagwttggtcytcttgtccacattttattactgagaaatgtatcagcccaracattctgcagatactgactgaaagtctttcggatccaggaactggcctcagaagtgagtaagaaagaccccatcagttagcccagctgaaaaggcacctctctccacttgaatatttttgtacatgaggttcagttaatcagttaggtaaatacattccttaaaataatcaaccaagaattttctgggacaggaagggagaaaggtatgctttcctatccaacatgcatgtgrccaagggctgggtgtaagatatgttagcatgtgacaacccaagcccattgccgctgtaagagtgtgtggccttgaacacatttcttaacacttctgagcctcaattcctatatctataaaatggccatataccaactcatagtgtcattataaagatttaaagactcaccagttgtcacrtgtcctcccacatcatagaccatgtggatgcttaatgagcagtggctaataaataccacttgcagtccagggcaagaagggcaattagaaaatgaattcgaggttcactttgcttctagtctatagactatttgcgggtggtatgtggcactaatgwatataaatgrgtttgatcgttcactcgcattattgaatatttcatgcacctttacgcatggaatagtatgaactgatacacataaaatgactaaggtgattattctccacactagaggcaaacagaatcctgatttatgcagttcctcgttgttcctttcagttttgacccatggcaataagtgggaaatagattcacccaactcactccaaattctttataatttctttcaaagacagagattgctacattaagtatagttgtccctttaaaggaatatgggcagaaaaggcaaaagtcagattaaggggaaatagaagttgtataagtatagcaataagagctctgaagtcaaaatgcctacacagtgccagctgtgtgaccccggcaaagttgcctaacctctctttgcctccagtgtctcatatacaaataagtacctacctgccaaaattgttgtaaaagttaaatttaaaaatacacgtaaagtgcctttgcttaggaggagctcaaatgaacgttagtgactgatgctacttagtgactgatgctgttgctactgttacagccaactcttgttttctgaaaggaagaaggaaaattttgaagtttaagagaaatgactgttttacctgtgttggtagaaacgtttgaagaatgcaacgtaagctgacctactaaatctacccttgcgattcaktctgagagaagtgggcgtggggctttactgtcagtggaagtaatcgtttatcaggtttacaacttttcccctgtatctgaggccctatttttttgttcttaaaattgtgctactgaaacttgatagatctyatactaggaaggcaatcatgacacattaaaaacagcctgaggccgggcatgatggctcatgcctttgggaggtcgaggcgggcggatcacaaggtcaagagatggagaccatcctggccaatatggtgaaaccccatctctactaaaaatacaaaaattacctgggtgtggtggcacatgcctgtagtctcagctacgcgggaggctggggcaggagaatcacttaaaccgggaggtggaggttgcagtgagccgagatctcgcgccactgcactccagcctggtgataaaacgagactccgtctcaaaaaaaacaaaaaacaaaaaaaaagaaacctgcctgaaatggtatgtaagtcctcatccaagacttgcaaactgtatctagtcatttgaaaggggagaaaacagcccaaagccttaagactgagtctcatgccagctggagagctgcaaaggtggaaacccatcagtttccacctgctcatacatttcagccagtkgacaagtcagccctcctgttcttatagagacctccactgagtctgcagcagtccaaaaggctgtctgtgaactcttcgctcatgaacagataggctcatctgaacagtcccaaaagrcaatcataacagcatgtctcagtgtgtcacatgattggacccaaaattctgtgtatttgtgacttatagtgaagcagtatattaagaagttattttgcaggaaactttgttgtcccctacagcttccaaaatgctgtatcagcagttttmtttaatatagtttgtgaaactaaatgagaaagagctgggcaaaggaagctttttttattccaggggaaaacaaaagttgttttgatcattttgaatcttttagtaaatggagaataacaaaagaaaaatggaatgtacgtgctccattgttcttacagatgtacagtttaaatagttaggatcccaaaatactgaaattatatccaaaaataatttggattttgtaacaaaattgaattgcgtgtgaagagaaatagcgtagcaccgttttcaagtgtctcttccaacatggaggaaaaaatatttcagaaaaatacggaatttggtttgttgctgcttatttttcagaccgtcagaaccatatgctgatgctgcytcctgggaaggcagtgtccaccagtggttaggaacaggtggtctttggagctaaatagagtcaagtttastctccagggctcagctgtgtggctttggacaagtcacttaacctctctgagtgcttcctcttccttatcaagcaggcaattacagtccttaccctgcagagtctctttcaagataaagtaaggaagtrcgtatcaaaagcgaatgcccccggctgggcaccgtggctcacgcctgtaatcccagcactttgggaggctgagataggtgtcaggagttcaagaccagtctggccaacatggcgaaaccccatctgtactaaaactacggaaaattaaccaggcgtaatggtgtgtgcctgtaatcccagctactcaggaggctgaggcaggagaattgcctgagcttgggaggtagatgtcgcagtgagcygggatcgcaccactgcactccagcctgggtgacagagagagactcagtctcaaaaaaaaaagtgaatgccccaaggcctgacaccctgtgagcaaacaatgaacaggggcaggaggaagatggcaagatgatgagggcaaggcattgagggtggtggccgcgatgctttgctttcattctttaagatgagaacccagaccatgagttctttaccaggctgtgataacttgtgccataaaaaagaagcataaatatttgcaaagacaaggttctgaaagaagtttgagcaaagttgagatgtgagaaataccagatgtcttcgatacttctttttcatttttctcctcttattttatacctcagtatactggttttacagagaatctttcaactgtctgatcttttcataaaatagtccagaaaagccaatgatagcagcatgaagatcttcatgattccagctagtctagagtttctgctgaaaaccagagtgagtgttttcagaggatgcagggtccggtctgggtgcataccgtttgccttccagatcttttctctatatttatttacctgtgattgtggaatggacagttttcattaaaggatatcattttagtaacttggaaaatcctgatcatgatttttaattatgatctttattcggtgctatgttttgttaaagctcttggcccttagtcccacatatgaaagtatttgtagctgtatttccacattctaataaaagaaatccattacccaaatttacatatgaatgattttgtaatttgtggaatgatgacatgataaagtaaatcttcagcaaaaaactcggttggatgctttgttcgaataccaaatggatccaccaggaagaagaaatcactgaagcctacattgcctggcatgatttaattgcaaagagtatctatactgcctgctggtgttaattgacaaacaagaactgtcttgtgacactttggcatggcatgaatatgctgtacagaataattaaaccctccaacaatacgtatggtcttcaaagaaataataggaaaaagttgacatgtcatcaatgagttttttcgtattctaagtaattgatgccaatctcttacttttctttccctgtttccctcatttaagcagtttgaaattgataacatgttgtcagcattgaactggatgacyggagaacattcagaattcttgaaataatgaaggaatgaatgagattgtccccaccccataccccctgtatgatcagtgtaagcaatttgaagcatatttcttttatttttaattgatccaactagttctgacacattctatccagattgggttgcgtttctatgataatgattcagtttctcattcgtttatttaygaagcacttcttctatgctaggcattrtgctaggtttagaggtgttgtttctgctttttagctcaacccagtgtgggaggaagacaagtaaacaagaaataaggccgaatagggaaagtcttgttacagaatcctggcagaacacaagagaaaggctgattcacttctggggccggggggtttctttcagctctcccatgctttggagtgtaacatatgttatcttaatgaaatccatctcattcaaactgtgtaactaaattatataagggtaaagttaaagttggataatttcaatattgatctkaaagcaatwtggaggtcattcatgttttgagtcaatactcaaatcatttcagaaatgcaggacattttatcaggaagaactttacctacatggtaatattttcatgcaaattctaaatactcgttttcagccagtatgtccaaagattttgaaatcagaaaatacagtactyggccaaaaaggatgggagtctacttgtcctctctaaatgagggtggacaccatgtgtctccaaaccgtaggagtcacctgctcccatgacgtgtccaagaaagagaacagctctcagcactgagcatggctggattaggacattcttgcgttgctatgaagaaatacctgagacttggtaatttayaaagaaraaaggtttcattggctcacggttctgcaggctttacaggaagcatagcatcggcatctgctcagcttctggggaagcctcagaaagcttgcagtcatggtggaaggtgcagtggaaacatgtacctcgtatgatgaaagcgggagaaagtgagaggaaggrgtgggaggaggaggtgccacatgcttttaattgaccagatcttgcaaaaactcattctyacgaagacagcaccaagccatcaaggatccgcccccacaatccaaacacctcctaccagaccccacctccagctttggggattacaattcaatgtgagatttgagtggggacaagtatctaaactacatccatggctaagactgaactcatgtctcttctctcctttatgagtgacccatctctgttgacatcacgcaagagtcctcagtctgttacrcagttcctgattctgggcccccctgaatttcccatccagttgtgtcctggcctggtgctctgtatggacgctcacaccagcctccttgctaaccttcctggagcctgtwtttttctctttcccctccaagtctcatytgtgtggctgtcagaaccacctgtggctctgaagcttgtgtctgctcaggtcccttccgtgtttggcggctctgcatggcacaggataaagtcagcagcattgggcagcatgtaggttctgtccccagcctgcctgtctcagcagcagcgggtctccctgcctcaggccctgcrccctgaccacctggcatccgtgtcatttcccctcccctctgcgcgttgcccgctagcatgctgtttctgcacccccatgcctttgaggatgcagtcccctctcgctggaatgctctcctccccatttcccattcctctcctcaccttttccccaccagcscagctcattcttccccatctttcccrgctcccttgggcaccccctccccaggctgacttctgggttggaagcctttcctggggctccagcagtgctttgggcgtgtccctgtcatggagccctgaccactctgggtctgtgtcmttcagcagtggggcctcctggagcatcttattcccattgtgcagcatgctagatattgtttaaatgagagaatatttaggtgtcacgtgtcatcccacaacaaacggcaaatagcaaaatcaactcctggcacagttaaaatgcattttacttcctggtattgagagaagcagagtgccttgttagatcrcctaatctaataagcagagaaaaagaatgttctcatgaaattatgcattcaccttctgttttcatttgctgacgtaagatagtccatctaattggattttctctttggggaaatctgcaggctccaaggccattgctgtcacatttccaatactgccattgtccatccaccccccttagttctctccaggggactttgactcccggccccttttaaattaggcacacatcttakaaaacctccatccagcgccttctcagtttcatccatgctccctggcaagtcatggtgctggagaaagatgtgggacgtgtatcacccaggaaggagcagaaagcccgaagcaaaaggggcagtgcctgcygcatgctcctcaaattcacttattctttcacgtattcatctgctcaacatgtaatgtattcagcacttagcacagcacctgcagcaracactccgtcaatattgcttgaccatcctgtaaggtctggtagcgccacrcagtggttaagagcacaaattctaaagcaaaaccacccggacactgtcatggatggcatgaccttgggcaggtcatttgaccctgctgtgtcttggtttcctcttttaaatagggattaaaaaaataatatccatgggccagataatatatggattaaatgagatatcaggggctcagcacagtacctggaccagggtgtgtttagcagctattaatgcttacagccaggaggaggtgcaggctctctgcagggctggaagtgagggaatacagcgatgacmwaggagccctcctgtggctcacattcttgaaggtagagataaataagtaaggagacgcataaacaaaataggaataccaggcagaaaaccaaaggaggactgcratgggggctaatagtggtgatggggctgctttagataagagatcaggaaaggaccctctggrgagacaacactraaaccaagagcagaaggatgaaaaggtgctggctacatgaaaagccatgtaaagaatgttccagacaygggcacagcaggtgcaatggccctcagagggagaggatctggaatgttctagaaccaaccagaggccagtgttggctagagtagcatgagctagaggraaaagtgagcacagtgtggtggcagggtgggcagcatgaggttgcaagcacctcggaggccatcgggaggcgttgggatttcaccccagggccaacaagaagacactaaagagttttagcagggacagcagcatgatctccaagcaggacctgaggaagtcagagcagggagcaggggcacacaaagccctgcatggtgggttcattcccaagggtgtggagcgcatgacacctggagtcttggctgcagaarcacagattcctggaagggagagctgggaaggagttccgatatcaggtcatattgcttctctccatctctcattcaaacccctgaaagaaaaccaaggaagctgcctgtttttccagctcatagcactggggctgatcaacagaaagcccatcttcagtttggggcttttttttggagaggggggagttggtatttatttaggtatttagctatttaaatggacatatcattgcgtgtttttgttgggcacaccatgttgttttgaaggagatagttgaatctagctaataaacaaatgtattacctcccagttaccatttttgtggtgagcgcacgtaacattcacygcctgcattttgcaagactctgttgtatgctgagcatgaatytttgctggctttcctcctgttcctgtcttccccttccccttcccctctcttgtcttcaaaatatcttgagaagatacaatgtacacaagtggtatgactgcatcttatctgtaaatcaacatttcttttccagactgcataagaaaaactcgaaaaggaacatatcatttagtgcctcagcagcagtgggacatggtcagggctgtaagcacaagcccctgttccactctccttagacaagagaagacataacacagtgcttaagaactytccagagctccaagcatgactgtggttgtatttctgcttagctccaatgacacttggatgatgatgaggagcagtgggtagttttagggctttgtattgctgttctgagtcacatttcaaaaccttctaattaattttactgctgtttaaccctaaaattactctgtcctccagtttgctgacagttgtctatcaaaagctcgttttctctaatccccagctttcctgrtggacttttctctccctcatacgtaaaatgacttttctccttggccatctgtccaaaccagctttcagttaagcctggtcagaagccttcgaatgatgtatctttgttctacaaatgtctgcacccatcactccccttaatattaggtatctatataccttgttcattcaaataagatttcaacattgttaagacctgaattgctaaaatattaataaaggatgtgatagaagtacaagtacatagtaaataatataygtaataattaatataacttaatmtacattaaattcttcctttcctttctctgtaatatttaagctggtcaagtgtgctccttttttttttttttttttttttttttttttgatggagtctcgctctgttgcccaggctggagtgcagtggcatgatctcggctcactgcaagctctgcctcccaggttcacgccattctcctgcctcagcctcctgagtagttgggaccacaggcacccaccaccrtgcccggctaatttttttgtatttttagtagagacggggtttcaccgtattagccagratggtctcgatctcctgacctcgtgatctgcccgccttggcctcccaaagtgctgggattacaggcgtgagccactgtgcccagcygtgtgctcttttttaagactattgaggccactatgggttctggctcagtagagaataggctgtgtgcatccttagctgcatcttccatgctctgtgcatcccccctccatgctctgtgcatcctccccaccatgctctgtgcatcctctccccatgctctgcgcaccctccccaccgtgctctgtgcatctactccccgtgctctgcgcwtcctccccaccgtgctgtgtgcatccccactccatgctctgctcatcctcccacccgtgctctgtgcatccccacccccatgctctgcgaatcctccccaccatgctctgtgcatcctctccctgtgctctgtgcatcctctccctgtgctctgtgcatcccccaatccatgctctgtgcatccccgccccatgctctctgcatcctccccgcctctgctctctgcatccccaccccgggctctgtgcatccctgccccatgctctgtgcatcctctctccatgctctgtgcatcctccccgtgctctgtgcatcctctctccgtgctctgtgcatcctctccccatgctctgtgcattctctccccgtgctcttgcatcctccccgtgctccgtgcatcctctctccgtgctctgtgcatcctctccccatgctctgtgcatcttcccatgctctgtgcatccctcatgctctgtgcatcctcccctccatgctctgtgcctctccctgtgctctgtgcatcctccctgtgctctgtgcatcctctccccgtgctctgtgcatcctcccctccatgctctgtgcctccccctgtgctctgtgcctcctctcccggtgcyctgtgcatyctctccctgtgctctgtgctttctcccgtgctgtgtgcattaccccgtgctctgcacattgtcctgtgttgtgtgtatccctctgtgctctgcatccttctgcctgttcctctgcagcttcrcccatgtcccctctcarccccatccctccagttattcccctcaagtccccrtctctggttttcacatcccgcctctctgcttccctttggaactgtgctgtggaamattcgttcacctcgcctgtcaccttgacctgggctcacctgctgcatctccattgtcaaggtcaccagactcctccaccmtcctggagctctctrcctrtgactaaggactaccccttcttcacactcttctcttcagggccctgtcaccttcccactgccttgcctgctctccttcccctcttcctctcctttgctcrtgactgcgtgacagggccagggtgccctrtgaatgagcctgcccaggcagcccctctggcagctcagaggaggtgagcttagaagacaggggtttcagagctcaacgctgccaaggagggcaactttctctggcacgacatgtgcactgctgaggagagtgaggggcagcacttgggaggcccacgtgcctttgccagtgagtgtgagggcccgtctgtgttttatgttttccgcacmctctctcaaacactmgctrttaagtagactgcagcggagacctgccatyggggtctaactgatttaagccaggcatatcctcaacatattgcaatccatgtaaaacaagragctgactctcagttctgaacttggctgggagcaggtctaagaactctgactgtgtaaggaagtgcttctcatctctgacatttgcatattcccgctgcttttccttccctgccatactgatcaggactctggttgcaaaacccagctccagccagcgtaggcagaagagagggacttatgaggaggaggagaggcggagcaggccccatgggcaacaggtccatctccctctccctgccttttgtccctgcctgagggtgacagctttgttctctctgactagctttctcctgaagtaagggaccaggatggaggtgstggccacattctcagagccttgagaacagagaagaaagacgtcatccccagacatcccagctcaacatgctgtagggaagatttgtgatgggcttagcttgggtcacatgttcatctctggatcaagagtggaggagcacccccccacacacacacacacaaaaccaaacggtgtgaagagtggagagtgtcttcctctgaagacaggaaagggcaggcagcaccttcaccatccacaaagttcagtatttaaagcaactcttgactccctgttgtccagacacagaaaacccaggttctgtttagagcctttctctgtcttccaccagcccagctccccagactccaggcctttcaggccctgaccttgacattatctgccaggatttcccctctccttccaccctgtcctgggcctggccgactcctgctccatcrttagggcccagtagttgtcggatccctacgcaaagcctttcccttgcaggatgctccacccaaagcacatccacgcacccagaagtgttactgctggaggatgtccaggttcttggtgttttgaacaaagaattggacaaaatgcacaaacaaaacaaggaaagaatgaagcaacagaagcagagatttattgaaaatgaaattacgctcctcagggtgtgagggggcccaagcataggtgctcaagatccccgttacagaattttctgggatttaaataccctctagaggtttccrttggttacttcgtgtgcgccctatgtaaatgaaggggatgaggtaaagttacaaagtcatttaatcgctgtacgccctatgtaaatggagaggatatttcctgtcatagctgaagtgtttccgtttgacttagttctagaaagtcagcatgaatcgacctttgttccctgcctccagaccttactctcctgcctcagaaggactctgtttctactctgtgatcgctcccttcacactggattctgtgtcamccatcaccctaccagytcgtggtgtcatcaagatgggggctgttcctayttgtctttgtatcccagcagctagcacctggcagcggtagttacacaggaaatacttcctgtggttgtgttgaacaggataaaatagtgcatgttatgtaagacattggaaaataatttaaaatctaagtaacccatgctttgcaatctttaatgaagttctggtagactgcatacagttttattaatagttagcataaacggggtttcctccccctttcaatttatcttagaaattcaatatttcaggatgtgcaaaatcatttttcctcacctcatacatacatygctgcttttagcatttcattgctgttctattctcttctgtgacatttcaatattttcagccrgttctctcacctgcsggggagccagcaggggcactgctgyggatcagaatgattttcccagcaggtggttcaaccattgattccagttggtggagactgtgacttccaagcaggagattttcccaaattggaaatctgcctgtactattcatggaagagtatatgtgtgtgacaaatgtgtgcstttgcaagtgtgtgcacccagtgtgcgmatgaaggaatgaggtgggaggaagggagagagggagggttccacattgagtgtgtgggctattgttccgaggatgcatatctgactctgttgtctgagtctcctctgaattctcccyggagaacctaaactgggaaggccctaatgggagcttccttggattatctgttaaaaaaaaaaaaaggaggtcacaatcttgctaccctatagcctagacattcacaacaatgtatcartgcaattctgcactcatctttttatggtgtttttgtttttccgcagaggtctcattgccagcagtttcacggaaacccactatctgcaagacggtactgatgtctccctcgctcgaaattacacggtaattctggcacgttgggatcaccataatcttacaccaytggatctgtgcttaamctttgtagccattttattcggagcaaaatcacatgcccagattcttaacttaggcccccccaagaagcgctggtgtgtcccttagtggtaggcgttctrttataaatccaaaacagcagccttggccaggtatgtgcacrgacagcccctgagggaatggctttatggcagagctgaaccttgaaaccaccttccaaggactatggatcctcatttgggcaaatcctttttagaaaacctagccagttagagatggcttggaaggcakccttgcctgaactgaacttggctacattaaactctgaggtgccttaaagaactttaaaagaaaactgattctgcttaacctattctgaatgtatccacaatgtggatacgattctatatcgtgggtgttactgtaacatgacatttatcccctctcaggcagtgtttctggtatttgaacttttagctgtgtcctggacaaaatgctcacttcatttgttgctttaacaaatgtttactgtgtactctccatgatctgtcccacatgtgaatatggggattcagagagaataggacagagtcrctgccctctgggaaggaggaaggttacttgttttaaagagctgtgggtattttaaaaaggatgagcttgaggcaggctttatgcttctcccttatcactgaaggttgtcaagtagccattactgtctgcagtgattcctcccttctctgcatgacaccaacacttttctttatcacttgtttgacacttggcacttgcaagctgatacctgcagccttccaggaacktggtggaatgagctgctgtagctctcccagcccaaagaaaacacatggaaatccaggataaaatataaacatttaagaatttttgctaatgcctggtcaagctcaaaagagagtcagcaaaatccccaagaggcagaaacaaagaggggatgttattcctgagcactggctggtgagttggggctccccaaaggactattcaaagacccaaagggctattcaagacccagaaagagggcctggtgcttgggtttggaaaaagagaagtaaccgcctgcaactgagaatcccacaaaagccagatccccaggagagctgctttcctctgtgaaaaagagacaaaaagaactcttccaatccagggatgggggctgggaggaagaattgtttgccaggtgtcttggattgaaaaaagacttcataaaaaatgaagacattgaaaccccagttagtctcatgtgtggatgttgggaatagtctgggcctgtgtccaaatttttaataccagcrtaggaatggaattcccagtcaagatattgacctcaaaactggtcccacatcagtgaaactcccatgggcccagacataagccaacccaaaatagttctgtaggaatatttctataacccagataacatgagatgccctcatggaagaaaaagtaataaaaatattaaagatgagccccaaatcaaaattacaagccacacaatgcaaaaagccgttgtacgcaagcatcagcagacaagagaaacaagaattaggacttctgagaacataagagataatggaaaaatcagagaaaaaaaattaaagagaacagaatgggtctaatagaaattccacaatgaaaatacataaaatttaaaaacacacacaggaaacaagccgtgtttaatcagagtgtgacgagcctgtccctgaattgaggaaagacatgagtcttgaggaaaatccaccaaggaggtggataacttggaataactaaactaaacatactccaggacagctkmtgatgaaaatgcagaacaccaaggatgaactcttaaaaccacttgaggcaaaagagagatttgtacaaaataatgacaactaaaccaacaataaacttttcattagtaactatgcaattaaaacttgagagctaagggaaaattattgtcagtctcaatcctatattcattaattattttgtaagaataaaaatgaaatagacattttcatacaaagatgagagaaattactaccctcagattccaacgaaggtatctaccaaagggtaactaacaaagaatagctcagtaggaaggaaactgatcaccagcagcaaggacaggaagtcagaggcactagtaaacaaaataatgcatgtgaataaatttaaataagcttcttaaaatgactgttgcaacagtgaccaaatttggatggtttaaaaccagatgagctaatagatttaaaatggtttaagaatttgtattgtactggagaataatagacacgctgattaactttagattttgataagagtgtgtcctgcaattttaagtataactatttaaagagtagaaaaacataaaatagcaagataaaaatgagtcaacatattaatctcattatatgtaaatagatggaatctctttgtaaaaatgaaaacatratctgcttagaatttaaaataaaatccagctacatcatttttacaggattcacacccaaaatataaaatggttgtgagaactaagaaaaggaatgggaaaagatattgtagacaaatcttaatwaaaaaaaaagcaaaacaaaacaaaaaaaaagctgctgtagtggtaacatcagagaagctagaccttaaggcaaaaatgacattaataggcataaagggagtaattctgtaatgataaaaggagcaacttagaaaggtagtaaaagaattttgaaactgtatatgctagcaaaattgtctcaaaatatataaagtgataaatggcagaatccagatgtaacttttaaatctaattatagattcatctagaactaagctttagcccagctcctaattaaaggatttctgaaaatccgaaacaaaacaaaaaagcattaaagattagacattatgggctaaaacttgtttggttcctagaaggttaccaaaaaagctttcaatactgacagcattttacaatttttcctcaaaagaaaagtctctagatgtaaaattgataagcttaattcataaagcaagtcactgaaaatgtctggacacattcacagagtgggagatttaaatatacctctctcagaaatgaagattttttaaatgagcagaaattaatgaaaaggaagaccaaaaaaaaaaaaaaaaaactcaagagggaagatgaattaaaccaaaagctggtgctttgaaaatattcataaaatggacaagacatttataaaattaagaaagaaagaattcccaagtaaataatattaagaatgcaaagagggatataaatatttttattcagagattttttaaatcacaagaatgttgtgaacaatactaattatttcttagaaatgtaaaattattaacactggatcaaggtgaaagaggaaaatttaaatataactatataaagatattaaatttgtaatagtayttttaatatttactgacaaaaataagctcagactcaaatgatttagctggtgagttttaactaacatataagaaacaaatagttcctgagaaaaaaagaataatttttttaaaggagggtgtggaaggagcttctaaaacaagaaaaagagcatgcacaaaatgaatcctacagactagtttcaattatggacgtagttgcaaaaatcctaagtaaattttacaaaccctatccagtacatattttaaaaatacttctgaccaaattatactcaactgaggaatgcaaggatagttcaacattagtatatctactaaggtaatttaatccattaatatcttcagattaaaagtattataactgatagtatttcttctgtgataacctatactgtttcttatagtgattttaatagcttttgtgagtggagaatgctatctatccctttcctaaccccatagagcctcacatagcatcttgcatataatagatttttaataaaattatccatctagcattgcattgtcttaggtgatgccatgtaaaattcatttcttcatctattcactcagcaaacatttatttagcacctcctgtttgcagacactgttaggctatggggagataggctgactaaaatatattcctcagcatataaatyctgcttaagaggcacagagcattttaaagacatttaaaaaacatgttttaatgtaattactataataggagatgtgtacaaaataccactgtggtattttaattgtggctgattttaattctttggacgccatttcactaaggaagtaacattaatctgggtctttaaaagtgggcaaagaagaagaccaagatggggatgaaacctttccatactaaagagtttcaactttacctattgaaatttgggagtcataggaagttctcatgcagcagaatggcctgttcagttctgtgatttagaaagggtctctgatgacagaatggaagaaagattgrtaggaatattggtagacagaagacaggaagatttcttatgggcccattgtagttagtgaaaattttgcctacagaactgggccttggaatggtcagcaattggccagagtcaagagtccttgggaagtcaaaggagacaggatcaggggatagagggtgggggaggtgtcatcagtgggactttcccttccacttaggccattggatgggcaatttgtttctcagtggtaccattaaggagcagttgttggttggaaggcagaggagatgagtcttggtttgtctgtgttgagtttgtcataggacagccaagtaaaggtcttctgtaggcagatggatatataagaacctagagtacagagaaagatggagtcctaaagtaaagatctgtggatcaacgtcataaataagtgatgggcagggccatgagttcacatttgacgtttatgtcctcttttacctccctaagatctcatttaaaatatgttttcagactcagcactgaggctatctccacagtgtaaatagttatttcagaaagaaacagaaaagagagatcttagaaataccacaacaataggctccggtcttccaaatgtccacgatctatgatggtgaacagtgcttgtctaatayagacatctctagaatgtgtaaaatatgcattcaaagttatttgaatagttttgtgcattctgttacaatctcccttactagttttctttttcttaggcatctgtattagtattagtcagggttctcttgaaggacagaactaataggacagatgtatatatgaaggggagtttgttaaggagtacagactcacacgatcacaaggtaaggcctcacaataggccatctgcaagttgaggagcaaggaagccaatccaagtcccaaaacctcaaaagtagggaagccgatggtgcagccttcagtctgtggctgaaggcccgagaacccctggcaaaccattggtgtaggtccaagagtccaaaagctgaagaacttgaagtccgatgttcaagggcaggaaacattcagcacgggagaaaggtaaaggccagaaaactcagccagtctagtctttccacattcctctgcctgctttattctagccrcgctggcagctgattagatggtgcccacccagattgaggacgrgtgggcctctcccagtccactgactcaaatgttaatctcctttggcaacaccctcacagacacacccaggaataatactttgcatccttcaatccaatcaagttgacactcaatatttactatcacagtacttttyccccttytttctcacttgggaggaaaaatgcaataagcaagaagacgaagaaatagaggactagagaaacaggggttcaacaactgccaggtctgtttgggacttggattgcaaaagctgaagtctacatatccaggcatcttagtaaacagcccrgatggaagggctccagggcgttgatagtgtttgtctccatgtggtgcgggactctgtgcttttctgggttctctgattcacatgtgcacaggagcaggagctcacatttttcctctcctccttttccatgtggttactgtgtgaaagggtgaatgtctgctccattcccctcgtcttccccyggtcctccccatggaactgtctctttacagggaagagggtgggaggagacaggccctgaaaatccctggtccctgctaactrgggagtggctgcagcccctgtgttgggcagcccttgaggtcagtagtgggtgagacttgcccctccctccctccatggagtcctctaggcagcagtgttcctcatttctaccttccccacaatgggtcctgaggctttggctgggaagaaggggaaagaggtcggggcatggggaggatggaagttggaaattgcaggaagcctctctactgtctaggcctaaactagtatcctctccagaatataccagaagcctcttttttggcagtcattaagctgatgctgtattttgatcttcatctgactctgtggatcatctccactggggaagcaactgaaagctagattaattggcacccccaaatctccagaagcatcaagcacatgttgcttttataattagaaaaatggtgacttttcttttaacccagcagttcccttcccccattcctttgaatgcctttccaagcagtcagccttgttacagtaaagacagggagtgaacaatgttgttcactaattaaaacccacagcccagaacagctggtccttccagcaggagccccttaaggagagtccgaggcyttgcattgtttttcgtggtgaggacccagatgcagcttttagggttttgtttttattgaatcaggctggaaaacaaaaagaaatttgctgactcatctcctcttctgctcaagtcagcacacagggaattttcctaaatttaaagttatgyataaaataagaaccactttttgttggctatagtgtatagtgctatttttttctttaaatatctcaacaattggtataagctggttgactcagaagagtggctgattttaattttggagttaatcacatcttttctctcgactgtcctgacaggatgaaatatttgtggctttatcctttgctgcccacatctaaggggagattatgttttatattgttacttttaataaggcctgcgggagactatccgtgtgacatttctgctgtttacatgccaaaagacagctctgaaaggctggcagaggtccccaaaaaggctagatgctgtcagtgctttggagggaatacattcgtctgttacatgcatcttgtcaaccaagaacctgcactacgcaggtaccatgacctgttcacatgcccccttatgctgagaatacagcagggattaaaaacagacaagggagcccatgggtgaggggaggctagaggaagaagactgcccttatcctggtaagcacaaacataattaacatctgggctaagtgcaccaaaggaaaggccacggggccctaatctggtctgagggatcatggaaggctttatggggaaaggaacatttgaaccaacagctggaggctgaggaggcatgaaccaggggacaggaggagaaacgttccaggctgatgctgagttttacttggggtggcrggggagaggaaggaagtgtttagragctgatgaaagtcatagcgtrtaggacctgaggaccatgttgatagccttggttgtgataggggaacattaggaggtcaataaaggccttccccaaggcgtgtcatgactatgtttgggctttgaaaagcacccrctggctccagcatgaagtcgtagtcagagggaacaggaggggagagggagggtcccctgctctgtcagggtcaggcaggggcctcttgtggaacagcctgaagcccaggtgagaggagatagcagcagaggccaggtgcacggaatgaaaggaaggaaacatgtctccccttagacatgatcaggacccaaaaatgtttcattcgtggtatatgtttctcactggaaaaaatagagagcatttgctttgatagtttcaaaggagaccagctgagatgaactgaggctggaccatcaggtaaggatagaatctaatattttggccaaaagtgttgtttgggtgacatcccattcatttccatggcaactactgattgtcagaaagggatagtatcttctacaaccrgcttggactaaacacgtcagggcggatgactatcaggagttaaccacagttcattacagttagaaagcatctaatcgagatgaaaagataattctggaaggaaggggaaagtcagagatcacgcacatctcataagtgtatcaagtgtaagcagtgttgcaggtgcgcagtgactatctgggccagaggcgtgggggtaagaagaatttaccaagacagttgtaggtaaagaaagggagatttactagagatcataggaaaatacattacaaaggagcaatgggcaggccagcaagagaggagctgactgcaaggagacaaaggcttgctggagatgttataggatggtgcttgtgccaccggtgtgctgaagaaagctttgtgcaatattgataatgccaaggttgcagtgaactaaattgcaattttctgtcagctgggggtctggtgatagctgggcacaggaagattgtgagtcatgtgcacgggagggatatgtgtcctggaccatgaaaaaggcagacttrtagcttatctgcttcttcattttgctttcccccaatcctgctagcctgactcctcctccctaactaggactccacaagccaggctcatcatcatattcttcttaaaacatcattgagaatggattgaatttccctgctgttgctgyactccacacatacctaactcaccggctctccctgcctgcctctccctcacaggctgctttgctgtcccactggccgaggcactcaacaccagtgccttctctcccttgggtcttcacccaagtcccgtggtgactcctacctccacagcacattccacaccctttcctgtccaccatcacatggctgcaccagctcaggccctcccttcctcacagctggaagatgttttagccacctgwctttttctcccaactaccagtataacctagctttaatccagaccccgcacckgcctgaatgatccttctaaaacatctttctatttgtrtcacaagattgcatttacattttgatcctcccaaatcatcagcagcttcccccaatgcctcctcagtcaaattcaaatttcttagaccagtatcaccctccacagtggtgacggccctaccttttcacacatgcctatgtttattcagtcattcattcatgcactaattcaacaaatgtttactgatagtgtccaatgtggtagctaacattgagtaaatatcaacarcaggcaagacactgtgcacagaacttttcatatattctgttgtttgatcttcaccaaaaatcagttcttgctatctttatacccagatgagaatactgagacattgaggggctaaataactcggccacacccacagttaataaggattcaaacccagatagtctgactctagaatctgagctcctagtctaaggcyaccctacccagaatgagcctgatctcatctgatcttggaagctaagcaggatcaggcctggstagctcttggacrggagagtctcagctcctatatgctgtgctacactgcctccagttcacttggaacaaaacactgagtstyggttatacgtttctggctatggtgtttgttgtaatggaattagtctataaatggagtggattggggaagcgggtagcattcatttacaatgggagacacctagagaatgctcttgggggagagcagctgaaccaaagtcctggaatatgaggagaggagaggccagaacaggcctctggggattcactaagtgcatcactccaaggcccaactgaactcagaccagtaaacatcccatactctgtggcaagtctgcagaagggaggatgcagcccctgtcctcagggaacatacattctaacaacatatgacrtaatgtgcccataacagagatgctttgggagccaaacaatgcaaggggcaaacccacgttcccagaggaactcactgttttggtgacttttcttccataaaattgtcaggaaagggcaggctrtaagatagaccttctgtctggagacaggatacgtcaaggttaggatcacaagccagagtccarctacccaggttcgaatcccagctcgagcacttaaccagctgtgggatgtgacgatgaaacagacaccgagcctggcackcagtcggggctttggggaagtgagccagccatggccactgctgtgccagtgatcatttcacagcagttcttccccacgctgtaccatatgttccttctgaaatcccttgtagattctgagaacagatgagaagctgggatgcggctgataactgagttgttcaggcctgtgtgtctccatcaaattgcaaatggccctataggtcttctgacccctgcccctgctaacccccycrtgtgcattttcacacaatatccaagaaaatttgcagttaggagttagagccaagtgacagggtataagcaaataaccctcccttctctctaatgggtcaatttctctcatgcacatccattcattcattcattcaacaaaaatacactgagcaatgggtcagtgtggaagaaaatagcaagtggaaaatagagcttacagcagagtgggtttaaaatatttatgttcgtattccagatttgtaacaatgccttacattttatgaattgcgtccccatgtcatgtttatttgatccacaaaactctggacaactaagtgcccgtcccattatacagattaaaaactgagagactcaacccgaagatttccaattctggatggatctagtgatctcactattgcagacgtgctgttcccaggcccagtttgcctggaggtctcaaagactatgaacatgattttgtaagcgtttgttctctctgcagaattctagcacagcaaaatgatttcagtggtccctgaggttagttctttatagtcttttaaccagacatggttcttgttatggacatgggagcagagatgctcggaggatgggtgtggtgacttatttcttcacaatcctgccctgcacactctcaggactaagtgtaatgtagcccagttatagaaacacacagagctgcaaagtcactttttctttgctcagatgcattgtcaccttgttttagtctcaagcaaacatgtagtatgttggggcttgcgtgcaagggaacaaggacctgactgcagtcatgctgaaatgcaggctggcaacagacatgcatgtacatacacacacccagaaacacagacacatacacacccatatacacacaatgcatatacacatgcatacccacacacacacatatacacacatgcacacccatatatgcacatacatatacacatatgcacaccatatacacacatacgtgtatacacacacccacgcacccccatatacatacagatacatgcacatatacacacacaaatatacacatgtgcccacatatacatgcrtgcatacccatacacatgtacatatacacacatgcacacccacatccacacatatacatatatgcacaccatatacacacatacatatacacacacatgcacaccatatacacacatacatatacacacattcacacatctgcacaccatatacaaacatatacacacacgcacagcatatacacatgtatatatacacacatgcacacatatacacmtgtgcamaccatatacacacatgcacacccacatgmacacacacacatgcatacccatatacacacatacatatacacacatgcacacccacatccacacagacacacacatgcacwccatatacacacatacatatacacagayaccatatacacacatacatatatatacacgtgcatatatacacatgcacactgatatacacatgcatatgcacacatgcacaccatatacacacgtacatatacacacatgcacacatatgcacatgtgcacaccatatacacacatacatatatatacaaatgcatatatacacatgcacaccaatatacacacatgcatatatacacatgcacactgatatacacacatgcatatatacacatgcacacccaygcaccccatatacatacccatgcacatgcacacacacaaatatacrcacgtgcccacatacacacacatacacacctatagacacacatacacccatacacatgtacgctcacccacctttggayccctcctatttatgggcttttctctgagtttggaaatgacttcaccttcttatgatgccatgagtgacactgtaatgaggctctgcggtacccaggaaaagcattccgcccatgtatggattttaggtgatagctttttgttgggaacaggccccccgccaaatctggccataaactggccccaaaactggccataaacaaaatctctgcagcactgtgacatgttcgtgatggccatgacacccacgctggaaggttgtgggtttaccagaatggagcaaggaacacctggcccacccagggcggaaaactgcttaaaggtgttcttaaaccacaaacaatagcatgcatgatctgtgccttaaggacatgctcctgctgcagataagtarcccaacccatccctttatttcaacccatccattcatttcccataaggaatacttttagttaatctacaatctatagaaacaatgcttatcactggcttgctgtcagtaaatacgtgggtaaatctctgttcagggctctcagctctgaaggctgtgagacccctgatttcccactccactcctctgtatttctgtgtgtgtgtctttaattcctctagtgccgctggattagggtctccctgaccgagctggtctcggcagcttttcttttctaaaagagagagaaactcatgtttctgagagaaatgcatgtttctgacagccaggtatggagggaagtgtctggcctagagttgagaggcctggatttyagttcctgccctaccgttaaccagctctgtgacctttgatggttatttaggtcttggtttccccatctattcagggaaggggctggctaaaagaaaaaggttggccttagatggcccaaagcttccttctggctagaatattgtgtgattcaagcacttaatcaagatagtttggctcattgcatagggcaaggagtctgggaagaccctacaaatttcccctaaagaaggcattcagaataattttcatttggtatactccctaacagactttgtctggtagcattcctttctaatcacaaggtcaagccatctttgttaccacttaagcatataaaatgcctttccttctagtccactgagagttgggtaacagacgtttgattttacttcccacatggcgtagagttgagggctaccaattttcaagttcaagagttcttattccatcttcctcttacccaccattatatttgattgatagtattaaacagaaggaaaagttgttctactggagtgggaaaatgcattaggttaagtaataagtatataaaatacatggttagaggtttttgaaaaggaaaagatgtaattttstggttatgcatgtttggggctctttttctgtgttgtgttttgttggtagaaatagaatgtcttggatcagcagaactaggcaaagacggcctggcctagtgggaccatgtcttgttcggcaatgtctttagagacataagggtgaggaaaagaaagaggctatacagtttagcgcccttgaggcaatcagagagaggaacaggaatgcagtgttggaaggtctgcagagggytgtggccacagctggctggctggtaagggccatgcagtgatcaacaggtcagggggccctggggtgcaagcccctcttaggcatgatggctccctgctgggtctctttctggtgtggatattcagacccaaaaaccaagtgtttgtgaacccacaaggcctagttggtgcctgcctcttagcatcagtgcgtgcagaggtgcacccttgggcagggcacaggctcacctggagattgtcttgactggccactgctggccactagcggtgatgtagcctgtgctcctctctctctgcctttgtcactggctaagagggtcaccccccacccccaggggttgaagactgcatctcctccactccccataatcaaatttcccaaccaaccacgtgatgcatggtgtgacaaccatgtcttgctgagttgcgaaattatctgtgtwttgacttatgttataaaaactcaatcacatttgtttaaacayttaatgagacatattgaaaaaaattaaatttcacgaaattgtcattgccttggaaaatctagaatttggagttctcataattatggtcagtaatctaagaagttaatcactgtcaggaatgaacaacggacttgttagtcaactgtctgaaggtgatacaaaagtggtgttaaagctggaaatcagttgttaactctactaatgactgagagaagtgagattgtttactttaagcaacagtttatgagagctgaaatccacccccctcctccctcataagcaatacttcaastgagttgttgaactggaaattaatttgatactagtttgttctaagctcatgctctaacgagcttatatttctgtgtatttaatttgaaagtacatttaataaataatctattaaaaacaaattgagattgagtataaatgagcttgaaatttcagaggtcagtaattaaaattattgtcaccatttggttttcagttttttaaacagtatttagctacttagagcagcatttcacattcctctaaaatgggggaaattctgtaaccatatgtgaccccaaagatctgtgacagtcaaaacccagtgattctggttaccttaagcagccaaaatcctaacagcagctgccaacctttcactctctgcattgtcttccgctttgatgcctgccgtgtgcccagggctaaaatccctascagggaagcccggcctgggaaggtactaggatccccctgatgccccagagcattatgatccaattatataaccccctcatagtcagagaattatcatgcttcccctacatacccaactaagagttaatctagagtgagaggacactgaagccattcaaaatatatgtcacacaaaagctaaggaggtgacctggcagcgaggtttgccctcccrgatggcctggatggaagcctgatgcatcctttcctaagccacgtgcttattgaagatggcagcttctctgggggaggaacagggcactgtgagagctacactcctgcatctgaaccttccagcccagcagaactaaccccacccctggatgccactccccacccccagcgcccactatctttgcacatgctttccctctgtaggtaagtcctctcctgccatggcccctgcatacctagccatttcactcttcagtgttgtatgaaggatccaaaaaggagcacacggcactttcattgtttgcaattgatataatcagcaacatagaaaaaagatacgctacaaactgataaactgataagatggtgtggcaaaagtgcccaatataagaccaacttacaaaatcaaaagcttccctttacattaaaaataaatatatgtaagacaaaataggaaaaaagagatcttatttatgatatcaacaaatctacacaatacctatacataagcttaacaaaaattttccaacagccacgtggaaaaaaaaatctaaaactagactaaaggacataaaaatgaccktattaaaagaagaggcctgccatgtacatgaataggcaarcrgtttattatgaaaatataagttcttcccaaactgacctgtacttcagtgtaatacaaactgagatctcaatggrttattgtgtagcttaaaattggattctgtaattcatctgaagagaaaatagggaatgataacctagaaacctttgagaaaagaatggtaccaaaagaaaatgatttggagaaagtcaccaagacaattcaatagaaaaaagagtaggtgtttcaacaaatggttctggaacaactagctgtccacatgctgaagaatgaagttggacttgtacttcaagctacatacaaaaattaattcaagatggctaaagatgtaaatataatagctaaacccatacaactcttaaaaaaaaaaraaaaagatatgtgtagatctttrtgaccttaggttaggtaatggtttcttagacatggtaccagaagtgtaagtagccaaagaaaaaaatagacaagacctcatcaaaattttgagcttcaaaagatacaatcaagaaagtaaaaggggccagttctgatggctcacgcctgtaatcccagcactttgggaggccaaggcaggcagattgcttgaggtcagtagttcaagaccagcctggccaatatggtgaaattccatcactacaaaaaaatacaaaaattagctgggtgtgatggcatgtgcctgtaatcccagttactccagtggctgaggcaggagaatcacttgaacccgggaagcagaggttgcaatgagccgagatcgtgccactgcactccagcctaggtgacagagcgaggctctgtctcaaaaaaaataaataaataaaataaaaattaagaaagtaaaaggacaacccataaaatgggaaaaaaatctgtaaatcatatatctaataagggtctagtgctgaaaatatgtgaagaactcttctaactcaacaataaaaacaccaaaatccaatttacaaataagcaaggatttgagtagacatttcttcaaagaagayataaaaatggacaataaacacatgaaaagatccccaacatcattagtgattaagaaaattaaaaccaaaaccacattgaaataccactttatatccactaggatggctataattgaaaagataaacaataacaagtgttggtgaatatgtggggaaattagagccctcgtgtaatgctcacaggaatgtaaaatggttcagctgcttggcaaaacagtttggcagtactttaaaaagttaaacattgagtttccatataaccagcaaccttacttttagacccacgtgtctactcatagtgcatatccaagagaactggaaacacatccttacaaaaatgtgtacacatgtgttcatagtaacrttactcataatagtcaaaaagtagaaacaactcatgtgctcaacacttggataagcaaaatatgttttcatccacaaggcagaaggtgattcagctgtagaaaaggaatgacattcyaatgcatgcctcagtatgaatgaacttgagaacaccatgcttaagtgaaagaagccagtcacaaaaggcacttattgtatgattccatttctataaaataacagaacgggcaaatccatagagatagaaagcaggttaatggttgccagagatggaggagcagggaatggaaagtgacygctaatgaatatgagatttctttctgaggtgacagaaatgttttagaatcaattagtggtgatgagtatataatattgtgaatatacaacaaaacccactgattatatatgcttttaaaaggtgagttttatggcaagtgaatttaatcttaattttaaaggacaacttaactctacctgatatcaaaatagagtatagagcamtagtcattggaacagtgtggaattggcacagaaacagacaaatggatgtctgtctcagtgggctagcacagagagtacaaaagtggcaccacaaacatactgtgggcctttgatatatgccaaggtagcatgtcacatcagtgagaaaaggaaaaatggcagcaaagcacagctggctctcatttttagkggaaagttagcattgaacctcacagtcccacaaaaattaattccagatggattaaagagctaattgtcagactataaagatagaagaaaataaagaagaacatatttgtgaccctgaaaacagccaccttgagctatgcaaaaaatgcatgaagagagcgacaaatgcatttagattgatatacactggaaactctgaacaaaaaataccataagcaaagttaaaagacatttcccatgtaataacaggcagagtattaatatcctgagtatataaagaacttctaaaattaatatgaaaaagctcaacagaataataawtgtccctgcaaccccttaaccctatcaccctcctttcatcgccttttagatgatctgagaattttgtcatctacgttgagaccaagagatcatcttagcccctttcccatggtggtgtctggttttcttcatgactcaattgcatctggtgctttttcttagcaaagtcaaggtgggttttgttgggcagaatgactggacaccaagctctgcgctggacaaagtgcatgactgttgtcgtgtgtgaaggagctgtgtgctaaggagggtgcagtggagacagactaacacctgagctgctcaaaagaggagcttctcagaggraaccctgagaagatgcatgtacctttctctgcagagacctgcacccagctggcgtccagaggatctgagtgaggagtactgagtatactcagccacttcttgccagtctgccacttaattggggctgcagcataacctttgctcratgataaaattaaccttgattccggactgatatctgtcttcactaaggaagtgtctgtgctgtggtttctttttgtaagctgtgacattatcaaagaatagaatattgcaggcatgacacacgggaacttttgtcttagacttagaagaccttcctatttttctttcctgccgagatagactttcagctctcaattgggtaattcagtgaggtcccctccttccttcttcacccccacttcctctcatctgctttcccgttttcataagccacagatttaggccttgttttattacatttcacagtgtgcttaaataccccctacagttcttcatctcattacaaaagacaatttacatgagggtaaaatggcgatgtcartgtgatttgttttgctgctggattttgtaaaacgttctgtatcagggctttcctgtagggtgccagagagacaagagtgaaactagggttcatttaaaaaccgctgttggtaatctgtaagtaaatcagatattcccgacatagaccctggctgggtcatgttgggctttgcattaaatattaagactgtagaacaatattttmtgcaatggaaaattctatagttaaaaacaagaggcagttgatttattataagtgggcaaaaatgtgttataactgaaatgggattctctcctcctcccctttagggtcactgttactaccatggacatgtacggggatattctgattcagcagtcagtctcagcacrtgttctggtctcaggtaagtggccatgaccatggcggctctagtcttcagccatctactgcaggcaayctctgtcttttcctgctcgtgctaaagcactgagagtgagtgatgggggctcccagctcagctacacctccacctaggcaagagaacacggaggccctctctccactgcttacaagagcatggccacccaggatcttagcctcatgttcatgccccctcttacagtgccatcctcaggcctggtggggtaaaagcgactgaactggttgagtttctrcatccaagcattttgtgaattattttccatttatgtggctctgatgctttataattcccagtgctaaaagatagaacattacataccaatgttgaagctgctrgcttaatgtaaatcttaaagggcctcctctcattaggaaacaaagtaaggaaactaatttagcaacaaccaaggtgagttgaatagaggcayggattggtagggggtttgctactatgctacgggcatgatgcaggaaacaattaccttcccatgctagacaagtcaaccccaggtgttactcacagcccgcttccttccacatcacagttattggccatcaggtggcccttatgtgctccccaggaaaatcattttgtttgataaatttccagctgtttcagcctttttactggatttgcttatcgartttgtgaactaaatgtttgtawcctcagagtcctgggtaactttggcccaaggcaccaaagcatgattccatgggagggaagagagagaaggccctggaaggatatacctgcttgagttaaaaagcagaatcacattctgcgcatcagcagttcctgtgacgtctttgcaggttctgtgtgggatcatggaggatgagaatatgcatgtgacacacacaacaaccacacacctaccagtttattctttgctgccctcacttctactccagccagcagagaatgagagttctatttgctcacatgttccccattgctcamtacatctgatttatctctaagtatttaccagcgttggtcctttcatgtaactaaaaataagtacacaaagctattcctcttcctcgttcatcccgttccagtcccactcagataaaaatgcaagctgggaattcccctcccagctttctcatcccttgtgcwtgtaaacacatagtcagagattggggtgtgtatttgtttatttttacaaacatagagtcacatcatatacatcattctacggctttcttttgtcacccaaccctgtctgtctctccaagttagcagacacagacccaaatcattgagtgaacacacacatttgcatgcacacacacatttctgcatacctgcatttttttaaaagcatttttatgtcctatttatgcaacacaattgaactttaagatgtctgctactctgaaaagtgaaggaggtgccttgtggtttgaatttgcttctcttcagttattcattcgttcagaaaacattccttgagtgcttcctcattgccagttctgttctaggttctgggggcacggcactgaacaaaatgcattcttcctggagcacttcctagtggaaggaacagacaatggacatagagtaagatacatgatgtcaaggatcatggagaaagacaaagctgagatggaggacaggaaaggcaacaggtagtcagggaggttcggaaggaggtgaggtgagccctttagatgakgtaggtagcatatcagagagaagagcatgtgcaaagctcctgaagcagaaagatgcctgggatattcccagagcagcraggtggccagcataactagagtggacagggacagggaggcagtagagagaaatgaggtcagaagggaagtggaaaggtaggatcaccaggggtcacgaaggtgatcagatgtcctttggcctcccccccagtgatgggtgccagggagcttggagctgaagtgatgtggtctgacttcacatttttacaggggcactccagctgccaggctggaaatagactgtagggaatgtgcacagaagcggaggcttgggtaggtgtcttcagagtaactctggtaagaggtggtggggcaggcctggtcaaaggtggcaacttttgtgagagtcgagagacctttccacgggtattagagaggctggcgactctaaattttgttagtgatctgtgtcttaaagtcactttcctgaggaagcgtggggtgtgagcacatgaaaggacctactgaagatgcagcaaaatccactaccaggcagggactccaatacgcgtacacgcccagcatgcagagtgggcgctcaggagaaggtgaagaaggagagtttggaagtgacaatttagagcaaagatgacaactgttcaccaccaaggagctgaggtacatgagggagaaattttaagtaatgaagtatcatcctgagaggctgcaggggaggtgatatcagtggaatcagccaggattcagctaggggaaggaggtaagaggaatattctggaagagatttggatcaggataggatttgaggatggaccatgagccccaagagcacagtggaaagggttagggaaaagggagtggggatagggtcagtagaggattaaagacttgtgggggataaggggccagttttcatggaaaaccagtgcttgaattcctggaggagacagagatgagggggtgaaatgggatcagacctggtggcatctgaggtgaaggtgagtgaccaattcaaaatggatactctgggaccccaggtagatgttctcaccctagaacatgatagtcagggtggtgaattagctgtgtgacgatggacaggtcactgggcctctctgagccccagtttgcatggtgggaagtttgcatgttcaaacaaagtttgagtttgtttctcccctgtgatgggtgccaggggagaaacagtaaacaaatgcagtgacctctaggaaagccaagccctgtgcccacctctagtgagcatcatgagacagtctttgttctttgattctgggactggactagttgdggggggggggtgttcatgcagcactcctgggataattccttgcaaagctttgcagctcctgtagagaccagggcagagatacacaaggccatggtagtaaggaccacacacacttggaaagggaartccacactttactattgtgcctctctggggcctgaaaggtggacctctttcttcaaaggtcatgtgttgaaggctggatattttcagccttcaatttggcattaaggtcattgtgtgtaaagaagagaaaagctgcccgggggcrcggtggctcacgcctgtaatcctagcactttgggaggccgaggcgggtggatcacaaggtcaagagatcgagaccattctggccaacatggtgaaaacccatctctactaaaaatacgaaaattagctgggcgtggtggcatgctcctgtagtcccagctacttgggaggctgaggcagaaaactgcttgaacccgggaggcgggggttgcagtgagccgagattgtaccactgcactccaacctggygacagagtaagactmcaactaaaaaaaaaaaaaaaacacgaattcaaactgacttaaagaaaaacaaaataatgtggagataggcttatgctactgaaaaatctaggcatggctggatacagggtcctagctaatattatcacggtctattttctatctcaagcctctaccttcttctgtgttactttcattctcaggcactatcttagcatgggctgccatagcaaaataccatagactggttggcttaaaccatagaattttatttctcacagttcttgagcctgkaaagtccaagatcaatgagctgacaagattgatttttcctcctgaggccttttctcttggcttccaggcagtcattagcttgctgtgtgctcacgtgacctctctttgtgcgtgtacagagggaggaagctctggtgtcccttataagggcacgaatcccatcatggggcttccctcatgatctcatctragcctgatcagctcccaaaggccccatctcccgataccatcacatgggggccatggctctaacatatgaatttgcagggtatataaacactcagtccataataggcagttgttgttttgttttgttggcagcatgaggcttccatgctcaaaaagcaagaagaagaataagggcctctctcccaagctcagtggaggtcatctaaacacatcccagtggctctgactaggccactggctcatctgtgaaacaatcagagttgtcagtggggagcttagtagtctgatcaaacaggttatggccctatatcctggaccaggttgagggaaaactgcacccagggtccccgaggcagggagcagggaaggggtgaatgtaccaaagaaatgcaatgagcttttgccaaaaaaaaaaaaaaaaaagaagacagctgagagccagggacactcagaaacaaataggcctcttccagcaacaattatgaagaaattcccaattatcaaaactgagatcagccatcaatggaaacatccaggattggctggataattttcaggttatctttatagggctatcagattcttgatgggcaaagagaaaaggattctctacaaggagttcctaatagctcctatttaccttaataaaacaacttataaactagtgacattaactcattagagtgacaactggggaaggtattcctagagtaatatccaagcaagacaaatcctcccatagggcttggccttgccactcagtcacaaccctccatccctcttcccaggccagccctgtagtcaccgtgtgccaggcacgctgccttagctctttcagcctcccacaaaggtgcagggcaactgtcagggttgccagttccttccgcatggtggtgacgacctcgctggccagactctgcagtgtctgagtctccacatccaccccgcatccccaggagcaggcacagactcataaatttggcagaaaagaatattgtgaaatccttgcagctgggatttcaggaaaagtcagaagagtaagtgctgcattgtctggtgtcagccaccaagagggaatgggaatggtgatgaggaacgctgtgtgggtctaatgaactcctcactgtgggcgcttctgagaattttgacttcccagatctttgtgctgttgttacaaaagcagcagaccgtgcatcaacagagaaattccgcagctgtacagtcaactttatgatctttcaagtcaagaatcagaccagggtgaggggaagctgtatctgatcaactgctcactgacagaagaattgattgagactggaagtaaaaggaaaaaaaaaatgcaactagagtagccccagcctgctagctgttaagaaagaaaatggggattaaaaattgtgttaaatgtggtgtgctccagaaacatattaagatctaggaacctggagggaagctggggtgtcctagaagacacattaattacagcccaacagattccagttttgcagcgaaagaacatcccacattgcttcaaaaacacaggatcacaaatcagcaggaagaaaaaaactctgttctagaacatagaagaaggagggaattaacaagttgtttttcatcatttgaagcttgaagcggaaagcacacggagacaraaacagcacaaagatctcagtagaaagggacatgaaagaggagatggctcttgaatggagggaatgaagtacaacatggaaaatgggtcgtaaaaaggagttcagccatggagtttattcttactttgaaatgactccaagtcgaatgtgaagttgaggccatacgttaattttgtcccgtatcgtatgtctcccatcgatgcgcaactcccagttaatacggtttcggtgaagtgcttgtgattctcctccccctttttacattctggttcccaatttgctctggtggcttggtgctctcattcctgccagccagggagcctggaggcacagccatgagcttcagataatctgcaactctgcagggcacagacatcaaactgtcactgagatgggaagagaatccagctcctggcccagaggaaccgacccactgtactttgtaatgggatagacgtccagccctgtcatgctcctgctggggcatcaaaacagccatgcacccgtcttctgagtttgttcctaaatgccacgttcccactgcttcagctcctggctggagcatgagctcctggagggaaaaggttgtctytcyctaatttttctggttctcttgccccgctctctcagctctgactcaggtatctggcaggaggagtctcatgggctcttggcattggaatgagccccaagtcttcatcacctgcaggcacagaggttcgactgaagctgaatttcttcagggcctacctgtgctttaaaagacctgagccaagctcacttgctagatgaggaagtggtatctcgatcagatcgtacactagagactggttgtcatcatagttatttcctttttaaatggggttggtgacacctgagcacgaggtgtcctcacactcacatgcgcaggctcccacttgcacacattcccacacgcgcaccacacactcccatgggcaggtgcccacttgcacacattcccacacgcgcaccacacactcgcacaggcgcccacttgcacacattcccacacgcaccacacactcacatgcgcaggcgtccacttgcacacattccgacacgcgcaccacacacatgggcaggcgcccacttgcacacattcccacacacgcaccacacactcgcacaggcgcccacttgcacacattcccacacacacaccacacactcgcacaggcgcccacttgcacacattcccacatgcacaccacacactcacatgcacaggcccccacttgcacacattcccacacgcgcaccacacactgacatgcacaggcgcccacttgcacacattcccacatgtacaccacacactcacatgcgtacccactctgtggggtgctgatgatagttgcagtaggtcatactttatttttcttcattgttatgattcctgttttcatgagaatggggcagatgttattgtcacctgagcagccaactaaggcatrgcatcctcaggggcctggagttcgtttcccaacccccagcattgctgtcatgcagtttgcaccttgaaatcgccaccctctcaaagccctttgccccatccccatatcaccaggtactgacccagctcacttcccttcctcatcccagctgcagaccggggcctctcctgaattggcacctcacctttccttgtcctcatgggaagctcacacaagccacgagcaggtctcatgctccttggtttacaggtaaaaagcagagaccacaaaagtgacttcctcatggcctctcagtgatartgggcaaaactagatcttaaacccaagcctggctgacccccgttcaattttttttctggtaaacctcttgcataatttggatccaatcttctttttcagtcccaccatccccttcctgaggaaaccaccctattcccgccatgctgtttttttggctgtttccagagcatgcygccacatgcgtggtgctgcccctctgcctgggacacactactccctgccctcccttttgactttggaagatccactcttccctcaaggcccaagtcaaacactgcttcctcctccaagaagcctctcctggtgtccccatctcctcaccatctggctcagccatgtgctgtcatgcatttcctcatacattgtagttctggtagcatagcaggtgctttgtaaatatgtgtttacgtccctgtcttaaggcccctatccttccttgcccatgccttggtaactgccatacctcattctacgaggtgcctgcaacgtataggtctaacacccagaaggtcaggtgcatggaggtggccttgccttcaccttcctgtctgctacactgggagttccaggaaggcagggactgggtgccccaacacggctgtgtcctagaccctggcatgttacaagtactcagtaagtagtgcaggaatagatgtgccctcccaaaggtcaggcagttcataaaccttaattttggccaatccactttttaaaaactatttaaagtgcagtagawcatatgaaggaggaaattggcatggaatggcggtaaagccactttgaccttcacctttgcacttgtggtgctcgctccatcagcacctgtctgactagcccacctggctctcctccaacctctggccaggtgtctctagccaggtttccacactgcttcccttctcccttctgcttcctcccatggagatctttggacatccgggtaaactcctgtgagagccatccctgggggcccacctcagctgtttgcagatattgttggacatgtgcacgagtcagcaagaagctttgacgtgcatgccacagggatccactggccaccagccacggtggttttgccaggtggcatctgctctgaaggagatccaaggtcaagtctctcagctctccccrggccccactgtcactcaaaactcaggatgtctcaatctaaactcctctgggtaggtctccagactggctctccacctgacctcttgtccagaaggtccacamcacctcgagtctataagcctgaccccagggagatttctgtaacctattgtatccacccaggccctgcacgctctcccctatagcgtctccttcatccctctcttctatcaccatccttgttcaacccccctcttagatttgaaaattgcctcccccactgtgcttctgtctccacccctcctttcattgccatgttgcacattctagaaggtcatgttttaaaaacactactagatcatgtcataaatcctgccaacccattgcactccagcccaccttggctctcccatggcttacttgtcaaagcctctagttcagtcttatgcttgttcaatagtcctgcaaatatttagtgatcacttactcacctactggtcacgtgcaaactgcaatgctggttctaaaaaaaacaacgaaaataaggaaactattccctgggtgtgtaaagggagccagatatcaatttaataaaatgttgttagtgacaggaagcaggttgcacaaaaccacacgaggaattccgcagaagggccctagatgctggggatcctgaaggaagggttggctaacctggacctcgaaggtcactcatcagcctcgaaggtcatccccagcattagtgctgtgcgtgaccctgaagaggaggctaaccatccagtctgatgagggcaagtgaccaggcccaggagccaggtcccaactgggacatcttggctctgctgctgattggctgtatggctgtgtctgtttcatagggctaccttcacaaactgccataaactaggtggcttcaaacaacagaaatttagtctctcactgcttttcaggccagaagtctgaaatcaaggggtcagcagggttggtttcttcagcagagtctacggaagaatccctcccacatctccctcctcgctttgggtggcttctggccatccctgctrtgccttgacttgtagatgtcactcccgtttctgcttgcatctttgcttggccttcttccctacgtctgtgtgtctcctcttcggtctcttctaaggacatgtgtcgttagatttatggcccaccctagtccaggacaatctcatcttgagatccttaatctaattacatttgcaaagtcccttttcgcaataaggtcacgttcacaggtccagagattaggacttaaacatatcttttctgggggctgggggggacactattcaaccccctgcagtgacctggggrctctcatctttattttcctcattagtaaaatgggctcatgttatctgctttacaggattgctgtaaatattaaagaaaataatatattcctggccgagcacagtggctcatgcctgtaattccagcactttgggaggccgaggctggcggatcacggggtcaggaaatcgagaccctcctggccaacatggtgaaaccccatctctactaaaaatacaaaagctagctgggtgtggtggcacatgcctgtaatcccagctactcaggaggctgaggcaggagaatcccttgaaccagggagtcagaggttgcagtgagctgagatcacgccactgtactgtagcctggtgacaaagcgagactccgtttcaaaaaaaaaaaaaagaaaagaaaagaaaaaaaaaaggaagtaatacattcgagagcctggctcatgggggccatgaaggatcaagagtgactgctgataggtccagagttttggggggaatgatgaaaatgtctgcaattagatagtggtgatgtttgcatgactcagtgaataagctagaaaccattggattgcatgctttcaaggagtgaacttaatgctgtgtgaattatttttccataacactgaaatttaaaaaaggagcctgactcagggaatcttttcatacatcatagctgctattattattattgatgtgctggtaatgctggtaataacacttttcttttttttyttttttttttttttttgagacggkgtctcactcactgtgtcacccaggctgaagtgcagtggtgcgatcttggctcactgcaacctccgcctcccaggttcaagtgattctcctacctcagcctcccgagtagatgggattacaggcacgcactatcacacatgctaatttttgtattttyagtaggaatggggtttcacaatgttgcccaggctggactggaactcctgacctcaagtgatctgccagtctcagcctcccaaaatgccaggattacaggcatgagccaccatgcccrgcccttggtaataactattcttaatgtgttttatcacagtttaaactcttacctcctctgtcgtgctcccacaccctggtcatgagatatatttgaaatgggagccacgggcaargggtctttgyatgtctagcctagtgtctcgcgcatagtaaaaggataaagaatatttgttttgactgtacctgagtagttcacatggaaattactgaagccctgtggtgcgtatgtgttaagtaatactgctgccacgactgtttatcaaacatgtatggggtgagatattacttttacccasgagttgctccaaaaaaaaaaaaagccgaaattaaatttcaagccaactgcttttccaccacatgattgacagcaccacactgagaccaaaagtctttttctaggaaattcagttagcagttggacactgagctagccaggataattcatgttttctaatcatcatcttattacaggcagtcaaaatccatgtgccactgtcctgcttgccgggtgcagtcaaaaaaatcaggatcagacattaagcggccccggtgcctgctgcatcgtggctttggagattaaaaactaattttcagaaggacaaaaacttatcttgaggaaatataggtctcttgagtgtccactttgaaagctaaaataatcaactaataaaaytttaatagattcctctttgtttcctgtcaaggaaaaacaacaggattttacatgttaaaggaaggccgctggttttcaaagcagcggctccattttctctttctaattctaattctagtccttttcatttttaattctgcttttttcatgctcctgctggttctgggcccctctctcaaaactgcacaaagggaagcaggcgagtgtggggttgagaggmccaagcccggggcacacaggtcccgmctgggtccccagctctgccacctgcgcaccttggacagtggggtcatggcgggagctgcagccatggtcagcagagtgatcagtgtacggagcgcagcccagaacctggatcctagaagagtgccacaggggggtgaccctgaccaccctgagaacccccttctctctgccccagaacttggcctgagcctggggtgatggctgggccggcctcctcctgtcgctctagagaagggacccacggtcttcatctttcccaaacattggagactttcttctcatcttttccccctactctacctagggagaaagaaccccacacgcaaagtccactggatttaaattccatgctctgagagtcttccaacttcaggtttacaactaaatatctgtgacattcaacttaaaacaaattacattcacttatctaactcagggccagtaagggctgtgagaacatcaaaatgtatctcagaaaccctgaatgcttcaattttgtgtccactgttgtttccagcaattctttagagctaaatgattaattatacccaagacagtccaaagcaattatttaattaagcttattataggctgccaattgtttgcagtaaagggaaggccttcatcctgatttctcaacatctggcctttggatgacttaaaagataaaagaagataagagaatatttttacgactaagtaacaattgctagaaatattccactatgtagaaaaactttttcagtaatttgcttctcatgattagaatgtggtgacatgttttacagttaagtgttcagcttatttagatccgatgtaaaatagaaaatgttgcartacaaaatgaaatgttactgccattttctttttagggcagaattgatggtattcatttccactttccccttgcctgtttttgttttttttgtttttgagagggactctcgttctgtcacccaggctggagtacagtggcacatctcggctcactgcaacctctgcctcctgggttcaagcgattctcccacatcagcctcccaagtagctgggactacaggtgcgtgccaccacacccagctactttttgtatttttaatagagatggagtttcgccatgttgtccggctggtcttgaactcctgaccacaggtgatccacccacctcggcctcccaaagtgctggaattacaggcgtgagccaccgcaccckgcctccctttgcctatttttttaagttcgcatccttaataaaatcaactttaataaacaaaaatcctctcctacctattccaaagttagaagtctacattttatttcataaagaacatctcagagaaggagacacaagccaccccacagagttgatgaccaaagtaatccctgaatgatctgtttggtgatatacrtggacaccagtgtgggggaaggcaacacttcatagaatgacttttagtcaatctggactttggatgacttagaaggagacatgagaacattttcatgactaagtaacaatttctacagatttgggatttgaaaatattgaaaaatgttttagttgctccaaaccacattggaccccttcttctctgaaggattaagtgttacggttcttcaaatgcacatcttagctctcacaggatttctaattgtcccggatatctcgatgctgccttgtctattaggataccagtatcctgagcatgatagatctgtttctcccattgcccatgacaactcataaaacaggattggtggagtaagccagttaaatactaatgagttgattagtctgtatttgcttaccagttgtgttcaaaatagatacttgactaactcaagcctcttccttccgtatcatttgagcgttgagatactgtcaatctattaaaatttaagagttgttaaatactacctacgaatgggccatcaatgagcataggatgatgaatgactgaacaaatatgtaagcagtaatgaatgacataggaacaccttacacagtcccttctttggaaagaagcttagattgaggaaaactgatggagtttgcaacttgaccagctattcctcgaggattgatgtatacctagatccttgggttgctgcaatataaattatatattagaactaattattatataagattatatattattatataattatataatatataattatctattatatattgttacatattatataatttctgatatataacatattgcatattatataatatgcaatatatwatatattgcatattatataatatgcaatatattatatattgcatataatatataattgcatatgtaatatataatatatgttacatgtaagataatatatattatgtattgcatatataatatatattacatgtataatataatatagtatattatatattatataatatatagtatgtatatactatatagtatatatactatagtatataatatatatagtatatagtatatatatagtatatagtgtatatagtatatatagtatatatagtatatatagtatatatagtatatagtatatatactatatatatactatatataatatagtatattatacatctaatatataatatatttaattatattgcatataatatattatattgcatatataatatataatatatattatattgcatatgtaatatataatatatgctatattgcatatgtaatatataatatatattatattacatatgtaatatataatatataattatattgcatatatattatataatatatattattatatattgtgtattattatatattagaactaatgccctaaacctcattccatttacatagaccttatcctcactcctgaatttgctaaaataatctgcaaaattttgtggttatgtatgttggggctcagaaaatgataccccaaaatatggatctttgacatgctgaactgaaggaaaaccctcaaggtctctctggcccctggcacccaccttcaccccatctgactctccaaaagcacaggatgaagttgttctctgacrttcccttatctgcctaaactatagaccctccaaaaaagaaataaattaccttggtccctctctgagttttcattaactaatgtcacaggaagaaagactgaagcctgtcaacacatccagacagacttttgtcataaaccgttgtctgttctgcaggcccaacagactttgtcccaggccattgtatgttcttccagcccaatgaattcccctaaaaatcatttactcaccccctaaaattatccatacttccctatctccctttctcctaagaagaagggtgtataaccatctgtgcccccattgagtaatcattcttctacaattcacctgtgctatgactgttaaaataaaattgtatgccttttctcccataatatttctgccttttgtcagttgatttgtagtgaactttcagagggcaaaggaggacattttcccttagcccctacaggtatgtatgtgaattatyctaggaagagtctraggaggttcatgtctcacaaaaggttagtagtcactgtattagaagggtccatttccagtcagatgaattttacatgaaaattttgtgtctttctaaagtggagagatagtggtcacctcgctaaataacataaggtactagacacatgggaattcagagatgccagtttgctgttacccaaattgtcatttctccaaagaaaacctttctctcaacatcaggaagcaccttttaaattaaagcacttcactgccccaccttagcaaagagagaaatgaaaaccaagctgcaggccgaggttcccatcgtttgaaggaacccgacagcccaaggctagcattactcatttccaggcagtgggatgtggccttagctgtgagctccagaaggtcagacatgtgtcatggtccatggctaaatgtcaccttctatctctgcaagttagagtcttcagcaaatttgtccatttttaaaaagaatctatgctttctttcccaaacctaaagactggctcaaaaggttctttcttagttattgtcattcccagaaatgtatttatatttttaatgctatrttttatatcacagagccatgagtgaccagtattcctatgagcagatgggttaacaaaatacagaactttcctgaagttgtcagtctttcagttaacctgttaacagatgcctaatccatgaatctgcccttattaatagtaaagaaagctaccatctctcaagcactgacctggggcctcccctgggctaagcgttttgactcgatgacatagcaaccctgagaagtaggtaccattatccccattttacaggtgaagaaaccagggctcaaagttaaggtcacataactagtaagtaaaaaactggaactcaaacccagagcttccagactccagaggccacccttgcagcgttgagactggcacttctccctgtagtgttcttgattccagaaagagctgaacacaggatccagaggccggacctcagcctccaagaagcagtgctaatgttctgtgtacttaagtgggttcctttattcacacatctcccacaaattaaataagtaaataaaaaaatataaatttgtactcatggtgcttataattccatcaaatatttagggaatagggctgatcaggataaataattagatgtaggaattgtccttttataaaaagatttcctaatggcttttggagcaacttggatggaactagggccattattgtaaatgaaataactcaggaattgaaaaacaaayatggcattttctgacttctaagtgggaagtaagctatgggtacacaaaggcatccagagtaatataatggacattggagactcagaagggggaggccaagaggcgggagagggatgaaagaatacctgtggggtacaacgtacactactcagatgacaggtgcactaaaatcctagacttcaccattacacaatttatccacgtaaccaaaggctactgtacccctgaggctattgaaatattttaaaagtaaacatttkccttttgaaatgtgtctgctaattcagatacagttatcttctaagcagttaaaacatctttttcctcattcttcttcccggcaatatatctttgagacataaaaagagataaaaacatacaaaagcaaaatgcactgtattctttaccataaaatatttcaaacagaagaaaattcctaggctaacttwccaaaagatttgccaaatgaatcaatgcaaacatatgtcacagaaacgtcctttccaatcaaaatctgagaatataagtaaattggtgtttctgttttcattctctctcttgttaagaactgtgtcttggccataaacaagaagctgtccttaaaattatatattttttcttgtttctttttcaacaggggacttattgtgtttgaaaatgaaagctatgtcttagaaccaatgaaaagtgcaaccaacagatacaaactcttcccagcgaagaagctgaaaagcgtccggggatcatgtggatcacatcacaacacaccaaacctcgctgcaaagaatgtgtttccaccaccctctcagacatgggcaagaagggtaagggggatacctgattttgtgtttctggaaagctaggagctcaagctacrgataccccacactaggacatctggagaaatgttgccatctagatgatgcggcatctgggggatggaagtgcccagtttatctggaggtggtcacaaccataagccaaatccccatcactgtactgcagatgtcagtctcagactcattaaaatatgctgaggaaagtcacacagttgggatcaaaggatgacaaaattaccccccccccccaacttctacccccacaagctcaagattcatggaatctcccaagagaccctactatggtcctaggcccagggttgggcgccaccatgacaagcaagacaagattggaccctgacccactctctagcagctctccatctactggaggtgaaagactacatagagccttccttattagcaagtttgggttcttataatttgcagagaattctcactctttgcctacacacttatgcagaggtgaactgggccttcctccacgtgatgtggctcaggaatcttgcttatccacagtccaagctgcaaatgcttgtcctagttccctcctgggaccgtccaagcagtctgtgttttctggccaccagcccctggatctgctgataaaatgtcttcctttttgcagsagcactggaaagagtagttgcctaagggagtctgtgctgcagacagacttcccttcctgacacgtgtagtgtcacaccatgaaacctccacccctaagggtggcctgccccttttctctctggcattatgtgggcaacagaggctacagtagagctcttttaataaggattaaaggcaatcgttcccaacatttggctggaggccctgaatttaaatgagcagaaacagataggaaattatcaacaatttcctgattttccatttctggatttcctgttcctctgttgayaagaaatcaagaaaatttatagataggatgtcgcttgtgcttatatttgactgtccgagaacatttcttctaggtttctcctaacccgttgttgtctcctaacttgaatttcrgtagaccactgcttagcactcaatatttaatgaatattattcttggttcattctaaatcatttttctagttggaaacagtaggggttatcccaaatgataccttctaattcttagaattcccctcatacctgtggatagatgtctgttcccctaaaactgctcttatcggaaccagttcaggacttttaactctaattttacattcattctttcagtccaggtattctacttgtgtaaccctcacgtcttctgtttgctagtatgtttctaagastttctatggcaggtgctcacaacctctttttcgtttcctgccccatcacaggaaggggaggaactctcccatctggtactgtggctcaccttgacatggctgcttggtggcagaacactgtatcctaatcccaaggaacagagcttgaaaattacccccccaacctctacccytacaagctcaagagacttttcaacttgtgcttctccccgcwacctgtcttagtggtggatttaaagatcagcctctggggtcccacggcaggtttattttactcttcaaatgcttttgcctttgattccaaaccttggagaagatgtgattaagctgtagctttaccggtcataaacaagtagaacatttgcattttgttttccaggctctttgctttgagtaccttgttgaatgcacgttgcccacgttacaagatttataatttgatggcttaaatgacactcaaatatgtttgtcgtttcatatagaartacacacttggtctgtacttgccagccatattttaattcttttagcttacagctttctagaagcatgattgtaatttccagtcattttgacttgtggagaaatggggagaatgggaataacaacggtgctttgttaataatgcatattgaagtgcaaatgaacctttaaattgaaaagggaaggcatcaatgccggtcaactcagttctcaatatttctctctagaaagcacygtgatggtttttatggaagagaaagcatcctggacttaaaatgcatgtatataatgaaaatggtgcgaaaaataatttcaaatatgtggaatccttgtgaattggaattatatagtagattgttttggttagcacctacggtaaatatgaaagggacatttcctgccccacttatgctgcctttatttcactcttaaaaaaaaatcaatagaaaggctgctaactaatcttgtttatgcaatgcagcaactgcatttgctttttccctgcatttttctgcccccactaaatgttaactattgcaaagactggtttgcagactctgatttttctgcagatgtttgcgtttttcttcacagagcatcaggaataaatctgcactcagggtatacactggctgtgatataaacctgagctattgtttgtcatttttacaaggctccacattagattttagtgagaacccaggctgcccctcgaagggcacagagaaacagggagcgtcacagtcagctcgttctctctgtggatttttgagtctccatcctgaagcctccttactgttcagctcccccacagcagactccttccctctccatcggctactcattcaagaatgcaaactaattttaacatcatcctaagcaagctctgagcaaggcaaagatggtaaatctactggagaaaatcacataagacatcccaaaggcaaatgcaaattatttttgaattgccttttctttagggattatctgtgccattgttcccctccgttagtatggataattatgagtcaaayagaaaagttgctgccttctctgaaaagaaatgtttgcttgggtactgtgtacatataggacagcgagttggggaggtgctgttttgcttcctcgaaggtggccattctgaaatgaactggtgctattgcttttgtgtttctagacagcctatcgtatttgtttaatagaaggcacagtagtggtggggtatttgtagccatagcagtatatagcacattatatgtagagcctaatgagagttgaatatcaggaactggccagaactgtttgaaaactccttaaatatgacaggcatactgaattcctctctaacaaccatccttgcttccatgcctcttctaagagactatcatgttcttttactaccttagttgttcttaaagcttggtggtgggggctcacgcctgtagtcccagcactttgggaggctgaagcaggcagatcacctgaggtcaggagttcaagaccaacctggccaacgtggtgaaaccccatctctacgaaaaatacaaaaattagcagggcgtagtggcaggcacctgtaatcccagctacctgggaggctgaggcaggagaatcacttgaaaccaggaggcagaggttgtagtgagctgagatcatgccattgcactctagcctgggcgacaagagtgaaactcgtctcaaaacaaaaaacaaaacaaaagaaccgcttggtggggaacggggcagcaccacttccttggccctgggctttgaatatctatttatgtgagtggaggctccagttttccaggtgtggattcctagtgagtttcaaatccactgaagctctggataaataaataatagatctcacttgtgccattcgtttttaaggcttaatttcaatacttcacatttctccctattaacattcagtttgccggattcagcctgttctcctggcagaatgtctcatttgtttacttctgcccgcctacatgtcggccaggtgtcagasgctgtatcctgtgtggatatgatcagtgtgtgctgtccccatgccagtcacggtcaaggatggtagagacaacctttcctaaccgaaaytggagctcaacttacaaatacgcagaaagtgatgttagagtcaaggcatggagcgttgcttgcttgagctaatactgattgttttcttgcctagaggaagagaaaccaaacttttgattcatttcatttgctgatattgctggcgatggacactttggctgtggtctcattgtgattgttgttttctcgctgtcaggtgatagcacagctggcttgcatgtggctacccatgtccatcatgactgtcacctctcacctggacgactgcatggcctccttgctgcactctcagcttccagtatcatccaatatcatcyccctagaatccgttctccttccagtagccagagcaatatawtatatatatatatatatatatatatatatwtatatatatttattttttttttttttttttttttttttttttgagacggagtctcactgtgttgcccaggctggagtcagtggtgccatctcggctcactgcaacctccacctcccaggttcaagtaattcttgtgcctcagcctcccgagtagctgggactacaggcgtgtaccaccacacctggctaatttatctgtttttagcagagacagggttttaccatgttgatcaggctggtcttgaactcctgaccgcgagggattcgcccacctcagcctcccaaagtgctgggattacaggcgtaagccaccacgcccagttgcaatatttttaaaatctcacattcaaggcccccatgctcttagattattaggctatcactcaacctccttgccatggccccagtgtcctgtccccatcttccacctcctctcgtccactcttgtccgccattcgccagactccagccatacggcctgttgccaacacccacaagctctccccagcctcaggacatctgctgttgccattccatctacctgaaacactgttcccacaatctttccacacatgcctctttctcatccttcaggcctcagctacctttggcctgcccactgcccagcttcatcctacctgcagaaccctgtttatttcctttgttgtacttttcacagactctctctttctttcgttaattctgcatgggctcaccttctcccaggccccaccagaatatgagtttcaggaggacactggatttcccgaatatgggtttcctgaatatgagtttcaggaagacactgggtttcaggaatatgggtttcaggaggacactgggtttcaggaatatgagtttcaggaggacactgggtttcaggaatatgagtttcctgtccacactgtatccccagcaccctacacagggcctagtgcaaacagcatccctggtagatagcatgggatgaataaatgttatacaaatggtctgacccatatgaagaaagaattgcaatgaggatttattatagccccaatgtcaacttgcttttctaacttgagttaagttcccattgccagagtcctcattgcaggctgatcgggggttatttatcctggggaacttggctgtgatgactttgagaggcccaggaactggttctttcttgagcaagattcaaagaaggcctctgcctccacctgggaacggagacttttgggctaatcccagaggctgatgttcccgtttgaggaagggcttttgttcataaccccccaaaatgaaaatccagtagagcaaccagtttctttttttaaattttttaaaattattattttaatttcttctttaaaaaaaaaaaaacaggatacatgtgcaaaacgtgcaggtttgttacataggtatacgtgtgccatggtggtttgctgcacctactgacccatcctctaaattccctcctctcatcccccacccctcaacaggccctggtgtgtgttgttcccctccctgtgtccatgtgttcttattgttcaactcccacttggttctctgttcctatattagtttgctgagtatgatggcctccagcttcatccatgtccctgcaaaggacacgatctcattcctttttatggcagcatagtattccgtggtgtatgtatataccacattttctttatccggtctatcagtgatgggcatttggattggttccatgtcttcagcaaccagtttcaaatgttgctctccatatcacaaatttaaaaacatgattctttgttgttgtttttttaactggacagccagataggtggaaatcacgtggggataatgtaaacctctctctgtgtgtgcagctaacaggagaataaacctccgccctgagccggcgactcccccagtgcttctctttattatgtggttaagcttccctctgagcttgcagttctctgaattcatgagaaaatgtagacttctctgaaaattgcagagacaggaaaattgtgttcacatgtttgtttttattatctggaattgtgtattttctaaatggggatcttaagccagttggaaatatcccatggtcgtttatttcacccctctgcaggctgaaaagtgtaaacgtctaaacaaccagattcctttccatgagcttttcaatgagagattagtttttcatttctagagctatattttcttctgcataattagccaaatttttttaatgattaattagggaattatggacaacagagagggttctgcctctttcacgcctcaatgaggaaaaagggcaagatcttcacactttcagaaggtgtctcattttgtgtgcacccgtgggcaccatgggggcaaatgtcttttcttttataagtaacgcatagttatcaccataaagcatgcctacaacatatagttacaaagcgtaacagtttcttcttgtaacattgtaaagatatgagaaattgtacctttcctggtgctttatttttccttttccataaggtttccagatatctttaggaacacctaaattcatgaattagcacagctgggcagcaagaaggaacactgctataatacaaacatttttcttgtaaaagtctgtttggaagatcccggactgatggggatttgttttataaaagatgtttccctcaggattatgtgactggaaacctgattcaaagcatacttttgtgattttcttttgcttttgtctgaaagagtggttataacatgcaagttttaaacttgaagcagtgtgtgtagttaactcataaaccagcaatatcagtcatcaggaccaaagaccaacttaacccccacttcctccaactgcattttatggcagaaacagaaggctttgttttttgtttttaatgtttgctttttgagaccaccctccacgaactgctttatttctcttaaaaatgcatttggaattcttccagtaattcacagaagagtgtgaatgctttttgaggaagtttgattaaaatgtgatccacttcaggagctgcctttgtgggggacggggttcctatttctgctgcctgaatcatctccattcatccacttccatatccactttccatgttctctcaactgtctcactcttacgaaatccctgttctccaggggcatattgcagtcttakttttttcttaactctgtttctttccgttctctttctctttgctcttttttttttctcctcatacctttctcacttctctgttcattagtctgacagtttccttttctccagaccaccccggtcttccattgcttctaactagatttttacatkatcatttaaaaaatgattatacagttcctgttcaaaatgtattctcctccacttttcttaagtctcaaaacaggtacacttggaccataaagacaaagggaacagccacagtgcattgaactccgtcgtcttctctgatgaccttcaaatgtggtcatcagagaagacctacacgtggtctgaaataaatgacttttgactggctcctgttctagagagtgctttggttttgtttgtttatgtgctcsttttgtttaataatcttgatttgctgctccaataatccatgattcagcagaaagcttaaactcctttttaagggttttccaagtggaaatggaagctggttactcatgttgagaaggttttacaaagagttggttggagttggggtaaacttctagatggaatggaggtgtggggrcctggcggggatgggggatatacattctcaacctaaagtgtttagattgagagacattgacagtcttaatgccagagaggcattaagagagattaagtgcatgtttactcttggcagcataaaagagagaccctcaaggcaactaagtatgtggagctggtgatcgtggcagacaaccgagaggtaagaactttttaaaatttctcagtatggttggttagagataaaagaaaaaaggacatgttttgcaagttattacttgctttaatgaacctcatttcctatgtgctcttaaaagcaatggaaacaacccattgaaacaatggttttctgattttataaagcatacaatattaaaaatttatttgatatataaagtaatggcaaagcctgcaggaaaaaacagagttgctctatagctcagctctccaaacaaggagaattaactgagaggaatgacagaaggctttagattatattctaaaacattttggggaaaagtttagtctttaaaatgggacatttaaaaaatatcccatatgtcattaatcaaaatgaataaatgaaggtatgaatgaaggctatagagacacagcagaaaaatcctcccctctgagctatagcttgatactacattcattttttattttaattaattttgaattagtttttctaaagattatcttctctgtatttactgcctcattggcatatatgaattgggtgattgggtgatattttctcatagactctttcaacacctatgaatgaaacaggcttgactatttttcagaaaatgattcccattctggaaggtcagattagagaggggaatgggaaatttgttgatttttttgtctattctcctctgtattgtttgacaagctgccatgagcttctatgacttttactttttaatttttaaaaacaaatataaagaaaatttctcaggaagttaaaatcaagttgatgatatgaaaaatggctttggactgacttctagttgtctgtttcctctttgccaaaacaagtcactgcctccatcatttatgaggctggaaaattgcagaagttgctgtcttgagagcacttggcttaggcaaatttcagggaatttcagggagtccccagccgggaaagttagtcrgcaggatgcaagctcattttaccgtgaactgtggagggtccccagtggtttgtaaaatcccaagacttcacatttccagaagccaggaagatgaaacgtgattgatattcttgctggtattaatgctgccatttaaaattgttaagtttcagaggcaaggaaaagatctggaaaaagttaagcagcgattaatagagattgctaatcacgttgacaaggtaagttctttttcagtagttaaatcattcagatcatgtaaatgtttsgaaatgaggttgggggacctcatctgacttagcaaggagatgaggttctgcctctgggccttggtttggaactgtttcctgtcctctgagtgtgtaattcctgggtyctggggcagcttcaggagatgccaaaccacagcagtctggactatggtggccttggtgacatgtcttcctccaggctctcttccggtcaggtggaataccagtctgagggtgttttggacttcccgattagctccagaacccctacagagttcacctgatcctttggattcctcctgagccgggcctctcccaggtctcccgatgacggatcccacaggccccttcaatctgtccccatcattgcaggcctgtaccaatgtaaccctgagggtgggcttgcatttataagggatccataggcttcactgtcctggaacacagaagttgactttcagctaaatcagctattggaaaatccctcgccaagaacaagtaggtcagaaactcacctttcacaaagatgatttccttgctggaggagcccctgcaaaccaggtcctactcctggggtacttgttcactaaccgctcctcacactgcgggccggcaaagaaaatggcagcgctctctgtctaaaccacctgtccttcctcagtgtatcctgctggagaggatgttggctatttgctgctgacgacccttagcctaaaataggcttctcacaagccccgcatattggagttgccctgtgagcttctgaaagcattgctgccctcaaggggcagggcgggggggaggttagacctcgaattttcagaagctccccagcaattctcatgtgcaatgtggatggtgaccgctgtcctaaagcaaccatagtctctcagcaatactgagtctcttgcctgtggggacagtgtgagaagggatctggtcatggctgagcctttcacatccatggtcctctgaaacagcagattttacacatagtggtttgtgagggtgcctcactctagccttgtttccaagcaatcttattcgatttgaattgcattctctaagttttcagaaaaatgaaggcaaaggtcctttcagaaattcggctccatattacaagaccttatgcactctgcatcaataattcagaatgaatcagatgtggtccctccacttgagaacgtcaaggctgtgtagggaagcagacatgcaacccacacagcatggtccaaggcattaagaactagatccatgctatgaatggaggtttatggggatgcagaagagaatcacttacttcttcccagggccagggagtctttgcagggagaggatcctcaaaggtaagttsagtttcacygtgagcatagcagaagaaggartatgtgtgatgtggacatgtatgtgcttcatgtacatgtacatgcatgtgtgttcctatatgtgttcatgtgtgtgttcatacgtgtgtgtgccctgcatgcatgtatgtgtgtttgtgtacatgcatgctcatattgtatgcaaatgtatgcatgcagagctagggcaggaggagatgaagctgcaaagattcacggtgctcaaggccccggctgttctacgaagccatcttgatgttattctgcagtgaatagagagctaggtgaatgtttttaagcaggggagagacacacatgatagtagaaaaatattcctgcagttagtgtggagggtgggataaccaaagacaaatagggctgagaggagcctattgcatagaaatgataaaggcctgagcgggcgcggtggcttacgcctgtaatcccagcactttgggaggccgaggcgggcggatcacgaggtcaagagatcgagaccatcctggccaacatggtgaaaccccgtctctactaaaaatacaaaaactagctgggcgtggtggcatgcgcctgtagtcccagctactcgggaggctgaggcaggagaattgcttgaacccgggaagcagaggttgcagtgagccgagatcacgccatcgcactctagcctggtgacagagcgagactccatctcaaaaaaaaaaaaaaaaaagaagaagaagaaaaagaagggataaaggcctgacctgacccagggcaggggaagtggggaagtgagaaggacaaggattgagagaggctcgaagggatgtgtttcctgattattatttttaccagttactgtgtgccgggctctaagtgctttgcacacactctcaggtacacactattgttcttatttttaaagcagaggaggctgagatgggcagaggttattcatttgcaggacgagggatgagtgctagtcttgccaactcccagcagcaggggctcttggctttgactctactccccctrctgtgagtcccgggacctcatgatgaccaagcagaggctgagggcgagtgggagaccacatgaccgccagtttcgttggagtggaggggcaggtagacgatgcttcataccccaggaaagggggagcaggaagaggagtttgaagggcactctgaacagtcagagatctgggtttgccactcagagagaggctatggctacatggaactttctggaagtcagaaaaacccacatggccgttgatatcctgggatgatattgcccttgtccacctttgaagcaggtcaaacttcctggcaacccctgcctgttgatgtgttttcagtagttactctttgcagattcaactttatcccatagtccaggtgcaggagaatcctggtgaaaggcaaatcctggcaggggggatgaagggtgggtcttagaggagacatcaaagatagcacggcagttagaactggacctcggtctagactggacattagaacccctggaggggagtttgtttgtctatttgtttatatgtttactttaggaaatattgattcccacaccttggcccagggattctgatttgattgacctggcacagggcctaggcacagatattctccagggtcctccagttatcctaacatgaagtgggactgagacgcactggcctagagggcggaaggcttaggtgcctgagctgggagcgcaggtgccactccaaggtgagcgagttggaccattgccccaacggcctcaggctakcctcagactgtccaacgagaagaaaacacgagttcttcttagacctcgggagcaaaaggaaatgataaactatattaaacccaaactggaaattgctgaagccccattttaaaaaagggatgtgtttgggtcctctgtgtttgtatttcttcacatttattctaggttatatcttgcttcagtttgcaaaaccaaaaatgagcaattaggggtttgttaataacttgcactggtaattaaaaaacactgtgcctcggaaaagtcctaacggactccgtggagtttgccggcctggctgtccttgtgtttctggcagggagagagccgatttgctgagcacacagctacccctggccctgacatccctgtccatccccagcagacgccaaagaccttggaggagatacccaggccccctgggagacttggtgcttccaagtctatgaacagatgactcccagctctgttacacaattctaaatttcagtttttcaactctacaaatgaaagtgtctcagtccagaaaacaacgactgtgccagtggcaacttcctcatttgctgaagtcttggctctcctggaccattctaacttaataactgcttgctgcgtggagaaagaggacatcctagactggaaaacagacgagtggtttagtgatgaaggtgacattctggaatgttcaggaaatccccccatgagcaaaacacagaaggcatgtctgacactcatgcttctaggccagacgctgagaattttccccgggtcctcattacattcccacaggagcccggggagtgcacctgcccatggagctatcgtggagtttgcatcttccacccttcacctccagactgtcctccttattcattaggaagttagtgtcagctgcaaattcagggacctgcttctgaaaggactcatcgtctatgtatttaatttcttttctttctttctttctttttttttttttttttagacagagycttgctctatccccaaggctggagtgcaatggcgccatcttggctcactgcagcctccacctcccaggttcaagcgattctcctgcctcagcttcccgagtagctaggattacaggcacccaccatcaggcctgactaatttttgtatttttagtagagatggagtttcaccatgttggacaggctggcctcaaactcctaacctcaagtgatctgcctgcctcagcctcccaaagtgccgggattacaggcatgagccaccatgtccagcctctgtgtattgaatttcttaggatattttcactcatgtgacagttttcttctcctcctgtcccaaaccagttgcctgaaggatgcagtttccttcattagaccccaggggattccgcctcactgtttcttcccaaaagtctccagtgcagcgtccctggacttcctatgtgcaccactgcttggcagttcactgtattggagttaactgaactgacagttcagtgtgccatgccttaagcccctggtgacctctgagcatttgggtggcaggagcgagggcatccaaatctttgctctctctgccactgccggcccagcccacagcaagaggcaagaaaatatttgttgctgttgtgtaaacaggtgaatcgcttcagctggatctctgactgtgtccacatatgttctgggctttgtaagtcaggcaggcagctgccaagctccatttgtacagcagaggcccgtgagcttctctccgggcctggggtcacagtgggccgtcttggaagggagtcttagtgctcacagaagatggcagtgttacctagtgggttcaaacatgagcgtcagggttagctggcctgtgttccaaccccagccatggagttgcaatcttaagtcacctgacttctccaagcctccgtgtctttgactataaaatagaaataataataattcttaacacatggagttgttttcaggattaagccacagcacagaaaccaccgtggcatcatgcctgtgatgcagtaatgctcactaaacattagctgtggtggtggttattaggaagaatcaaaaggaacccgtcagcagccctggaaagaacttttagagcaggcagcaaaggcatcatgtatgatgacttgatgtgagtttagcataaatgacagtcaaacaatggcactaattttggagaggggaggttgtctgttatattactactaagtatgaaatctgttctaaggatgtggtttgagaagcctagtaggtggagatgcaaaacccatcattatcatgaaaagctccttgatgaggaagcagcaaacctagcactaaggaatgatgacaattagtcctttgctgaccttcattactggctccatgcaacactcctgggaggcaaacctagtgtctccttcccagatgccaaccctgagcccacgcaaggtgtctgaccccaaggacatctcttagcaagctggtgtgagcatcagcattggatcgcctccgtttctgctttctgatcactgttacctttgtatataatagagctgaaaatgtaatctctcagtggacagcagccaaacatgtgcattcagagttccagagccggccaggaacttactttcgccccggaagcctgggctgggagtttgcaagtagatagcgtgggccatgcaattcttgattgaaaacaaactgttgggctgtgttgtagtcatgtaatcgtctcgttaactcattaatgtaatgtctgtaattgtgatctgtttgaaaccaagttggaccaatgcaatcagcatatattctgtgatgcactttgtatccyggtcatattctcctgctaacccaatgctcaccagatgactgtggggaccagcaagggaaaagatgagctcaccttatgtgggttagaatctagggtcagatgttcaactttgagcagtttcttctactttagttcaccatgttggaatggtgcctaactagcaaatgcagaacttctataagttttrttattggccagatgcttccagcaactgagaataggacctgctttcatctggtgcttggctttggctgctatcactagccacccttttctccgtggctacctgggatctcagaagatgagggctttctccctgtgtgctgcctcatacactaggggcattgaaagatttgacagcccaccaggtgacaccatgtcctagccccctcaaccatgagtacaaagccatctgcttgtctatgtgatgcctatgaggacaatgggtaggtcatacctctaccctgaccgctcatcctggccctctgaactcctatgagacaaagccatcccttagtccctggaggagttgcttttccctgccctgacccagaacgacctgcctgtaggtgtagtcaggtatgggccatakgctgaagtcaggaacacccaaagatggtgggggcaggcaggggagtgagaagtcttgctttcaktggtgtgccggatgctttgtttcacaggcgcataaaagaggaacttcatttaacagacctttccatgacactgttggtgagctaacttctggctgtggggaggatagtcattaatgttcctgaagaagggctctgtttatgcctttgttattctgaaagatattgacttctttattttattaaaacctgcgttgattataggtgacagaatatgatagtgttagccagagctgagactttgctgaaaaattaatacagattcattttcagtaactaataagcagaacattttgctcaaaatgaacaagttattgtccttggcagaagtgtctgaaagatcctaattcacttattgtttcacttgcagtggatattaactggccatctttagctataatacacatctgtatgtacattttaaatcaccagtgagtcatttgaaatgtatgcttccatacaaatgcaagtagacagtaaaaaagctgataacttcagcatctaattggtcaatcttcgagaacctagttaacacatcactttgcattaggcactgcaaatatttcttaaattccaacaccacaggaaccaaagagcacagagatatttttctcacctgtgtcagtgaccctcaaataacgcaaatctgttctaattttcatttcgagtttttattaacgtgatcccaactccaatgccagttttgcctgttttgcccagttttacagaccactgaacattcggatcrtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcaggtagggagttacgtcttgtctgcttaaaaaaaaaaggagtgcyctcggcgaagcccttcgtttcacctgcacagccccaggagctgccacctttctgcagagcacactgccttgtgcaagggggcttctcagctcacaccaggggggcagatgccaccctcacctggaactgaaggtctgctaggaaagtctccctctgaacaccctggaaaacctgtccctctacagaactctcatttccttcttctagaacccggacattttcttctataccaatttttctgattttagctgtgatgtaaagttgttctgagtagcctatttttttgttttgttttttgtttgtttgtttgtttttgagacagagtctctctctgtcaccaggctggagtgcagtggcatgatctcagctcactgcaacctccarctccctggtttaagtgattctcctgcctcaacctcccgagtagctgagattacaggcacacgccaccacgcccagctaatttttgkattttttttttttttttttagtagagacagggtttcaccatgttggccaagatggtctcaatctcctgacctcatgatccgcccacctcggcctcccaaagtgctgggattacaggcatgagccaccgcgccmggccgaggagcctgtttttaaagattcatcattattagtggaaaatgtatgtttatacaakatctaaggacagtactttgggtgaatactgtcagattcctggagggaaaaaagactttattcctcctcctgttgtggctgtgactctttggttttctagatcagagaataccgggaagcatagcacattaaccttgtgttccctctttaaatcaatatgcatcacccgttaggaaccaaagagtgtttggggggctttgaacacagtggtgaccaacactgtaaatctccctgctctcagaagtctccactctactgagagacaacaataaagaggacaatttcagcaggatcaactggaagatgataaactaaggcaaagcatagctctattataacacaaaaattgttgagatgttgccgatgcttttatacttaaaaaaaaaaggaacaatctaaattagtatgaagtagatgtttctagaagtgacaaatttttatttaaatctttaaatactttgtgctattattcttttgttgtcatgtggcttatagcacagaaaggaaagcttctgggacagagactttcctttgacaaacccaatgtagctattgaacatttgtggaaagttaaaaaaccagtcctaccccattgtcacttcagaaaatgcctacrtctgaactgaggctgttggcattctttgataatttacttcggccattttcacagggttcccccctgcccctacccttggatatttgtggttgcctcacattttatgcattgattagtcttgaactactaaaagtacattttatgtattttgagtcagagtgttttgatatttttcccaaatggagtctgtccaacttgaacatctggaaataaattatcatcttatgtaactttattatttatatacatgtataattatatctgttcatatagtctatatagatgtaaataaaggccgaaatttctaccactgtaaatataagtatagtgggataggtggatagagagggagggagggagagagggagggagagagggagggagggaaggwgggagaaggttttatatacacttaccactttctgttcaattgaccatagctaaaatatctaacttttcaaacaatatatctgtatacatacatggccaagatagcattggtaagtcatttgactcctttaaaggaaattcaacaaatacagcgttttgtttttcatgcatgaggttggaattaacagcacttgtgttcaacaggcccttggtgtcattagattcatgatcaggttaagattccagatagaaggacgactgcattgaagccatgaagtccccttccagaagcttcctccctaggtgccaaggctttgtgggtgctcacttgttctacaccggctccagggttgataatttttctgcccatttcaattttgcaagctatcttagcgggacaatttgaaagaatttgggtgtctggcagaactgtagtaagttacccaggaaagcagttaagctatggtgaaaatctagtaaaccatctaatgcatttcttttagttaacagtgattctctgtgactattttcagcctttccatcagcagacattgtttaaatggagcagcttcctacagtccattaggaaataggcagattacaactcataagtacaaaagtaataactagttgtcatctgagtcttgaaaacaaaactctaaaaaatgacagaaccatgacgcaactgcagaaataaaattttcagggaaaaaagataaaatcacatgtgaatataccctcatayagctatttttatttttgcgtattttattgcaggaatatccarcagaatttttaaatattagagaatgcccccgttctaatttgattaaagaaagtcctctcttttatttcctagtggggtttatttccaagggaccaccatcggcatggccccaatcatgagcatgtgcacrgcagaccagtctgggggaattgtcatggtaagccaagggcatygggagctggttccccttgataatgattccccaggaagtcactacttttatcagactttgtgaagatagatcctttcctttaatgctttttagatttaactctatttttactgtagctgtatttataattttatatatcccacagtgttttaggaaccatttaaaagcaaattgcacacaggaaaggtgggcatgtaaaatagctcagcagaggcaagcctacctcttttatggagaaacattttcaaccaggactttccaaaccaggaattcctcgcagcactggggtgagccagggcattggggttgccctcgtcatgcagctgttgggacgccctgtggtctcaccagacgttcccgtttggatggttttctgatggttctgtctccaagcccaatggcccaaagtctgaggtttttagctttttaccactgcaaatgctttacatgccttctggccrgtatacagtttgtctttaaaataaccttattcttggaagtcagaaacccaggtttattgctttacaaggaccattttgtcatatataagctatatatgtttgtgaaaggaaatacagtgggaaaactatttgggtctcgttatgaatgtaggagggaggtagctttgataggcttgccagcagggggcttgtgctccacttcatcagataattaaargagaggttttcaccctatgctgtccctgctctgaaaatttagtgtctcctctgcaccagacctcagacagggagtatcctcagagaccattcttccatctccattaaacaaatagaaccctgccctcccaagaaactgtgagttcctccatgttttttaaacagaacatgtgtgaatgttcagttgtattacatagtggaaggagttatgttctgctgatgattactttctctccacctactgcctaatcagatattcttcatgaatatacggaaccaacatttccctcttctgtgggttcagagattggtcattaatgtaagcctgcactaagggtcaaagctgcgtggagggattgcccccacttactggatttctggcttgagtggtgactgccttgttttctgtggacctggaggccctgcatgtgatctccaccatggcaggtccttggcaagtttggtttttgtgatgccaggttcacttcaagtcagatcccaactctatttttacagagcagactgtacatttttaagagggaataattttctgtttcatggttccatggtcagttgctactgactttgccacttcaagttggcatcatattttttttagagctggaactcaattcttcataagcatggtaagttctgctgctgtgcggtgctgaaatgggcctgtaacccatctcaccagagtaagcggctttcttcagctcgtgtcccttattccatttccatacaagcatttgatgaaaattccttctttaaaaggatacagggaaggctatttttaaaaaaggtatatgaaaatgaatgtgggaaatataagcaaattatgtgtcatgcaataagattcaattgaagatcaaagttaattatcaggaaatatgttttagcaatttgacagcagttaacatcatccttagacacactgcttacacgttccacatataacagaaacatcaaataggataaaaatgcctcagcacctttgatttctacaaaagtcatgaaatcagcaagatcaacatcttgaccagaccaaaaacttctagactcactttcttctcctgtgtctgtaaagttacattcacgggcatcccgtgtgactgtgcttcattagaggaccacaaatctaagaggaaggaatcaatgtagcaaggaagcagagatcctcataaaattgaaaacaggattgtrgtaccatttctgtattttccaatatagagcaaatcattaattttagtgactgaaagtcattcctttttatctaactggcctaaaacagccttgstttggaaataatattaataacatgaataaagagatattttttcttactacaaatgtraactgtttatcaaggtcttttaagagacattctgtttataatcattgatgcrtgaaagaatgtaaaacaatctggcaactaaaaaccaagacattcaatgacacaaaagaatcagaagaatattttttaagggtgaattccttgaattttgtgccagagcatggtaacttcagcccctatgttcttagactgactacattctcttcaccattgtgttattttcgagaaccgatttcctgaaacatatttgtaaacttcctacaacaggaaactctaaaatctaaacaaagtaatttattaggaatttcatctactgtaagattatcttggttccttgatatgctattgttttcttagacagaagcctcattgtaaacactgtcaacaaacctgtaagatcttacatgagcacacttttatccaggagcctcacacagactgtatcagtgtgctctctgaaattcagtatcatatttgttttagcccattttctgttgattctaacagaatacttgaaactggataatttataaagaaagggaatttatttcttacagttacagaggctgagaagttcaaggtaggggggcacacctgatagggcttcttgagggtgaggactctctgaagagtcccaaggcagtgcgggggatcacatggcaagggggctaaacaaactagctcaggtccctcttcttcttataaagccactggtcccactctcatgataaaccatgaatgcattaacccattagtccatgaatggattaatacattatgagggcagagtccccatgacccaatcacttttttttttttttttttttttttttgagacagagtctcgctctgtcacccaggctagagtgcagtggtgggatcttggctcactgcaagctccgcctcccgggttcacgccattctcctgcctcagcttccagagtagctgggactacaggcgcccgccaccacgcccggctagttttttgtatttttagtagagacagggtttaactgtgttagccaggatggtcttgatctcctgacctcatgatccccctgcctcagcctcgcaaagtgctgggattacaggcgtgagccactgcgcctggcctgacccaatcacttcttaaaggcctcacgtccaatactgccatattgggattaagcttcagcatgcgttttggagggaacaaaccttcaaagcatagcagcactgtttcttggaagcctcttggaaaacatcttatctctttcctaagtagcacaaagcaagattcaaacagggtattttccttactccatggtatacaggccttttcagaaatgttgtatataggcactgtttctgtagatcatatatgctaattaactaatttcagtttgtaaaagttaagtaactatattttttagttaatttctagtatctgtttgagccaagccatccaggcactccactaagttaggggtggccaagtagtgcttgttgaatggagaagccgccttccatatccaagcaaaaggttaatgaacccccagccgcaagagtcagagaatcgggacacctcccatttccaaagtctgcctggcaacacaaagagccagcaagaataagwtatagctggtttataatcttaaatgaaatgaatggctcttcaaacagatgactcaatgtggtcagatttattatgaagtattgtgaattttccaactgtcctcccygaccaagcacacaggaagaggcaggctcaatgacaacctctcagggctcatttagaatgtcattaagcgtgcttgcacctgtcacctttatatcagcatcatctcaatcaaaggtaaaatgatacttctatggcccatgaaggaatgagcttttcctatgatgcaggatgactttttgcytcattcaatggaagagttttgtggggcaattgtaggaagcagaatggagaccctgccttgaagatgtcatgtaaaaacataaagaatcacacatgtatacgtgcggcatacagacattmctcagccgaaaggaccccaaactggsttaatgaaatgtcaaattatatctttttaagtttaaactaaatgatagcgttttaccttggtcccttataaggaattacattaagtcaaatgttaatgaaaggtatatttctgtggggagggagacctgggaaataaggccaaggagatatgaattatacacctgtacttttgtgttttctttgaggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccmcsgggcaagtaccattgcttccatctgctttgacagtgtgcatggcttgaagtgtgtgttgggaaccagatgagtcaaagtgtctctggttttctggtcagagcacccagggaagcttccaaaaagtaattccttcccaagaagcaagrgtggcctgtgctactctggagagccatgggcagccagatggcaatgctacatggtgtgtacaaggaagagggctgaccttttccttgaggaatggtgggcatggatgctgtctgtgtttagaaatcgctaattatcttcctgtcccagcaagtgttttttatttgagcctacggctccagctgccaggcagtcccaggagccagccatctgaaagcctgggcagtggagatgggccacatgtaaactcactgggcagagtggagatgggccacatgtctttagagggtgctgggtagaaggtatttctttccccagggttggccctagggtgtctctgaagtcggtagcttgggggtttgtagtgtctctgccctgacatcaccttaccagatcttagaggtttaaatgaaatgatttctctgctttggtatattacaatgctgttccttatttaatgctttcctgacactcccgacttggttcaaccagaaaagagcaagacagttccattatttggagtgttcaaacgaagtggaaacagatgcaccttggagggattagagattcagatgtgttcttatatctataaagggcctatcccaaactagaactttgtgctagtttaagaagattctcattagtaacgggaagcatgcgctggatacaatgctatcttctttattataccttgaaaccttatgaacactgactttcatggaacattccagcccaagcctgctctctgggtttcccaaaaggagacactggggcaagaggcaagtgctctgagcagcccagtgactcatctctgtgaagacttgctggccaggggacaagcgtggtgtgaggggatacctgctactgcggtttaaaagacccagtagagggaggaattgttaaagaatgtgtctgtgctttttcaagcaatagccttgtgggcctcctgggaaatagtttgtagggcattgagttgcccttgaaacaagaactgagcagaaccacacagctcatcaggggattgtcctttcatgggagccatcaggaggcatcttcttacagcaagtgactgattcctcatgttcatcgcccccatttgggcagaggcttcaggggcatctttctgtttgtggttccctcttaagcataattcaagggagtcaccaagactttgttgaggaagttgctttgtgagtgtgtaatgacagaaaccaaggatctgtacacaaagtcaaagtactaaccgataggaaatgaaatattgcaaaactcaagatactaacatgtgtgtctctccaaaagggaggccaccctaaaaagtaatatgttcctagtcactaaaggtgtctgagaggaagcacagtaattgtttgctggacatttggggcaaggatttccttcttagggtataaggttgggccaagggcctatagatgccttctgtttccaacatttcacaagccctgatcgctatgctgggccacacgctgggtgactttcagacagtgagtttggcaggagactgatgtgcaactgagtggccttcgtgttttctcactctcaatgaactcatagccatagaaaatgcactgtgtgtctratttccctgatcatcagatgggcacaaatacattagcctatgggcctccagaaatggtttcccatgactaagaagatcatattgttaatattgttaatgttttttaattattgataaaccaatggaagagaggaaaacctakatcaagaacactggacttgaagagatctggttgtcccaattctcacaccattttttaaaataatataggcagtttagtaaccccctggctcttacattcctcatcaataagatgagtgagtcagtcttcatccacccatccaaccatctatccatccacccatccacccttccttcctcctttctttccatctgtctctccacccacttgttcacatattaaacaaatatttttgacccctgtgctcgtggggaggaatgcacagatgatgaagactctacagctctaaaaattatataattctgaaggcacaatagcaaggcatattttctggcactctatatggttttatctaaatcctttccaattggaaagtcttcatggcagtgctgaagaatgcaagccagatcgccccagagatatttgaacaccgtaggtagaaatggtattgttaagagctcgacaaatcatttaaaaggcttttttttcccccattaccaggggtttgctaatagcctttatttgatttataccatattagcaatttctgagttttctcttttgctgagcttgtgcttttgtataaatcttttctatttgcttctcatttatgatcccacattcctgtccagagagtggtgtttttaattttctcagatggaaagcaacttcctaagcaagtaggtgaattaatcacaaaagcccacagtgagggggaggtcgagcggctcagtcarccctcagtcatccatcacccgtggtggagttttcccggctgctccggtattatctcaaaatggtggttctcttacctcatagtgtctcygagagagtgggagaatggactcaatgagatcacatgtctgtaaattgtaaatcattccacaaaggtagtatattattacttagcttacagggrttttggaactatcaaaaagttaaaggctttttcagaattcctactcatcattgctggaaagactcccagtgcccttagcagtcactcagcagcatgtccacagtttccgtgtgatggctcactttaaactggcccacatccaaacaccagccagcctgtgtcttcctcctcccaccactgatggaggcttggggatgtcagttaaattcagtctcagctccaaaggtgattcagagatgaatcagtaactgctttaatgatattaacatctcagaatcaaaaagaaccaagtattgtagatggcttaaaggagaaaagtatatcccttcatataccttgtttattctttatcaaaacattccagaatcctaactctgaaaacattaaccaattgctgtcactgacaaatgggacctgaggcctgtaaatacaaggatagagtcctatttcaacttaagacttgtgtgacttcagttgcacattgcagggatggttggagggggttccttatggattgtatcattaattactgcaaggctttaagtgtgtgtaagagtgtgtgttttatgtctctaaacatttaagacctgtcctggaaatgactctttggcaaaagcagtatctggggattcatgtgggagtttaactcagttgagtttatccattaatgagcttggagcccttggtcttagggaggtgagggctacgtatgctgcatttataggagtaagaaaattgtgaatgacttgaacactcatagcaaagaatatttagcgtaatagtaaatgtcacttcctagagtaggaaaaaaggcaatattaacattcaaaaaatgactcttacagattcctttttttttttttttttgcagaaagtttctgttaaatgagagttggaggaatagggccatctcctcgggtggggtaggtgaatctgcaagtcatattcaccgagcccctgccactgttacacactgataggtgttagggacacagctgtgaacaggacaagcctgtttcttgccctcttggaactggtgttctagtggtgaaaagagttgaaaaatggaaaatttaaaacttgcagtttgggccaggtgtggtggttcacacctgtaatctcagcaytttgggaggccaaggcaggaggattgcttgaggccaggagttcaagaccagcatgggcaacatagcaagaccctgtctctatttttaaaataaaaaaataaaagtaataaattgcaggwtggaaggagtgctgtgaaggaagcaaaggaagaggacaaagagaggaaacatggggtgagggagcccactttaagtgggggtttgggggaggccaaaaggaagacagggatggagagcctgcaaagcatggaaggaagggagttcaggtgcaggggaccatgggcctgtgggcgctgtggggacaccttgctgccaggagccttggggctgtggggggctggagggaagtgatgctgggtagaaatggaggaaccagagccagcaaagcccagttggccagagcaggaaygtggattcttatctgcagagcagcgggacatcattgaagcttctcaggcaagataggaatatgatctgatttatcttttaaggtttcctcatttttaagaagaccrtgcagcctctgagatattgtagtttgccaagttaaggggttttctgtctgtacaaaaaagaagagggaggcttcctttagaagaacaagtaataatagtgtgtgaattctagtttagttctggtgtaattcataggcatttggaaactgtgaagaggaaggatccttcaccagcacactcggtgctcatcacgccacgctccacactcacctctccagccttgtacacttgatgtaaaatatttcttttggtttgagatttctttttccttttcctatagtgagcatcctttagggattctgtcagagagccaccaaggagcacattcacattttcttcatgtgtatctgaaaagaattgttgccacagttgtcacacggatgctgaaatcaggagtttgggcctgtctgggttttgctgggtctatactggcaaatggcttcaactgacgagtgtgtccccagctgccaactgggagtkggggcgggcagcgtgttcgtgttgtgcactgaggataatgtgggatgagaaaataagcaaatgagggttaccccctgctctcctggggtgcaaatcattcacattaagctgaggtcagaccttctgcaatctacacccagatcaaatgaccacgtttaaggagaatgtgttgccatcctacttccccgcaagcatgtataactggcccattcgattacatttaattccattcaggacacattcatggcacacctgcctggacacggaacacaaacagatgtgtccccaggtctaggtggcctccacccaggtcagccttctctctctcttttttttttttgtttttgttttttgagatgtagtctctccctgtcacccaggctggagtgtgcagtgacacagtctcggcttactgcaacctctgtctyccaggttcaagcaatcctcccacctcagcctcccgagtagctgggattacaggcacacaccaccatgcccagctaattttttttttttttggtatatttaatagagatggggtttcatcatgttggacaggctggtcttgaactcctgacctcaagtgatccrcctgcctcagcctcccgtagtgytaggaatgcaggtgtaagtgaccatgcacagcctcggccttctctaatgacatcagagaagacagcagccctgcccctgactcaggacaagcttgctacaggaaatgaggtcaacagacgmgcagctggccaccaggcagagcaaagccactcatttactccactagtayttactgtgtaccctctagaggccagatcctggggagcagtttcggagcaggcacagaaacacraggcaggatccttgacttcagggacctcactgcagggtacctcatcaaatctgcttacacagtccgggtatcaagcaccatctagaagtgatttcagtgtgggcctctaaaagacagagagaaaaatctataaccataacatcatttcacatcttttaaaaagcgaccaataatttattgcaaacagggagcaaaggttagaagaggcagcaggcagaaaagatatcctggaatagagtccagtctaaaccgatctcrgaagaattaaatacaggctgggcagaccgctccctgaaaattcctayctcatactgtgggaaaactggatttctcttggaagagatttctgcctgaaaaggtgttttaagagggtaaaatgaactgcaattttcagtgaaaaaaatcccccaagggctttggaagtggtaggaattgatagaaattcaatgtarcgggaaagtccacactctgtagaacttgctttcctgaaaatcagtggacaatacatatcgttagaattctccctcgaactttggggtgctgttggagattatgaaatacatttgtcatgctggaattttaccaagatggaattgaagggaattatttttccatcttaactcttcatttgagagtgataatttttttctcaatgaaaagtttaagaaaatcttcatttccttcctcaaagtgttaggtgaaaaaatggaaatctttatccagagagagagaaaaaaggaggaacagctacagaatgaggaactctggtaagatgaaaacactactagttagaatcaatttaattactcagccagagtaatggagycagctgtaccccgacattatcacagggaaaaatgaactggcaggagggattcttgaaaacagttcaagaagggcgcatcaatatrcagcctgttcttgtttcttctccatgtaattagatattgctcactggaaaatgaaagaatttgtgtgcaattccattagaatatgaaaagctgctgcccaagttagaattgtcctccccgttaagctgtacacaaaatagaggtcaagctcgggaggctgattctgtgtggccactgatccttgaatatccagtttaggggatattgaccctgraggaytgcattcatggtgtcctgtttcatcgatgaactttttaaattwaatttaatttttttgagctgagcctcgctctgtcacctaggctggaatacagtggcacgatcttggctcactgcaacctccacctccccagttcaagcaattctcctgcctcagcctcccgagttgctgggattacaggtgcacactaccaaacccagctaatttttgtattttagtagagacagggtttcaccatgttggccaggctggtctggaactcctgacctcaagtgatctgtgagcctcggcttcccaaagtgctgggatacaggtgtgagccacgcacctggcccatggatgaacttagtgagatggtcatgactatacctattttattttatatatatatatatatatatatatatatatatatatatatatattttttttttttttttttttttttttttttgaggcagagtccattggggccatctcggctcactgcaacctctgcgtcccaggttcaaatgattcttgttcctcagcctcccaagtagctgggattacaggcgtgcaccaccacacctggctgattctttgtatttttagtggagatggggttttaccatgttggccaggctggtctcaaactgctggcctcgagtgatccacctgccttggcctcctaaagtgctgggattacaggcgtgagccaccgcacctggccaactatacccatattactggagctcagagtgttaaatgaactgcttgcatttttccagaccgacctaagtagaagccccaggacataaagtcaagcggctttttcccagtgtgtttgacacatggaagtggccgtgaacacatctgggctttatgagagaactaaagctgcctcagtacagagccaygtccctgtgcaacctctgggaggtgggaggtagccccatttttaagccatttaattctgcaaacctccttcaatttatgttccarcagcagaraatgctttcctgtcactggctcgttaacccagcattttatttgttgtacagcatgtgtgaaaacatttcarctgaaatcctgccaatcctgcaatccccctcccacacacttacccccatggcttcctcctctccccaggcacagaggccacagtgtrgggtaaaggrttatttctagacttctctacaacagacaatatccaaaaggactcattttcagctccacaaggtcaggaatttgtgttttgtttattgctgaatccccagcacctagaacagtgcctgacacatagtagagctcaataaatacttcttgactgaaaggatccatgagcgggtggctggatgatggatgcatggatgggaggaaggaaggatagataaataataggtagatgggtcagtggatgaatggataatgggtgggtggaatgatggatggatggacggayggacagacagacraaggatggatggaaagaaggaaagatgggtagatggataaatcaatgataggtaggtggataggtggatgaatggataatgggtaggtggaaatggataatggatagatagaaatggacagataatggatagatagatggtacaatggacagatggatagacgttggctgggtgggcggatggagagagsgatgatgagtacagcacaattagataagtgcagagtgaggttttctcttcctyatctgtgtaatggcaaaatctctggggagaacgctctgaggccactgtcttttgtactaaatctagcaattgcagcagcagcattttcattttttgtttattccacatcattctacaatggatttacaatagtttgyaatgatacacacaatacaataaatagaagaaaataaaaacaaaatagagcagagaaaacccagataaataggaggcagagtccactgcttttctgtacataatccatggagacctgggtgagggaaacaatttgctttcraacagtagagtctttccagcagggccttcccctgaaagtctttgcttaatttagctaaagtgggaagagagagatcaaaaatatcaaatctaaaagcagttgtgagcataagactttgtagaaccattctccagtttacaaagatctttggcatctcctttcattgtcacagccctaaaaataaagaacaggtacaatcgtctccattttacaggtgagcacactgaggctcaggaaggccagagggcccacaggtggtcagggtcattctggatctcagcctgcagcctcaggctcctgatccattctttggcctttcacygggtacctgtgagcctttggctcgcaggcttggggatggggagggttgagagggacagctctttcccattcttgagttccacattgccctggtggtaacttcagtgtcagttgctcagtggggcaagaactgggcacrtgtagacttcagccctggtggcaggcttgtagatatctaccgtgactgctttttctatcatgtttgattagaagcctctatcctgttacaggcttgctaagtcagcagaaagaactagcgtattctgtgcaggtckgtctactgggctaggaagaaagggtggtaccatttcagacatgcccactgtccattattaaccactgcatctgtccatgtctacgagagtctgctcctccaacaacccccwcacaaattcagcagtcatttcttgcaatgaagctgagtagctcgtctgatacatggcctctgatgggctgargtccttttaatatggacactgtgtcccccgccmctgggttcttggtctttcaggacttggtgcaggaagaaatagccatcgtagctcagaagtgaaaagtccactttctggtaacgtccagaagcttcctgtacatgtctcaactgaccagagctcagttggtgactttattaaaaattctgggaaattatatttgcacttaaattggtttcagggaggaggagcagagrtcaaagttcacaagttaagaccatgaattataatgtgctgcagatggctgcattctggggcccaggtgtttgctattaacaatggaaatggcctactaaggatctttctggtcatttgctcctggcctggtggttttcttagctttctgtggtccgtctggttggcccactggctcagcgtccagttataaggcagtcactttctgtttctggagtggacrtgaggatggattgccccattagcttcagcctcrgttctgttctaycgtytgagcctgtgtggtcagagctgtgtccctgtgcaccgctgggcaggcagagtgggctgactcaggcccagytccctctcccatcacaccrtgaggaggagtcacgaggcttttgaggcggggcgcctatttcccctgcctgcagctcattagggtctcaacaggcttgcagccctcctcaggtgtgcacgatctggcccaggtatcacctcaggctagctggatgaatcccaagactgggcctttgtcttctgttacaccaaagacctttagggaagtcctctaaggtacacctggaaggaagtgtagaaccttgggtgttccttctgtttacgtctggctccagggagtcccgaggcatcggagcagctgcctctcccaacccatggatmctactgctgctggcatagccatttgtgctgggtcatgcctgaggctgcccagaggccctgycctggggcagctcctgatagccctcgagrcggtgtggttgagtgggaagaacacaggccttctagtcagatctgtgctttcagtctccacgcagraactgcagggtcccggcaaggaacccaagctgcctgcactcagcttcctcatctctaaaataggagtcataattggctcccagaggtgtcagtgagagaatgtctgccaggcttctggtccccagcagggtttcactaaacaaatggtrgctcctggccagccccgctccaggcagsatggagtaaaaagcccctaaaatgakatgacctccttgcatccacagcaggcctgccacggcactgaacatgaggccggtcacctgcgagtacaaatgccaccgccctggcctaccaggcgtgctacttggttgcacataaattctgtgtgtggtgattgaaagtttttattgttgggcataactggggaaagacctgaagattttcctgaagatggccctagaatttttggtcagcagcttgtccaagcaatgtccattccccacactgyggtcccctgccccctcatactgtaagaggacctcgctctcacttgggaagagaagagggaattcatgttgggcttatgcttctcaagggactaggaatatrtagaactggctgtgaactaagaatggctaagttgtttttggaaaagctcagcaagctagttatggaatgaatgataaaagttgtggccggcatggtggctcacgcctgtaatcccagcactttgggaggccgaggtgggtggatcacccgaggtcaggagtttgagaccagcctggccaacatggcaaaaccccatctctaataaaaatacaaaaaaattagccaggcatggtggtgtgcacctgtaatcccagctactcaggaagctgaggcaggagaatcgcttgaacccgggaggcggaagttacggtgagccgagatcgcaccactgaactccaacctgggctacagagcgaaactccacataaaaaaaaaaaaaaaaaaaaaaaaaaacagtcattagattgtcttctccagagaatggatcccacaatttgtggccacgtctcactctgagctcagtgcctggacttggctgtggccaggaaatggacrgaagatgtggggtgagctcatgtgacatgagctttakgaaaagggccagaaaaaagctttcaggaacagaagacaaccacagctgcgtagcaggtaacagccatctaaatggcgtttttgttttgtttgtggattgcttcattggttggttgtgctcctaactacatgctcttgttgagctaaagaaaaactggcccttccagaatggaacaggctgttttgcttctttgacaccatctatgtattaaacggagggaatgatctttaactgtttgctcatcccttcgcctcctgaatcatcttgctctcaaatttacttgtatttgtggttttacagtgtaaagcgtgctctattttggctacaagtactacattctataccatattggaaatgttcttgagcactatcatatacggggggattcgcagtcagggcaactcccaatgggagaaagaaagacacatcttttgcctgtcagtactaggagctagcatttcacagtgcttggaagttaaccagactttgatctttttgtttgaagctcgtttagcctccacttcagtgcaatgaggtagttgttatccctattttatagatgtgaaaacagaggctcaatgaagtacagataggctgctcagacwtaggcttcggacttgagttctcaccacacgcccaggtaaagaagagcctcctgggtctgccsaatctgtggcatctgctgtcaggagaaaaacaaaactccattttggtctgcaaaaagaaaccagtgggaagcagaatgtcagcaacatattttccaaaaccagttagccctttaccatctaatcatttgtcagctgtggacgatatgaggttgttttttgttttgttttgtttttttcccccaatcagtttaaactgaaaaatctggatggattcccatccccggttccctgcaactttggcttttcctatcacacagttatgtcggctccaagctgttctcagccgctgcctggctgttccatccttcttcctcggtcacttccactcctttcctgccgtcagcactcagacagatgtgagcccctgagcttggaggtggggaacctagactcagtgcgtgtttattaatgaggccgcagagtcacaggaagcagcaggaccctgacctgcagccccccttgaatccagcctgattatagctggtttctccagacgcctaatttccagcaagaaaagcagttgtctccraatcatacccagagagcttttgcaagtcagataactcccgacttctactgtcraggttgataaattggcctagtgtgattcacccccaagaatatagcagtgagacgcacaataggctcctacaagaaaagaaccttctgactgcagatttttcaaagtaaaagtaagccctaataatattttacttggcagctttgtgatggctaaaatatgaagctgtgactgcctttatggtggggagctgtaagtggcattcctctttttaaaagtggtgtttttttccccaaaatcacccagctgtctgtttcatcctctttttatttttaaccttgcattcaacatggtaaacttgcctcaagtgtccctggtagttaaatattagagaaaaaggaaagcaaggctaacaaaagaggtcacatcgtagcgggggccacagtcaccctgccacggctttggagataaattctctgcctctgagctgaaagcagcacttttttttcctgggccgcaggtatcaccattttaaagcattctcacgccaagggaaaggatcgtgctaaagggcttctttcctgagtaattctccagttttattgctttgcaccagtctctcactgctataggtcacttcagttagctgctgtcctggcacatgtgggataatttattagacatgttaaaaagtacattgtgatgagcttgccaaaagctacggaagaaactgaggcttgtctttttaaccacagacgaggggctgtatgagatctttgatgtcatgagcaactacctggcccaagtcaatgttcttttcatggatgctccggggaataaagctgttaaataagaaaaatacaagcacaaaggaggcacaatgaccatgtaccatactttggatttggaagcaggtggaagggaaacatcactctgttcacaaccagaacttttcctacactttaattactgtgcagtatgaggattagtcaatttcacataacacttccaggtacttgaaaattcatttctgatatgaagtttgtttataagacagatactcttgggatttttagcacatgcctaaaatcagatcagtagcatcttgccagcatcctctctctggcatggctaagtgagccatagcagtcttatcaacgatcgcactgacagatcctgcctatgattccttgccttgcctgttgtccattggcacatctttcatgtgatcacaaaatcaggtcaggttttcaaaatgccatacattgggcttttcttagaagatgggacaagagagcaaaacagaattattttttaggatatgacaagtggcccatggtgagtctagattgcattttttattgtcacgacacaaataggtacaacagcatttgaattttaaatctagggaagttgtttccagtctctaatgggcatcaaaatcacctggatcattaacagatgagcagatagcaaattgtggtatggtctcacttrcaatggaatatcatccagccataagaaggaatgaggttccratgcatgctaccatgtggmtgaacctcgagaacactattctaagggaaaggagccaaacacaaaaggmcacatggtgtaggattccgtgtacatgaaatgaacagaacaggcgatctgtagagacagaaagcagattcgtggttggcaggggctgggtggggaatggagaatgaggagtgatggcttcatggatgtggggtttgtttgaggggtggggggaagttctgcagttagtagtgatggctacacaacattgtgaatgtgctggaaaaaaacattggattacatayttcgaagtgacttaaaggatgaattttatgttgtgtaaattcaacatcaatttagcaaatcgtctgcagagcttattaaaatacaggttgctaggcccctaccttgagttttctgacttagtaggtctgagtggggcttgagaatgtgcatttctagaaagttcctggtgctgcttgtcctgggagcacactttgagaaccactggtccaggcatatgtgggatcacagcaggatttgtctcctgtgtttaaatcggtacattgaggattaatcaatcaccttctgtgtttcagcattcactgctggtcatccagtgctgaactggcactggtaataaagaaaatggtttttagtacctgaacgtggaatcataagaattggtgaaatctagtactgccatcccctaactgtgaactgtcaaatcccttcacctcatttgcaaatggagcaataataactgtttcattggattgttccaaaattttaaattcaaaaaaaagtataaaagaagaaaaatattaccatgagaaagcaccaccatatcacctagctaaaagcaggtactccataaatagttatgccaaaaaaattatatattttaactcaattactagtcttgggaatttataatgttgtggccagaatatggtgacacatgaaggcagcgagaacttacaacacagccttggactgcacagttccactcagactccatttatgtggcataaaagatatgtttctgggggtttgggacttcaaagaccgtttctggaggagtggaattatatgggccttggagaacggctggagaggaaatgagataggagggtgggcacatcccttaaggaaggagcttggcaaggggggcatgggaccaggttcaggtcatattggaattgggatcctcttcagtgctttgagtataatagacacttgaaaactattgctccataagtgagtgaataaatgagagagttgtgaatttgccactcaaagttgtattctgccatcatcagaggtatgtaggcagagtcagcacctggggagcaggtgatgcacctggccttgctgagcattggcacctgctttgctctaggcactaggtaaccagtggctacttaggatgtagaaaatattctaatatgtgtggattaagatggtgttaccattagaggaatctaatattcgctactggcaaatttcccttatctcttaagatttgaagtaattttcatttattaaattttttgtattggggggcagtcattgggtttgctgtaagttttccatacttagttctgtgtyttgatcaaatgagactatcttagagcagcaaaagggagatgaggagcagacctttgcctgcttaaaaagcagtttgctttaaaaaaataaaaaggtgggggaataagggtttggagttcttatgaaaaacacctttaaatctttaatccatcttgagttaatttttgtaaatggtgagaggtaggggttcagtttcaatcttctgcatatggttagccagttatcccagcagcatttattattgaatagggagtcctttcaccattgtttatttttgtcaatttttgtcaaagattagatggttataggtgtsggggtttatttctggggtctctattctgttccattggtctatgtgtctgtttttgtaccactaccatgctgttttggttactgtagccttataatatagtttaaagtcagataatatgatacctctggctttgttctttttgcctaagatagctttggttattcaggctcctttttggttccatatgaattttaggatagttttttctaattctgtgaaaaattacattgttatttacattgtaatctgtacattgctttgggtagtatgaacatgttaacaatattgattcttccaatccatgagcatggaatatttttttgtttatttgggtcatctctgatttctttcagcagtgttttgtagttctcttatagagaactttcctctccttggctagatagattcctaggtatytcctttttctgtgtgactattgcaaatgggattgtgttcttgattttgttctcagctagaacattattggtgtagagaaatgctactggtttttgtacattgattttgtatcctgaaactttactgagttcatttatcagctccaggagccttttggcagaatttttagcattttctatgtatagaattatattgtcagcaaagagagaaagtttgacttcttcttttcctatttggatgccttttattttggctttggcaaataatttatggctgagtccccaaaagcaattgcaacataaacaaaaattgacaagtgggacctaattaaagagcttctgcacagccaaagaaattaccaacagacagcctacagaatgggagaaaatattcacaaactatgcatctgacaaaggtctaatatccagaatctacaaggwacttaaatcaacaagtaaaaaacaaatagttcaatttaaaaatgggcaaaggacataaacagacacctctcaaaaggagacatacaagtgaccatatgaaaaaatgttcaacaacactaatcatcagrgaaatgcaaatcaaaaccacagtgagataccatctcacaccagtcagaatggcgattattaaaaagtcagaaataacagatgctggcaaggctagccactgtggaaagcagtttggcagtttctcgaagaacttaaaacagaactcccatttgacccagcaaccccactactgtgtatatatccaaaagaaaataactcattctaccaaaaagacaygtgccctcatactttcattatagcgctattcacaatagcgaagacatggaatcaacctaggtgcccttcaacagtggattggataaagaaaacgtggtatggaatactacacagccatcaaaagaacgaaattatgtcctttgcagcaacatggatggrgccggaggccattatcctaagcaaattagtgcaagaatagcaagtcaaataccacgtgttctcacttataagtgggcactaaacattgaatacacgtagatgtaaagatgagtacaacagacactggggactattagatgggggaggatgggaggggagcaagagctgaaaaamcacctattgggtactatgctcactacctgggtgacaggaccccagaccccagcatcatgcaatatatccatgtgacaaatttgcacatgtaccccttcattgctaataaaagttgaaattatttaaaataaataaaaataccttcagtcattcccagtgcctggcccatacagaggcacagctcccagtgtattgacactccatgggatcttctcaccatcagcatgaccttgacctatctaagaatgatgccaagtagaaaatgggttgcctctctgggtgtgtgtctgcaggaagagcagactgtttcccactgttgagtaagttcctccaggccagtcctgtctgcagacacttgtaccagctctttcccgaggtgcactcacaccttcttcccttcgggtgaggggctcaaatgaccctcttactggtgaggtttcctggtgaggtccactgtccctaaaagttcaatacayaccctcttcccttgctcttttatttttttctccttaattctactctttctaactcattctgttcccttagcttgcctattatctgttggccccactgaatgcaagctccatgagggctgagatttttttgttctcttcattcccatatccccaaagcctagaacaatgcctggcacctagtcggtgttgaataaatacttggggaataatggaatgatgtgtgataggctgttctgattttcttcctctaaagcctgacttcctctaactgcccaaatagggttcataaatatcctatcagagtgaatagtcacctgcctccttgctgagaaatcatgaaaggatgggatgagtaatgacatcctacaggtagaaaatacttctcagcctcatcaccattcgtcatcaaaagtaagttcttgaacaataaacgaggcatttttttcttcattacatagaggaaatggtagcgatattggctgacccagtccgaggaaatggcaggaatgtttgtggaagggctgctggactccccattgaccttgctgggtcgcctgagcaagtcagaaaaaccccaggttggtgggaagagaagccactcacacctgctcatggctggagctgtcacccatggtcaggagttgctggaagtttgaattgtcctgacctggaaggcaggcggcatgctggtgagctcaggccatgtggaaaggagccctgagaaaggatctgttcagtgttggtgaattcatcaagacctcatttcgcatctgaggaggacatcrctactttccttttaaaacagaggcatccctgaagaattaatgctaggatgctgttcctcagagcaaggttgaaaacccgtgaattggatgacgaccatttatgtatgcatgattctaaatgagaaagaattttgttaacacttgggagttgtccttcagcagaatgaggaaaagctaagggaagtagaaatagattattacacagatcactatacagtctgacaacacccaatgcagacacaaaaatacaatgatgatctttgccaatgatgatctgttctgttctcctctcctacacattctgaagtttaaatcctggacttaaactgttctccttcatcctatttggatgggaaacccccaaaaaacccaatgtttgtgtgtttgttgctttgaaaggaatgagatggggaaggcatgtctgagcttagtgaacggagctggtctcagctctccaatccctggggtctacggacrttctctgctcctttgggaaacaggccaattcagaccactcttttccaggcttctcttaattgctgtgattctggctataaacccttcctgagacttaacatttatcctagagtctttcctaattaactctaatattttctagaaatcacttcccttctagaatgaactgataatggtttgtcacagaactaagttgcgtatcactgagtgagaatgatgtttcatctcctagatcaggcctggagacatatatgtcctaggaaaactctcagatacagaagaagtttccatctgtacctccatgaaattgatttttatttctttctttctttctttttgcaaagagaagaactgctcttaagtccctgtgtaatataccaattacttcaatataatacccttctaaattgcaaaaacattatcatttttcttgtgaatcattgtttgaacctagttagtatattttgataccaggaataaccagtctgtctgccaggggaagttacaaagatttcaagattgttacagcactatgagtaagtcctggtatgttgcctttgcatccacagaggagcactttcatttattaatttatttgtaaattagaattattaatatactccagagttaatagcccgaggttgatagaaaccacttggagggaaaactaatgcaggaacagaaaaccaaatactgcatgttctcatttataagtgggagctaacattgagtacatatggatgcaaagaagggaacaacagacactgggaaaggagaggatcaaaagactccctgtggagaactgtgcttattgcctgggtgatgaaataatctgtacaccaaacctcgctaacatgcagtctacctacataacaaacctgcccatgtacccctgaacctacaattaaagttaaaaaaaaaaagttaagggccaggcttaaaggctcatgcctataatcccagcactttgggaggccgaggcgggcagatcacctgagctcaggagtttgaggccagcctggccaacatggtgaaaccccatctctactaaaaatacaaaattagccaggcatggtggtgggcgcctgtaatcccagctacttgagaggctgaggcaggagagttacytgaatccgggaggyggaggttgcagtgagacactgcactccagcatgggcaacagagtgagactcggtctcagaaaatgaagttaagaaaaaataaatacctggtcattaaaaatctgtgcctaatagtatgccttatatacttggggaagaaaagggaaaccactcggagaggatggtgcagtgttatcagtttggtcctggaaatcagcatgatctcaaaattcaccaagctcaatcattaagtggccgctggtctaccatcatcaggggagcgtagcagcttgcgttggtttggccaattgattgagatccagttctaatgtcatccttataaatgtctccattgggagagggtgcttgggtttgctggacagcagcccctgctccctctctaagtaataaaactttctgggtttctggcatgcttataccttaataatccttgctgcctcaagacatgggaaaatgcatttgtaaaaagtgagacactctgtgtatgttggataacactggctgctttggaatcaaaccccaaatgctcagtgggttaccatattagaagcgtgttttccttctgtatgatgctctgaggctctaggctgcaggtggccttcctccatacagtgagttaggaccagatgccatgcctgacacctccatctcctaaaaccgtgggatactctaatctcagctggcagatggggaaagaaaggatatgaagaaggaatactcgcttaaataccatcagccaaaagtgacctatatcacttttgttcatgttctagtgccaagaatgtcatacagcccacccaggtacatgggggctgggcagcccttctagagcacagaaggggagcataactttgctggggagttggctgaccctgccacacccggttgtttagaggcacccggttgtttagaccctgccacaccgtggaatttagagacaagggtaagacctgcatttctggatcacctccattctcttacaactgtgctgggggaagatagggacttggcctttatagacctgaatgccagcatcagcaggccctgccctacagtggaaccatgtgtccttggaaccatggaattaataaacaccgtcatttgtactcttttcttctttgcactttccaataaggacattgttatgtgtttgtattacaagctacagtccctacgaattcacttttcgtagcatcatttcacccagaactattaataatgtctttaatgagactctgcctgaacttattgatttgaaaaccatcgaaagatcatttcttttttgataaagcacttcttcatcagccgcgttggcactgtacggaatggatgtcgggatggaactgaatgtgcctcacttracactgcatatctgagttttttkatatgcattgttcattgagaccaccagtgaacacctgggcagatgtggccrgtgggtgccttcttgtgggcacaagaagggcagacaaagccattccatgccctgtgacttactgttctgggctctcctttctcaggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggtaagaaccattcccagaacaaggatacaagaagacttgtatcctcggctaggcaaagaagagagaacttggaggaactgtacagccagatgaaagtactagwactcaggaaggaagagtcctatctgcccatcctgaacaagccccgtgagctagggtggctttcttgaattttaactattgcatggaataagtgatcacttcatttaaaaagataaataatcytatcgaagggtacagcattctcagcaagatgaggccaaaaacaataaaaaaaagtgtttagctttgagtttgacagagaagaaagccctggaattctagcttcaaatagctaataagcaccatttctttttcttcataaggtgtgctaccagaggggaatctgaataagcagcattcatttttaaccaggagcttcctctgcagttgaaattctgccttgctgctgcagacgcctctgtatgcatgactygaggcttctgcctctcgagctkgtagctttcagaagcaataagtgaaggcagggaacgtttttatctagcacagggcttaaccctgttttccagccaatatcaggaaatgtccttgttttaatagggcccaagataatcactataaaaattataaaagtcactttttaatctctgaataatctcaagaaggaaagagagaagacagcatgagacctcctagtaaaacaggtgccccytcgaagtctggaggaggttgtgtttagaataaatcaaagcaagcagttgtacagcaggcagcctccatgtgggactccctccccgagagtttatgcaagctgaaatagtagacaagttcaaggcaggcttagctaaattcacagatggacttaatgagggcttaggaagagcatctccaagggctgctctgaaagagggagtttagggtggaggagaaatcgtgttgagactggcgcatccggtatattcctgtgttcatcacacaaacaactggcaaacagaatgttcatcatatccccatcttcaagtctctgaggttttccataccaggaggaatgagcttggtctgacagtttctgcaagaacgctggaagtatgtaagtattgggtgggagtaaggggggatgtgatgtagaagtggtttcttcaaatgtttttatgcccttgccaaactcagaacttaaccatgataatgacattgtctggaggggtgtctaattttgctcaccatgagcagggaatggttgctgtgtaggagcaagtcctaattatagtgttacagaaactcttctcaagattagcagaggaaaacttaaaaccatcatgggttggggtatgcaaaggggaaattccttgtaggccttgttaatttcttaaaggaaaaaatgaattagtttaagtttctcacctttctcaggagaggccatgttggctgaaaatggtttgtctttgaacttcttatgattgtttgttcatctaaataaatttgacagctcttcatgaagccatgaactctcgggtttggaatgatttcgttagcagtcatttactccatatgccaccagcagcagccacatcactgctacaatcacgaccaccattgctaacatcaccatctccacaatcgccaccaccacctcctccacccaacatcatcaccatttctctcatgaccatcatcaccatatcactgccactgccgccaccgtcatcactacagccctcaccatcaccccactattgtaaccactgccatctccacagctactgccaccaccgtggccacaccagtatccacatcgctaccagcatcactgctaccatccccacccctatcattatccccaccaccaccatcacatcagcaaatgcttgagtgcctaaaatgtgtcagccactcatattctgatcctccctcttttctccatgaaggagtcatgcggcttgacagggtgctgtctcgccaggtggcatgttgcattatagggtagctttgattattacaaactccctccttgtacagagccaaactgcttgcatgcagttaccaactttgtatttctgcggttaaggtccttattttgtaggataacttcttgatatttgaagatagctctcattcccctcatccaaagttctttctttgaaagttacaggtgagccttttgcctcactttttagatttgcttttttttattttttgcttttcaaaaaatagtttcaagtagttattattagaaaataatagtttcaaggttcaaactcaaattgtgtttggcagtgtgacaacctatttacagtttccaaactgctttgcctaagaattttaggcaaaaagacttgttaacctgggttctttatccccctacccagtgctcaggccctggttattctgcatgcccttacatcagattgacctggccattccctggcccacagagggacccagtgtgttacgacatcagggaaggagtagtaaatgggatccgaaaaacaactgccagcacccaatggaaaccagcttctcccttgctcccagaaataatctccatcattttcaagaagatggcttctagtcttctcccagttcattgtgattaagaatctgtgtctgctacctacaacctgagaatgacaattagggctttgcagagaattctctaatgctttcattattctttcttctttggagacttggtattcattggctctgttggacttctctattgaggactaaaataatcaatgtagcagcagatgaagaatgtgtctcttctgagaaatatggtactgcagaagaaatagatcctgggtggtttgaaggcaggttgattgctgaagccttcccggacagggcattggatttatatcaacataaggaaatcctgacaactcactcattcttccagctaacaggattgggaaagcagccttatctccttgtttaaagtcaataggatgccagtagcttgcgaatatcttttaaacttagttrtctttctcacattatcatcccctttgaagtcagagccatttggcatggctgcatttccatttgagctgctgcttayattactgggtgatttgagagaggggggaagatatttcttaaagaattttaggacccagatttaggatggctgatttaacatggaatttcaagaaaacttgtaatttggtaaatgtgtcatccatagagccatttagaccataaggaccaggatagcagtggtgtgcatttgatgacactgatttaaaaatgcaattaatggactactttttttaaaaaaagttcctaaactcttttagaattgtaagtccacaagttagaaacccttactgtcataaaagttacagctatgacttctggttgacagttttatcttattgtatatattacgcattctggatgtttataaagtcctcaagcaaatttaaaatttaataactttggaagtctgtataatagaatcaaatggaacatcaaatgagagcataattagagttttacataggatatagtttcagtatctgggtttgccataaatcttctggattattgacaaaattttattaattgcatttataaaactcakgataaatccattcaagaaagatggttttcaggagtaaagtattatattattaaactagtatgtgattagcttcaccccagccaatggtatataaatttttcaaagcatatcatatactggataaaataaaagaacattgataaattactcagtattaaagatctatgaactgttccatcttatgataattacatttcttctaaaatgtgtaaactgcagttacttgaatgttctcaagtacaaggacttcacttgataaatgcgtgcaggccttttgttgagaactgagcgaaaaatgtcaatctcttgtttttgttaggaaaaaatggaagcaatgggtacgtgtggagcacagcattataaaggagttactttcttttctcacttttgtttcagagaggacagtacatctaatgcttgaactatccatttaaatccctcgcaaatcaatgggcacagcccacaggcctcctgccggccacttgcttgttataaggtccatktctgactttcygagtgatggaattgtcaggccagacaacttacccgggctgctcaagggtctcatccacaaccctggcgagattgcagggaattgtggttgaaaccactggtttgacttcatttcctgccagtactctctaaatcaaaaaaggttcatttttgaagagtacagattgtatgcatctatgtatatttttgattgggtaatttcaaagtcctccagggatcctgatgcagtccactgcaatgagatccgcctggacacccctctacagagccccagtgtactgctgactagagtgatgtccccrgccggccagcctatgttacaactgctttacctttcatgagggcacttgtgtgctactggctttttccagggactcgtagacccagttggttcataaamagcagaagctttgctttccyarcagacggaaacaggcaggtgtgcagttcaggagctgggccctcttggtctttcttgctttttgcagccatttaaggtgtgatgtttgcattcagtgagtgcatactccataagaccctgtcaaacaaatgccattcccctttccaggaatgtatgaatcgctgctgcaatgccaccacctgtaccctgaagccggacgctgtgtgcgcacatgggctgtgctgtgaagactgccaggtgagtcaccggagctacaacttgacccccaggtcgccaacaggttcaggtggttcagatctgatgcagggcaagcagtgtggctggaaggtttcccagcactcaccacagcacgcaccatccctccttctcacgccagttggtgttacccacctcttactgtttagcttccaatcttggggtgaaatgcacgcttcagttgccagtcacttgtgtttatttatttaggggctgacaactgatcagaccgataaaccctagttcaactttaaatgctccatttgtgccgtcagaggcacatggggttctactatgctgacaagaagagcaaggcgagaacaagtccccatccactgtcactcaggttcccccaggttcatcttcttgatcccgcggacatctgcctgctggcttgtcccagaagttttgtataaacaactcaatcttaatgtcctcccaaaagaagttgccaccaaccccgcccagccaagaatggcagttttatactctcgccattgctgctggctaggactgcgtttcttttggcagttccattgtctcattattcagagctgatatctgagagtagaagcctgagcttttgattcaacagttccaagggtagagttttatttcattttaattaagcaattgatcctgacattctgcttgcaggaaactccctcttagctgccccacgtgagcacggtgatttagaagtgcattataacatttaatgttcggctttaaaatagccttcatcctcttcctaatgctgattaacttctggggaatgttataagcagctggctctccctggctcccagtaactggtgaaggaaggtgcctggaagggagtcgggggaagggggaagcaagtctgagcctgtgcccaggggatgcccaagtaaggggagggaggaccacagggcaatgcctgattgtggttcacttttaggttatgactttttaacaattgctttcgacttccagatcttctagaagttggcaggggtcttatctctttgcgtttgaggagtatgcagggaactaagcccaggactcgcagggttccctagctgtgtagcctcagacgggctactctgagccttaatttcttcaaccacaaaaagctgagccattggtcagatggcttctaacatcctttacctctcccttgttcttctcctgttcttcccatawagcagtaaagagagagttccagttctatgatttgacgactgactaaaattgctatcgtgattgtgaccttaaagttatttttattaacttgcccacacatgccaacaccataaatgcaaatgtccccttgaaatgtgtcatagtgttgacacccagagacctttttcttaagaatcaaccaggccagcagccaacgcttccctccttcttcttcctctgaggtgccaagtgccagcagccagcttgtgtgtttcttggagaaccctgatgttgcatgacattaaccagaggctgctcttggttgtcccacccactttagagtggaacagtgaaccccagaacgagaatctgatgatttaatgaggtatctctacattagaagcaacttcctttgaaatcctcaccccttatgtgggacttatggccttgtccactccagcccaggagtaatgctgagagctgcctctccctttccccgggtgcatgtgtcataaatggccctctccttccagctgaagcctgcaggaacagcgtgcagggactccagcaactcctgtgacctcccagagttctgcacaggggccagccctcactgcccagccaaygtgtacctgcacgatgggcactcatgtcaggatgtggacggctactgctacaatggcatctgccagactcacgagcagcagtgtgtcacrctctggggaccaggtacgtggccgccrcaagctcggcatcaggagaggcactggcagacctgggctgtgggactgggggcatgtgctctgttttggttagcccccactcctggygggcgctgtccacacagcatccggtgtgttcagtcgggagtgattgactcccagggagggtctgrggccgcactgggcatggggtgcacagaaatggacactgcctggagcctggccttaagaagctcagtgcggtccaacaggagctgcaggagcacctactgtgcgccccgggggatacagaagatgcaggagcacctgtgtgccccgggagatacgggagctgcaggagcacctactgcgtgccccgagggatggcagggatgaatccaccatgactcctgccctcagatagcatagcacgtagttggacagacagacagaactttcccaccaccactgagattttagtaatgcccctttgtactcataagaggaccccaaccaagtgaggggcccagggctccatggggaaggccctgatcagacttgaagcatgagtgtgtctgtaatcrgaaggcctgagagcagcagtgagtggctctcaaatgggaaagtggggtggttgcgtcaaacaagagaccatcagttcaccatttcaccagttcaggctgggcacttggcacastttgtctcttctgaccctccaacaagcccctgaagtggggactatgaagctttacagaagatgatgctcaaactctgagaccaaatgtcagtttccccaggtctccgggctaggatttgaacctgggttactgtgacccaatgcccatgtgttactcccacaatgcacagtcaccctgaagagggaggtgttgctctaaagctccaccaaagctccaaaatgaagcagaagctcagatgcaaaagggaagaatccatcccctgcrtgtctctcctccatgccccaccttctggggtcagagatccaaggcctcattgggcagccctggactccaaggccccgtcaccccagaaccatttgagattcaatgcctgtgtccagctcccaggagtccaaccgtgaaatccacaagtgcagsccccaccctgtcctgcagttctctttcccttatgataatgtggttgagtcctttgtcactccctcctcctgctggctgcagaaatgacctcagcccaggccagagaccccagctctggcaaggcctcttgtggtcggccaggcccaggctgaaagccaagcagaatcaggcaggatctctagcrggagggaaacctgataggacctttgtcagacttttgttgtgaggctttggttttaggagtgatgagggaaataaagtggaacagaaattgatgactaaacctcgaagcctgggttttcaatggaatgtaaaagccacgcccaggcatggaaaacaagatggatgtctctcggagctgggtcctgctgggaggcccatgtcccctgccagccagcgatgtcctctgtacttggagctttctgggggggaaaagaaagggcagcttggtagcaaggagggacgagcgcaggcctctttagctcggcctctgaggagttgttctgatgctcctcagcactcagggatgcgcgtgggcaggtgggatggggaggcctgcagttcccgggcccttagtrcttcatccttggaccctgagcagccctcagtcctggcatcatcgcctgctgggccttggggcaccctgggcaaagcagggggcaggagcagtgggggacaccctgttgcaatgacaaggactaagccagtactcgctatacacattgaatggtgtttgggcttgacatggtttagtgacttcaggcagcttttagccaactgaggtcactttgggactgcggctactgctgcaggccaaatcttcatggcttcaggcatccctagtgccgtccccgtcccagcctttctccagaatcagcagtctccttttcttgagttacaagggctgtgatgaagctcctttccaaaaagcattttgtggccagagcacacacaacacttggagctttgggagtgaaatgtgttccttaatgccctgccgtattcgaacagctggccccgtttccagagtgaggtcagagggaactcgacagtgctgtctgagccacccccattgtgtgactcagctggctgtgtgcctctgaytcatggtgaccaaagctggtatttattatctcatcagtctagtccttctgtagctgcctgaccagagagagaaccagacaggcagacagactgacaacctgacccacagactgagcttttcaaaagcaagagcaataggaagtcacctgcttgggctctcatcatccccatgatggagggggaggctggaggtctgagcacccaggtagccacgtcctcttcctaaggarggggcttccctgggagctcctggcttagctctactctctcccacccactctctccctggtaaccaggaggcctttgctggggtggtggtgggtggtgtcgtgtgtggccactgcacacagcatggaacatccatggcatcaggactgttggtaacaaatgtaaagttttggtgaagaggctttatctttggctcagggttcctgaaagccacagcacagagaccaggcttgggaagccacctcgggcttgtgacttcctgggttttggtctgtcctgcccgcccctcctcagttcttcagatcattatacagacttccttgggagagcagagagcagggaaggctgcaacccactgtggcccttgatgccagggagctcttggaatgggcctttgaccacctcctttgggagtgcagtgtgctccttcctccccttgtcggtgtttccgcctggtttccagtttacaggcgctgtgtgagtttcccatggctactgtaacaaattagcacaaacttaatggcttataaatgcttcattttacagttctggaggtcagaaatcctgaaatcaagatactggcaaggcagcattgctttgggaggctctggggagcatctgtttccttgcctttcccaacttttagaggccacttgcattccttggctcatggccccttcctccatcttcgaggccaacagcacagcatctgcaagtctctgtccctctccgacttctgcttctgtagtcacatccctttctctgacactgactctcctgccttcctcttataaggacccttttgattccatcaggctcacccagattgtccagggtgatctccccacctcaagatcctaaaagtaatcacatcttcaaagtcccttttgccatgtcagataacatgtgcataggttttagacaaggatgtgggccttttaggggagccacaggcattgaacagaccacttactagcaagggaccttctgcaaattgctcaaccttgttatgcctcatctgtaaaataaggatagtgatctacctaccccaagggtctgttatgctccaacatagcctataatctattccatgtaatatatgtggttctatgctagatgcagagctcctagtaaatctaaactctataaataagatgcagctgcactcccaggaagcttagactagtgagcaaggtactcaaatccttggggtctgtaaaacgggctgtaagagggtcatgggccagatatgttggggtggaggaaagcagccaactaggaggctttgaagacaaggttgccgtggaatagtggtttgccaggggtggaagaggatggatatttccagtatacagaayagcaacagctcagggcacaaagggacagtggggccaaccagggcaagtgcaggtagttctgtgtgtgtagagcttgggctgtgccttgaagagcagagatcctcaactgccacaccattctctcatttgtcaagtatttgttgatgtcctgctgtgtgtaagatgctgactcaagagccccgactctgccagagtgacacacttcccacagtccctgtgcactcctgcctggatctggaggggagkgcggatgtgaatccttcacaatatcctcccgggaggcatggatcccggacaaatgcagtcctgggagcggaggtgacttcctcagccaggcccctggccagccagatataccattgagaacatttcaatgctttgttgtagtggttggtttgaattagcttttcatgattcagaaaggaaaacttattgtcaagtttgcatttgcagtatttccccacccaggagcaaatgcttcaggatctggatcacgtatgcactggggtcatcacaggcctcctgggaaatgtaggaactcagagctctaagagtccttgagtccttgccccaccggcccttgacatttgcaccccagtgaccttgcccgagttgctgagttgcccagaattctccagttacattcaggatgtccattactcaccctccagatctggcgacccaaacacygactggacgaagcccttccttccaactaatgattcccttttgaaatgggcttttctcaatctggcgttrtatttcaataaaacaatcctgcttccaaatctttctacaaataaaacaacagaaaattcaaaacacatgcctgcaacttctaactggcaaagcaatacactttgagaatgcctttgggttttttgttcatttatttgttgttctaattgttttkgttgttgataacgtacgttctcgttggctgagagtataatttttttctcactgatttttgtcccacaaatctggtatctcaagacttcctatgttgatttcaaacatacaaatgttattcacagttcaaactgtggttggcgtttagctctctttgcccagtttagtcttaatatctacaaagattttctgtcaatatgacatgacctttactccttctgaaatatagctggatatttttgtttaggtagcaaatttacttttaccaatgttttttgtgagaaccaccagcatggttactgaaaatattccttggcaattaatcttacagataactacacatctatagtcacraacaactggcatcagagaattcccgaaatrtgttagttttttctattttatcactcaccagaatsyaatgtttggtttctgcagtgtgagctgaccagaccatttttatgggctggtgaatactcagtgtttatttgcaaatctggtttacatgagcttggtttattgtgacccacttggggcagtgcatttatgaatcacctacaactcctgtggccacagatgggaaaaaaagagatttttgccagaagtcttattgtttagaagtcaggaaagtctcccttttgtcccatcaagtgagaaagaaatgatcaaatttgttcatttggacttcattttctgatgaatacaaaggtcygtctgaagaagagagatgggaaggacaatacagtctccagttgtctgtaaaaatgcctttgtctgtggatgttagtggcaggggttagggaaatcagtgacacagggaaggaggagctgatttgactgaactggggaagtacatttgcatcgtggagtcattttaagtaagattagattgagtaaaytgtgggcttaattcaagatgccatcatttctctttcaaaaaaaayataatgacattgggaacttccaaactacaattacaaatataagttatagcactctgaagataaaactggtaattaaaatccatcactttctacatcattataaaatatagtatggtrtcaaaattccctctgaaaggctaaattttatcttttgataatggcaaaatacmtaagtgttccattattaaggactcaaaggctctacattgatgtaatatggtagtgataagaaaaccattgtcattctttctaagagatgtgaaatcgcttgtcttcatgaagacagacattttttaatgcagcaactttgaaccaaatctctgcctttgtaacatcttacaagtggatagaagtcatttgcactttttaaattattgaccactctgtctctaagataaatgccagatggcagctaacgcacaaaagccacgggaagcactctgttggcccctcctccgctatcctgaccgggatcagcaggttctggacaggcagggcgcgcagagagttgyctgcgggctccgtgcctttgagcctctttcctttaatgatgttttctttcagtgctggagctgcatctgctcccaaggtcagcactcagccccctttggtttccctgcttataagttttcttccttaactttgagggaataacaatttacctttccaggaagtaaaacgtctgtctttttatgaccttacataagatcccacagtaatacttcatttgatgtcaatgaataagtggaaatccagagwcatagaaaagataaaccagcagacagcgttcatttacccaggctgctgtgtttgcagaaccacagttgacttcctccgggaagggcaytggagacatgatgtgctttccccaaatggcttttcactcattcgttcttggaacacatctgctatgcrctggcccgaggcagcatccctgcccacaggtaggagccctggggcctctcaggaggcaaaagcaagtgtggtaaatacaagaggaagacaaccttgggaggagggaaaggagggccaatccctgcctccatggcaaagctgggggcagaggagagccctgaaggacacgggagccctggaccctgatccagctggctcaggcatcgagttccaaggaagacactgactcccctggcttcggtcrtgtgcccagcattgacccgatcatataacctgtgggatggacctctctgattcaatcttatgtgcatacctctgccattagataggaaagttagctccaattaactataaaaaatggatttcccatggggaaaatgttctcgttcctagaagaagggatatgggagaggtgttcaacaaaacaataaccctgtgtctcctaccccacartccgttttcacaaagtgctgttgctgctccaagctcccrgagcaacctcctaccacacaggtagatttcaccctggaggggtgtggccagtgtgtgsttctggaaggagttgtgctgaatcactctggcgaccactagctggcagctccctggccccaggaagtggcccagagcccaccatggtaccatcctacaacctaacattggagtttggggcagcaggggcgtgttgcaaacaggaccaagttccggccgctgcgtccttagaagtttggttcatttgaaacccmttagcctttaaacatccgtgttcctcatgggagatttctcattacagcctggagactccagggtaaggcaccctggccaactggataagagtaagcactgtaaacagggctctgctccatcttcctcccaccttccttgcaaaccctcaccaccactaccaaattaaagcagcagcagtttcagagggctgataaaaggaagcaaaagatcgtatctattggggctacccgtgagttagccacttttcttcattctccagggaagagaatgaacaaagtagatgacaggggctggagtatgcattcgggcctttgattccatagagaaatgcatctgtcctatccccgtgtttacatggctgatgaaatcatagcctgcctctcctgcaaatgccccttttctttgccatgtggcagtgagccctatcattgctgtgcctcagggacatcacktcctggccatatttcagtggtaaagtatgatatggcatccctcactccctcatgttttgggtgaaagctcaaatgaatgaaactcttagaaggtgaccgttattgccttcctggaggtagacagaaagttaacctttagaacctcrcatcgttcaagccactggatgaattaatggcagagtggagtcagttttactggccaaacttcactgagatttatttcttgaggaactgctccctcagaggtttccaagtcattctactccgaatttttcatttctttccctgaatcagtatagatgcaacaaaaagcatacaaatatctgctgcctgcctccattgtcccagttttaaagggaaatctcactaagcatgctcaggtgcagggggtaggccgtgacccaggtcagttcagcacctgagacatgagcatgaggcagctgtcgtcctcacctgtcaggagattttttggaaaaagatttggtgaagaagwwgttgactccatgagcagctggattacaggagaatatgttggtggttccgaagaggaaaggatggcagggacaggagtctatagtcaagtagggggtttccaagaggaaggcagcacaggatcatggctggatcatgggttttggctttaaacccatgagacaaacccaactttgccatttacattgtgatcttcggcaagttgctaaaacgctgagtctaagtgaaaatctctgaaatggggagaatgtagaccttacagggtggctataaggatcaaagatgataccgcgtgctgtatccagcaccatactttaattacaartggcctgctgatgatctaaaatgtatcgttcatttaaagtgtgtgtgtttgttaagagcaaggagagtaatgacaggaaaatgatctttgttctagggttgagtggcataaagagaagtcagactcaagggtctttgcccagggttgcctgctgcctctttcaatgtggcactgggtgctgactcagggggagtctggaagcccaggccaggagggttcccagaaccagctgggatttgggggccgtggggaaccacactcattgaaaggagtaaggggatgggtgcagggaagttgaaatccttgtgctggatgatarttctgatttatatgcaaaggatgtgcaaaaactattagggtttcagatgagattctcttctttccttctcatttcctgaggcatctggttagcccacagtctccactagttgcccttaatgtgtaaggccctggagaccatgaagtgtgagggagatggatgtaaagcccctactgacgtgatcatgaatcgttacaggtgtggtaastgatgcgagcaggggctggtacaaggaactctcttctccccacacacacccccagccctaaagtccagaagccacaccttccccacagtccaaggtggtcttcattatcacttgggtttcctaggggtctgccacatgccaggagctctacacactgatgcacctccacagcacctttgagtcaggtccttgtccccattttacagatgaggggacagaacctcgagagcttgtacaacaaggccttttggacattgaatgccagatcagcccgagttccaagcctttgttcttccaactctgaagcatggttactgagtagatcagtcagacaggagggggcaatctaaaaaggctgaagactgataggcattaggtatttttcttagaccccatacatgcccagctataaaacaaggcttccccctgaaagtagycagcaaaaagaatcgctaaccactgacctgtcactctctcagccacaccttttrgatgtcgcagagcaggtgggaaggcgctttggcgctcatcatcctgcatccacgcaggttcatcaaggctgcctgacaamatcaggtttaaaaaaaggcaggtgcatctatcacatgcttaaatattattcttcggctgtgacttcatcccattttggttattctggtaaaagagcttttaagggttcactttcataagcaatagagtgggtggttcagttgtggaggttatgaatatacacccactgggctaatagagaaagtgctcactttctctattaaaaagtgttggaagagtgggtacttgaacctagaaacaagatttccagygataacataacagaagaaaaaatgtcagcatcttgagaaagccggaagtgcagggaatgtgccatggaaagcaagaagactgagaccaggccaggtacggtggctcacgcctgtaatcccagcattttgggaggctgaggtgggtgaatcacctgaggtcaggagttcgagaccaccctggccaacatggtgaaaccccatctctactaaaaatacaaaatattagccagtcgtggtggtgggcacctgtaattccagctaaatgagaggctgaggcaggagaatagcttgaacccgggaggcagaggttgcagtgagccgagatcacaccattgcactcgagcccgggcaacaagagcraaactctctctcaaaaaaaataaaaagactgagaccaaaggaaacgtcrtctcagtaaaattgttccacggtgtgggagaggttttttttttaagacaatctaaattaaaatgtgattcttttaactgtttctcattaagttaattgacagcatattataagatgatgcttgactgtgtcatctgtgttggtaaaaattcacatattcgaattggccacaagcctttctgagggtttgtctttgggagaatggcggtgctcctgaaatgccaggtggccttctgctggggcgtgtaccatgcttctgcgttattggtaaacaaggcattgcatcttacacacacctggttttctgagctgtgctgctccaccagcatttggggcattacaatcataagcacaccctgtattagtctgttctcacactgctataaataaataaatacctgagactgggtaatttataaagaaaaaaggtttaattggttcttggttctgcaggctttacaggaagcagagtagcttctgcttctggggaggcctcagaaagcttccaatcatggcagaaggtgaaggagaagcaggcacatcacgcggccggagcaggagcaagagagagaaggaaaagggaggtgccacacacttttaaacgaccagatctcaactcactatcccaagaatagcaccaaggtgatggtgctaaaccattcaagagaaactgcccccatgatccaatcgcctcctaccaggtcctacctccaacattgggaattataattctacatgagacttggtggggacacagatccaaaccacgtcacactctgacccagaaggctcagtgtgtttcagctttggattcccaagtagrgatccagtgttttcacttccagaatgcttttatacttgattacacactgtttccatgcctttgcttgacttcctatcataacgatagccctttatctggtattcacgtatcaagcttcccctttgctttgccagtacatttgcagcstcttcaatccctgttgaggttggtctctttctcgtcctctctctctcccccttcctctctttgtttttatccttctgtactccccagtccaacctygtccaactctcctcccaggctsctgttgagctgtttgtragctcacgtgtctgaaactgcccaaagtctctttagagctccctataaggaaaacaaatgtatcaactgacatayttgaattgtgtcatggtatatgtattttttaagtggtcacaattcccaagaaagaaattactttataataaaggtagcagaatctaggacatcagaatagcattgcgtgcaatggcacagtgatgtcaactccacccacccatttcctaggagctaagcagtcactaggagctgcttgtatttccgagtcctagccttatgaagtagggaaagaagcaacaaagccatttcctgccccattttcttagcccttccacaggcagctgcagcagcacaccccacatccactgaacctgttgttgcttgggctgcagggccaggtcttaatctgctctctacacctgagacccagtgcagggtccagcacctgtgaggatggagcacaggagggaacagcccagaagcctggcttcacccttagatgatcctgccttcgttacctatgtgaatctragaaatatatttaacctctgatgtgctaattttcttgtccataaaatggaataatgagacctaccttgtaggattaaatggtaggattcagctcatgatgtcttctctaagaggtcttccttgaccagcctgcctttaaaagcaacagtcccctgaaccctcctactctgtttctaccttcatagcattccctaacactgggctttagaggaacataatcatttgggtcttttytctgtgtctccttgcaattttcaagcaagcaggaggtttgtccagtttggtccctcttatactcccaatgtctggaagatagtaggtgctgaataaatacatgtgtctgattgaagcctgcaacatgatggctggctggctggmtggmtggatggatgggtggcyggctggctggctggatggatggacgggtggctggctggatggatggacaggtggctggctggctggmtggatggatggatggatggatggatggatggatggatgggtggctggctggctggctggatggatggatggatggatggatggacgggtggctggctggacggatggatggacgggtggctgggtggctggctggatggacgagtggatggatggatgaatggatagatgggtatataaatggatgatggaaggaagtaggaagggaaggagggaggaaaaagagggaaagaaggatggttgggagggagatagagttaggcaagcaacaaatacatagggtgtgtgcaaaaacacaaacaattgttgaattgttactattctagatgccagtttttccaaactgctttgatcaatcagatcccagtactttgatcaaaagtgctgccaaacaggattaaattaagcacaaagtgcaggttccacactgaggctctccctccccatccttccctgctctgacagatagacgaaagagaaaaagaaggcagaatgcggacaaatcaggtcccyaataggagctgagtgtgtcggtggtgtcatcctactgtgagcaaggcagatgtggaacagatggaaggaaagggcatgtgatgtgaggagctagggacctcatctttctccatgacagagaattgtgtccagtctgggctaatgcccctgaaaaaagagattgcagaggcttctctaacatggcttataaaagaaatgagaaaaggagaggtgcaaggctggctcattgcagagattggagcrctgagcacactgttcacatcaaatgatggcaaggtggtgtggcacrtgtgtgttgaatgagatgatcatgtctgctagtagctgatgagaagrgatcaggtgcaggctarcgaagggggatgtttttagtaagaagaacatcttctgttccctgggacgaggtatcttaaataaatccgttgtcaccttggaaagcaaagcctccccagggtggagagcagagaagggcaggagtcagagtgaggctctggagtgtcggcatcctgrccatcagaagcgatgtgagataaagtgccaaacaggacaccaatcagggagagaaaagggaccacgccgcagggcatggtttgttctaaagaatgtggcatgttttcttgacttgctcaatagtcttcaacagacatcactatgtccaggattcaggagtcctccagaactttggctgcaaatgctgattatatgtgctctctcygtggctggaagatgtgctaaaaatggccatttctgagctctctggctgccatgaccctctttgctgggaaycgtcatgttgtacatagggattaccagggtttatgactccatggcctctgagagaaatctctgccttgcaaataaaatagaaggtattaaaagaaggtagtactttctcttatagggagctttatgggactaaaaatatcatagaagatatcttcattgctcctttggagcctgccctggcttgcatttcctcaccggaattgtgtgggatgttgttaaagagagcaaacttccccttctctgcagccagccagccagccagccagccagccagccagccagccacctcctttctgccctggatcagatctcattccacagccaggcctcatttcctgagaggccacacrtgccacaagcccagagagcagacctaaggaagagtaagcattggaacatgtgctctgccagaggccgagtcaagagaggatgcgagctgctgacaccctaggcttcccctggccagctcccaccatgagtcgggacagacactgggtgtgattgctttgagcacgtctccccgtaaccatttgagaggcctacagccatgaaaaaaaaaaaatcacctgcaggagatgaaaatgcagttctgcttctgtttcaggtgctaaacctgcccctgggatctgctttgagagagtcaattctgcaggtgatccttatggcaactgtggcaaagtctcgaagagttcctttgccaaatgcgagatgaggtatggaatccagacatcctggcaaagtctttgctctgaccttcccacattgcatagggttggttccaaatggtttctccttgggaattgtttgttcttacccttccagagatgctaaatgtggaaaaatccagtgtcaaggaggtgccagccggccagtcattggtaccaatgccgtttccatagaaacaaacatcccyctgcagcaaggaggccggattctgtgccgggggacccacgtgtacttgggcgatgacatgccggacccagggcttgtgcttgcaggcacaaagtgtgcagatggaaaagtaagacccaaatgtttgcttggatcataaatgtaagtctggaacagggcccattgaaaaayagcaagaactgggttacaaggtttgttggttttcctaaatctacttcttctcagatgcacctagaagaaaaagtcaataaatcctagatcctggtctgactattaaaatgcagattggggaaaaatcaagcctgtcttcttaggccttgagtgttaataagtcatttctacactccaggtggcatgaggacttctagccaggaaattactttggaaagaaatacaatcgcatattctattggttttggatatgtggcttggttttyagcacagagttcttgggggcttgtcctcacctgaacagaatgggaaatcagatgtatttttagaaccctgtagagagaagaataggagagggaaaggagtggaagaaactcaaaaccagaggggagtcctttcagagaacagggagaaagatacatggagatattttgaggtttagaaataaagtcaaactttttttttttttggaagaaaaaaagaatttgagattttcatgctctgccatactgattttttttttttcaccaaactttctcatcagactaaatgacagcaagcgaatacaatgttttaagaaaaggatgaaacaacccccaaatgcttcttaggactccattttcaacatggtcttgaaatcactcactaacatgaggtcacacaggcaagaaaagacagaggcagagacagaatcctgaggacaggtgttgcctccactctcctgtctttggccccacacaccctgagccacaaatcctttttccttgagaaataggatcgtacatgaatcttcttatacattctgaatgtctccttacccacatttgctcatattcaggccttgacattaaaatgacatctgatatttttaggctcaaatcatattttgtcttttaacttttaggttcaggggtacatgtgcaggtttgttatacaggtaaacttgtgtcatgggggcttgtggtacagattattttgtcactcagatactaagcctagtacccattagttattcttcctgatcctctccctcattcaccctctactctctgataggcccagtgtgttttgttcccctgtatgtgcctatgtgttctcatcatttagctcctacttataagtgagaacatgtggtagttggttttctgttcctgaattaatttgcttatgaaaacagcctccagttccatccatgttcctgcaaaggacatgatctcattcttttttatggctgcatagtattccatggtgtatatgtaccacattttctttatccagtctatcattgatggacgtttagtttgagtccatgtctttgctattgtgagtagtgctgcaatgaacatatgagtgcatgtgtctttatgatagaatgatttatatttctttgggtattacccagtagtgggttggctgggtcaaatggtaatttctgttttaggcctttgaggaaygactgcactgttttccacaatggttgaactaatttacactccrccagcagtatataagtgttcctttttctccacaaccttgccagcatctgttgttttttgactttttaataacagccattctgactgacaccttttttttaaactgtagcctgaacagccagggccaggkgcatctggacattccaattccaagggctcaatttatcatcaaatttgttttccacgttcaagatgaaatgtgctttgatctcagaaccttggttctctgagggctcagggatccgcagtgattcccatgagggtcctgctgtgttcactgtaatccaggacaggttcttttatcagctggaatgtgaccatccccttggccaggattcgcacccaccgagtgggaatccctcagtgctgcttgggccagcgcttctcccaaaggctatgcctcttgcccttatatgagctgttggggtcggatggtgacctcctcaataggaaggttctacttgattaaaaattcttctgccatttgaacgttagactctttttcctttgactccacggatttgtaaaatcttataggagataaagggctgcatcccttgagtctggagtatattatgcacatttgaaatgaggctgagttctttcagccagmccagtatcacttaggaaatgcctaccactacaacagcttgataaattcaaggagccrtctgttttcctctgctgagcctcgttgctgatggtttatgtcattgatgatactacttgtcagtcastatctggaaraagttcccatatttcaacytctcccttaaaagactcttcaaccctggattcttggagtctcyatctatgtctatccaggccctgggataaggagtaatctgtctcgccctcccctatatcttttttttttttttttttttttttttgagacggaatctctctctgtcgccagactggagtgcagtagcatgatctcggctcactgcaacctccaactccctggttcaagcgattctcctgcctcggcctcccaagaagctggaattacaggcacgtgccaccacacccagctaatttttgtattttcagtagagacagggtttcaccatgttttccaggagagtctcgatctcctgacctcgtgttctgcctgcctcggcctcccaaagtgctggtattacaggagtgagcaaccgtgcccaacctcgccctctcctgtatcttttaatggaagaaaaaaatactgcartacatagatttctttacaagctccaaacaaaactcataagaaaatcagttataattttaggatcaactgaaagttatattaaaagccataaaatgcaaaataatttaatagtgttgacattgaacttagtctcaaaatgtgctgagtttggaggagtcaggcaataagatccatgcctgagtccagtataaaatgtattgttatgctccatccgtattaactgagacaaggttgggtcttctccaagctttcttttgcttgctttttgtttraatacaggtatgtatgcatgctggaggggttggagaaatactaagagatttgctgtgttttcctcctcctacagatctgcctgaatcgtcaatgtcaaaatattagtgtctttggggttcacgagtgtgcaatgcagtgccacggcagaggggtgagtaggctgagctgcccttttacagccagcccataacaagytaagtaataatacattcatttgtaaaaggttttgcaatccatagcattttttaaatagagcagttaktgtgtttgaaatattttcttctaaagrtattcatttcttttgaccttttcatgtgacttttatttaacaaagaaaatcagactgagctgtaattaccttttaaattaacattctatgattttaaaaaagacttttgttgttcaaagtaatttgaaaagcaaccttccttcatgaagagtttcaraataacatttcaaactgtgctgttcctcttactaccaacattcagaaccagtgtctgaactgaaatatttccaaaaggaattaaaacaaggacaacagatcatattaaacacatgttcttgaaatcacacacaatgggtttcaactaaagaaggctgttattttagttcagagaacctttagggtagaagaggactctaattgctgaaaacataatttatttttcttgatgggcttatttccaatggaatcatattagtcttgattaaccacaccagaggttcatttgttttcctgaaacctttcctacagaaatcmtgstccaaattctttattttaaaacttgtagacacttgccaatgattcttacacagaattaccgggtgcatggggggagggggttgtaaattaccatcatgctggaaccataaaggatcacagtgtcacctcagatgggggtgttgacggtaaggttagctaactcccaatatacaatggaatcttcttatgtcttcattggatcatagattattttctgatggctgttaagagatgatcaagtccagtcctattattttactgaagaagccaggccctgagctgkgggratggtgtgcccaaggtaatatggccrgcaagctgcaagctggttgaggaccctggaccactccctttccaataccccttggccttatccacacatgggagcggagaggcccgcatttgctgggtaggtggagmctacccagccttgctgaagggtagcttggccacagtcccaccctaacaagggcaggctcccrgcagcaccttcctgtgggttttaaaacaaggcgcatgaccacaagttgcagagagaagccatgaggggcaggcatgaatctggggctagtacgtccacagcagcatctttgaggggacaggcaagacacttacatttgacrtaggctctgccacttgctgacaagttctactcaatttctgctttatagcagtctactttctaacttattaaagcctatcttgrcagtcrgccttcttatctgaagcaatgagggtaggtggttgattcatcaaaacaagtcggttgaagcaggaaagcattacatgggagacatatactctacgcattttattttgccttaaaatatgaaastgtatatctggcagccatattttgatggcgggctgaggcctttmggattgatttactgaatgtcattgtgcatcgacttcctgatataaaccacccaaaaatgcatcatcaacaacttctagttcgtttctttttgtggaagggaaccttagacactcaacagcatccaagaacagcctcctccttgtcctctgcagctcttcccaatcattgtgcagtagtcccactcattcctaatttttcagaaattcttttagtgatttctcttttttaatccagtgttcccaaaggattcaacctaattttttttaacttttttttttttttatctttataaagacagggtttcaccacgttggctaggctggtcttgaactcctggcctcaagtgatctgcccaccttggcctcccacttgctgggattacaggcatgagccaccgtgcctggacttgacaacctaattttcatagaaaaaaatatattaaatayatatcatcttcatggtcatcttccattggatcatgtactttcagttagttacatctggcataatagcgagtccaaccagcatggacaggcttgggagtggccgccatcagtagcccttggtaaccaggtgggcaggggctgctggcccctgcatggaatgctctggtctatgagctgggcccaacaagggtgaagcacagcctcctcgggctttcttggtctccctttcccgccgtgccagaaccattctcttatttcacaatgaaaagaatccactgttggattcgcaccctggtgcgtgactgggagccagggaacagccactgggaacctctgcaagaaggaggcaggcgttgcaggaaggacacacggggacaggcttcaggaagtattagtggaaatcccatgcaccctgctaggattgcaggaaacaggattcctttgctcaggaaacrgggggcctgcctcggaccccagcctggcgtgggacccggcagtcaccagcctctctgagccttctgtctgaaggagacagggatgcgccaagcatctgtcaggtcccgcggtgccccagggctctgggtctgtagccccaaagcacggtccctcctcactgctgagggggcttctcctcatggtcagacagttttccagattgaaaaaggaagatggggagatggagaaggaagtgaggtgggtgggggaggcaagctgatgaacccaaataatcttcatcactctctttacagccactaataggcagatgatgcatcttcacagcctcaggtttggtcgcmcctgtgtggtgtgtagtgccggctttgggcttattcrcacyatggcgtgtgctgagtctggctgtgtcagtgttgggggggggctctgaccatggccccccttgcttctgctgtggtgatgcacagagcatatgccctaaccccacgtccctcccctctgccctgaaaggtgtgcaacaacaggaagaactgccactgcgaggcccactgggcacctcccttctgtgacaagtttggctttggaggaagcacagacagcggccccatccggcaagcaggtcagtgaagcccctgcatcccggtgggaggaggctgagcacctgggggcgggtgggctcgccagctgtcagyrtgggtgcaggtagagccaacaagaaacccagtggggaccccacatgggtctacacagcctagggtctcccgcagtttccagatgcccctctcatccctgcccgatcttctctgaggctccttgctctctgctttgactgagtggctgagtttgccagttccttagcctgygacacttttcttaactaaggtcatttctatagtgaactgctgaatgggtatgaatktcatcactgtatcaaagtactttgtaaaggccgacatctgtgtggtagggtgacaaggtgtgaagtttaatgccttttaaaaatcttactggaaagacacccacctcttagkaaaggtgacagtcacggcagcagtgggagtcattgcaacagcttttgcatatggaatgatgtgtgcaggtgctgtgtggtgcattttatgcccaygatgtcatcccctccttatacaactctgaagaaggtggtatgattcttttctcacatacctaggacctgaggctcaggraagttaagtawtttgcctaatgtgatctcgctaagatttacacacacacaggtctgcctgtcccccaagaagctcttagtagcagctgtgcttgaactcgtggccatttctcctcggatgacctttagaaatggtttactggtgcggtgctgttttctctgagttcttattgggcaattcaggggcaagtctaaatgatgcctcttttcgagggaaagaagcaaggcaggaagctgcagagtccaacagggagcgcggccagggccaggagcccgtgggatcgcaggagcatgcrtctactgcctcactgacactcatctgagccctcccatgacatggagaccgtgaccagtgctgctgcagaggaggtcacgcgtccccaagrcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagccyccacagcagtgggggagaagcaagggttgggcccagtgtcccctttccccagtgayacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcawtgaaacaaactggagaagaaggtagsagaaagggcggtgaactctggctctttgctgtggacatgcgtgaccagcagtactcaggtttgagggtttgcagaaagccagggaacccacagagtcaccaacccttcatttaacaagtaagaatgttamaaagtgaaaacaatgtaagagcctaactccatcccccgtggccattactgcataaaatagagtgcatttgaaataccgctgcctccaccctgttcatacatatataaaatcaaggcaggccatgagcaagcatggctcactgctccctggcctggccatggctcaggggctcattaaacaagtactcgtgtgtctgccacacaccagccactctcctgggtcctggagagacaytaagcaagaatgacatggcgtaagtgaggggtacgactgcagggagagagggcatcatgggaggggagcaacccccacagagcggcagggggttgtcaggaaggctcctggggaccctgcatctgttgaggtctgaagggggcgagggaaacatgcattctgaagccgagatagctggctgtgcgaagatctagaggagtgtggactggcctgggctcagattctagagtgcggactgggccaacaggaggggacacaggacacggtgctcgtgctggtcctggggaagagggaaatggagtcagtcactgcccgggcctctggcttgagcaaccctggggagttcagcaggttcagtgtgggggccctgtaaatgttcagtttcatagattgatgtattgaagatttatggattcactttatggaactagaaattatagttcaagatttttgctgttcactttttaaattaactttaattaactttgttatgagacaccagaactctagctagagccccctgtgatcactrctaagggtctgaaaagagtgacattttgcccaggaaaccagaagcaatgcttttccagtaacaccaacaagtaagtcaagactgtcatctgttggctgtcttgcttaggctaagacacatccctgataggccttgttagtgggggatggggtccagaaaccaagaaggtgtgaaagacattctttccctggagtaggagctgctgctgcagtgatccacagccagmtgagggtccaggtgggaggcagggccgaggagagcccaggtaactgcatcacggcgatcaccagcagccggaaaggactgttgcacacttacctgatgtgaagtacaccctgatccttgctgatgggaagacaaatgaatcaagatccctgtcctctaaaaattcactgtccagttgaaatcacaggtagacctcctctaagtctgagcatttagagtccttcccagacagccgctgaccatagctactgtaagaaaccaacctgatggtttgatttttttccttcctttccctacccttgaggaggctcttaactgtattaaacaaaatggcagcagrtcatagaaaagaagatgttttcatagagaaaatagcttcctcccaggaaaagggtttcccccacaaaggctgtgtttttaagtccccaacataacaaagcaaaacccatgggtgtttcatttaaatgagttttctttctcttttttcactatctactttgagatgtccagcaagaaagcaattcattttttaaaaacacgaaaagagataaagcagaacccaactacagaatgagtaaagaaaagcactttggaatggcaaatctgygctggggactggaaacatttgagcctggggatggctgtgattccagtgaggyttcagtgatggctccctgctaccttctgtggctaccatggtccactgtgccgttgtcacgcctcagggaacctgcgtggtccagaccatcaccccacctacccgactatatattcctgtttagcaagttctagagttgtcagaaatgaatgatggtaacatagattgaacctcaaacatggcatctgaagtaagacagtttattagtacatcactcacgggtgtactctcttcatttctgttgcttcagagttcactttgccataaacgtcacaacttgatacctcccatatttcattgtaactgcctccttctgtgagccccatgtgttttgtttcagataaccaaggtttaaccataggaattctggtgaccatcctgtgtcttcttgctgcyggatttgtggtttatctcaaaaggaagaccttgatacgactgctgtttacaaataagaagaccaccattgaaaaactaaggtaccctgggtttagcttgtcatctgttctagaaatggtggctcagaggctgggygcggtggctcaagcctgtaatcccagcactttgggaggcygaggcgggcggatcacgaggtcaggagatcgagaccacggtgaaaccccrtctctactaaaaatacaaaawatcagccgggcgcggtggtgggtgcctgtagtcccatctactcgggaggctgaggcatgagaatggcgtgaacccgggaggcggagcttgcagtgagtygygatcactccactgcactccagcctgggcgagagagcaagactccatctcaaaaaaaaaaaaaaaaaaaaaaaargaaatggtgtctcagaaaatgtacagcaaactgcttctcacttcatttttttagcaaaggtcagattttctggatcataaacctgggacttggttcttttttggggggtttcttgttttaaatttctgccagatcagctgcctcctttacttcccttcaaacaacaatgtgctgcttattacataagctagcagggtgtcaggaaattccactgatgtgttttctcccacccttatattagtaatttttatacaacatggagacattgaaatattttcatcagatggggtagcttttgatccaaatatattcaaagacattatcgctgaaatgccagcttcatacaaatcatcttccaggtgtcactacactgcatttctatggagcgtgagaactaatttgacaaaatagaggttttgagggaaaaaccagtatttattttttaatctcctaagagtgttattaggtaatttttcctttgcatgtttagcacactgagttaagtaaactgtcttttgagtgccactatgagcaaagtgtaaaaagtcaagtcagtgagaaggggaaacacgcttggtcagcaggtatgggattctgttgcaggtgtgtgcgcccttcccggccaccccgtggcttccaaccctgtcaggctcacctcggccaccttggaaaaggcctgatgaggaagccgccagattcctacccaccgaaggtgagtcttgagtagatgtgagtgctcagggcacacatgcagacatgaggttttcaatacgagactgaataagaatgggatcctagaggcgctgcctgtgaaatgctgagtcagcctcactaggtcarcaggctctgagggagggtctctgtgatctggggccagagggaggccccacggtgcccccatggaagcccacctagatcctgttggcgcactcagtgccccctgcatgatatggtgcagcatagtgtgagctgtgatcccttcagtcacccagaccagccacatttctggggccccactgggtctgcagcccgagctggctcctgacaccagcccccaatgccagccccaccatggtttccaaatgccaccacctggctttaggtgagctgctttagcccactgttamtcttaaaatatttttcaaaagttacatggagctctcagaattgaccattttgctccagccctgagmtgaggaagccctgtccaccctgtggtttcagagaactggatccttaacccagagtacctcacggctccctgctgtctcttaaccctcttgctaccctggtgaattacagctagagttcattctaatagttcttccccaccgagtttttctgatgtacccacaagaattcttgaatattgaacttagtcaacaagagtccaaattataacagtgaacaagattggtgtcaaaaaaaataagtgattgaaaaatcattgctgcatatgcagtaggcaataaactgttttaactcccttgatccaaaaaacgcaaagggtggggctccaaggaggaggctgccattcccaataagctttacccctgctcgtccccaaaggtggaaccataagcgagaacggctttgtgtggtagccaaaagcacatcttcattttcgtaaaaaagaaaaatgcagctctattaaaaaaaaaaaaaaaaaagcacagccttatttttgagagccccaaactagaaacaatccaaatatccatcaaccagtaaaaggataaacaatggtatatttgcacaatggaatgaaccattgatgtatacaacattgaggatgaatctctagataattattctgagtaaaagaagaaaagccagagtatatactctgtgatcccacttatatacaattctgacaaatgcaaactgatagtgacagaaagcagactgatgattggagggagagggaagggagaagcatgacaagaaaactctttggggtgatggatgcattcatttgtccacttgtttgttgtgagggtttcatgggtgtaaacacgtcaaaaaatgaccaagttgtatactttatgtcaactatacctcaattaagctgtttttagaaagagaggaaggaaggggtagaagcctgaggtataagggtccctgcagcacctgttctaagaacaagggttaccatatgggagaacgtctccaactccaagccccaacctcagccctggcttcctgaagccgcaactctcctttccccagtggttttctcagttctcattgagccttgaacacattaagctgtatcttattttcacatctcttttgtaacttccctaagatctcggtccgtgtctttctttatacttggtactttttcaagtgctttgcacctatttgttaaacagttttttaaaatctaaacaaaaatcgatccttctaytccagatttggyggggtggaggcaggtgatgcttctgtttgaattttgaagtttaaataaatacaaaaataattcccctcttgtgtacatccttgatttctttcctttaccccaccttggccttcagctataacagatgagttagcactgctttttccttaaggagttactgatatttttgaaacccgctatagcatggctttttactttgactgtacaggacaatcccaggagattgctgcagtgtcagaatgttgacatcagcagacccctcaacggcctgaatgtccctcagccccagtcaactcagcgagtgcttcctcccctccaccgggcyccacgtgcacctagcgtccctgccagacccctgccagccaagcctgcacttaggcaggcccaggtatgctttcagtactaatatgataggatgtagttcaaatccagattctgctacttgttaatgtgtgagcttagataagttgcttaacttctcggtgcctctgtaaaatggagataattcagctactcagatggttaaatgagataatccacataaagcagttagtttggtgcctggagtataataataagagtgtcayatattttaatttactagttataattttttaagtatttgaatagttagaccactcatgcaactaaacgatgacactattgagaatagcagagggactagtaataattaggcctgtacagtaaaatagagacaggcaatctaagacagatggtcaccctaagaagcatcagttatactctctcatcattttatttcaaaattatttacaagaactataccacctatatacagagtgtctccgtaccaaacttagcactgtattgtttatgtatatcatctcatttttatgctgtttttggaagtaaccatttctgtttgctgcaataacgaatgatatttcacaatagaaaacttgaagggaggagaaaacaagcaaataagtaggagataatcactggtaatttttcactgctattaatattttttgtttataattgtgtattttaacataatttatttgtacacagttttatatgctgctttgttttgccttaaaaattagtcccatttacaatggcattaaaaatcctatttaataataacactatacttgaatataaaygtttaagtacttgcaaattattgggcatgtattgatgtrtcattttttgctgttagaaagttctagagaggtaaatcttgggacctctttattcccctaggagagattcttaaaagtaaaatattgggttgaaagattgtatgaccattttaagcctcataatataaaaatattttttcagaactcatatacatttgcgttcccacattgttattgtctttctcaccatgactttgctaacactaaattttaacttttaccagtttgataaatacaacaaaatatctcaatttgttgctgtctagtagttctgtcagttaccaagaggagatgttggacttttccactataattgtgtctcctttgagttcatcagtttttgcttcatgtattttgaagctctgttgtttgcgatacacacaattaggattgttgtgtcatcttagtaaagtgacccttttatcattatgtcatgtctctgtttagctctggtaatctttgttctaaaatctactttatctgatattattatatccactccagttttattttgattagtattagtgttgtctttttgcaatcatgaatgatatttcacaataggaaacrtcattcatgattgcagcaaacagaaatggttacttctaaaaacaggatraaaagcaaagtatgaatttttccatccttttaacatacctatggaattacatttgaaaagcgtttcttgtagacagcatatagattttttcatccatttagccagtcactatattttaataggtgtgtttagaacattcatatttaatgcaattgttgatatgtttggatttaagtctaccatgttaatattattctgtttgttctctctggtttttgtttcattgtgctttttctgtgttcctgtagattagtattccatattgatttatctgcatttatgtttttgagtatatatctttgtattttttttgtatgattacactagggcagtttctcaacctcagcattttgacatattgtactgaatactctgttatgtggggttttcctatgcattgtagaatgtttagcagcatccatggcctctatcaactagatggaartaacatgtgtaattatgtttccaaacattgccaaaatgtcctctgaaaggcataacctcccttgattgaaaaccactgctctaaagattacagtatgtatgtacttactttatcacagtctactagtcaatatttcttcactttaagtagaatacagaaactatcaccttttaggtcgcttttcctcttccttttataatacagatgtcttaaatactacctttatgtgtactragagtcactgcagatgttgtaattttgctttcagccaaacataatctttaaaacttaactttgcttattattttctgtctgaaaaactttctttagccattttttaaagcaaatctgtaggtgacaaattctcttcattttcctttatctgagaatgtatttattcctagaggatagttttgctggatatagaatyctgcgttgactgttttctccattcagtactttaaaaatgttgttccccttccttctggactccatggtgatgagaaatccactaaaagttctacccatagtctctgttccagggaagggatgtggcatgttattgcaagaagtgatagaaagtagagatctgccagtctctaggctatgatgcctggtgaggagcaggagggaggcatggcttttttcaagtgttgagctggagtaaggtcaggtatggtcaaaacacttctgtgtttctggactgctctttctctagtcttttggctcragatagcaggsttttccagttgtgggcctatccagagcccaggccaagatatataaaagaacacacacacacaaacacaccactgggtagttccttgagttctgagatccctagccagcatactttatgtccagacatttttgttgcacttagcaggagaaatagggtgaaatgtacttattccaccttgtccagacctcatttctccttgtatttttttgattactggtacacttgaactactttttatgtatccattagccaatggtatgctggcaaactggcccttttaaaaaaaaattctgatttacagctgatttctctggtataaaacttcccattgtggccagtttcaagctactagtgtgacattactgaatgaggagtagggaactggcagttatgagccagtaccagccagctcaagcataccactgctgttcactgtatttgttctgtgacttgtcttttcctatcctttgcctatttatttctgtttgagaggtagaggttttcttcttggtttataagtttcttttaaaaatattttaatgtaattttagttatgattttttggcataagaataattctggttttgaatattgaatttttcttttgtgaattttcccattcctttcatgcttgcaaagtccactcccatttcattattagtgaaagtccatatataatttcttctgtttattgacagttcttttacatttgtttttctaatttgttttagatttgcagtcatggaaggtggtgagcatgccctaaacttttctggtccgtggacttgagaatctgacaaaagctatgaactcataaaatgcaccaatattagcattttgtgtgcacatttcaggtagccaaagagcagagaagctcctttcccatgtacccctcatcctgaacttttttatttattttaagcaactcacctgtgtaccatgtcaaactggggctaacagaccatgttatcagaggaaggtattcctactgctggtgtttttttctccaccagcagggactcttgcaagatttcctttaaagcaggcccgaaaaagtccttcattctgttttatgaaactaaggaaatgttaccctttaaacatcagtcactgaaaaatccacatttctcactccaggctggtgtctgtctggaacttttctaagacatatgatatagattaagtgkgtgatttctctcccatcacacatagggaacggaaattaattccatgcaggtgtggagaatatttggaggtgactcttgtttggcagcacaaattgaatccactgacattttgtactttggggttcctcatgccctgcccaggacaacgtgacacacagctaatcctgcttcatttgtcccaatgtactaagcattccagaagaaaacactaccacaaacaccatcttggtccacctcacatttaaactgtaagctaggtctttatagaaaccatttcattttctataaatgttctgtttgacttataaatgaaggagagctgaatgaatgtaccctcttgtccacaaacatacctttgcaatgtaccacttccttcatggtaaaaggacccttggaattcaagcttctcatcctaactccccagtcttgatcaaggaaacaaacttttttcatcccatcagctatattagaggaaaaataattcagtgtattcatctagctgttcactgcatcttaaagaaggctctatgcattttctgcagaggtggagatcttcagttcagtgatgctgtcaaaacacaacatttctcctaatcaacaacttttatctgtctgtattatatgcaacatataatattttataacacaagactcaccagtctggcacagtctcatctaagaaaaggctactttgtttaagttgccatgggaagacggtggcagctattacaaggaagtccaaattcctcttcctcctcaaacctttataaaaggtgatgaatgatgagctggggctgttactggtaaacagcagctactccttcaaatgcctggtcaggatgcagatgtgagcaaagccaattaatttaagccacgattgtagatcagtcaggtgctggccagttcagaggttaagtccaaactttcaaactgttcaacaaaatgaatttggctccgaatggataagggcatgtgcccttctggacctgtgtgggtgtctgatattgaaacctgcacttgcagagcctagaaatctggggattaggtccttgctcatcagaaatgccaatttgtaatgagaaaaagaagacccatttgttagtatgttctcctgaagaagatgaaatacaagaaaactgagttttatgagagcttctgttgctacacacaaagcacaggctaataactggtaaaggtgctggtgagtgtccttctgtgccctttccctgcattccagatctcaccctcccmtaagacctctccacagtcctccctccaggacctctgatcacctgctgccgtagcctggagttaccagtatgccagctctgccctacttctgaaggcatagactgatcccaggcacagctaagtccagcccctcgaacataatagatgtgtaggaaatatgctgaattgatgtggacttaaaatagtaaaaaatcagttgtcacagtgtcattctccatggcgccatcacactcagttacggattaatgacaatgagtccattccccctgtaaatctaaaacacagctaccaaggtcttggactctccctgccacctacccaatacttccagaaactttagctgaactttctttggcatcatatactaattattcatcagacacaaacatcaaatgtctttaagggtatcagttatccacggaagcatgatctctccctgaagggaacttctcagaacaygttttcaagggaagttgttcacgtgattacagkgttsaaaggggtatttgtttcccacttatttgttactataaacatgaaaattacataaaaagcagatgcctgatattttagcctttacatttgctaataggtaatataggcctataattaaaaatctcaacagtataaagggtcattcggaaaacagtctccttcacacctgtcaccagtctcccttcccagaagcaatcgtcactgttactaggcttttataaaacgcaatttgggatacaatgaaaagtctcagctctaccccccacccacctctctgctaggagagattatggaaattttcaaacactcaaaattggagagaagagtacagtgaaaccckatctacccatcactcaacttcagcaaccgtcaacttgctgtcactcatcttacatccttgttttgaattcaaatggcaacacattatgtactttcttctactttggttattccttattagttttatacatctgcttcattcttttcactggctacatcattatttgtgaagctataccatgacttctttaacctgtcccttccagattcccagatgggttgttttcaatcatttgctacgtcacacaggcataatcttgcccaagatggataaattcctgaaagcacaattgctgtgcaaaagtcatatgcatttagaaatttgatagactgagtgaagctgcctttaaaggagctgtttcagctattctattatccagctcctcaccaacacagtgtgttcggaggtttttcatctctttgccaatcgataggttaaaaacagtggtctccatgtttttcttcataggaaatacttcatagtgagatgaaataccttttcacaggtttaagattttctttttcatgaactgccttttcatctttgccatttttaaaatttaagatcggggtacatgtgcaggatgtgcaggtttgttacatcggtaaacatgtgccacagtggtttgcagcacagatctcatcacccaggtattaagctgggcatccattagctattcgtcctgatgctttcctcctccccctgccccattgtgtccatgtgttctcatcattcagctcccacttaataagtgaaaacatggggtatttggttttctgttcctgcattagtttgctgaggataatggcctccagctccatccatgtctctgcaaaagacatgatctcattcctttttatggctgcatagtattccatggtgtatatttaccacattttcttacccagtatatcactgatgggcacttaggttgattccaygtctttgctattgtgaatagtgctgcagtgaacatatgcatgcgygtataatagaatgatttctattcctttgggtatatacccaataatgggattcctgggtcaaatggcatctctgctgctaggtctttgaggaatcatcacactgtcttccacaatggttgaactaatttacactcccaccaacagtgtaaaagcattccttttgctctgcaacctttctagcatctgttaactttttaataattgccattctgactggcatgagatggtagctcattgtggttttgatttgcatttctctaatgatcagtgatgttgagctttttttcatgtttgttggctccatgaatgtcttcttttgagaagtgtctgttcatgtcttttgcccactttttactgttttcttgtaattttaaattccttatagatgctagctattagacctttgtcagatggatagattgaaaaactttctcccattctgtaggttgttcattctgtgtttcttttgctgcagacactctttaattagatcccgtttgtcaatttttgctcttgatgttgtcatgaaatcttttcgcatgcctatgtcctcgatggtgttgcctagattttctcctaaggtttttatagttttgggttttatatgtaagtctttaatygatcctgagtttatttttgtatatggtgtaaggaaggggtccagcttcaattttctgcatatggctatccagttcttccagactatttattaaatagggaatcctttccccattgctttttctcaggtttgttgaagatcagatggttgtaggcgtgcagtcttattcctgggttctctattttgttccattggtctatgtgtctgtatcagtaccatgccattttggttactatagctttgtagtatagtttgaagtcaggtagcgtgatgcctccagctttgttctttttgcttaggattgtcttggctatttgggctcttttggggttccatatgaatttttagttttttctaatttggtgaagaatgtcaatagtagtttgatggggatagcattgattctatttgggcagtatggccattttcatattgcttctttctatccataagcatggaatgcttttccatttgtttatgtcctctgatttctttgagcagtggtgtagttctccttgaagaggtccttcatgtcccttgtagctgcattcctaggtattttattatttttgtggcaattctgaatgggagttcatgatttggctgttggcttgcctgttggtgtataggaatgctagcaatttttgcacattgattttatatactgagactttgttgaarttgctcaagaagcttttgggctaagacaatggggttttcaagatataggatcacgtcatctgcaaacaaagttagtttgacttcctctcttcctatttgaatacacttcctttctcttgcctgattgcccttcccagaacttccaatactatgttgactaggagtggtgagagagggcatcttgtgctggttttcaaggggaaagcttccagcttttactcattcaggatattagctgtgggtttgtcatagatggctattattttgaggtatgttcctttaatacctagtttattgggagttttttatattatggggtgaattttattgaagactttttctgcatctattgagataatcatatggtttttgtctctagttctgtttatgtgatgaatcacatttattgatttgcatatcccgaaccaaccttgcatcttgggacgaagcctacttgattgtggtggataagctttttgatgtgctgccagattctgtttgcctgtattttgttgaggatttttgcatcaatgttcatcaaggatattggcctgaggttttttttttatctctcccaggtgttggtaccaggatgctgttggcctcacagaatgagttagagaggagtctcttctttccaatttttttggaatagtttcagtagaaatggtaccagctctattttctacctcttgtagagytcagctgtgaatctgcctggtcctgggttttgtttggttggtaggctatttactactgcctcaatttcaggactcattattggcctattcagggattcaatttcttcctggttcagtctcagagactgtatgtgctctagattttctagtttatgtgcatagaggtgtttatagtattctctgatagttgtatttctgtgggatcaatggtgatatcccccttatcatttctgattgtgtctatttgattctttatagtctagctagtgatctattttagtaattttttcaaaaaaactagctcctggattcactgatttgttgaagagtttttcatgtctatctccttcagttccactctgatcttggttatttcttgtcttttgctagctttggggtttgctcttgtttctctagttcttttagctgtgatgttaggttgttaactttgttaactttatctttctagctttttgatgtgggcatttagtgttatacctttccctcttctgctttagctgcttctcagagattctggtatgttggctctttgttctcattagtttcaaagaactttttgatttctgccttaatttcattatttacccaagagtcattcaggagcaggttgttcaggttccatggagttgtgtggttttgagtgaatttcttaatcttaagctttaatttgattacgctgtggtttgacagactgttatgatttcagttcttttgcattagctgaggagtgttttacttctgattacgtgatcaattttagagtaagtgctgtgtagtaataagaatgtagattgttggttttgggtggacagttctgtagttgtataacagatccacttgctccagagctgagttcaagtcctgaatgtctttgttgattttctaatattgtcaggtgggtgttaaagtctgcaggtctctaagaatttgctctctgaatctgggtggtataagatgcacacatatttaggatagttagctcttcttattgaactctttaccattatgcaatgcccttttctttttttgatctttgttggtttaaagtctgttttgtcagaaactaggattgcaacccctacttttttctgttttccatttgcctggtaaattttcctccatccctttgttttgagcctgtgtgtgtctttgcacatgagtttcttgaagacagcacaccaatgggtctttcttcattatctagatgatattgggccagatatgaaattctgggttggaaaatctttaaagaatgttgaatattggtccccaagctcttctagcttattgggtttccactgggaggtctgctgttagtctgataggctttcctttgtaggggacctggtttttctctctggctgcccttagcattttttctttcattttgaccttggaaaatctgatrattatgtgtcttggggttgatcttctcatggagtatcttaccttctctggatttcctgaatttgaatgttggcctgtcttgccaggtaggggaagttatcctggattatatcctgaagtatgttttccatctttgtgggcttatctacctttgatcttcgaggttgctgacacctttggatgagatttttgtgggtcrttttctgtttaacagtctggccactcttccgtaaggctgctgcaatttgctgggggggctctgttctgcccgcctcttttgggtaccccaatcacttgtagatttggtctctctacataatccggtatttctcaagacgacctgttcattccttttcattcttttttctctattcttgtctgcccatcttatttcagaaggatagtcttcaagctccgagattttttcctctgcttcatctattctgctgttaatacttgtgattgtgaagttcgtatagtgtgttttttagctctaacaggccagttatgttcctctctaaactattttggctgtcagctcctgtattgttttatcatgattcctagcttctttgaattgggttaccacatgctccttcagctcagcaaagttctttattacccaccttctcaagcctacttctgtcatgtcagccatctcagccccagcccagttctttgcacttgctggagaggtgttgccatgatttggagaaaaagtggcactctggctttttgagttttcagtgtttttgtgttgattctttctcatctttgtgggcttatctacctttgatctttaaggttgctgacctttggatggggttattgttgttttctgtttaacagtctggccactcttctgtaaggctgctgcaatttgctgggggtctgctccagaccccagtagcctcagtttttcttgtaccacttcccatggtgagggttcccttggctccrtgtcactcccaggtgggccattgcctcaccctgcttttttttttttgttctccatgtgtctatttgtttcctgaatcaatcccatttagtgtataatcaaattttatttttttctagatgaccacctagtaatccttaataccatttattttatttgtccttgattggcctatgttttattagatttgtctggtttctcattctcccctaccttcaaccagctcaaagtcttatatgatcttcctcttgctaccattagatcttggaaacatcactttaatgtcccctctacaaatgtgaaataatagtacttgcttttgggactttgtgacagttacatgaaaatattattaagaactttcctctaaacattgctttacaccttgctcactggttccaatttgtagtgtatattttttaaatagtctatatattctcttctgttttcctccttagcccaaagattgaagttattttttaaaatatttaaaatatagaaaagtaaaaactaaaatttactcacatttattctacatagaaataactagttttacatctttctagatgtacatgcctatttaagtttcagatatatatcctttttcaaaagaagtgaaacattaaagtcactacattagcctccctccagatacaagcactgtcataagtttgcttamtgttttcaatatttttgtataaatatgtatccatkaatatagtgtttcgtgttttaaactttacgtaagtggtatcaaactgtacttaccttcatgcaatttgcactcatctatgttgtactttttttgcttctagaagttctctttggttctaattcaactatgctagcttgtcttgtacttctttaaacmtagtaagaaaactttttccaataatacccaaatctgaagtctttggatatgttactgctgaagtttctatcacttctcactcctggttccttgtttccctgtatgctttttttttttttttccakgagttcacttttttaaattatagttcttcaaggcctaggatgcaggtgtgttcttccataaagggctattttgcctctgccaggtgcctggaggcagtaccagtttgagaccactttaaaatggcttggagcttattgaaatacccaggtgatgtgatttcagcttcaagtcctcaaggacaatttgtggtgacaggtttatttttctccctcggtctgtccagcaccagaagaatgctccttgtagtatcctggggatagattatagtatgtatttacttctagaagattcttaacctgaggtcttgtctgtagagcccaacttgaatggagaggagtcaggaagagaattctctctcattaaacttggacatttggtttctgcccatatgtcttgaccttggttggatttctctattcctcactgtgaaagagtatcaaaacccacatttaggtttccctaacttggcagatgcctccatcttcagttactactccctctccaagctgctgctttcacttagacttaaaacatttgctgtcttgtaactcttggtggtcatcagagaaggggtagggcacaacaacagagcctgccatgttactggaaatggaagacccgcctgtcaactttggcgagttccatgatacctacattagggtttacgacatttatattctgatctatagccataattcccacaattgtttttagctagaggtagaccgaatttgcacagtgaaacatattgatgccgccccagccctgcatgagctcgtcagggatctctggggcatctctggcattttcctgtgatgaattccagtcttcctgcagagatttctctggataagcagggcatgtttactctcgtttaccatgtgaagttgataacagctgagacttcatgatgctggtcaaggcaaagtggttatatctggatttaaaattgttttgaaacctctaaaaaatytgaaatatgtggctattgccagaacatgagcagaatatagaagaatggaacagccctatttaatagcatattaatagcatacctggatttttcttcaatatctggaagaagttaagagggcataaaaatgaggtttgaattcatttccttgtttaaaatgaaaatagatttaaagaaatgtttatcgtgtgtgagcaatctgcytagagtcatttctcagctcccttcagatgatgcttggtgatcacactggacttctctgggagaggttcaggtttaggttttgcaaaggcagaatgaaaagcaacacctagaagacagcatggcaatttcatcccttcctccagggtcaaaatgtgcagctggtgcttcttgcatcatgggttccacacctccatgcctaatgtctaaggagtgaaggcacatcttcttggactaacccccactgttccatggccattctgtcccagttaagccctggcaggaagccagcatcttacctaggcaacatctttgcttgcaacctgtctcatgcttccatccaaaccatgtcctggccatggctggaggaagcagatggtgcctgcgctgatccccaggttggaggtcagacccttcaatcagcgtctcagtcatttgggttttcatcactatggtgaccatataatttatcttctaaagtaggagacatgcctgagagagtgtgattaataattaaacaggacgataaacataaattgggaacgtcccaggcaaactagaatgaatggctaacctaactatctcctatgtttccatgataaatccaaatatattgtgatacatacctcactttttctccagcattgcaataaaaacctgacgttattctttattgccaagacagcttagtcatacttagcagcaaaactagtattgctaattatttcaatttgatgagtgcatacatccatttttacatgacacactaatgtcttgctcacagttttctgttatctataggaaggggagcttgatttgttaccttagttaattatccaaagtttgttggtagggttatggtgctttttggtggtaaattcactccattaataatagttgtaatccagcagcagctaacactcatgggttatattgcatgccaggccctgtgctaggagcctcaatatctcatttaaccctcacrtccacccgggaggaagggactatgatcatccctgctccaccagtgaggatactgtgtgtgtatgtggaactggttgaatatatmaacaatccrtgctcttgggcacattatatggcctttattcctagctagggaattttttctatttaatgtttcttttaatgaaaactaatgtagaaatatcacttctaagtctgtcccttgttcagggrctttttcctagcccaatgtgtccgttgttccaactcagcttatcttccacacacctgtggacacttgtgatttacaaacttctgtggtagcttcctttgctttacaaagatatgttaaatggtgattatattgttgcattctttcagctgagccccaactgctaaakaaatgtaattttcatatgataggcactgtgagagaaattcaactcaagtgtttgaaatcattgttgagtgttgctagatatatactgggtcctatgatggtgaattgaagcacttggttattaggggtgttctgtctccctggaggttctagcaccatttccaacagacattctgtgcattcatgagtgtttccgggcttcaaagacaagacatggcacccacattcacctggggccaagagcagagatgtgtccaacacttactgacttctggacacagctccaatgaacccctctctcatgggtatccacaggaggggccccacgaaaaaaaggggcatgtgttcttacattttttttttttttttttttttttgagacagagtctcactctgtcacctaggctggagtgcagtggcacgatctcagctcactgcaacctctgcctcccgggttcaagcgattctcctgcctcagcctcctgcgtagcctgggattacaggcatgtgccaccatgctaggctaatttttggtatttttagtagagacggagtttcaccatgttggccwggctggtctcaaactcctgacctcaggtgatccgcccgcctcggcctcccaaagtgctggagttacaggcatgagctaccacgccccgccgtttttcttctatttctactaaacatttttaaattgcggcatgaaggaatgctgatattaataactattatctgtgtgctgggaacttcctatgcattattttctttaatcctcataacaatgctgagataggtctttttccccacattttccagagaaagaggtcaagtgacttgcacaagtcccaaagcatcatttttggctaaaacctagcgtggaayaaccccaccttccctggccagctccctcacactggcttctggtcaacacagccctgccccttagtgtgtttacaaagcttgacttgcccctcagaccactgcatcaattctctgagcttatgagaaagtatctagtggaagaacttcagtgyatttcgcggagccttcagagcaacatgtggaacagygcctgcacgtggcagactgagcacaaccatcctcaccgtctcatccacccacagatgaacgagtcctgctatgtgatgttggcaaaactgaagaaacgaatgtgatgtttgaaaagattttcaccaacttcttattttagggtgaacagagaagccgcctaactaaaagcacaggaaagtgtgtatcctcagggtgacactgacagagaaaccccaacatcaacgctaccccagggcccaggggcagtccagaagccccatagttgagtgtttataactacgatccatggataagtcttaaatgttacagaaaattttggcaagaagattaacagaggtcagcctccacccaccttgtatggtgasaggatgatattcaggaagcagggcctgtgccaagyggcaggccctgcttctcaggggcctctgctggctcctggwaagtgaccctgcctaaccctatgtttattgcaggggacctgtaagccaaacccccctcagaagcctctgcctgcagatcctctggccagaacaactcggctcactcatgccttggccaggaccccaggacaatgggagactgggctccgcctggcacccctcaggtttgtgtgacatgccatgcccatctctttctctctcaaactcttgtgggaccaaccacgactaatccaagccaggacaggggtgcagtggtctaggccgtgcttcctgctccccctacaactgggaataccgtaaaatagacatgacaattaccaggaaggaagcagtccmygtgagcttataatcacaggcattggcacacagtgcctatcaacagccacagtggacctaagagagcaaatcaagatgtcataaaactacagtacctcagaaagccaggcctgtaagacacaaagaaaaagaggagctaccaagtagcatgacagtatgaagactggacacctgtgttagtctgttctcacattgctataaagaaatatcgaagactgggtaattcctaaagaaaagaggttcaattggctcacagttctgtaggttgtacaggaagtatggcagcatatgcttccggggaggcctcaggaaacttacaatcatggcggaagggggagccagcacttcmcatggctggagcaggagaaagagaaaaaggggaggtgccacacacttttaaacaaccagatttaatgagaactcctatcacttagaaccaaggagatggtgctaaaccattcatgaaggatctagtcacctcccacaaggcyccaccttcaactttggggattacaatttgatatgagactggggcaggaacacagattcagaccatctcaatgcccacctccacaactctcagcagaatctgcccagttcctgaggtcctgagacattagtcgggttggaggcatacggctggagcaagggacatatggggagtaagggaaagcagctgcctggcagcaggacactgggaaaacagggacaatgggcaaaaggaatcacctttcacagcttatcctgcttggtccactaggaaggcagagacctcaatcccaacttatgctgggaggctaaccccatggtgtaggggagccagcttaccctggttggtgagagataaccaatttccaggaattttgcaagctaggtgttaaacctagccaatattaaggattaaattatacaaatttatgatattttatattagaaacaaaggtaataagtgctcaaaactcacttcacatttttctccattttgctataattgtctgtgctcttgagattgcactcatccattatttctgtatggcagaaaacctaggtcatggtagctgcctgcatctcttccatgtttagtgatgtcaggtggtagcttgaaaccagccacaggaggagtatttacaccatggacattggcaaatactgcaaatcaggctttcctgcccccaaccccatgggctgttcaacatttaccagcacacagatgagttaaacccacagccaaagtactcttctgacacacatgccctcttggcaggaagcctgctttgtgagctcaaaagaaccaaaggtactgtgttggccaggccctgggttcagtaatcctgtatctctgaaggagaagacacactggagtgatttyattacagctcttgggaagaatgtttggcccgtgaaagaaagagctgcttaataaatgtcagagataaaggcggtcaaagggtcaggacaattgtttaattcccaacttcataaatagagaaaaattgcatagcatcctaattatttcattgtggtttgcatgttgatcttgaagttatttttcttgttctatttgaggaagaaacactactttacatgaaaacaatgaggggaagccctttttcttaaatgccctcaagctgtggccaatcttacctctggtcagttgctgattttggtcctgtcctgcacatttcattttttagggatactgggtgcccacctttgctccctgttctctggagctgtgctgtgggatgcagggactgctaggcatgttgcgcctggtaaaagtcttactgtattttgaagacttagtaccctaaaatgtcaactatccatttttttctattgatgatgacctgttgaaataatcctctaggtatactgagttaaatgtattactaaaattaattgcacctttctctttacttttttcatgtggctactagaaaatttaaaatttcttgtgtagctcacattttttctgtgggacagtgctggtctagagttgacttgtgggtgggaagtgcggctttggagacaggtttcccacccccgttatgaggggcagtrgtatctgacacagaaaacccttcagactatcagaatacatctccaaccccagacctctctatcctcagaatcacttctcaaggtctctgatcatttttttttctcctctcttcattcagacctgctccacaatatccacaccaagtgcccagatccacccacaccgcctatattaagtgagaagccgacaccttttttcaacagtgaagacagaagtttgcactatctttcagctccagttggagttttttgtaccaacttttaggattttttttaatgtttaaaacatcattactataagaactttgagctactgccgtcagtgctgtgctgtgctatggtgctctgtctacttgcwcaggtacttgtaaattattaatttatgcagaatgttgattacagtgcagtgcgctgtagtaggcatttttaccatcactgagttttccatggcaggaaggcttgttgtgcttttagtattttagtgaacttgaaatatcctgcttgatgggattctggacaggatgtgtttgctttctgatcaaggccttattggaaagcagtcccccaactacccccagctgtgcttatggtaccagatgcagctcaagagatcccaagtagaayctcagttgattttctggattccccatctcaggccagrgccaaggggcttcaggtccaggctgtgtttggctttcagggaggccctgtgccccttgacaactggcaggcaggctcccagggacasctgggagaaatctggcttctggccaggaagctttggtgagaacctgggttgcagacaggaatcttaaggtgtagccacaccaggatagagactggaacactagacaagccagaacttgaccctgagctgaccagccgtgagcatgtttggaaggggtctgtagtgtcactcaaggcggtgcttgatagaaatgccaagcacttctttttctcgctgtcctttctagagcactgccaccagtaggttatttagcttgggaaaggtggtgtttytgtaagaaacctactgcccaggcactgcaaaccgccacctccctatactgcttggagctgagcaaatcaccacaaactgtaatacaatgatcctgtattcagacagatgaggctttccatgggaccacaactattttcagatgtgaaccattaaccagatctagtcaatcaagtctgtttactgcaaggttcaacttattaacaattaggcagactctttatgcttgcaaaaactacaaccaatggaatgtgatgttcatgggtatagttcatgtctgctatcattattcgtagatattggacaaagaaccttctctatggggcatcctctttttccaacttggctgcaggaatctttaaaagatgcttttaacagagtctgaacctatttcttaaacacttgcaacctacctgttgagcatcacagaatgtgataaggaaatcaacttgcttatcaacttcctaaatattatgagatgctggcttgggcagcatccccttgaactcttcactcttcaaatgcctgactagggagccatgtttcacaaggtctttaaagtgactaatggcatgagaaatacaaaaatactcagataaggtaaaatgccatgatgcctctgtcttctggactggttttcacattagaagacaattgacaacagttacataattcactctgagtgttttatgagaaagccttctttkgggggtcaacagttttcctatgctttgaaacagaaaaatatgtaccaagaatcttggtttgccttccagaaaacaaaactgcatttcactttcccggtgttccccactgtatctaggcaacatagtattcatgactatggataaactaaacacgtgacacaaacacacacaaaagggaacccagctctaatacattccaactcgtatagcatgcatctgtttattctatagttattaagttctttaaaatgtaaagccatgctggaaaataatactgctgagatacatacagaattactgtaactgattacacttggtaattgtactaaagccaaacatatatatactattaaaaaggtttacagaattttatggtgcattacgtgggcattgtctttttagatgcccaaatccttagatctggcatgttagcccttcctccaattataagaggatatgaactgagtttttcttttgttgtttgttcttagctgtaattcctatgcttctatttcagagagccaggagagtttgatattaaaggaggttaaaactgtgatcttatgccatgtcatcaatggccacttaggggccatggctgatgacacattcttatctctacagtactaatgtgttattatagagccatgcattttatttctgaataagaacatatttaaactaatattcccttacaatatggacagtattaatccttccaagatgcagtatttatcaagtgaagcatatttagcagcaaattccattttaacataacttaggaaccaataaccagggtgttttgtggttgggggaggcacggggtggagtattcttttttatatcctcaaaacaaaaaaaatcaatacttatatttcaatggcaatctagtatttttttaaaagactgtataggcatgaataatagaggtggtttgagttttgtagggccatcacctggaaagtcaatgtgactagacacaaagtagcccagaggctacttttcttcctacagcttattatagttgtaggttctatgacctcacttcatgggttccaggcaattccgctgaaaggtttgtctcctgaaattttttaagtttgttttcctgacacatgtaatcagatgtgtagcaaccgagggaaacgaagcctaacattctccattgtggaaatacacacaggaggttacayttcacagcgtggatttttccagcttacacatgtgggatgacatcacagaaaccacaaaagcagcaaattaaactgtaggagagtcaatactcctgacgagtctcgggggggggcatttttatgccttcttaactttatgagaattctcaggctgaactataggccattgttcccaggcaaatcaatacatcaatgcatcctcaaaaaaaaaaaaaaaaaaaaaaaaccggctaaaactgtgtcaaaatgttcttaaggagcctatggtctccacggtgctaaaaagagcctggtgctgggccgactggcagggctgagcatcctcctgccccctcgccactgatgtttactaagcactctgagccaatgagacccccagcagcagaaagggcacaaggtggcgccagggcagcagggccagatctttctcatgcacctcgacctcttgcagactttcttcgtgagatgtactactcatttcaaaactgctttgcagggctcccctatgtattcggggggcccacggcacactcaggctggagatccttcctcactgcgctcaagatggcctcagccagacaccagttacccagctgaaagtcacaatccctcccagaagtctcccaacactagtgctgaccagaggtggggctctcaggctaggagtttcacacacaatgacaggctgctgggggacattgcaggaccccttttcctctcctctccatgctagaagccagccctaggcagctgcagttactccctgtgactcagcagcaggctgattcaacacagctgcccacacaaagccagtggctaatacatctgtttacctttccctatcacccagacacaagcccctttcccaggtcaaaccacaggccgatgcatctccagtttgacagtcaaatcactacttccattgctactttagatcagccaaagtggtgactgctgcagtgtgtggctatccctacaaggcccacccaagggatgcccaaagcccaaccttctccagggctgcagcccagagcaaccccaccagcctaagtccagcagaggacctcccacccaatgtcttgttctaattagaaggggaagttagccacagaaaatcaacttatctataattacaaaattctcttgactcaccttaaagttcctattgacatctactgcttttaaacctatttgaaaactctgatactaaaacaaatgacactctaagaaagtttgggagccccatgctgagaaccatttctgtgcagtgaggatgtttccagaagctacttacctacatgtgaatgtgccattttctttccttttgtagagaaaatcccctttactttttggaacagtaatggcagcttctagtacagccattacagtttcatatgagaaaaattaagaataactataaaattgttaaaatatccaataatggataatgatggccagaagatttaacatacaaagtaattctcaatgtaaagctattcagctcttccaggttgaatgccctgtaacccaccctgaccttccacatcatcttcaaaaagcagtttctctgttccccatgattctcctataaggtaactctttagtcctccatttagcacattttaaatcctccaaagaataagtatcatgtgattattttagctttacaaaaaaaaagttgaatggcgttttattttcatggcctataagcaggtaccttagtagggcagatataggaaaaacaaattagagcaaaacaaatcctctacaaatccaaggcaggaaaagtggtggcagagtgactcattctcctgtccctcccatcaggtcaaatcaggaggctgcagtgaatgcctgttctttgaatgtgtagcagttgttcctgtaactctttaaaacttggctataggctgtttagcacagtacagattaaagatacagttacgtaaacagcaaagtaattttatagtgcttcatccatttatcatgctttggtttgctaattttttcacatacctttttctatcacagtctgttgcttttgtacacatttctcatattggggttcgacaggtaaacacaaactgctatttcagtagaaaaagttattgttatgaatattaaacccaataaattgtataaaggtaaatatcaatgtgtctctcatttgttactgagaatgttacaaaaattggcggaaggccttcatgtagaaaaatgtattctcattcatttatagatgcttgagaaaactttggagcagtacataagaaactaagaagaatggttggcagggtgggggtgcataaggggtgtgtgctaccaacctcatgaacgtgtgagaccacggcacaggaaggaagatgctcacacacaacacggggggtggggcatgatatggtttttgaacaatgtgaatgtataacctaattttttaaaactcatctatttacataagaaatccaaaaagcaagcaagcagtggtagagacaatatcggagttatttggtatgaaaaatctaagtgtaaatagatacctatttaaaaaacacagcatccaacttaataaaactacagaaaatacaaaaatacaaatacaaaatgctaacaagaataaaggagtctttttttttttgttttttaagacggagtctcactctgtcacccgggctggagtgcaatggtgctatctcagctcactgcaacctccgcctcctggcttgaagcgattctcctgcctcagcctcctgagtagctgggattacaggcacgtgccaccacgcctggctaatttttgtatttatagtagagatgaggtttcactgtgttggccaggctggtctcaaactcctgacctcatgatccgcccaccttggcctctcaaaatgctgggattacaggtgtgagccacggcacccagccgaagaagtctttattcttaccactctccacctatgatcacacaagctggcaaaaattagtacatacagaacttcagacataattgatatatatcaaacaggatactccaaacatacagaatatatcatctttccaagtgccttggaggaataaaaattctcaaaaaataattccataccctagaaatgaattgattcattagttttcaaagatgaattgcagattagaaaacagcaagtgaaaacatttctaatagcacatgtgatggtagggattctcaagatcttagaattagaagacctcacttgtgatgcttgttcaaacccattaaaatccattgctcatgccctttccctgaagattccaattcagagagcagagatggggctacgaaatgtgtacttagcaagttctcccagttgaatttttcattagaaaagtttagaaaacttctatgataatgtaactaaagcactgctgggggaaaattcatagccctaaatctataaattaatttgtaaaggatgaaaaagggaacttaatatctactataaagttataaaaggaacaataaaataaacccaggggaaaaaatagaagaaatgaatttgtagacctaaggataagttcattagaatacagtagagctaataaaactatgagttgctctttaggaaaattctaacagtgtatacgccactttctaatctcattaagtaaaaagaagaaaaagagcaaacatacatagcatatgagcatgaagaatcctgcagtccaccataacccagggagatgatctcaagaatataaggatggttcaatatcgatcgggagggtgggcagttttgccaagcttgatgtcaaccagaagggatgcacactcctaccataagagcaggctagtgaatacagtctacaacagaccaaaaaatgaaactaaggtgaacatcaacattgaccaccaaccaaaggagggacctctggagagttgtaaatgtgctccaatttttaaagaggttttaaaaacctaatctggcaaatctaaaggaatttgcatttgtacaaaaggtaaaacactcatgaaatatctaaggaatggactatatatggtccacaaatccaattcctaaaacgaatattctgtgggctctttggaataaagctgattgctaacgtcaataaaattgtgtgctttttctctatgcccctcagcaaaagctttggagctttaattaccttttattaggctttccctacaggaaaaaaaaaatccactcctctacagacctatgtagctggttttcccatggggtcaagttaaccagtgtctctctggagacataaactcatgtggtctgtgtgctcacttttttgctgattttgaagtgtgtttgctgagttgaagctctaccacatttgtgtctttaagctcccaaccagcagacatggttgcagttaattcctacttgtctaggaactgcatgatcagcatcagaaaaccttctgctctgaagacaaaatttaatatactaccctttggctacatcgtccacccatcagcaggctgagtcttccattgtcagggcatgagtatatgcaaacacattagacctgtctgtggccaaaaaggctgaccctcaatcagacacctccaatagaacagaatcagagtcctgaaatatgtattctgagctttgatgtgaggccaacagctgaagagaaaactcctgggcttttcggaggagcgccactccaggagggagcagcggcctgacaaccagcctggaagccctaagttgggaggggaggatttaattgaaaacacatgagggaaagaattccaacaaggcctagcatggtagaaggacagcttgcggggcaggagccgggagtgggagaccccatgtrtgtttgtgtagctccggtgcataaatattttgtttcatgtctaactccaaaaggcgcaagtgcaagaaaacatccccattctacagacacccaatgatggtaccacatacgsacatgcttaggtaaaaagatgtatttcaaagtgggatcagtgaatcttcaactaaataaataaatgtacagccccccaagatgcagaatttcccatccctagtttaacagtcacggttcactttgttttacgtgcgtttcgcagatgagtggtgctctcatcagcagacamaagacttctttggcctctgcttttttttcctttcttctaatamggagactacactctagataaacaaaacagacaggcgaatgtaatccagggttttggtggtttttctgagtctagaaggactaaaaattagccttgataggcagaaagagcatcccaacctgtctgtcaaaaactctggccatttctaggacacctttgccgaactgaaacaggaaacaacaaaaattttacatgcttataaatgttttctccccctccgaggaaaatctttacataaagatggactcatttacctcattttttacacttgcatctgcccctttgtcaagaagtaactgaactaactcttcatgattatttaacacagccacctagaaaacaaaacccagggtggtgtgcatgagcttctccctccagggcacacacagcagggggcatgagcctggcacatgcagggtcccagcagcccccctgcaaccccaaaagaccactgtggctttgcatggcctgcaggcacagcgcttcctctgcagctgtatggtagcaactccagggaaaatggaaaatggactccctctctccacactaaaaccagaacagaaagcagcttgttctttgtttcaccagttctgttttgatcccacagtggtcctggggacaggggttctttagtccttaaatagttgtaaaaagacaacgaaagtattctagtgacagcctcatgcccttatgaacaagccgacagggaacacacacacacagtcaaacccaagggctggtgcagggctgaactcacaagaattgtctaattacagaaaaagctctgaccttaattccacgtagaaaactgcctattttcgggaggaggacctaccataaggggcgtctttccatttctgtccttcacattcacattggccccagcatcaattagaagagaggccaccctctgatttcccgacaccgcagagactctcatgagtggggtccatcctgaaccagtgtccacgacgtctacctgttgggccagagaaacagctgtgttgagcccaatttctttttcttaaaatgattcaaacttataaaaggaatattt

SEQ ID NO: 17797 - DNA, 30754 bp, Homo sapiens
  misc_feature (1)...(30754): n = A,T,C or G, or insertion/deletion polymorphism (see Tables 1-2)
tatgtatcaggtaaatgttcaaacttgctctggaaataattctgaaccaaaaaatttagtctatgtaaatctaaactatgtctataggatgctaatgaacatgggaaatttttcttgaatggtgacctttaaaccatataattatggacatgtggatatttctgtgcaatcttatagttaccaagatttttttttcatcttgtttagtattttctagatatctaggttggattcttatatctaatcttgaaaattatatatctattgcttggatttttataaaagactattcttttcactataaatttattgaaataaaaattttaatgtataccacttagaagtaacatttcaggtaatgaagatgcccagtgaagtaaaaattaccaaggatatatattttagtgactacaagagaggatttgaatcctggtttggttttaccattaaatagctgaatgactttgggtaaaatacttcaattctctaaggcaggtttttcatttgtaaatgtaaatattaatgatacactcaacattcttggtgggaggccttaaagagatgatatatattgaatgcttaggttaaagccaaaagtataataattagcattcaacaaatgctatgagggtgcataaatgctatgagggtgcacattttatttccactatagcttgcaaatacagtaagtatggaaactacctctcacctttctttggtttaactctatttttatatttttcaacttctgtagtctagaaaccttgtgaaaggaagttctgttcaccctcacattgtgttaggaggctgctgacatgtgatcactaaatcttactgctaacaaaatttaatggtggagcaacacattcttgtcttttgttataaatttcctctcaatgaaacttttcaatatggtctcaagaaccatacatgactgttgaattttgctgccttttgaactttggaatactgtttacatgagactgtcatcattttcattattaatattagtgatgtcattctgatcaggtaagcagacttccaggtccaaaatgaccccttctgggtaggtccatgaggaaagtaccaaccattgccacttttcccatcatctttagttctgtgtttgttccacatcagacatctcaggagagaggccacacgaggagatgagaactggacggaattgataattcctaactcatccccctatccctgtgaaagcaactaacgtaggttatttctaataaattccatgagtgtttgttttaatgttaccagttataaccaagatggcatgacaatgtcaacctcaaaattaaaccagacctctcatctctctgcagcctctttgatcttttttaaagcacaaattgatcatcctcccaatggtccccaggaaaaatccatattccttaatgagctttgtgaggtcctttatgttctagttgtcaccttggactccaggcctcatctctcaccatgctccttctggaactctacattttggccttgttccccaaaagggccttgatctctgatgcggctggatgttgccatgaatggttcctcttcccgggatgttcttttccttatcttcctgtctgttcaactcctactgattcttaaatatctgagtagacagcacttcttccaggaaatctttcctcacctccattacccataccccctaagacttgataaggggcttcccggcaataatcctactgcacccagaaatgttcccacctcaacccttgactctccatatcataattgctggttcatttctctgtatatcccatttctaaactccttaaggggtttacctattgcctacatgcctggcatgtagtagaagagcacataaatattttttgaatgactttcccagtaatggaaacaatgaatggatccactagggtcaagtatttaaaattaggccatgtccaaacaataacaccctaagaaagaaaagtatatttgtgttaggtcttaaaaagtggatagagagggccaggcgtggtggctcatgcctgtaatcaagacaccagtttgttagagctctgcgaattcttacccaatccattgggataatcctagagttatcagcctatacttgtcagagtactttccatgaatctccataaagctgaagctcggtaaggttacagttgcttgcaaaaagctttcagaaaacaattcactggccaggcgcagtggctcactttgggaggccaaggcaggcggatcacttgaggccaggagttcaagaccaccctggccaacgtgatgaaaccctgtctctactaaaaatacaaaaactagctgggcatggtggcatgcacttgtagtctcagctactcaggaggctgaggcaggggaaccgcttgaacccgaaaggcggaggctgcagtgaactgaggtcgtgccactgccctccagcctgggcgacagagcaagtctcaaaaaaaaaaaaaaaagaaagaaaaaagaaaaagaaaagaaaaaaaggaaacaattaactatttaatgatctgtgcgtgaataacaggacttaaaatgaccatcgttaaaagatgagaattcattataatagtgacacaattcacaaggaaatgtggttgttttgtagcatataacagtttaacataataaccaaaattacagctgctaacacattagatttctaagaatttattagtttgtggaacatgaaacaacatatttatacaagtataactaaaagaaggttaaatataatttcttatttacaatgtttcccatataatttaatgtatttaataagcctaattggtttaatatgtctcttcctttgagaagctccagggaccctctagtatgtcccaaagtcattctgagatcaaaagacttaaattagaatttcagaagtttgtaagaaatgtcaaaagacctaaaacattttcttaaataggatcttggtcattatgaaacaactaaaggtaagtacagaaaagttacacagtttttaaaagcttagctcttttaatattaagaagacagtttgttatggcttctgggcagtattcagagaagagaattgtaggagacaagactaggatggtccttgagtaagcattcatgtcttccacaaacatgtgctgagcacctaccatatgtgaggcactccgctaggcattggagacacagaagtgagcaaaaaaaagacccagttcctggtctccgaagtccatggcagctggatgatgaggacttcctcatggacaagcagaggcccccaaaagtggcttcagccaagttttgggtgtaaatcaaccgttttgatacttgtatggagagcaagttctgattatttccctatctaatcgtcattcaagtttgcagaacttcacagcacccagattctgaaggctgggagttgttctggaaatgccaaggacccctacagaggagcgcagacttttggacctaatgcactccaactggcaccagggtttgtctggcctcggtgagatctaccagcggtcatcaaggactttgagaactctaggtgaaactcagaagctgagttcacttcccacagacaggtatctctaataaaagaaaaagaaatcaatagctgactaatgatgaggcaagttcttgtaccctacttccattacaacacacagagggagagtctgccagttcatgggatatttagaaacatagttcaatgtaatacagtctgattctaggctctggaagagatttaaaaaccagctttctcaaaacaaacatttctctaaaattaagggactccgaaaacccaccttgaacccaactctatcattcccccagaattaaaattgaaggagcaaacaaggacagagctgattgcctgaaggaaagcagatatttgggcttcatctacacatgtatgtataacagataatggctggtgacttcattctttacttttgtgaccttcaatgagtcatacgtcttgaagacctgagagctgtctggtggaaatgaagtcatggtttcaaaaagagatccacagatttgtatgcctatgaatccttacttgtgaccctgaaactggatgtaagttcaatcaaaatattccagttgttggccagacgcagtggctcacgcctgtaatcccagcactttaggaggccgaggcgggcggatcactaggtcaggagatcgagaccatcctggctaacacggtgaaaccccgtctctactaaaaatacaaaaaaatagctgggcgtggtggcgggcacctgtagtcccagctacctgggaggctgagacaggagaatggcataaacccaggaggtggagcttgcagtgagccgagatcgcgccactgcactccagcctgggtgacagagcaagactccatctcaaaaaaaaaaaaaaaaaaaaaaagaaaagaaaagaaaaaaagaaattccagttgttattgttgtttgaaagactcacccagaaatctttccatctggtgtggaatgaataaattgtctgacagcctgtgaaggagaagcagcttgaacctcagccttgctagaggcttagtctaattaaatcccctagagcatttaaacaggagccagtgcattggagcacagtgtatattgactgatgcacggagtttcctcattgtcttaggaaagggtatgctcgaacctggtgctgtgtgctaaagaatagtaacagtgagtgcaacaggtgctgctgtctctgaattccaggcctggcttgggttcctgtattggttagctactgctgcataacaaacaatcaccaattcagtggcttaaagcactgaattaaagcatttatccatgctcaaaaatctgagtttgctgggtggttcttctggtcttggctggatttactcatgcctctgtggttacagtgggttgagtaggcagtgccactaatcttggctgggtcctttacatacttgggggacagctggctttgagttgttcaaagatgttgctgttaccacacttaatgaccaaatcaagtcataccatgtctagctcagattcaagaggtggagaaataaactccacttcttgatggaaggagctgcaagatcacattgcaaagggtgtgtgtacaggaggaagggatgaagaactctgaccaccttcccagtccatcaccaagtctagcctgtttctccatcctggggatgcctggaagtagggaggaaacaggtcaagggccaagagggttttcacattttctcttttgactcattctgtgtatccctcttgttctacatggttgacatccagtgaagcttgctgattactagctcaacacaactgaatattcaacaactctgtacagcctgaattcaaatcttacctcatcactcgttagtcgtgtgactttttaggcaatttacttatctctctgtgcctcagttcccacatttataaagagaggcttatgggattgttttaaaacttattaggtaatacacgtaaggtgcttggaattctgactgtacttggtaaggcttcgtaacagttggcagctattctttatgattccaggagtcctttccattttcttaagaggaaggcccttaggcctgcacccttgtgttttggttatttaagattgagaactttgacaccgaggcatatttaacttggcaaggggaggcactcatggtgtttgctttgtgaaggcttatctgccttgctgtgtgaactggctgggctgttcacagatgcagaggtctctggttatatcatgatggctttacagggtccaagaattatctgcaggtgtgcaaccttcagaggacctggggaaactcaacagacatgacatgggcctctgggggctcctgaacccaactattgagattacagtggcataatgcaatcattgctattgttttaaagtgttgtcttttggattggttcattgcatagcaatatataactggaataggcagttaatgggaggattgtggtcagaagctactgtgagggctgttgaatttttctccaaagctcagatgcccagtattcctagtcttcgaaagagagagaggaagattgagagagagagagagagagagagagagagaagaagttttcttaatcagagatttctctttactttcaactaattgcaggtattttcatctattctaaatgagaaatactatcctctatcattagggtttgctgctgtgtccctattgagacttgtaaactatttggtgatgaaatagaaaactgaaaagtgagggcccattcagctcacaagtacatgcatagttacataggtacaaggttggtgacttcactccctgctttaaccaagcattctgtcatatttccagacttgtgggaagacttgacagctattattaatcttgttttgtgtatttgggcagattaaagtattaagtgcgcacagcatgggctatmatcacctgctgttttcttgaagtagtgtccaaatgataaggctggaatatatatttttagaaagggctggacactcgatccggtgggagggaacatctggaacattagacagggtaagccacctttgcaactcctttcccyctgctgtgacgtacaggtgaggtaaacagtactgaagtccagggcgtcggtgctcactgctctggcaatgcccggtgagactgaattatgtttaaatttattgtagatgctgatcttctggacaatcacacttttcctgctgggagcagccaaaggtaagaaacaccactcctgccccgtaggaagggcttaaacttaagctctcagccctggccagagaaagctttaactgtggcagggctcccagcagctccagggtaccagagagaagatgtgggctgacactctgcctgggagagtaggctgggcagtttaagggagacctgtttctggggatccccccagtggcctaccttcatgctcggggtgcccaaggccagacatttctaggtaaagcatgaaacatctgcctgagttaacatattgacttatcaatgcccatgatcacattggtcaaataaatgtatcagaagagctaggaatgggacttagaactttccagttttgagggtagttctaaacaaaggctccagtggtgtccctgtgggattcaatgggactgatactactaccggccagtagtaggtgggcactggggtcaagaagagagtgggaggggttgcagtaggttcatccattgtcttcagactgtccctgaatagaagagtgaccaggcccgaacagcagtgacaccccagagcacaccttgagagcaaatccttgagcagattcaacctttctctgtaggaaaagaagtttgctatgaggacctcgggtgcttttytgacactgagccctggggcgggacagcaatcaggcccctgaaaattctcccctggagccctgagaagatcggcacccgcttcctgctgtacaccaatgaaaacccaaacaactttcaagtgagacctctgtcatttaaatgtcactgtaactggcacggggctatgcccaccctgcagaccatgaataccttatctctgtgccctcttcctccaccatgccccaccccatccctcaagctgccccccagacctagctagacctagacagagcaggtctttagtaatgttggcttgaatgaatgaatggttcacatttgccagaacctctagctactgtgtgattctggtctggggcaaacagcttactgtctaacaaaaaccacagggaaggtaaaacctcaaaccacaatccaggcctagtggaagcagtgattactcacctggagagatggggcaagaaaagggagatcagggtgggcttcatggaagaagtggctttttgctaagctttgaaaagtagaggcattggcgcaggcggagatgaggaaggaaaaaggcctgtgaggctgggctgcgaaaacatgmagcacttctgcgtctgtcacagattctcctcctctctgatccatcaacaattgaggcatcaaattttcaaatggacagaaagacccggttcatcatccatggcttcatagacaaaggagatgagagctgggtgacagacatgtgcaaggtaggagccagctctgatccctgtggccagctgaggccaacacttctgctaacatctctgcatcactttatgcactcaagaaatctttacatattaggtaactttatgcaattaaaatgcttctcttcacaaaaattaaaatgcctttccatgtttccgcactacatctgcacactgaagcaaccacatttgctgttagaaaagtactcctactacctaatttctggttaaaccaaggcctgatgttttctgcttccatttgtagtgagggtactttgtatcctataagcgagggactataggggtttctttgttcaaatttttcccacatccctgagaggctgacatgtgttgctgtgaccacttaattgatcccagcactttgggaggccaaggtggatggatcacctgaggtcaggagttcgagaccagcctggcgaacatggtgaaaccctatctctactaatgatacaaaaatcagcctgttgtggtggcaggctcttgtagtcccagctacttgggaggctgaggcaggaaaattgcttgaacccaggaggcaaaggttgcaatgagccaatattgtgccactacactccagcctgggcaacagagtgagactccatctcaaaaaaaaaaaaaaaagaaaactaagattaagttactacaatgacagaatagaaagtgtcacctacatgtaatataggtcagaaggagagcaacagaagaatacacacatgtgcacacacacacatacatacatggacatgtgtgcaacttgtgcatacacacacaaacacacacacatgtgcgtgcaatataccacaatataccatcatcctttctatttatgtggagactagttcaatcgatttttctgtcacctaagaatttacctaccccaggagcctgccttccacacatacattaataacaccaaccagtaatgtcaaaaggaaaaattacaaacccagaaaattaaagtcattctgcacttgcccttggtttaacaggcatttcactcttggcacctttcctgtcctatcattaataagcatcttattgatacagtttatactccaaattctccaggcttgtgaaagtttcctcaggattgcttgaaaatgaaagtcctggccaggtgcgcagtggctcatgcctgtaatcccagcactttgagaggccgaggcgggtggatcaccygaggtcaggagttcaagaccagcgtagccaacatggtgaaaccctgtctctactaaaagtacaaaaattagccaggtgtggtcgcaggcgcctgtagtcctagctactcaggaggctgaggcaggagaattgcttaaattcggaggcagaggttgcagtgagctgagatcgcgccwctgcactccagcctgggcgacagaatgaggctgtctcaaaaaaaaaaaaaaaaaagaaagaaaaaaagaaaagaaaagaaaagtcctgargagaaaactcccactatctctgtgcatgtgatcacacatattagtatactatatgtggaatgattccaagtgcattttaaatttatagtaccattttaaattcaagctggtaatatgtactgcctggcagaactcctaaagatatatcagctcctttgacatccaggaagacattttccttccagaattcttcaatctcttttaaatcagtacagttctatttttcaaatatctacatgtgtctactccatgaagtactgtgtcatcgtgactataaaaatagtgaaacttctctctcactttccagcagcctggggcatcgccaagagcctgaaaggaccccttacagtcaaatccacaaggtcatttagacactggccaccggagattgcacctaagacttttccttttcaaaacaggactcttttcatgatgcaattgtttttcccttactaaccaaccttactgaatttggttgaaggaaaccagagagtagccagcttccaattaatctgcaagctggagggggaatcagtttgcctttctcatagcattcaccctgaaggataactcctaattaccaacaggattccctaacagagtctagtttatctcatgccctagctaggagaagagagaagtggccatttctgagccctggctggataaggtttcccctgctcccattatctccccaaccccactatctccccaacaccagaaactgttcgaggtggaggaggtgaactgcatctgcrtggactggaagaagggctcccaagccacctacacacaggctgccaacaacgtgcgagtggtgggcgcccaggtggcccagatgctcgacatcctcttggtgagtcagctggctggcctatgtgaggagggaagcagtgcctgctggtctctgtttggtagagatgcagctgagagttatggattaaagaaggacaaagaattgatatccagaccttacttytaaaactctgaaatttgccttcataatgacacgccagtggaagcaaaaataagaatcgctaacacttagaaagtggttttttaaaaatcatcttcaatttacagataaagaaactgaggcccagaaagtttaactagtttgctcccaaagtcataaagcaaatgaatagaagacctgccttttgatccagaccatctagcttcagaattcacccacaacaccaggtgggctctgtttcgcgtgaaacacagcatggccagagagagccacagagagccaacggacagtacgtgcaattggcatgtaccagctctactggcctggtggtatgggtcctattgatgttggggaattccttctgccacaatcatttcacttatttcttcctatactgtttcattatagctaactccttcagtctttaattctttaagttgctaatcctttgtgactattttctataccaggtaatgactacagccatttctgtcttatagttaaagggtctacaaaagaatcaacttctgcactcctgcagaaatcaaaacccatggtatttgtgcaagaagtatgatagaccaataaatgaagtgcctttgggtgaacgtctctgagatcaacatgtgcaaatacctcatagctctatttgatttgcttgttcaccagtacttttggagcagaatgtcaggagtatgtgaggaagtaaagaagacacatgagatcccagaccatcaaggagcttgcagtgaaaacttgcaatgccagtagagtgcgatctattagtgggttctgatggggagagtaggagctttacaggaacacatagaaggcagctaatccacactgatggggtggggaaagggcttaaggaggtctcccaaggaagagacgtctaaattgacagctgaaggctagtctgttgatgttagctggcaagtgcttgggggatagacaacaacaagaagagaagaacaaaccaggcccagaggtgagaggctatgatgtattcgagggtctgaaagttcaacaargggtttggctgaagagtctagaaaaatagatgatgagttaggaaagctcggaggccttcagaatgagtttgggcttgatcctgaaggcaatgagaggcatggaaggttttcagcagaggagtaatatccattaggctggcattttagaaaaaccacagcaaaaawtgtcctgaaaatacaatcttccctctccagacagagtatagctaccccccttccaaagttcacctsattggccacagcctgggagcccacgtggctggagaggcaggaagcaagactccaggcctgagcagrattacaggtaaggccccagaggcagggccccagttttgtccccagaaaccccagaatgaggtctcaagaatgcagcccagttcagagctcccctgaaggagactgtcccccttggctgtgatagagctgcttggagcctgcacagaacattttagggagcccccaagaagctcatgcgccaccttcacggcaagggaagggtgattttgttcctctttgcttcttccacctctgtcctagcccctcctttctaagtcctggttttctggtggtgttcgcctctcaacaggactgggcacccaggaaaatgcagagtgagactagtatgaacatgagcaaaacataatcaaggagggtctatattgccaattctttctcccttctctttgaaatcaagggcagaatagaacctaaaaattgtttcccactgcttctactagtagaagaaacccagtcgccattatggccaaaagcattcttttaacccaatcaaagcatttgaattataacagcaacagcaagatayatctacataatatgatggtgataataataataataatgctattataattattatgataagcatagattaagtgcctgcttatcccaaatactgcacaaaatgctttatattttcttatataattctcagaactgaagaaaaaggctcagggatgcaaataacttgcccaaagccacacaactcatcagtgggagaactgagatccagacctggttttgccgatgtttggcttaagcaactctttataagaaatctctcttttattttcagctggcaactacattcacgttcctattttatcagctgctgtaatgaagccttcaaaaactattaacaaatccaagatccctactaagaaggaaatttgtcaaaaacaataattattaatatcttacttatacacccatgactatacaccaggcattgtgctaagtgctacctattaactcatttaatctataacaaccatatcaaatagatgccattatcaccccattttgtaaaatgaagaacctgaagcacaaaaaggtagagtgacatgctcaaggtcatgcatcttkccccaaaagcagctgagtaggaatttggagccaggcaacctagacccagaacctgtgttcttaactatgataccacattgcttcacccctttctttctacaagcttggggagagaaaggatgatgaagaagaaagatacacaagtaaatgggagactctggtgtggaaaaaatccttgcttaaacaaaatctaaatttctttgctcatttgtcctcctccatccaygccactgggaacccttttgcaatgagccacattcagactctatgtcctcatatttagcacccaaggccatggcactgcatcactctggtgcatggtacccattgagttgggcagtgcatagcccgggcagctgtacaccttggtgctgctgacatctacagtcaggtctattgttctgcagtgctgatcatctcttttagggttggatcctgtagaagcaagtttcgagagtactcctgaagaggtgcgacttgatccctctgatgctgacttygttgatgtgattcacacggatgcagctcccctgatcccattcttgggtgagacctatgatgctccagctgtgagyaygcacaactgtgttttaaccatgaaagtcctgcatgacaaaaagctcattgtttttctaagcatttcaggttttggaacgaaccaacagatgggtcatcttgacttcttccccaatggaggagagagcatgccgggatgcaagaagaatgccctgtctcagatcgtggatctagatggcatctgggygggtaaagtcatggtggggtgaggggagcagggcgggtactttcctggagtgaccaatacctttctgcagcaaatcttaagaataaaaatgaaactgtctttaaaaatatacaattccctcttctggggattatttcagaaaaaatgtagctacatagtatttgttatatctcagctttactgcttttgtgcttccttaaaacattgctgtggatgtcctggcatgtacaagcaacaaagaattataaaactgtcacttaaagctgtgactccagcaatcagttggtagttacctaatacagaaaggaaataccataagagcaaacatcctgactgtaactaagagacttttgctacaaattctctcttgggagtcagtgataaggttcaaaatgatgtaatcagctccctttcagtagctagaatgagaatattcccagtggtttccacagcaagcctatttgcacaatgagagccattgctcacccatgttgagtaggaatgaggagcaatcacagttaaggaaggtgagatgggagactgctattggatgtggttattctttattgttgatctagcacacttgggaagaaagggcatcctgcagacacagctctgactctgtatctaatgaggccaaaaggacaatggacaggtgaagttttcatccagacttgtcatgtggcaccacacggagaaaacccttagtagtctgaccaaatgtaatgagtaaagatttttactgaatttcatcaaaatggcttggcatatatggatgccatcaaagcaaatattaagaatgaggacaggccagctgtggtggctcacgcctataatcccagcactttgggaggccgaggcsggcaaatcacttgaggtcaggagtttgagaccagcttggccaacatggtaaaaccccgtctctactaaaaatacaaaaagtagccagtcgtggtggtgtgtggctgcaattccagctgctygagaggctgagtcaggagaatcgcttgaacccaggaggcaaaggttgcagtgagccgagaccatgccattgcaccacagcctgggcaacaagagcgaaactccatctcgaaaataaaataaaataaaataaaataaaataaaataaaataaaaaataaagaatgaggacatatgcagtttgtctttcacagcctcatgagggtttgcgtgcatagggcagtcaaaactcttcatcagtaatggcccagcaagctcaggccaggtctagaaggtataatgtaacatttgtcacttggcaggagttgcagggagcccagaaaggttgcaagtaaaatcaagacactatgagagtgaagctcatacaaaaccacctaaagttatccagcccttgtttttatttgtataactgccgcatggaaatgtcctcgcattggcttggtcatgtcacatctggtcatgtctttgaggacctccagcatggtgcctgggacatgagatggcactaaggttagagggatgggccgaagacaagatgggcatgggtttaattaccagctttcccacctattagytaagctgtaaatctgaggctacactctgtagtcctttctgtaacataggaatgagatgataatgcataaataaggatgatatggtacccacctcctaggaagactgaggattacatggacaaggcaggtaaagtgatcagaatgttgccttgtacacagaaagcaccctctatatgttaattgtcattatggtggctgaattttggatttatcttaagtttctgaaaatacggtcctactttggaaccatcccatttggagagagaggcagagaagctgttacaggcccccaaccacctgttcaggtctccttattygttttcccaggaacccgggactttgtggcttgcaatcacctaagaagctacaagtattacttggaaagcatcctcaatcccgatgggtttgctgcatatccctgcacttcctacaagtcctttgagtctgtaagctattgtcctgcctygagcaacaagcatcacccctctgagggactgctgtcctgctgcgtttgggatttgcaatgccttctcactacacgttttgcattgaccctcagagttcatggtcctgtggagtggaagagaaaaaaaagtaaacaacttttggcaggagatggctaaaattttagatgacatgagttatgtggcagaggaaaactgggaaatcagagagaaagagcagtcaattcaatgatatagaggcttcctgcaggaggcaacctctgaatctagcttaaaaatgatacagtttagaaaacacaggaatgcacatttctggcaagggcagagcgagagtagaagaatgtatagagaataattcacaccagagagaaagcaaggtggatgctggagtcctatatgccaggctggcaacaaggggagagatgaagaatgacaggttagagcctgcctattctggctcacgaragccagcatgagtatcccttcccaactccaaattcagagacatcatgttggtagcctgaaactggccacagtcagagtatttacaccactgaaaatggtaagcactgcaatccagggtttttgtcccagagcttttgctgcttatcattcaccagctccactcaacagaaggtataattgatctaacctgggtcctgggcatcagtattttttaaagctcctcaaataattctaatgtgttgtgcctaaaagttgggaaccctgatccagatgaaggtaatttagagatcatctgctccaacccctttgttgtcacaaaggagaacgcttaggctgtaggaaaattgagtgtctgccctctcagatgtatcgatcatacaaacacaaattctccttacagtcccatctatctcttctcattaggacaagtgcttcccgtgtccagatcaaggatgcccacagatgggtcactatgctgataaatttgctggcaggacaagtgaagagcagcagaaattcttcttgaacacaggagaggctagcaatttcgctcgtaagttgcactttgactacctgcccatgtaaagaaagtatatagtttctgttacaaatgaggggcttgctttcaacctgaaatatttgtgggtacattttaattatcttagaaatggacacatttaccgaaactattgcagttacaagtaaactgaggatttagacagagtgtgcatttcttccrttctatttctgcggcatgaaatgagagcaagcaactagtataattaatgggatgaggccagtttgcacatccttgtgaccagctaccctgaattyttaccactccacagttcattgtttctttcctttttaaggccgcatcagacacacctgttctcttcattcagcaaagacgtaattggtaccagctctttgctgggctatgtcccttaagaagcccaactccattctctgctttcccctctgtctgtgcatccctgatgcccaggggctgcctcgctggtggagtgcaggcrggaatcagggggaaggatgatttctctccaaaacctgctgaatggactaagacacagggtagagactgggcatgtttgggccactttgtaccaacctgccccatgacasttccataggaggtgacccagtaaagacagaggttacatattcatataaatgtataacacatcttacrtagtttttaaagtcagatttattgaggtataatttatatttggcaaaatgcacgctgtttagcatacacttgtatgagtttggacaaatgaatagttgtgtaaacacctccaaatcaagatacagaacacttctatcaccatatatatcactctgtaatttttttttttttttttgagayggagtctcgctstgtcgcccaggctgsagtgcagtggcgcaatcttggctcactacaacctccccctcccgggttcacgccattctcctgcctcagcctcccgagtagctgggactacaggcgcccgccaccatgccaggctaattttttttttacatttttagtagagacggggtttcaccatgttagccaggatggtctcgatctcctgaccttgtgatccgcctgcctcggcctcccaaagtgccgggattacaggcgtgagccaccgcrcccggcccactctgtgtattttttttgtaagaagacattgattaawcaatccttccactgatgttgtgatgcatgaaatacttgccaatatttcaacaacaaattaaacactcaaaaaccaggtattcattcctcaatcaacatttatttatgggccacagactatgctagacactgaggatgcagggacgaacaagagactcctctcatgaaattaataatccagccaaagacagaaactgggcaagcaactacaagcgtgttgggcttggtggctgttgccatgacattatgggacagagaacctggccctgaccagaaggagggtcagggtcaaggtctctgaagacacgaaagatgaataggagttaggcaagaatcatgtctgtgtatattaatgtacatctgtgcacatgtgtgggtgtatgaatgcatgtgtgagtgtgtttgtgtatgtacctttgtgtgtatgcatgtgtttatatacgtatgtatatgagyctgtatgtttatgtatatgtatgtgcatgtgtatgtatatttgtatgtgggtgtctatgtatgtgcgtggttawatgtgtgtaggtttgtgtgtgtgtgcacatacacatgcatgtttgtgtagatgtatttgtgtgtgtgcacatgcacatgttgtgtatatgtatttgtgtatgtgcacgcacatgcatgtttgtgtatatgtattgtgtgtgcacatgcatatgtttgtgtatatgtatttgtgtgtgtgcacgcacatgcatatgtttgtgtatatgtatttgtatttgtgtgcgtgtgcatgcaggccctgggacagcatttcaggtagaagcctaagtgacagctgcycgtgcacctgctctgtgctagagactgcccagggccctggggagcagagaggaaacacagtccccgccctcgaggtgcttgccaggctgcactcccgagctaccttcccaaatgtggagacaagcccctattccctctctcttcaccttaccttactgtactgccattctggggcagagctggctaacagaactttctgcaatgaggggcatattctgtgtagccattagcctcatgtggcaacttaacatttgcaacacagckaatgagtttgagaaactaaatttttaattgtatttaatttggatttaaatgtaagcagccacatgtggctggtgacctcctccctgggcaatgcagttctagagggggatactgctaaatacatacttctccataaggccttgtttgatttgtagattaacaaatagaatttcttatactttggctgggygtggtggctcacgcctgtattcccatcactttgggaggcggacacgggcggatcacttgaggtcaggagttggagaccagcttgaccaacatggcgaaactctgtctctactaaaaatacaaaaattagccaggcgtgatggtgtgtgcctgtagtcccagctactagggaggttgaggcagaagaattacttgaacctgggaggcagaggtggcagtgagccaagattgcaccactacactccagcctgggtgacagagtgagaccccatctcaaaaaataataataataattttttagaaaagaatttcttatgctttgttgcctcagagtaagagaaggagacaagtctgggatgtaggctacttattttgtgtgtgaataaattgaactcttccatctcctgtgcaggctggagatatggggtttccatcacactgtctggaagaacagccactggtcagatcaaagttgctttgtttggaaataagggaaacactcaccagtacagyatcttcaggtaatttcctattttaacactacgtctcatttgatgatatacacagccttcaaaccacacacttaatttgaacacttatcatctctttatatgtcactggtttttaattatagtcatgcaacatgtaacaacattttagttgatggaccacatacacaacagttgctttataagcttgtaataccatatttttactgtactttttctatgtttgggtgtttagatacacaaatacttaccattgtgttccagttgtctacagaactcaatacagtaacatgtagtacaggtttgtaacctaggagcaataggctgtaccatacagcctaggtatgtagtaggctgtgccatctacgtttgtgtgagtacrtgctatgatgtccacacaatgattaaattacctaaggacacatttctcagaacatatctccattgttaagcaacgcaggactatataactttatgtactgatgttaattgcagacttctgctaataatttttcttttctgttataaacctaggcatttcgtcctttctctctcttttttttttttttttttttttttgagaaagagtctttgctctgtcacccaggctggagtgcagtggcacgatcttggctcattgcaacctccgcctcccgggttcaagaaattctcgtgcctcagcctcccaagtagctgagattacaggcatgtgccaccacacctggctgatttttgtatttttagtagagatggggggcgttttgccatgttggccaggctggtctcgaacttctgacctcaagtgatccacccatctcggcctctcaaagtgctgggattacagacgtgagccaccatgcccggcctctttctcttaatagatgtttttttaaacataaatctaatattacttcagatatgctgttttctgattagtgcaataacacatgcttattgtgccatactatgtggccaatttgttactgtacaaataattcttccaaaacatataaaatgatatgcaggaattctattttattttctattagaaagctttaaggaaaaattaacttgagttttaaaaaccatagtttgaggtgctagcatatagctggcttttccatttctccatcctttatttggaaattaattcggaaaaataatcctgttaatctagaakagaaaacagcagcctggcattgtrtggtaattagaactcatttccgtgaacagggatgtttatgtttctctatttcaagggggattctcaaaccaggctcaacccattcctatgagtttgatgcaaagctggatgttggaacaattgasaaagtcaagtttctttggaataacaatgtgataaatccaaccctccccaaagtgggtgccaccaagatcactgtgcaaaagggagaagagaagacagtgtatgtatctttgctggctggtgcctaaaaatgtttgcagagattcatgttataatgaaaacccaccctagaaagttacgtgtagttaagcaagaaaagccaagaaaatttacccatctgtggccccttctccccaaacaagcaactgacaaacagcataaaatgtttctgttgggtgcaccttattgggtgttctcagcactgcctgtgggaatacagaagataaggctgcactttcaaggtaaaatgagaaaatacaagaaagagaacaagaaatcctttctgaagggtacaagtttataagtatgggctagtgaatagctatacttgaaagaggagaagaccaattacatttcaggataataaaacggaaaataaatcggttttaggaaaagatcgaaaattttacataggacaagaatgcactaggattgcaatacttgtgagatcctgacctgtggtctccctggctttgggcctgaataagcacagggccgtgggtaggaaaaagggacrgctggaggaaagttggagtggtgacctgagagggcagagcgactgtctctcaaacctcagaccccaagtctggctagtagaacatgtggctttgtgggaaggagatcctgggctctcagccaccgatgttcttgaagtttggggttaggtggagtcaccgagttcaggtcccagagattgtcactcccccaggtggggagggtggggtggcagagtagaatgggggctgactccacatctgggtctcctcgaactggatgacttagtgaggttctccttatccccacgaggcaaggagaacaaagaggttggccctgccaggtggtgggtggaaccaggaggcctcataagctagagcatagtacagaggaggctgggccgggctggtcggsagccctgtgcaagctggaggtgcaaccaaatcctttcctccctgaccccatcagaggatactcagcctctaaattcagctccccaaggccccawtagcaagcatcccatggcctggatcctgggactgtgtggttaaaaacatgtcaggtggtggcatcattggaatcttaaaaattagaggtgttcccaggagatgacttgctcacaggtaaggcatacaagtccaaatcagccagggcattgcatcttccaggttttctgaggaaaggctgaggctttctgaactttctgcaaatggaacagaacatacttaaggctgcacctgaggtcctgtgcccatcagctgtcacctgcattccagtggctgagtgcagctcccctcgctgtctgctccagaaagactctttcttaagagcagctggatataagacatcaggttttctaaacagaggaaagtcaaaacagcttcaaatctctcaaactagtttgggaagtaaaaacactgaattagttgaattactcaaacattttcctgttatgaaaatggccagtaacatttaataataataataataataataataatgaagaagctaaagaaaatcaagattttggtccaagctcttctcagaatcccctcatattttttagtaacctcattggggtttcaattcctactaaggaatctgccgactaggattccctccaatgacacagtatccaaagagaaaggcagccctcccccyctttatttctccgtccccctctctttattaagtacctttggtaaatgtacccttgcaaatgactttattmagtacctattgtatggcctggcaaacagtaagggatgcaaacactgagcctacactcaaggagcttacagttcagctgttgagaaaaatcagacttatggttcacagggaaggtcaaaagaccaaataaagaactcccaggagaggctcagaaagacagtggccaaggaggaaagcagagggccgcggggaggctgtgatggaaggaagggcagctctcaggatgaggcagggagtaggagggaggaagggcacaggggcagggcaacaggtccaagtgcatgaggggcgacagggcccaagtgcagggaatatgatcggaggcctccgatgccaagttagggcttcttggcagaaaaaatgaaacacagaagagaargtgggaaggggccaaggaacaccagtgaggaaatggggcaaagcttccgagctcacagstggtgaggcctgagagaagtccgtggttcttgaacaaccacaaaaataactgcttacatctgcattgttttttgttaattgtaagactttttacatttaccatcatgggatgttacgttcttatcatggaattctcaacagtcgtgggagaatgactgagatggaatctcgctctgttgcccaggctagagtacagtggcatgatctcagctccactgcaacctccacctcctgggttcaagagattcttgtgcctcagcctcccaagtagctgggattacaggcatgcaccaccacgccyrgctaatttttgtatttttagtagagacagggtctcaccatgttggccaggctggtctcaaactcccggcctcaagtgatccacctgcctcgacctcccaaaagtgtggggattacaggcatgagccaccacaccaggccttgccttgctcttttgatactgtgtcattggagggaatcctagtgggcaggttgtttagtaggaattaataccccaataaggttattaaaaaatatgaggggattctgagaaaagcttggaccaaaatcttgattttctttagcttcccagttactaactacatccttcctcagagtcctcagataactagccccgaagcactcaaatgtgggagggaaaggtcatgaggaactccagggaggaacgccaggtcccccgactccagagctggaagacaaggtcaaggaaggcttgatgtgtgatcctaccatggaaaatacagcctctggcatcagatggacctgtttttgcatctttgttattctgctgattaatggagcgccctttgtgcctcagtttcctctcctgtaatgtagaactaatcatcagaccccctcacacatgtgtggtgaggatgcagtttgcataagtgaattaagcagcataattggctgcagatgagaagggctcagggcgtgttggccgctgtccccttccgagagtgactggaagacagcatccctctgtaagccaggctgctgggcctatggaggccgccaggcgcctgtggggacaaggaggtgagagtmcctgccttcggaggccaccgtcctgtgtgacactccagaaccatagcagaccttgtcctagagcctccaggcagcaagcgctgtaggcgctggttgcagctccagccctagtgccccctcgtgcctcctgaatcactcatcaactgtgacctgggcttaaccccttaagaaaaaccaaaccaaaccaaaccaaamcaaamcaaamcaaaacacctggcttttgctaaggtgacccaaactcttacaaagcttccttttctccccaggtacaacttctgtagcgaagacacagtgcgggaagacacgcngctcaccctcacgccctgctaagctcccggggcgacgaggctgctgcgttcacactaataaaatccactggtgcatctgtatgctctgggtctatctcctgccgcggccgcctcccggggatacatttgggaatggaacgtttgcaaatgtcccgagcacgtccccatacctgggtttctccccgttaactttgggtcacacggtttccctggctcctgtgcgtaggtcgactgtcttctccgtgcctgagctggtggcgatggactgaactccggagcctcagctcagggataccagcctttagccccgtccctcacttcacagggaggaaactgaggcccagaggagcaggtagctgttcaaactcactgagtgactcgctgtccccgtcaggtcggagggccgggccccggacccctatttcaaggaccctccctgactcaccgagaccaccccgagggatcgcggcaggcccgggaggaccagcctctctgaggaggtagatttgagggtgaggggacccctcgttggccctggctcttggggaggtgcgcagaggcgggcacaggtgcagggcgctcccgggcttccttcccgctcccctgggtcgaggcggcctcgcggccacctaagcacagagcggcgcggaggcggggcccagggcgggccctgctgaaacgggcttttccgtcagccaatcggctggggccccgaggagcctcctccccccccacccgccagtctggcgtccccatgggcccaacccatagagacctgggaggagcgggcgttctttcaggaggcgtttctgccccgcggtgtcccaagtcaccactccccccagggagtctctctgtggttcaccaagccccgcatcctaccccggcagtcctggtgccaacttctttttctcttttttcttttttttttgagacggagtttcgctctgtcgcccaggctggagtgcagtggcgcgattctcggctccctccaagctccgcctcccgggtccacgccattctcctgcctcagcctcccgagtagctgggactacaggcgcccgccaccactcccggctaagtttttttgtatttttagtagagacggggtttcaccgcgttagctaggatggtctcgatctcttgacttcgtgatccgcatgcctcggcctcccaaagtgctgggattacaggcgtgagccaccgcgcccggccaccgacttctgtttctaacctgcgtggccacgtcaagctatcattgaacttaagacttgaatgcgagtgggcttcgattatccctccaaagcagggtcgtggcgaggatcaaaggagcgaccttaggaggggccttacaggacagggtgcaaggcgagtgctcggtaaaccgcggtgatgacgagggtgataaagacggcggcggccagggacacccaccccttgggtggtggcaccaagtgggagacagccaaaccctctggttctctgtcagtttcagcagcatccgcagtgagcccacaccccaggcaaagaactcaatcaatggaacgtagattcgccaaacatttatcaaataccagctctgtacccacccctgtgccaggcattggcaggagaggaaatcagaagacatgctgccctcaggcagtgcttggtgttagggaggctgcccctgaaaaagcactgtgatgctgcctactaggtacaaaaagcaaggtaggtcccaggccagggaatttcagaaggaaggagcaagacaagaaggctccacagagatggtggttacaggaccaggcttgaaggaagatgtcctaccaagaccgcagcctgggaggccagctaggaggaggcggcatctgccaatacccagaattgataaggaccatctgagggtagtgactggaaccaaggtataagggagggggtgtggctggttggccatgggtgagagccctactccctggtcaaggacagtctgtctcaccatgcttcccagactgacagctatgggtgtgatgacttgggaaaaacaattttaaaataggaaggaaactgagaagagagaaactggagagaggaagccagctggggaagctccccagggctgttggccacatccataagcactcggccaaagcactgctctgaaccttggagtgacctgtggtgacctgggtcccagttgcagaggcagagatggttggatctccaggggcaggggaggcagcagatggagacctgagctggaacggggccaggcccctactcactcctcccacattcccttcctggaacctatgtccttttatcagttatgcagctggaaaaatccccaggaaggtaaagaacagcaggttccaagatcaccagtgtgaactttgactactgatcagtgtgggtatctacggtccactttctgatgccactggggagtccaagctcagccccacagatccgtagcccttacaccctgacttgaggagatgtggagtccaggactctctggggtaggcctgccctgtctttatggccctgaccaaatctgatcaggtttctagatttaaggggttgtatgaggccagcttgattggacttttctatttgtgttttaagtaacaaaagtggcacattgttcagaatgcacatggatagagtctttggggcaatgaaaatatgccatactaacattgactttattaacataaagctcagatggacatccagtcttgttggaagcaatgaaaaagggcactgagctagcatttaggattctagtcaagccaggtgaccctggacaaggggtttccacctctctggaccatagctttctcatgggtaaaatgaatgcaacatttgagccctgtctttctcatgttgtcttaagggtctaacttacagggatgtccaaccgtttggcttccctgggccacattggaaggactgtcttgggccacacataaaatacactaacgacagctgatgagctaaaaataaataaataaataaaaataaaagtttaaaaacttgcaaaaaatctcataatgttttaagaaagtttacgaatttgtgttgggctgcattcaaagccaatatgggctgcatgcagcccgtgggccgtgggttgtacaagcttggatcagcatcaccatgggaacgtaaggctctagccttaagtcagtgtgctataaggcgagcaaggccatctaaggagtgtggtcacagtctggctgcacaccccaaagttacccgaaggctgtaggcatgcagagctttggggtccctgctaggtagcaatgcttgttaaggttggctccaagccccccaatccacaccctgcayacaactccaaggtgcacgaagccaaaacacaatcaagacatgccacttgttctccatcctggctgcaaaccagagtcacctgggagttaaaaaaaaaaaaaaaaaaagaaaggaacagagaaatcccaggccccactccaaccaattaaagggtaatcataagccacaggctgctttaaaaagcccacaggtgattcccatgtgcagctaggtgagagtccgccctgatataggagtatttaactcccaggactcctgggcaggctgtctctgagaaattactatgtgtttccattttgatgataatctatttttaccagttataaaaataaatcttcctttttgttgtgataatttgtagcagaacttttgtttcctgagctgaggcttaatagaatgaagtcaataggaatattccagggggtcgtgaaagtttttttttttttttttttttgagatggagtcttgctctgtcacccgggctggagtgcagcagcgcaatctcggctcactgcaagctctgcctcctgggttcataccattctcctgcctcagcctcctgagtagctgggactacaggcgcccgccaccacgcctggttaattttttgtatttttagtagggacggggtttcaccatgttagccaggatggcctcaatctcctgacctcgtgatccacctgcctcggcctcccaaagtgctgggattacaggcatgagccaccacgcccggctttttttttttttttcgagatagagttttgctcttgttgcccaggctagagtgcagtggcacgatctcagctgactgcaacctccgcctcccaggttcaagcgattcttgtgcctcagcctcccgaggagctgggattacaggcacgcaccaccatgcccagctaatttttgtatttttagtagagatgggggttcaccatgttggtcaggctggtcacgaactcctgacctcaggtgatccacccacctcagcctcccaaagtgttgggattacaggcgtaagctactgcacccagcccgtgagagttttttttagaaagaatagagttcacatatttactggcatctgaaaaatcttggagagtatgatctggaactgaaaatgtggaacagatgtccaatgtcacaggctttgcgagcagagagagtttgacctgggacctgaaatgaaggtggaaacgtgctggcaaggagccccaggcaatggaggagaaatgaagctgggagacctgggagttggggtggagatgtggaaacattcctggcatggggaaccccaggggcaaaagctcagaagaggggaaaagcaggttcagaactgtgagtgttgactgtttgtgtccttctatgtaggcagttatcagctgggaaggcatcaagggtgttggcagaaattaggctgggcagaggtcatatgggagctgttagtttgctggggctgccataacaaagaaccacaagctgaggggcttaaataatagaaatgcattgtctccccccagttctggaggctggaagtccaagatgaaggtgtaggcagagttagttccttctgagggctatgagggagaatctgttccaggcttcttccacagcttctgatggtttgctggccactcgttggcaatctctgccttcatgttcacaggatgtatgtgtctctgtgttcaaatttcccctttatataagaatgtcaatcatattgacttagggcttaccctaatgaccccattttaactttattagcactgtaaagatcctatctcctaataaggtcatgttctgaagtactgggggttaggattctaacatatctttttgtggggcctgtattcaacccatatcaatgtccatctgctatggtttaaaagtttgtgtccctccaaaattcacgtcaaaacttaatccccattgtgacagtattaagaggtagggccttttgggaaatgattaaatcatgaaggctccacctttgtgaatgtccttataaaagaggctccagagagctgcctggtccttccatctcatctgccatgagttcatcctttgttgtccccttttaccatatgaggatacagcaagaaggcagcattttggaagctgagagcatcccacatctgacactgaatctgctggtgccttgatcttggacttcccagcctccagaactgtgagaaataaatttctgttctttataaaataccctagtcttgggttttttattatagcagcacaaacggactaaaatatcacccttgcatacctagctttggtgcttggacgccacctaaattcttacccctctccacagagttattctctttaaataaagcccaaattacatgatagctctcctcacctgccttttcttcttagtgcttttgatcatttgtaattatgtatgtatttataggtaaccattgcctgtgccccatgggaccatcagtccatgaaggcagggaaggatgatgttttgctcactgttgtgccttcaaggctggaagagctctagcacattgtagccacgtgaaaatgaatgtgaatgagtgaaccgacatgtgaataatgcatctgaagggaatgaggaaccacccacaggattcaagctgagaaggactttaggaaatgggggaggctgacctggagggagatgcagtggcctagagagaggtgatgctagccccaggaggggaagggcaggggggaatgaagggaggggaccaggcatg

SEQ ID NO: 17798 - DNA, 45555 bp, Homo sapiens
agagatacctcagcagttgggaaggggttctgtggctgctgcatcacaggcacacatgttcacacacatacaccctctacccacacctgccaccttttctgttcccctggcagtctggctgttcctcagccttgtcatgtactgtttcagatccgccaccgtgatgatgctctaccttttgcccacgtggccattgcagtagagggtcctggctgggccagcccggacaatgtggccttgcaagtggccaatgccatcatcggccactatgactgcacttatggtggtggcgtggtgagtgccagcgcgagcatgggacctcgccttcagggaagagagggtgctggggctgtgtgctcctgtgcgtgggggtcacagtgtgcgttgaagacaagagggtgggtgctgaccacctatccccctggcagcacctgtccagcccactggcttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggtaagtggcagcctggtattcctaggtgggatggcggctttaaccagcacagtgggaggctgagagatgacacactggctcagaatgaataccacccacccccccactttaggatgcgcctgtgtaccagtgccacggagagtgaggtggcccggggcaaaaacatcctcagaaatgccctggtatctcatctagatggtgagtcctacagctcagcggggaggggtagagtacatcttgccagcgacagcaccaaggtggccactgctcctaactaaccaaggttagaaaggaaaactttgaagaccacgccatgccccatcaccccacccttggagatgcaggcaggtgtgagacaggtccacagcccatcactgccataataggtgaccatagaagagagggctgtgatctgagtcagcatgaggtcagggaggtccttgtcaacctgaggctggagattgtttgtgtacctgtgggtccaggattgggctgggtggacctctgagccttctctcacccttaaaggcactactcctgtgtgtgaggacatcggacgcagcctcctgacctatggccgccgcatccccctggctgaatgggaaagccggattgcggtaacatggacccctgggagaggttctggagtcttggcctggcagacacctgggaggtgtagggttggggcctggcatagcgcagcctgctcctataggcatccctggtgtcctaggcagctgtcacctgcaggggtagcatagtgggagggcagggcataggtgctgatggctgtggagatgggcggggcccatggaggtctatagcagggatcccttctgcctttcctcttttgggctggggacagctgcatgctgcctgtgggagatctctgctagttggatgatgctgactggctgaggtggtggccaggtgcccgttagccagtatgccctctgcctcaccctgcaggaggtggatgccagtgtggtacgtgagatctgctccaagtacatctatgaccagtgcccagcagtggctggatatggtaagtggcctagggggtctgctctttgtttatttcctcaggccgttctcttggcctccccttccacctctgctcccgcactgctgctcagcttacagagcagccagttaaggccccaagcagctctccccagtcccctggctgccagggagttcttgctcagaaaacctgtcccagcagttccttgactgcctgccaaggtgccttcatcaataccctgcacccgtcaggtaacgggcacctccatgtggggtggggcttcaagggccagaacatgaagggacaggctcagcacccctgggggaatgttctctcctctctttccactcaaagcctgtcttgtgctgctctgggcagcatctccgagctgggtgcggcacagggccaggtgtccctgtgcaggccaggtaccccaccctgacgctccaccctatccccacaggccccattgagcagctcccagactacaaccggatccgtagcggcatgttctggctgcgcttytaggcgggaagyctatgtaagcaagagggcagggccggggtttgtggtccccccycmaccacaaacacagcacttcggctcctctaacctgtgccacaggtgaccaccaataaaatcctctgctgagaagtgtgtcatccctcttttggcattggcatggagtccatggggcagtagatggggagcaaggacttccctctagttctgtggctcctggatcctcctgccttcccacaggctgatgtgtcctcagccaggggcaagcgtgggggttgcagctgaggccggaagtctttgatgcctacagggagctgagcccagatgtttccactcagccacttaggggagttcctcagccagctggtcccaagattgggctgtgggagtccataggaagtgtaaacccagcctttgcccctgtaggagtcccagcctggaatccctgcaggctcaggtgggaaacccctcactgtggaccttgtgccaagtcaccccctggtggtccctggtggaccagaaggggccaaggggtgtctccaaggatgcctcttgtgtgtgtttactctgcattctgggaggaggatagcctggggcatagtgttctcatttggtttctaactgctgcctggacaagcagggcaggaatcctttgcctccgctgactcaggctccaagaatagccctgagctcagtggggcccgagccccctccctctactacatttgtcccaggcaagtccagagctgctggcctgacaatcccctccccattttcctgaggcagccaggacctggtacagctcttagctacctagtccctctgttatctcttttggctctggtccccatggtgggtgcgcaggtaggctgctcctcctgcaccccccagtgcttccacagtcaggttctctgggatcccagggggaagttgaaagcgaggggcccaattttcctttgaggaagtcgctgcctggcagtcacaagcagggtgctgggacaaggtcttttagaagatggctgttcagaagtccccccagcatcgtagcttggaagtagcccaaggaacccttgtatcactatcaccctgccccactgcctttccctcaccattggttgccatacgttgccaattcggagacatttgttaagcaccttctacggcccgggactggggcattgcgcagatcattctactttgtgaacggctggagagaagatgctgggcagcgcagaaccctgacaggcccaaccctgggtgctcatggaggtgcaacacccaggcaggggaacaagtgccaagtctgttgtcaagtttgagctcctggaggatggggcttcatttctaagcccagcctggcccttagaggctacaggtgtgctggacacgagagcttgagttgctgggagtggtctggttctaagggaccttgcgtaccaagccagggactctggtctttaccctggagccatgctggggaggtgtgttggaggttactgtgaagagaagtgacttggtcagagttgagattcagcatggggactctcaggccatatttctgtatcagtcttggtgagctgtgctgtggcagaacagaggtcatggccacacgaactggagccagctgtaggggacacaaagaggactacattcccagcagggctgggagacgcggaggcacgagtgggttggaggagggtaatcttccatagtccagtgaggagtttggtggtgtccagggtacagtgggatgtgtggggctgggacctgataaagaggccctggttggaaacagatggggtgaggtagtgactgaggccagggaaggaaatgttcagggaaagcttgggagggagaaggatgtgctctgggggctccaccgccctgatggggttgcaggtaggcactggcctcgggctgtgccctaggctgtgttcctcccaggaggccagagctggggcttcagagggccacactcctgctcgtgagtctcatagaagctccagacgtggagtcattccaaccttactcctaccttctcaacagcctctcccagcaccctttgagagaccctctcacagcagcctgtcctttcttttggaggcacctcaattctgatgaggtttgcctgagcacccaccctcccagctgggcctcctgtctcccctaagactggcccacgtgtgcacatatgtctgtaccgtactgtccatgccactggcctgctcttgcccgccctggctgcacgggaggaggtgacagtcttagggggaaggggctgcctgtgtgataacatacctggttctctgcagccccccacctggagcacaccttgcagggatggggggtcctgggacatggctgaggagaccctgaccttggaataaggtcatagcactatgccccaggatagtttggggggtcagtaataagggatagagccccagccttccttgggcaataggaaagcaggcagcatggatggtcttcactgcctccagctctggccacaccagagtcctcgggctgtggaggagtccagccagtgctgtccccatatctccctgtggatcccaggggaggctgtggggccgggcatattagaaggggcccagcagccttggtgagtatagatgtgctttctgggctgcccagagttattcaggattagcaggaaaaaaagggggagcaggacccagatgggggcctgcccttcttagcagtgcctctctgccttagtgtcacccatctaatggagagatatgcatatacagagccccacctccttcggacagtggccctggcgtggtgtgtgttggaggactgtccacagcctcagaagcgaagctgggggagggtgtgaagtcagcctgggtaaggggacaggagtaaggtagggggcagttatgaagctggaagctacaggtaccatgagggcagtgaggaaaggaggaaggggcccaaggggacctcggcctggtaggggagatgggtggcagggacctacaagaaaagtagatggaaggagaggatgcctgtgggtgaggacatgtaggtagggggacctggcctggggcatggagggctcgattcctgagagatgagctgtcactgtgggtggtcccgccctccacagatgggcggccccctccctgcaggcacagctggattgcatctgcctgtgacatggtaggggatgtgggacactgggatgtatgcataagcatgacacaggttctctcctccttccggcttatcccctacaaagagggggtgagttacttggatccaggccaaggggaccttggtttccctaagaccggcccagagtcactcatttgccagggcttcttgcctgtcaaggagatccgggtggggcccaggaggcccaccagacagatggctgaatcacaggagtggccggcgggacccatggcctgagggcttgtctgggcacccccactggattgggggtgagtcatccccaactgcagccccaccccccacggcgctgctgccttgtggctctgcaggaacctgtccactcctcagcctggtcactgtgattgacctaaagcagccaagacctgtgaccttagatggagttaggggtactccctcagcatctgcccatgcagaaccttctgggaaattcccagaagccacggggggtcggggggtttatagttaagtgcgtcatatcgtttgtctgggggaggggtggggggggcggcgacctctcagggatatgggtgagggcgggtgcctgggttcccgcctgccgctccgccccccgagatcagggacttttctctgctctgcccgagagactgcagcggcggcggcgggagcgggcggacgcgcaggcaagaccaggactcgggctggaggggcgctgggctcggacctgccaaggccacgggggwgcaagggacagaggcgggggtcctagctgacggcttttactgcctaggatgacgctgcggcttctggtggccgcgctctgcgccgggatcctggcagaggcsccccgagtgcgagcccagcacagggagagaggtgggcaccgcaagggaggacccggcccggggcactgcaccgtgccaccctccgctccactcggccttcatccccaacaccccccgcccacaacccagccaactccacgacgccccgcggattcctcctaattctgggactccccgaaccctccgcgatcggtgctgggttccctaaaccgcctcctatcctgttcctacccaaattctggctccctggatgcgtgcggggtcccctgccttatgccaatccacgccggcccctagaggctgacctcagtcccaagtccacacccgtgctggcgactctccctcccccgcacacccccaaccctccgcgggagtctgctctgggacccaccgagctcaactccctccaaggccctcaggctcaggccgattcggccctggtttgcataagatgaggcctactctccccaccatcccaagtcccagtgaggccaccgtgcgggtaggcgggtggttggcctcccagaagaggccctgatctctcctgcccgccccagtgacctgcacgcgcctttacgccgctgacattgtgttcttactggatggctcctcatccattggccgcagcaatttccgcgaggtccgcagctttctcgaagggctggtgctgcctttctctggagcagccagtgcacagggtgtgcgctttgccacagtgcagtacagcgatgacccacggtgagtaggggccctgggggctggggaccacgagatccccaccaagactccttccccagagagggaggagaccctggaaaccccaggccaggtctttgcagaaacaagttttggggaacctagagaccccctagccaggacctcctttggagacagaggtaaggattccctaggtagaaccttcgtgccctgaggcacctccaggctactgcaagacaggaaggtgcaagacagtgaggctgtgttttctgatctggagatggggagcccaggagggggcccccacgcctgttggattctccacgttctagccctctaacccttgcagccgttcaccagaggtgctccatctggccagcatccactttcctacatctggacccctcctcctgcaattatttaattaagcagcatcttgttccccacagactgtgagcccctaagggctccttcaggtctgcccaggcccacctgcagatggtgcacaaaggagcccctggggagtttgttaacctgggggttccagaggcaagtgggtgtggagaatgacagaacgaagggacccctcaagagagcctgatacccgtaaccctcaccctagaggcctcctcaaggccagggccagaagagatcctgagtcctagcctgttgccacccctaccctccaacaggacagagttcggcctggatgcacttggctctgggggtgatgtgatccgcgccatccgtgagcttagctacaaggggggcaacactcgcacaggggctgcaattctccatgtggctgaccatgtcttcctgccccagctggcccgacctggtgtccccaaggtgatccctacccctaccatgcctcccaagatgaccccaaatgaagtgtccaggggaaccgtgatttgacccctgcacctgtcccaggtctgcatcctgatcacagacgggaagtcccaggacctggtggacacagctgcccaaaggctgaaggggcagggggtcaagctatttgctgtgggtaaggaccgagcaggagtgacaggtcagctggggggtgggggcagtcagagagcatgtgggtgactgagtcctgatgggtcgtcacttcagggatcaagaatgctgaccctgaggagctgaagcgagttgcctcacagcccaccagtgacttcttcttcttcgtcaatgacttcagcatcttgaggacactactgcccctcgtttcccggagagtgtgcacgactgctggtggcgtgcctgtgacccgacctcgtgagttcctgcccacacggtgtaccctgacctagaccccggaccccaatccccmcttggcagtgctgattccatcctatgtgctcctgaccccgaccccaacyctgcatcatacatgcccaccccaatcctcctgcctgatcccctgatcccgcattcccagcggatgactcgacctctgctccacgagacctggtgctgtctgagccaagcagccaatccttgagagtayagtggacagcggccagtggccctgtgactggctacaaggtccagtacactcctctgacggggctgggacagccactgccgagtgagcggyaggaggtaggatgtcaggagtgataggtggtggctggggacttggctgggcaagataaagtgacctcttgccctgggcaggtgaacgtcccagctggtgagaccagtgtgcggctgcggggtctccggccactgaccgagtaccaagtgactgtgattgccctctamgccaacagcatcggggaggctgtgagcgggacagctcggaccagtgagcaattctgccagcctctgaccccattcacctaacccccgaccccagtaccccctcccacttctgactccatgaatccctggtgggactctcccccagctgccctagaagggccggaactgaccatccagaataccacagcccacagcctcctggtggcctggcggagtgtgccaggtgccactggctaccgtgtgacatggcgggtcctcagtggtgagtgagagatgtgggctgaggggagtccccgcgcctcagacaaggctgtagagtcctgagtctgcaaggcccactggccccttggtgtcccccatgcaggtgggcccacacagcagcaggagctgggccctgggcagggttcagtgttgctgcgtgacttggagcctggcacggactatgaggtgaccgtgagcaccctatttggccgcagtgtggggcccgccacttccctgatggctcgcactggtgagaaggctgggcactttcttcaggctgggacgggcaggcagggcaaggcccggaggccactgacatcccatgtgccctgggcagacgcttctgttgagcagaccctgcgcccggtcatcctgggccccacatccatcctcctttcctggaacttggtgcctgaggcccgtggctaccggttggaatggcggcgtgagactggtcagtgcgggggaaggratggacaggcaagggtcagggcatggcctctgytggtctgaccctgttatcttgcaggcttggagccaccgcagaaggtggtactgccctctgatgtgacccgctaccagttggatgggctgcagccgggcactgagtaccgcctcacactctacactctgctggagggccacgaggtggccacccctgcaaccgtggttcccactggtgagggctctgtgggctgggccagtgagtgggggaggtgtcggagccccaggctgcctctatgctgtgctctccaacaggaccagagctgcctgtgagccctgtaacagacctgcaagccaccgagctgcccgggcagcgggtgygagtgtcctggagcccagtccctggtgccacccagtaccgcatcattgtgcgcagcacccagggtgaggtggacgcagccagcacccccaccacacacactgaagttccagcctgaggggtctgagtgtacctccagcsctctccttccacacctgggtccctatagtctcctccctgtctcgttatccatctgcttcccaagatggcactgagccctgaactgtcaacagggtgtgtctgcccctaccctaccccaaccaatctcctccctgccccacaccccatccacggctttcacctctgcacagccacaagctcaatcacctgtctttctgttaccctagtggtgaccactgtacaccaacctctcattgcatgtccccatccagcactgacctctgccatcccacatcagtgtctgtcaatggctcatcagttctcactgcagtccactgactcctgtcatcctacatgctaagatcccacagactcctgtcctccagtgtccctgaccatcactggcccctttcatcctatgtccttgtcttgcactsacttttttcagccatatcccagctctctggtccccaccaccccacatcccmmcccccmwggcccttctcactctgcgtccctgtccatcactgccatcgtcccacatccctgtctctttctgacccctgcccacctaccctgacttctctcttaggggtkgagcggaccctggtgcttcctgggagtcagacagcattcgacttggatgacgttcaggctgggcttagctacactgtgcgggtgtctgctygagtgggtccccgtgagggcagtgccagtgtcctcactgtccgccggggtgagtactgcaggaggcttgtggaggacagctgcctgcctcactctggtcctggttctgacttctgacttctgtctgtaactcctagagcyggaaactccacttgctgttccagggctgcgggttgtggtgtcagatgcaacgcgagtgagggtggcctggggacccgtccctggagccagtggatttcggattagctggagcacaggcagtggtcagtgtggggtgtgtggggggactgccaaagggaccaatgagggtatgggtgccagaggggacaggcaggagccatgccagcatttccctctgacctcaggtccggagtccagccagacactgcccccagactctactgccacagacatcacagggctgcagcctggaaccacctaccaggtggctgtgtcggtactgygaggcagagaggagggccctgctgcagtcatcgtggctygaacgggtcaggccctgcccccgtcccttggctctctgcctccattgctctttcagacccccatgccttcccttgcagacccttgcttctccccagaactcctgcctcccccttcagaatcccactccctcctccctcagagacgctgcttcctcttcagtttcagctgtctccccttaagccctccccgtattcagattcctccgcttctctcctaagactcccacagcctttgccctcaaatatccaccacttcaaccctcagacccccatcccttttttgctggacccaaatctcctctgagatttacactttctcctccatcagacctgctcactgcttcctaaaacctccacctccccactcctccactggacctattcaccatctcctctatcaaattcccgtctcctgttagactcccatcatcttcccctatcagatagccccactccttcctgcctgttccagcagactccccattgcctctccccactagacccactgggcccagtgaggacggtccatgtgactcaggccagcagctcatctgtcaccattacctggaccagggttcctggcgccacaggatacagggtttcctggcactcagcccacggtggggactggggtttgggagggggcaggtcagggtggaatgggggctgggggtttattgggggtycaggtggggctctggggcacagagtttgctagccctggagctgcctccatccctgttcccaggcccagagaaatcccagttggtttctggggaggccacggtggctgagctggatggactggagccagatactgagtatacggtgcatgtgagggcccatgtggctggcgtggatgggccccctgcctctgtggttgtgaggactggtgagtggaccctggccagctactagccacaccgcattagctaccctgccctgctgtgtgttcctgattgcccagctgcctccacccccctgctcagtgactgtcctgtccacactgacccaccccacactgattaagtgtccacccacggtgacctcctggtggccccacactgcccaccccaaggcactgacctcctcctcctcagggctgcctaaagtgacctgtccacactaacctcacactgactttcagatcacccctgcgtcaaccattcctgcactgcctctctgttctctaccaggaccccttaccttgcctctgtccccagcccctgagcctgtgggtcgtgtgtcgaggctgcagatcctcaatgcttccagcgacgttctacggatcacctrrgtaggggtcactggagccacagcttacagactggcctggggccggagtgaaggtatggctccctgacgccacccctgtccttcctggctgggactgctcacccctaaccattgctgtatgcccacctggccaggcggccccatgaggcaccagatactcccaggaaacacagactctgcagagatccggggtctcgaaggtggagtcagctactcagtgcgagtgactgcacttgtcggggaccgcgagggcacacctgtctccattgttgtcactacgcgtaggcagagcatgcgctggagagcttyggatgggtggtgtggatggtttggggatccgggcttgtgctctggattggagaaaggaccaggattggtagtgagcctttgggggcagggtctgagaggagggagaggggtctgagaggctgggcggggtgcgtgtgccagggtgggcctgggattggtgcaggggccatgggggcagagcctccctgattcctgagctttctctccagcgcctgaggctccgccagccctggggacgcttcacgtggtgcagcgcggggagcactcgctgaggctgcgctgggagccggtgcccagagmgcagggcttccttctgcactggcaacctgagggtgagaggtgtccccaggaggaagttagggaccaktgggggcagggctgtggcagactccgcaaggtaggcgaggacagtgatggtgggcggggtctgtcactgggggtctgcgggatccgtgacagtaggtaagatcaatcaatgaagtgggtgggatcaatgagttcatggagggtcagtctggcagggtccgtaaagtgggcagggtcagtgaggatgaggaagatcagtcaggagggtgaacccagttaacagagccagtgaagtgggcaggccctttaatgcccccaggtgtcactatcccacatgctcttggcccccaccctcacgcctgccccaggtggccaggaacagtcccgggtcctggggcccgagctcagcagctatcacctggacgggctggagccagcgacacagtaccgcgtgaggctgagtgtcctarggccrgctggagaagggccctctgcagaggtgactgcgcgcactggtaagcctgcctcaccttggcgtgctcctcccctgctgatgacccaccctgacttcctgcaccccgactctgagtgactcctcctgtacccctacccctcaccctctgaccctgggtgaccccagcatgacctcccatgatgcttcaataagacaaaccggacccaggatctcagatctctcccttctgggttctcaggactcagcctctgatcctcgatctttcattcctccttcagagtcacctcgtgttccaagcattgaactacgtgtggtggacacctcgatcgactcggtgactttggcctggactccagtgtccagggcatccagctacatcctatcctggcggccactcagaggccctggccagggtgagggggaggccaggatttgggtgggctggcagttggggctctgtggagacagctttttaatcaagttctgtctcctgcagaagtgcctgggtccccgcagacacttccagggatctcaagctcccagcgggtgacagggctagagcctggcgtctcttacatcttctccctgacgcctgtcctggatggtgtgcggggtcctgaggcatctgtcacacagacgccaggtatagtgggcrtagtgggaagggcagaaaggtgtgtctgggtgggctgcccgcttcagtaacttgttccccttcctacagtgtgcccccgtggcctggcggatgtggtgttcctaccacatgccactcaagacaatgctcaccgtgcggaggctacgaggagggtcctggagcgtctggtgttggcacttgggcctcttgggccacaggcagttcaggtttggccctggggcagccagattctacctctccctgaggccccccacccaggctccataccagttaccatctcctgaccacccaataggttcaggcattctcccagctctctcacaggctccagacctcacctactgcctggctccctatcctgccatcactgctgactccctaatagatagggtttggtcacacacaccctgatgtgtttctccaggctctgtgcacccccatccctgctctgtcatcctcctcaggctctgtgtttccttccaccccaggttggcctgctgtcttacagtcatcggccytccccactgttcccactgaatggctcccatgaccttggcattatcttgcaaargatccgtgacatgccctacatggacccaagtgggaacaacctgggtgaggactgcagcaggcatggactcctggggctatccactgggagcttggtgccccagggttctgacatgtccttccttccaggcacagccgtggtcacagctcacagatacatgttggcaccagatgctcctgggcgccgccagcacgtaccaggggtgatggttctgctagtggatgaacccttgagaggtgacatattcagccccatccgtgaggcccaggcttctggtaaggagtaggctgatggggaaggggtctgggaataggggtggccctgaaaaggctatcatgcagccactggaccccaccttagggcttaatgtggtgatgttgggaatggctggagcggacccagagcagctgcgtcgcttggcgccgggtatggactctgtcyagaccttcttcgccgtggatgatgggccaagcctggaccaggcagtcagtggtctggccacagccctgtgtcaggcatccttcactactcaggtttggaagaggcctctgggggactgggtggtagaatataaggggtctgggggttcttggtagaaatgttcaacctcaaagagaccctatgtccgcagccccggccagagccctgcccagtgtattgtccaaaggtaagagtccctcatcgagaggtgaacagaggctgcacctggggctagccactctgacccacatctgacatgtctttccccagggccagaagggggaacctggagagatggtgagtgcccctgcgggcggggaatagagaatgggttgagtgtcagtggggcaggagaggttggcagcacaggtctcactgattacccttcctagggcctgagaggacaagttgggcctcctggcgaccctggcctccyggtgagtgtcccccacatctgtccctgcaccctgactggcttatccccacctaactgctatcttctttcagggcaggaccggtgctcccggcccccaggggccccctggaagtgccactgccaagggcgagagggtgagtgtggagaccatcgaggtttctctgaggcactcctcaaagctgtctcggggtttttacaagagagaaggaagaagcagagttagaatcatcgggaattcctagaagcccagctggaggttataaaccaccacagagactttgggggacactctgaaatagaagggccagtggggcctctagccccgctgcagagcctgagcagcagctccaagtcccagaggcagggaagccctctgccttgtcgctgcccttgtgcctggaattgggctctgtgaagctctgaggggccatttctctgcctcactgttccacccccaataacacttgggggtcagtggggtaggcgaccccttgttgatggggtgaggcccctccagcaaaccaggggccttgggggagggtcccttcctgtcctgacctcttcacctcctcagggcttccctggagcagatgggcgtccaggcagccctggccgcgccgggaatcctgggacccctggagcccctggcctaaaggtgagcaagcyttgtcctgcaggtcagggtgggcgctgcctgagtgggtggggtggctccgactgttctgcctctggcctccatttgcagggctctccagggttgcctggccctcgtggggacccggtaaggtgccttcccttctttgctctctaagtgtcttcccagggttcttccacagggtgggagcctggggtggtggtgcagtgcccacgttgacattcgcctgagcccaagcaccaccctctscyctgtttcgtcctcagggagagcgaggacctygaggcccaaagggggagccggtaggtgaagggggaagggaggcggccgggatgtcccagggaggagcaggactgccccacaccagaccctgtgcagggcctaaggcgcgaataggaatagctggacatgtctaggggcttcttccagctcaaggcccccatagcctgaatcctgcccactgctctctgtccttacagggggctcccggacaagtcatcggaggtgaaggacctgggcttcctgggcggaaaggggaccctggaccatcggtaagtgcagggtatgtggaggcaagtgatgtgtagtggggggaccaacacsaggggggcgagagtgaggtctgtggggttgcaccttatactttgtctcctccatcagggcccccctggacctcgtggaccactgggggacccaggaccccgtggccccccagggcttcctggaacagccatgaaggtgacagcctcatgagtgccatgtgatgcrgagacctggtgaccccatttgaacccacataacccctgccagttactctggcccttgtgaccctttgattacccccatcctcaccatgacgcctcagttctcccaaartccttgaaatccaattggaccccatgaccctcatcactyctggtatctttgggagtgaggygtggcccagggtcatggggtcgtcatctgttttctagggtgacaaaggcgatcgtggggagcgggtaagtgagggacaggttgtgctaggggtggcttggagtctgattcccctgttcattccctgacctgctgttctctcccagggtccccctggaccaggtgaaggtggcattgctcctggggagcctgggctgccggtgaggggccttgaggctctgctgggggccctgctcaggggtgtgggtctctcctggggcagtggttgggtgctgggcttcatagttcttggctcatatttttactcacttmttcctagggtcttcccggaagccctggaccccaaggccccgttggcccccctggaaagaaaggagaaaaagtaggaaggctgacttgatgatgtcccagttctggggtgggaggctgcgtgctgggggcagggcctcccttcggtcttcccacccgtgtgtttctccttcagggtgactctgaggatggagctccaggcctcccaggacaacctgggtctccgggtgagcaggtgagtggaggggccagggattctgaatatggtgggcacagctccagcccctacctcaatcatcaaccactgctccatcctcatgcccaaacccaaatctctgaacccccaaattcatcccttccagggcccacggggacctcctggagctattggccccaaagtgagtaccagttgggggattcaggtgtgaggggtgctactctgggctccccatggtgttaggggaggctggaagataaggagataagagttccctccaggtcagaggtcgyggttttggagggggtggttggagttwgggaccccttgtctggggtttgacgttcaagccccsccaccaaccctctctctctctgtmtttctctcaccctctctcttcagggtgaccggggctttccagggcccctgggtgaggctggagagaaggtaagtgcaacctggggggtgccaagggccctggaggatctgggcccaactcagctctgacctcttcttttccatcagggcgaacgtggacccccaggcccagcgggatcccgggtaaacccactggctgcaatgctcataccagctgacctggctgtgccctttctggttctgacttcttgcccttgacccctgctacccctgctcctcacccctcctcaatgaccacttatccctgctgatacaggctctaaccctcagccccagggacctggctttgaacctctgaccctgctgaactgaccttgattttcactgacctggtctctgttctcctgccaagtcttacccctgccaacctaaatcccaatcttccctgacccctctccagcccccaccccagcctctagccctgtctgtccatatcccccgtccccacccacctgcacagctcttcccttcctctcctccaggggctgccaggggttgctggacgtcctggagccaagggtcctgaagtgagtctgtgactgtggtgggaccaggagtgggacttttgtgtgtccctcccctttcccttcccctcctgggctcacactttctctacattcaggggccaccaggacccactggccgccaaggagagaaggtgggtcctcggctgggggtggcactgtctggtactagggatgtggcagatgggacactgggattttgggctcctaggtgactccctgacctgtccctgctcctatcctctctccacagggggagcctggtcgccctggggaccctgcagtggtggtgagtgacgggaggatggcgctctgagcacagcacagcccttgagcagtgaccctcctatagaacactatctgggctgtgattccacagtgctgggcccgtgagcaggyygggagctctgcggctctccttctgctagaacctgcccccagactcttggctatgatcctgtgaccccaagaccgccatgcaggtcatgagctctttgtgtcagtccattttgtataaccccttccctgctgtcagcggtgactctgtgacttctgggmggggactgagctgtatgacttccaattccatgtgacctccattccaatgaagactttgrtcatacaaccccaaggcagskccaagctgtatctgtcctgtttgttttcagggacctgctgttgctggacccaaaggagaaaaggtaagcctggtatggggcaaggggaggtttctacagggttgaggtctaggtcatagggcctatctatgggacttggggggtcacaggacttgctgggycagggggttaactggagcctgggactagcactgatggtctttgtcacctccagggagatgtggggcccgctgggcccagaggagctaccggagtccaaggggaacgggtaagtgaagcgaagtgtttagggggcagttggtgaaggttgtcttcctgacttcttatccttccatccacagggcccacccggcttggttcttcctggagaccctggccccaagggagaccctggagaccgggtgaatcaatgtgggaatggggagtgtgacagagggagatgaggtggtgggaccctgactaagtcctgccccccttctgtccccttcagggtcccattggccttactggcagagcaggacccccagtgagtacccgttaccctgggcaacctcaaggcttctggggtcccctccccttgagaactgcttgcttcgagygtcctgcatcacctccctcttgcctcctccacagggtgactcagggcctcctggagagaagggagaccctgggcggcctggccccccaggacctgttggccccygaggaygagatgtaagaggctggagtcgggggagtcayggcgggtaagggagtagggctrttgccagcatcatgggggttcttggaaccagggctgactctcatgtttcacagggtgaagttggagagaaaggtgacgagggtcctccggtgagactccttcccactgtggtttctgatcctttacccttgaactaggatcccagtaggctggtgctccaccagttcatccatccactccctgcctcctgtccagctgctgctcagacccttctctgtcccctctccctgagtgagttagakcctgactgccctgtgcagtatgacttttctctctatcaccagggtgacccgggtttgcctggaaaagcaggcgagcgtggccttcgggtgagtcttggcagagagaagtaacaggggtgatgggaggtgggcatgaaggtgataggaaaggctgaggggggtaaggggtgatgggagtccctgcagggaggcatggggtgatgggaacctctgatgtggattttggagtaatggggaacctggggcagtgtagcgggtcataggggcacctgcaaaatattgggagggtctgtctcaggccagctgctcttcttagggggcacctgsagttcgggggcctgtgggtgaaaagggagaccagggagatcctggagaggatggacgaaatgtgagtcccagcctatgactcctcaccccaaccttaaccctccaaccagscaattcccaatacctgatcctaccccccaaccctgtaatgctaaaccctcccaatcttcacttcctttgacccctgcacacacgcatctgaaggctaccaacattcccatgagtcctcatggtgcttccaaagctctcccaaactgctgcctaccttgagtggccctgacccctgcctttctgcagggcagccctggatcatctggacccaagggtgaccgtggggagccggtgagtagggctggtgtcctgggctcagaagggatggagggtcccctggcgctgctgccagtgtgccttcacacaaggggtctggaggtccaggtgggaagcatggatggccacccatgcctgytgggggctggcattggggtgcttcggggaacttgggggcagagttgagcctggggcaaaccagagccatggcctgggacctgagggctcctattgactataatcatttcctttcccagggtcccccagracccccgggacggctggtaagggctgcgctgggtctggtcctctgtcattgttctcacttgcccctttggctccacatcatgtcccctcattccttccactaactcccacttcccccactgtccctctgaaacctccgcggatccctggagcccctcacagaccctgtatcccctcgccaactcctcttccccttgttgagccattcttctcactggtcattccccccacaggtagacacaggacctggagccagagagaaggtatyagggtctgtgggtggagggtaagaaagaccccagtgcccctcccagcaggttctaccttgggcatggcttggcttcaaggmtgttcctcagcaagcttatctctgccacagggagagcctggggaccgcggacaagagggtcctcgagggcccaagggtgatcctggcctccctggagcccctggggaaagggtgagtgtgattggtcctygggggtgcaggcatgggagggcctgctctgatttcttcctcccctatcctcagggcattgaagggtttcggggacccccaggcccacaggtgagtgatgcactttgccccgtctgccaagtccccatcttaccctcacctcttatctgaccctgttccctccagggggacccaggtgtccgaggcccagcaggagaaaaggtgagagggtgtgggggtttctcaggacrtgagcctgggttatcagatccacctcagccttggtggcctcttaccactctattttccacagggtgacyggggtccccctrggctggatggccggagcggactggatgggaaaccaggagccgctgrgccctctgggccgaatgtgagtcttggtagtcctgcctggttgtccccttcccctaccccttcacatgaggaccctagaccccagcctcattggttggtcttggccttgacgagctctggggcgagacctgttgtctgtgtcttctcccagagcyctgcctgggtggggcatgttcttgccatgcaggccttaggctcacagggactagagcccctgaccccatgaccatgatgaactgactttgagtctctcctcagggtgctgcaggcaaagctggggacccagggagagacgtaagtgaggggagatgctgggacagagggggctcggggctgcgtaagctccaaccagatyatcatagtcacagcatccgagagagttggtggggggtcggttcagccttgcctttgggagggtctcagtccctggcacacaggttttagtagaatccccctttctgaccttctttgccttgggggtcttcataggccctccaagtcctgggggttcttcccttgggagtctcagcaggggcccccatccatggggtctgtgcctgagggatctcaatgggacctctcagtcctgggggtctctaccctggagggagatctttttggggtcctcttagtccwwggggtgtgccccaagggatatctcagaggccctataaatcttaacaaagactttttccaggggcttccasgcctccgtrgagaacarggcctccctggcccctctggtccccctggattaccggtgagaccagactttcatgttacccccttttcccccttactacsctcacccgatccccgacatccaaccagtgatctgttcccacagggaaagccaggcgaggatggsaaacctggcctgaatggaaaaaacgtgagtgtgtccagggcagctgcggcgaaacctgccaagaaacgccagcacacctacacagccaagatctgtagcaacacatgaggcacacgtgtagacacatgcatcctggcccagacatacagatgcatccagaaacatagtttttttttttttgagatggagtttcgctcttgttgcccaggttggagtgcagtggcacaatctcagctcactgcaaccttcgactctcgggttcaagtgattctcctgcctcaacctcccgagtaactgggattacaggcatgcgccaccatgcctggctaattttgtatttttagtagagatggggtttctccatgttagtcaggctgatcacaaactgacctcaggtgatccgcccgcctcggcctcctaaagtgctgggattacaggcgtgagccattgcgccaggcctggaaacatagttctatatgcacacacaggcagcctcacagacacatagggagttaggtgaatgggccaatttatgccaggatgggctgacacatgcccagataacccacagccataggcacaggtgaagagccacagacaggtcgacaggcacaaacacactggtgtgtagccacatttggggcacttagagacatgttgatacccagacacttccacccagactcatgtgctaagacatggacccaakaccgcatgtggacctgtgttgagacatggtgagacacacatggatggctctgacctgtgacatgtgctaggacatgctggcccatgactttatatggtcacccacacgcttatggtcatacacattgagctacacacaagagttgcagacagatgccaakacacatggctctcaaggcatgtataagcccatgctctttggagacatgtataagcccatgcccatatgcagacatgggccaagatgtgcaaacagaccaggacacacagacccatgggtacatgtactaagacacacatggatatgcacacacccaggacatgtggacgatcaccaacccagagatgcataaatgtggagctacctctagagagccagagtcaaaggacatgtgtgcagttgcctgttggggtgagcaggcctatgcaggcacacccttagacatgtagcagctcactcagacggccacaggccatgctccaagacacacacaaccatggagctacaggcacagaaatacagtcacagtcatctgaaatctagcaaggtagtgtcttgcagccagacaccagtgaatgtttgggctgatgtgagtcctctgcccacagggagaacctggggaccctggagaagacgggaggaaggtaaagtcccccacctgggkyctctctggtctctgcttggagccatgcctgaagcatccttgtcttccttagggagagaaaggagattcaggcgcctctgggagagaagtgastattggasttttctgcaacctctgacccctgaccctgaccctgggggaatatgactccactcttttctgaggtctcagggtgctgatgctggctgcatccttcacagggtcgtgatggccccaagggtgagcgtggagctcctggtatccttggaccccaggggcctccaggcctcccagggccagtgggccctcctggccaggtgagtgtcctgggtcattctgggacttcagagcattagaagccatgatgtttcaatgggcaaccctcctgggaagccatgggcctttgtgacccctttgtgttctgcygtatctcagggttttcctggtgtcccaggaggcacgggccccaaggtgagtgcggatgttgggtagggggcgtggtgagggggctgaccaggctgggggccatttccccacctggtcattcttgttttcagggtgaccgtggggagactggatccaaaggggagcaggtgaggcccccaccttttccacatgcccaggtagccacagcacccacatgtgcacatgcacacccataggctggttcctagcagtttgtcttcatctctccagggcctccctggagagcgtggcctgcgaggagagcctggaagtgtgccggtgagccaggcttgggatgtccccttgactctgttttgcatgcccattggggccaccttgccatccccttccccttgccatgaggctccataggttctgtgctgtgtgttcagtgccctgccccattggggttcttgtagcccacactcaagggaacttgggcagtggggacacaccagaaaggggctcccaggagtctccagccatgcctcaaccaagtgctaaagggtgctctgggcaagaggcctarggaaaagggtstsaaggtgctttcctgaggccgtgyggggcagaaggcaggagcttctctgtcatgggcagcccttcacccagactttgtccccagaatgtggatcggttgctggaaactgctggcatcaaggtgggttgtttaggggctgggggtagggacaagtgggggcccttggggctagtggtgcccacaggcrtaggggctgcggcgacrcaccccgctcctctgacctcttgctgtccctcaggcatctgccctgcgggagatcgtggagacctgggatgagagctctggtagcttcctgcctgtgcccgaacggcgtygaggccccaagggggactcaggcgaacagggccccccaggcaaggaggtgagcagaagtggctcagtgggttgtgccccgtggagtggggtgtagctgtacagccaccagcattctctyttccactcctgcagggccccatcggctttcctggagaacgcgggctgaagggcgacbgtrgagaccctrrccctcaggrgccacctggtctggcccttggggagagggscccccccrsgccttccrgccttgccdgggagcctgraaagcctrdtattcccdggctcccagkcagggctgggggtgtgggagaggcagraaggccaggagagagggtgaggctgggggctggccaggagagtgagggaagaggggttgggaggggtgggaccccccatgggcttggccctcacccgctatttgcatttcagggagaacggggagagaaaggagaacgtggagaacaggtgggctgcgatgggcttcgtggggcaggctgtctggaggctgtgctggggctgccaccccattttcttgtttcctgcagggcagagatgrccctcctrractccctggaacccctgggccccccggaccccctggccccaaggtgatcaccccatccctgccttagtyctgtgactagtgascaggaagccacccttagcttggtccccagaaatatggtagtgtgtgccataaccctggaatttctgaccctataaccctctgtgatcctgagatctgtgatgactcccccatgcctctatgacagagacatctctcccctgtgaccttgtgtttgtaggtgtctgtggatgagccaggtcctggactctctggagaacagggaccccctggactcaagggtgctaaggtcagtgtgtggaatcagctcggggccaccctctgccatggcactagggactgacttgacatctcatccccacagggggagccgggcagcaatggtgaccaaggtcccaaaggagacagggtgaggcctctctccacccttccatagagtccccctcctttctgggsgcacactagaggtggtgtgcatatgcacctgggcacgtggcagggactgggggctcagggcacgacactctgccttcaggrtgtgccaggcatcaaaggagaccggggagagcctggaccgaggggtcaggacggcaacccggtaagtccttgcccaacagccacacatgtgcaagaaggtggctctcacatgtattgtcctgtgtgcagggctggggtctgtactgcctgggactgtctgggtcctgactctgtctagggggatggtgggtggaggggaagttggaactgggaaactaaggccttaaacctattctctgcagggtctaccaggagagcgtggtatggctgggcctgaagggaagccggtgagtggtggctgaagcacctggccccaggctccggaccctccrctaggtgctgctgctgctgtgtgtgtgcatgtctgtgtgtgtgtgtttgtgtgtacctgtgtctgtgtgcctctckgtgtgtgcctgcttgtgtgtgcctgtgtctgtgtgtgcctgtgtgtgcctgtgtctgtgtgtggttgtatgtggatgtgtgtgtgcaggcccgtgtgtgctatctatgagaggcagtccatgggtaggtattatctgtgactggaaagggtgaggtatggaaattgacccccaaggaaaaagcycccagaggttgggaacaggcccaagtgaggcccagwttgaggctcatcagtgccctctctatgtagggtctgcagggtccaagaggcccccctggcccagtggtgagtacccaagaaccttcacctgtcttgcccccatcctgtgccctgccccagtgaccagtactgcctcagtttccttggtggggtgcggctaactccccctcatcagactctttttcgccacaacagggtggtcatggagaccctggaccacctggtgccccggtgagtgaccagggaacactgcctggtgagggtctggaagggctgggataggcattggccacagctgatgagccaggccttctctgtgttaatccctgagccctgttccctgcccttgacccttttctctagggtcttgctggccctgcaggaccccaaggaccttctggcctgaaggtgagtctaggtgtgtggatrggaggaggaggctccttcaagctgtgtccatgcctggggtagtgtgcgccaacctcctgggctgtcatctcctgcaatgaggatgagctccaggagccctggccacgtgggctctgctcatgcagtctctgggttgtttgcagggggagcctggagagacaggacctccaggacgggtgagtggcctagctcacaggttagggtcatagggagatgggtggggttggcactgccctgaactttctcttcctccagggcctgactggacctactggagctgtgggacttcctggacccccmkgcccttcaggccttgtggtgagtgagtccctgtggcccctgtagggacaccgtgttttcactccttggggcccatgttctctcatgtcgtcctgtgtccattgtcaccctgacatcygacttgttctccgtcagggtccacaggggtctccaggtttgcctggacaagtggtgagttctgggggtcaagggttgggctccaggggtcaagggtcgacaggcagccctgacagagctcttccctctcagggggagacagggaagccgggagccccaggtcgagatggtgccagtggaaaagatggagacagagggagccctggtgtgccagtatgtgttctgggggcagctcgctagggtgtggtgcccagctgtgggcctgaaatatgaggagtggggcagcaggggtggtggtggagaggcactgagttcctcacgctgctctgccataggggtcaccaggtctgcctggccctgtcggacctaaaggagaacctggccccacgggggcccctggacaggtgatctttgaccctgacttccaccccctgcagcaactcctctgcctcacccacaagcctgtttccaaatgccatgggggtggcagggtgggggcgggggaggaggaggaaactcactagcattccccacaggctgtggtcgggctccctggagcaaagggagagaaggtgagtgtgtgtggggctgccagtgakggggggtcaactggtgggggccaaggaatcccactgacctctcccscttaccagggagcccctggaggccttgctggagacctggtgggtgagccggtaagtagggaacttctgacagcagatgttctgggggtcctgtctctccagtggcctaacttctgaccttcgacccatagtttacccaccctcatgaccctcagctttcatagtagaccgcatatttaagctctggccccatgcctccctccggagtctcatctttctgtkactgatgcctgtgttgcctcctgacctctgtcaacagggagccaaaggtgaccgaggactgccagggccgcgaggcgagaaggtgaggtgggttggccctggggcctgactactgagcagagaaggctcagtccagacacccctcacctgccattctgtgcagggtgaagctggccgtgcaggggagcccrgagaccctggggaagatgtgagtccggggcctaggcaagggcgagcctggcctgaggagtgtgatggcgggcataaggggccactcttgggccggggcacatgtctgagcccctgagtcgggctgcatgtcccaacatccaggagcctgctctctggatcacagggagccacacactgtcggcttccacactctgagctctgggggccctgtcttggcttctgtgtgcccatccttggtctgtttctcaccayatctgggcacacgtgtgctctggtctgatctcccagatcccaggacacacctgagttcttgtgaacctctccttggtcctgtgtttacaatcctcctttcccctgcccctggctgccagcgttcagcctgtggccatgcctgctctacccgggagtggacgtgttggggttcccctctgagcgcccgtgtgtccgcactcacgtctgtggagccagatgtctgcactcgcgtgtgggctccctgtgcctgtgccatgcctgaactcccacctgtctatggtagtatctgagcgtccctctgtctgtgctgtcctgagataggccatggtcatgtctgagctcctgtgagccaattcttggtcgcatgtctgagttcccatgtgttcatggtcacatcagaactcccctgggaatattttcagcccgtgtctgaactctgtgctcatgttcctaccctctcaaatgctgtttgctgggttttcttagggtcagaaaggggctccaggacccaaaggtttcaaggtatgtgtacccagaagggtccctgctggggtcctggtygtgagactccctgagcttgatccgatgcctcttttcctcaaagggtgacccaggagtcggggtcccgggctcccctgggcctcctggccctccaggtgtgaaggtaagtcaatgccccatcaccagttgtrggggcagcaggccgggcccccacaggaggaagagggagttctgatgagagtcctgggaggggtcctgcattgaccattccctccctttgctgtttttatttcagggagatctgggcctccctgrcctgccmggtgctcctggtgttgttgggttcccgggtcagacaggccctcgaggagagatgggtcagccaggccctagtggagagcgggtgaggggctgggaacagcatgtaggggcatggtgaatccatggtgggtgaggagggggccctgccttgggggttcccagtcttgagggggcagagggtaggagggttcccaagtcactctctgcctctcttgccccatttttctggtagggtctggcaggccycccagggagagaaggaatcccaggacccctggggccacctggaccaccggggtcagtggtgagtagaggtgccctaaagccccacgtatttgatttcctgtcctcgtgaggacttaggatggggcgggccacactgtggggtgttgggggaggcgctttgagagccacaggaccctcacctcactctgacctacagggaccacctggggcctctggactcaaaggagacaaggtaggtgggacaagtgctgctgactctctcttgtgccctggtcacccccttcagcctccactgacctcccatgaccctgcgtcccccactgattcccctcactgatccccggtgtcctgttggtctccagggagaccctggagtagggctgcctgggccccgaggcgagcgtggggagccaggcatccgggtacgtatgtcwtactccacagccgaactcccttcatcccagctcttgcctctgatttccaacctctgagtcaatgaacctaatgtcaccatccagggtgaagatggccgccccggccaggagggaccccgaggactcacggtgggtcccgctggggaaagtgacagtgctgtgacttcagtcccctgcctgtgccctttgtaccccaggactctctgccatcctccctagccctctggccctcctcgtctacccctgtcccctttgtctggtccccactgtttccctcctccccctgatcctcctccgtcctccactgccctggttcctgtagctcacggtcaccttctctcacacaggggccccctggcagcaggggagagcgtggggagaaggtaggaacgtggggaaggtcctggcatgagtgggggggtgagtggatcttgtatgatattagaattcaggygcggggcctccccagtttgggcgggactcacactcttttgcccaatagggtgatgttgggagtgcaggactaaagggtgacaaggtgagtgtgggcatggggagggcagggcaggggccagggtgctcccgactcctctgattcctgcctgccccctcagggagactcagctgtgatcctggggcctccaggcccacggggtgccaagggggacatggtgagtgggcccacgtgtggactgggtctcccctgggtgcgagagggaccccgtggggctggcccagggcatctgagagctcaaactcccagagggtgagggaccttcagccccttaccgtgacttcttacccaaaccaacccagggtgaacgagggcctcggggcttggatggtgacaaaggacctcggggagacaatggggaccctggtgacaaggtacagggaagagggtggtgtactctctgtggggtcctgtggctgtggtggttccacagcwwctgtgagggcaggaggggaggacaggaggaggctttctggggttyagggggaaggggttctgtggctgactatggagtggccgagaggaggggctctagggagggctcaaggccttggtgtgaggttaggagagctctgtggactggccctatgaaggggccctatagggacaggaaaggggctccttgggtgtccccatctgaaggtgcttcagatgggatgaggaacccagtgataagagggcggggcaagggtctggagtccttggggtgagaaatgagccagtctgtggactacagcccccagttccacccgctatggcacaggctgggaggacgtgctgctagggccgttcgggagtgacttgagctctgccccagctggcgggctcgttgtattctaagcccccagcctgatctggtcctgactgaatccctctcctggtcactcccacagggcagcaagggagagcctsgtgacaagggctcagccgggttgccaggactgcgtggactcctgggaccccaggcaagttctgccccaggcccaggcccaggcccaggtccagagccagcatcacacacacacatatcctgggggtcctcttaagtgctgggggttctggctcccttgctgccggccccatgtgtgttcacccgggatctgtgtgtggcctgggmcctggccgctgagcatctgagtggccacacatgcagcggatgggccagtgttggggacagtcccactgaagggctcccccatctgtgtttctcacagggtcaacctggtgcagcagggatccctggtgacccggtaagatgcccctgctcccacaggggccccctgtccccagagggcccccgtcaccatggtggtcccaccastgtggtagcttttgaccttatagtgacccagtgctctcatggtgtcctcatgtcacccagggtcccccacctccacagtagccgcctatgatggtgtcccctgcctatsstgacccttgtccccatggcaagccccagtggctctggcctccagaggtgactcccaccccatggtgttccctacccactatccagggcgattctctttggtccctcactgacctcctctgacctcacatggaccctctccctgctagggatccccaggaaaggatggagtgcctggtatccgaggagaaaaaggagatgttggcttcatgggtcccyggkgcctcaaggtaggaaagaaacaagattggtttttttctggtcaggaaggcctaatgttgaagggcgagggacctggggtcagatattagggcactgggtcagaggttggagtagctgaggcctgtttggagagttagtttcagggtgaagggggtcacagagtgaggtgtctgggaatcacttcttcatctgcttttctccctcagggtgaacggggagtgaagggagcctgtggccttgatggagagaagggagacaaggtacagaggggatgggggctggggggctacgtggcctggggcctaaggctcaccccactgcctgatgcctgcagggagaagctggtcccccaggccgccccgggctggcaggacacaaaggagagatggtgagtgtgggcacgctcagaatgagggggccacgggtggacgggggccaagttcatgtctttttttctccagggggagcctggtgtgccgggccagtcggggrcccctggcaaggagggcctgatcggtcccaaggtacagggtctgtggacagtggacatgacagggagtcaggatggggcagggaagctcatggtcgggtcatgggggtgtagggacaaggaaggctgtagagggttgggactttgggggctgaagtggggctggtctcgaggtgtcaaggtgggttggggtcacagtggagttaggatgaaagcatgggaggtggagggggcatgtgcatcagggcagggggctatagtggagttggagtcatggggatcacatctggttggctcacaggtgcttgggttacagaaggtttgggcattaggccagggagctcatgggagttcagggaggttccagagctgagggaggtcagggcagaaggtctctcatsmttcttctgttcccagggtgacygaggctttgacgggcagccaggccccaagggtgaccagggcgagaaaggggagcgggtgagttgaagccatggtcatggtgaattgaggggagcgwgsactttgggagagggtccatctctggggcctctgattactgactctgtcctatatctccccagggaaccccaggaattgggggcttcccaggccccagtggaaatgatggctctgctggtcccccagggccacctggcagtgttggtcccagaggccccgaaggacttcaggsccagaaggtaaggggccccagctctgactcctgatccctgaaccttccctacccttccaacctcataaccatcttccagcctgcctgccccaacctctgaagctgtggcccccaacctgcctgactctgatccccactgcctctgaccctgctcacttggtccctgtgtctgacagggtgagcgaggtccccccrgagagagagtggtgggggctcctggggtccctggagctcctggcgagagaggggagcaggtgagtagggattccaaggcttgggtcagagatcggggtgacttctgttgtccctgaggtcagaggtcacagcctggtcccatctgttgcacataggggcggccagggcctgccggtcctcgaggcgagaagggagaagctgcactgacggtgagtgtgggcctggrtgggcctgggwgggcctgggtgggcctgggtgggctggggccctacctccctcacccagcaccctgacccctgggccctggctccatgcagtctcaccatagtccctgtattatgtgccctatgtccttcctgtgggccatgggttctttatggtccctgtggtcttctgctcccaggaggatgacatccggggctttgtgcgccaagagatgagtcagcactgtggtgagtggtgcccagcccgcagtctcccactccaccccagcaccctaggcaagggcaggcaggcccctagaacttacagggcaagcagtcaagaagatggggggatggatggatacacagaaggacacatgtgctgcaggactgacacatgacatgtgtccccagtggagggagacacacaggcagatgaggattgccatgcagtgctctcagatgtccagcttggctgtgtggggagtgggatgatggtgggagcagagctggtccccttgggcctgacctggacccggtgggaggggcatcagagtgaagctgtctcttcccgtctctgtctgcaccacctgcctgtttctgtgtctggcctgcttctgtctcttgccttttgttggcctgttcccaacttccctctcctctgccttcttctctttttccatctctctatctacctcccaccctctctcttcctctctctcctgtctgttaccctctcctgctatctctttgtgtatctctacccctctgcctgtgtgtctctgtctgtctctccatcttcccatccttctctctgtcattgtctctctatccctctctgccccctctagcctgccagggccagttcatcgcatctggatcacgtgagtagttttctactcccagaactttcttcaccccaggccctgccctgcctatcaactggggtcctctcaggggggttggctgggatggctgcccatggtgacttcagggccctgaggcccctgctcttggctccaggacccctccctagttatgctgcagacactgccggctcccagctccatgctgtgcctgtgctccgcgtctctcatgcagaggaggaaggtgaggacagctgaacccgtggggcagctatgggtggggccgagacacgcacatgggtgtccatgaatgcagggcacacgccaagcacgtagggtctgcatgcagggcacacgcatgggcactgtgtgcacacagtggaaatcagtgctgcccaccttgccccggggccagcagccactgctcccagcacaccctgccctacctgcagagcgggtaccccctgaggatgatgagtactctgaatactcckagtattctgtggaggagtaccaggaccctgaagctccttgggatagtgatggtgagaatggggggctgcgcccagcggggtctggggaggggcaggcagggctgagccctgctgacctccccctgacctttcaaccctctctgattcccacaaaccctgctgacttgaccccattggcccagacccctgttccctgccactggatgagggctcctgcactgcctacaccctgcgctggtaccatcgggctgtgacaggcagcacagaggcctgtcacccttttgtctatggtggctgtggagggaatgccaaccgttttgggacccgtgaggcctgcgagcgccgctgcccaccccgggtggtccagagccaggggacaggtatgggctgagcccccaccgtggggaactgggcactgagcctgcctggatcgggttctgggggaggagtccttgggccagggttccaggtcagggtcctggaggagacgctccctcgcagtaggggacctggggcagacgcccagaccaaagagctgaatatagagccccagccgtggagcccccagtagggtccccttccatgttccctcctttaaagacctaagtatggacccctctgaggtcagagcccccacttcctgttgtagcctccgctccctccccttggcggtgcctctgcctgagcgtctccggggaaggtcagatggctgacgaccgtttccaacctgtcctcaccaggtactgcccaggactgaggcccagataatgagctgagattcagcatcccctggaggagtcggggtctcagcagaaccccactgtccctccccttggtgctagaggcttgtgtgcacgtgagcgtgcgwgtgcacgtccgttatttcagtgacttggtcccgtgggtctagccttcccccctgtggacaaacccccattgtggctcctgccaccctggcagatgactcactgtsggggggtggctgtgggcagtgagcggatgtgactggcgtctgacccgccccttgacccaagcctgtgatgacatggtgctgattctggggggcattaaagctgctgttttaaaaggctcctgttgtgactgtttgggaagatggggggtttcaagggggaaggttttccttggggggttggtattattctgcatgggtacagagtccctctgcccagtcctggtcactgtcttgtgattctcagtccccaacttgtccccggaaaagagtagatagggtgggggctaaggacacccccgggagggatgygtcataggtggggggctgcctcatgccaggaagcatgtaccagctcccaccccagggggctgagggagataaatgggccctgaagcggggtagagggtcagaccacaggayagtagtgcctggccccagccccaggcagccacagcaggctgccttaccccagaagcagctggtggcggtaggactgggttgggtcgggatgggaagggtcttggaggttgagtggatgtggggtttggctttatggagggcttggacccaggggactctgggatctctggctgcttttctgcctctgagatccgattcctgcccttctgtttcctggatcagctgcaagctctcctgctgagaaccgcctgccctcctgtggactctgtgtttctgtctgaatctttctttccatcatgctgtctgtctctgggatggtttctgtctgtctttttcttctagtctccattttgctctgcctccatctccttcatctccctctcttgctgtccctctgtctctggatttctttgtttctttttttctgtcttgctttctgcctctttgtctcattctggctctcctcttgtctccccttctctgtctctggcctggcctggcctctctaacccctttctcggtgtcttcctctctctccatcccccgctctgtcactctgcccttgccatctgtctctgtccatggaccccagttgaccagagcccctgccctgagcccattttctccttgcagcctgacctcacgatgaccaggtgtgctctgctgttgctgatggtcctgatgttgggcagagtcctggttgtcccagtgacccctatcccaaccttccagctccgccctcagaattctccccagaccactccccgacctgcggcctcagagagcccctcagctgctcccacatggccgtgggctgcccagagccactgcagccccacccgccaccctggctcgcgcattgtcctatcgctggatgtccccatcggcctcttgcagatcttactggagcwagcccgggccagggctgccagggagcaggccaccaccaacgcccgcatcctggcccgtgtcggccactgctgagcctgagagagggggtcacagtgatagggccaccctggatgggaagacctggagggcagccacacagctggayggatgctgccacatctgggcatacagtgtctggacgctgccacatctgggcatacagtgtctggacactgccacatggagccactgtcatgcaggtcatatcagatctgagtgccccacagagtcacagtgtgtctggacagcctggacattggacattgctaagttgggtcactgccacatggagtcttgccatgcctgtgtgccccacagacctaatatatgtccggacagcttggatgctgccacgtaaggtcactgctgtggcgagtcttgctatgtctgggtgccccatagtcacagaacacctggacaccgccacatgcagtcatcatcatgttactttcaggagcctcaacacgagagctcaacactgcctccgaccagtccctctgaggcccacaggtctgtcatcccataggccaccacacagagaaatgctggctgagggtcacttgcttgctctgtgccccatgaggcagcacctgccccagatggacggggctgtgaggggtgtctccaggcacaaaggcccgaacacaggaagcctgtgaccatggcagccttgtcttatgggcgcatatgtgcgtgtgtggctgagtctctgacagctgtgagtgtgtgtgagcagggtaagggtacgtgaggggtctgagaggagtgggtgcttgtcccccaaacctgcatgaagcaagaacaactcctggccaggccctgtcctccccacgtacccctgcatccccagcctcgacccagggacatgcagggctcacaggagacagggctcaggctgccggagctccaaccaaactctgtcccacttcacgcacggactgtcctgggcaaaggtgttcacctttccgagcctcggtttccttatctgtaaagcaaagcgacaccagcaagcctgtgagcattgtgtatatagcagacatggaggtcctgcagcaggaggtgctcaataaacacaaagcgactgaaggatgggatgtgcgagaatcccagtggtgtgcacccaggccgcgacacatggtgggtgagtcatacctggcttctctgccttcctccctagctccccggttaactgacctggtcccttggtttggaaggactaggttttgcctgatttcacagcccaactccattgctgggccagagacagaactgactttccaggcagtgtggacgggcttgcccgcagagggggcaggcactctgggctgtgcagacaactctaggtggacatgaaggcagacgctgggtggcatgggcagctctggcgggagagggagactgtactggccacagcgtggccggctgactggagtgggggcactggcgctgccctcacagttgtaagcagccctgtgggggcgggcctacagtgggctggggaggcggggctgcaggagccgcaggagtcgcttctctctcttcagagtgctaggcggggttaccccactctggagctgcagggggcagtggccctggccagtttggttgcaggatggacagaggctcgttaggaggcagctccctgaccgacctggggccggggagcagcaggcggggtaggcacggsacagcgtggggagggtggagggttagggaaagacctggatgaagtcagggtggtgctggaggggtgcgagagtgttggggggtctctcctggtttaggggtgctctgagggccattcatctgtcagtggcccgaaggagggggaaaactgtcgccctgcaagggagagggggctgggccaagggggaactataaatagtgtcttcctccagcccagggggagggaccgccagctggcgctgcccaggccctcctgctctgctctttgctggcctccaagggatcatgtttgtccaggtttcctcttggggtcacaccagtttggggaagtctagaggctcatttaggatgggtttcacatgatgtggctttagcccttaaaccagcacttctagggtgtctgctgtgtgccctgtgccagtcctgagcttctctgaacacctgctgtgtactcagtttggtcatgaacctctctgaaccctttctgtgtgcccttgctggtcctgaatccctaagcacctactgtacgccctgtggcaggctggaaggaggaagtgcagatcagggttcccaggctgcttggtgacatggttctataacctgaagtcagaacttcacactccttgtgagccctgggcccagggagacacaggggacaatcctttgctggaaatggccagaggaagctggaattcctggaaactcctgaacctcccagtggacagcagggctgggggtggagagatatatgtgggaagggaggcagcagagagcagcaggccccactgcagcctgcctgtctctgcacatgctggggtgcaggacttgtgagtgtgtgtgcgtctgtgtgtgcatgtgcagctgtgccagtgtctctgtgtgcatcagtgtgtgggcctgtgtggcatgcactgaaacccctgggtctttatgctgcaaagggtggtttgtgggccagatgtggtggctaatggctataaacccagggctttgggaggttgaggcgggaggatcgcttgaggccaggagttcaaggctgcagtgagccatgattgcactatgtgctccaggctgggtaacaggagcgagactgtgtgtgtgtgtgtgtgtgtgtgtggtgggatggtttggcagttctgtcaggactggccagtagatacagggactgggaagagtttgagctttgagaactggccaccacatggcttctaggctgggacactgggaggaagtccagtggtcagtgcagagggcaccctgggagccaaccagggtcaggccagccaggttcatggtgggcagaggctgagcagaacatgttcacacgtgtgtacagacatcccagcatacttcccacgcctgggacagaacagctggctcactttcggatatactgaggaggaaaaagccatgagggccagagattctaccgggcatccgctgatgctgagagagcagacgctgggacagcatctccatggagaggacacaggggagtgggagcacacatgtgaaggtggactgtgcgattccactgtagtgtggcaggcaaggtctggaaggctgggagttgagctgagtccatgctgcactgtggactcgctttgtgatcttggacccttctccctcttcctgaccctcagtttcccacctgacaaacagggccatgggaggggagatggagaatatcctcagagcagatgtggacggtggccttggggaggaaccccaggcatctcctgatgttgacctgtggccttccagctggacatagggccttgaaggagggtgcctgggtcagccacgggtagactttctggggaagagaggaaggtgcagagctgttgcatttcctgggaaccaggctcatcctgtctgggtgtgaggatgccttcccagagatagccctggccccctgcccaggccagctgtcctctacccccagcccttgattagcatcccaggaggtctgggaagagaatggacaggccagaggaggtgctgggtgtctgtagatatcagaggagatagcttttgcaatgagtgctgcgggttagacagggtgtgggcatgtggtaatgaggtctcagaggccacggtggccccaagatggccttggcagtggccagaagacaagagggctggctgtgtcacgaacagaatgagtggctttggagaagtagggagcaggtcacgaggggcacccagctcatcaggagccgcccatggatgtgctcagatctgctgggactggggtggaggaataagcgggtagatactgcaaaaggaggatgaggaaggaggaagttgttgactctgcctggggcagggtgttcccagggcaagcagctagagctggtttgggggagggtccagatgggcttccagcatgtggacctttggaatcttcagttcctatgaagtgggcaagacatctgtgtcagtcatcttaagggtccttgccaagctttaaagagctgggtggacttggactgatccaaggcagggctgtggcagggagggcatgggagggggtgctacacctatagcccacgaggccagtcttgttgccagtcccatgccctcaacacctggctcctggctgggtacacactgggcagagagaacctgaggatgcagggcacctgccaggggtgttgtggatgacatcgctagagggcagtgtggctcaggttgaagccgtgttggtgggggctggggcagagagtgtacaaagcttggagaggcggggctggggatcccgaggaggcgggaaactgcaggagtccggtgggggccaaacaagaaagtgagccaggggtttaggaacttctggatctctcccttgttccttgtccccagtgcattttcaaagacaagagggagatacaaatatagtaaaaggcaaccataacgtattttaaaatgaatttcttagagattgacatacttaatttatactgtaatactgtaagatagacaatgtgcacatcccattttcctgaagagaaaatgttattaacatattagtttcaaaaaatatgtaaaactttagttaaaaaaaccaaaatactaaaaatcaaaaaaaaattgtaaaaaatgaaattctggaaagacgattaagatactcccagggcttagtgagtacccaaagtacttggttactaagtgccacgcacggccgggcgcggtggctcacgcctgtaatcccagcactttggaaggctgaggagggcgtatcacctgaggtcaggagttcgagaccagcccggccaacgtggtgaaatcccgcctctactaaaaatacaaaaattagcagggcgtggtggtgggcgcctgtaatcccagctacttgggaacccgaggcaggagcatcccttgaacccgggaggcggaggttgcagtgagccaagatagcgccattgcactccagcctgggcaacaggagcgaaactccgtctcaaaaaaaaaaagtcccacgcatttgctcccagcagccaaagcaaagaaagaggaacaatattgaaatgtgttttgagtctctatccatgaggtaaaagagcttttccagcgtggttgagcatgctcctatggacggcggaagagtcccggggctcggagcagtcaagggggaccccgaggaggggcaggagggcgcagcggagttgacggctgggactgcaggcctactggcccctgtcggctctgaccaacctggccgtgcgggtcacgtaggcctcgtcccactgcatgaaaacccctccctcctgggggccctgggctccctagcaaggaggtagcagaattcacgcgtgccgctgctcagggatgcagcgccagggcggagcccgtaggtggggcctatgcaaatcagcgcgggcaggttgggagagctgagtttgcgcatccggggcgggcctgcacaatccgggccttgaactggggcgggaccagtacaatccggagttgagcatgcgcattctcgatcctggcctgaagaactgggcccacttgttccaaaacgggcgggtaggtgagttgggcatgcgtggtcggaggccgggcccctttcagctggggcggagcctactcactctggggcgggacctgcgggaagatagacatgggctgtcgcggcttgaggaggggcggggcccaaggggcgggacctcgggtggcccgaggtggcccggctgctgggttggaagcggcgcagtccgactcatcccggccccgggatggcgtccccacgggaattgacacagaaccccctgaagaagatctggatgccatacagcaatgggcggcccgctctgcacgcttgccagcgcggtggtgaggcggggtcctctgggaggaggtgggaggtgcaccgggatgggtgggtagggcggcctgggcgggggtctcgcatggagaaggggcgggagacagatggggaaccggggacaggtgaggttgccgtgactggggaggctgctggggacaggtgaggcggtcgtgacagtggtgggccagagacaggtgtggcagagcagggggcggggacaggtgtgtgggggcatatcggcttggcggtggctaggtctggccaccatcacctcggggagggctctggccccctcgcttccctctccaatccccatcgcccccagtctggggaggaccctgtgggcaccccaggcccttccctctctcctggccaaggagtgtgggccgggttgttggactggaactgagctgtgtggccctaggtgaattacttggcctctctgagcccagaactttcaaaggtgggctagttttccaacaggaggaagggtgcctcttggccttaaagctgagcttgggcaggaacttcagcagagatgtgctcaggatagagacagaaaagtatgccgtgtgggcctgtgtctgtgtcccgggacatgtaagtatccacctggggtcatgggtgtacagtaaaactggagagtgaaacagctaggagaatgctgaaattcatggaattgttaaggggctcacctctcctagggtcccaggtgtttaaaccgcttccttgagtttctgcctgtccttaaatgagctggcagttttttttttttttaagagatgagtctcgctcagtggcccaagctggagcaagtgcagtggcgcgatcatagttcactgcagccacgaccttctgggctcaagcaatcctcccacctcaacctcccgattagctgggattataggtgcgccaccacacccagcttttttttttcttttttctttttttttgtagagacagggtcttgctatgttgtctgggctggtctccaactcatggcttcaagtggatcctctggcctcggccttccgaagtgttgagattacaggcgtgggtcctggcctgcaacttttttatta

SEQ ID NO: 17799 - DNA, 14603 bp, Homo sapiens
cccgcccccaccctgtgtgccccccgctgcctcccccttagtgtagggcaggggttggtggagaagggccaaggccgctcagagcccgaggcctttgcccctccctccaccaggctccctattttgccctctggacccactgataacatcccctgggggaggagctggtctcatgtctggggccctccccagcccccaccaggactgattctctcgttcaccttcctgggttcctcagtggggctgggggaagagcagccctcactgccccctggctgtgggagcaactgggaggaacaaggtctggtgaggagagggcacagaggagttctgcggggagtcggtggtccaggaggggccgctgacccttctcggggctgagatgtcccctgggcccacagtgaagccgcagcagggatggcaggatgagggcgcctgtcttccagatgctgacaccttggagccaggacatcttaggcttaaatgatgcctttggcacgtaataggacccaggtcacagagataacatctcagagcctcaattttctgaggataaaatggggctggaatactgatttcccagagtggtgctgaaaaggaaatgagatagagaagtacaaagcagcgggtccacggagggactcacacctccctctccctcctaacgctgtgcccttcccagacagcagagtctgcaggcagaaggagcctctaacataaaaaatagagctctggcagcaagctgtcctctcagaagtaactaacaccacagtatgaaatcagaggcctgagaaagtggcccggctctgccctcagaattctttatcggtgggtgagacttggaattcctctattagcgatccattcctggctgggcacagtggctcatgcctgtaatcccagcactttgggaggctgggacggacggatatctgaggccaggagttcgagaccagcctgggcaacatggcgaaacccagtctctactaaaaatacaaaaaattagccgagcatggtgatgcacgcctgtagtcccagctactcaggaggctgaggcacgagaattgcttgaaccccggaggtggaggttgcagtgagcagagatcgcaccattgcactccagtgacagagctagacttggtctaaaaaagagagagagagagagagagagagagattcattcctttgacttaagactttgttttctgttaaaatgcaaatagaaccctgtgaagtagacgttaagtccattttataggttagaaacctaaggctctaagggctccaagtgcacagcccattagtagtaaggctgggaaccttaatccaggtcttcacacaccccaggcaaataccagacggcttagagcactgagacccctatagaggcatcagtcacacgcccagaacaaacctgtctcaagtctcctgcagactttggtggtggggtagaaggtgaagaagtggtcactggaggatttggtattggggatgccctttcctcttctgctgcggcctgctccatagccccagaggcaaaggcacagtggggacccagatccaggcaggggcaggcaacaaggtctatgggcccgggtgtgctagaatgggctggcggggtcccgtggccccagaccctccaagcctttccatctctgcagagggtctggaggagcctggcctctctctcccrcatggcaacggacccagggaggtcaggacatgtgggtagagagacctggcagggtgctgagctagatgtagcacacctccaggaagcctggtaccttgtctccttccaagggcttggtacctgagaatacctgtggcccctcaccaacagtccaacctgcaccccggcaggggatctcttggtggccagcctgcgctgcccctctctcccatcatggctcccctgggatgaagactgctccagggagaagccagtggtagatgggaggaagaggggatttgaccatccggggccaaaaatggtcctctggggttgggctgtttcaccttgtgtccaggtgaggtttagtacatgagcccccatgctccatgcccttcccaccaggctgggctgggcagccctgattcagacctgttggccagaggcccttgttcatcacacatcatcatgccggaagttcctcctagtatctcacccagctccttcctatggcaacaggagctgtccttcagttctgcccgggggagggccccttgaagcatacgtgaggcacatgtccgtgtgacctgcctgtccctggctggatctgagttttctgctcctgactctgacctctggactgacccctggtttgatccctgtgtggttggccaggaggggtggctgtagctaatgctgagctatcagcctcattgcctcaccaatcattaagtctgcctgttgcacagataaggagaggcttggagaggcgatgtctccctcgagatcacacaggcctttcatgcccactaaggtggacgtccctgactcacaggaccaggcctggctggaaggcagtctgctcttcccatcagctacttgcaccctctaagactgagcacagggggctctcattctctccctgctccccaaaacaaatccatctacagattgatgcaaaacgtaccctcagactttgggaagtaaatacattcattaacaggtcacatccccgccacgttgaaaggcaggaggtcccctcgcgagcgtgggtgcacgcatgggctgtgccagtcccttggttcttagtgatttgcacacttctgtgaatccacacacactctggtggatgctctcggacatgctcaaatggtgcaggcgctcccagcatgggtgcacccaggcgggcgggtgagacagaagcgcctctggacctctcacatgctagtggcacckgctgctaggactgtaagtcctggaggtcaaactgcggctgaggtgtcattygtgactcagtctcctcctcccctctggcctggggaagggacaggggcactgagtactgacctttgctcccgctgcaagctggactgtgcctgattcaggagcagggttgggaccgatgggttccagggaggtgagccttgcaggrgtaagacgtggctaacatttagtgatcacttttactatgtgccagacattgttgcaagcactataagatcatctcagtgaatcctcacagcctaggaggcaggtacaatggttatgtctcaccaaggtaactgaggctcagagaggttatgagacttgcccaaggacacacaggcagtacgtgttggagcctggatgccaagccagggagtggactccagcatctgaccccaacaatcacagagagatggcacaggctgcatcaaaaaggaggcagcatggtagcgtggggaccactacagggcagtggggacccagcagaaggggtgccagagtcaggaggtcatttgactgcctttgaccctaggaaacattaagccacttctggaaactgaaaaaatgaacacaaagcaaattagagttagtacaattgtggtctactctgatggcgttcatttttacaaataaatgtagctcactgttgtcaggcactgcactcaccgacaggagccaatagtgcaacgtgcctggatgtcacctcatagtcactaggagtggtgtggtccggcagagggacccatgctgacgtggtgtgtcaccttctcagtggatgtttgtgtgtgattatgcatgcagcctcatttagagatccaatagacatctaagtagaagacctcctgggcaccaccaccattgccctccatcccccaatgggaggtcycctgagagcctcaggtcccaagattctgctcaagccagctgctcctgcccagggagtgtggctggggggcaagaagggcaggagtcaggcctcaggctggtcccacccatcaccctgcctctggcccacctggcgcccctcagagggctgagtctcattctgccactctcactagaggagggagcactctgctaccctccctgctttgctccaaatcaggaacacagtatgattattatacagtatgattattataataacagcaactatttttcagagcttactctgtgccaggagctctataggcagccctctgtatccttggtttctgtgtccatggattcaaccaaccttggattgaaaataattttttaggccgggcgtggtggctcacgcctgtaatctcagcactttgggaggctgaggcgggcggatcacgaggtcaggagatcgagaccatcctggctaacacggcgaaaccccatctctactaaaaatacaaaaaaaaaaaaaaaaattagccgggcgtggtggcgggcgcctatggtcccagctacttgggaggctgaggcaggagaatggcgtgaacccgggaggcagagcttgcagtgagccgagatcgtgccactgcactccagcctgggtgacagagcaagactccatctcaaaaaaaaaaaaaaaaaatatatatatatatatatatatatatatttttttttaaattgcatctgtgggccgggtgcagtggctcatgcctgtaagcccagcattttaggaggcagagattggaggatcacttaaggccaggagttggagaccagcctgagcaacatagcgacaccccatctccattaaaaacaatgttttaaaaaaattgcatctgggcagggcgcagtggctcacgcctataagcccagcactttgggaggcccacatgggaggattgcttgaggccaggagttggagaccagcctgagcaacatggtgaaaccccgtctctgctgtaaatacacaaattagctgggcgtggtggtgggtgcctgtaatcccagctactcaggaggctgaggcaggagaatcacttgaacctggggggcagagattgcagtgagctaagatcgtgccactgcactccagcctgggtgacagagtaagactccatctcaaaaaaaaaaaaaattgcacctgtactaaacatatacagacttttttggtgattacctcctaaacaatacagtataacaaccattcacacagcayttccgtcgtattaggtattataagtaatctagagatttaaagtatgtgggaggctgtgcttaggttatatgtaaatactatgccattttatatcaaggacttgaacatccatggattttggtatctgcagagggtcctggaatcaatttcccatggagactgagagatgaccgtactacccacttcgcaagcaatgtcttctttaatgtactgaaccatcccattgttcagaggagaaactgaagctcagggctttgaataactagaccaaggaggcacagcatgggagtgggacatgaagcactctacaattaaccctttcaggacaaggccctgtctcccacacccatctgcccaaaggctctccagggccccctcctcttgggtgtaccttgacaagagacctagattttagctcactatgctgtctgcagtcctggatggtcccactccagtgtctggtgctctgagatggagtcagcattagtggcggatgtggagactggggggacctgtcttcactggggtagacagaggagatgtggactttgccccccatgagcccggcacaaacccagagccgccagcagggcctcgaggcatcagtcccgggctcatgggctccctgaggtgtttctcctactgttttccgttcccctcctcccttccatgctgaggttggtggggtgggggtgggggtgcccacgcacggaacagccaccacttctaactatcgcctgagccctgatctgctgtcagcttccacgtagtctcagggtcacaaaagtccaagaggcctcttgggaatgtgtcaccttccagcgtggagtcacactgaggaaggaggaggggagggcagccaggggggtggcgatagggagagagtttaaatgtctggctggctctgagcttcagtcagttcccactgcagcrcaggtgagctctcctgaggacctctctgtcagctcccctgattgtagggaggatccagtgtggcaagaaactcctccagcccagcaagcagctcaggatgttcctgaaggccgtggtcctgaccctggccctggtggctgtcgccggtgagtagaagctgtctttggatggcactcctgggctgctgctctgagtagtgcaggatggaggctgagccaaagcaaaaggacacttctgagtgcccatcagcccccagctggacatgaggtctgcctggctgccaagtggctcacaggagagctggcccagtcccagtggtgggcccattggcattggtgctataccagtttcacatatycctgtggcttccaaaaagctaagctcagacagggaaaatggcaggttgaggcacccccaccatcatccagtctgcagctcagagctggagcagaggggccacacaggagacggggcctcatgaattgctctctgttaccacccaggagccagggctgaggtcagtgctgaccaggtggccacrgtgatgtgggactacttcagccagctgagcaacaatgccaaggaggccgtggaacatctccagaaatctgaactcacccagcaactcaagtaagagggactacagtgtgyrgtggtgacggggaattcttaaaggccatgcaatgtactggcaagggttgagcttagagacaggagccctgagcttaggatacccactgccctgccactaactggccgggcctctgaacctaggatccacatatgtaaacyggaagtttggaccgaataatccctgccatgtccttttgctttgacgttcyagagtttgacaaatggccacatcctatcattcaggctcatggaagagagggagggaggaaaatgycaygtgagctgatttctaatacrtttcagaaagacaggccccagtggaatcaaggggagggaggtgggaatatttgggaggcccctgggcacaggcaaggaaagcagcaccttgtgccactggaagaccccagcagaggtcaagaagacaacattgtgttacacaatgtgatcctatggcccagaacaytccctctgggaaggacctcaaagtcccaccctctgcagacaaggaggggaaagcaaactgctggaggtgacatggtgggtagattctgagacaaastatgtgggagatcctgagatagaaattcagcatcgtaacttagtctgtgacacccatcctctccaatctgcaccaccatagrgagggtgaactcggtacctctgagcactcacctgtcytagcacgtgtgcataaggcgagtggtatacaagcagacaaagtcttgccgtgtaaatgccaaatgtaacgtggcctccttgtgcccttccccacagtgccctcttccaggacaaacttggagaagtgaacacttaygcargygacctgcagaagaagctggtgccctttgccaccgagctgcatgaacgcctggccaaggactcggagaaactgaaggaggagattgggaaggagctggaggagctgagggcccggctgctgccccatgccaatgaggtgagccagaagatcggggacaacctgcgagagcttcagcagcgcctggagccctacgcggaccagctgcgcacccaggtcarcacgcaggcygagcagctgcggcgccagctgaccccctackcacagcgcatggagagagtgctgcgggagaacgccgacagcctgcaggcctygctgaggccccacgccgacgagctcaaggccaagatcgaccagaacgtggaggagctcaagggacgccttacgccctacgctgacgaattcaaagtcaagattgaccagaccgtggaggagctgcgccgcagcctggctccctatgctcaggacacgcaggagaagctcaaccaccagcttgagggcctgaccttccagatgaagaagaacgccraggagctcaaggccaggatctcggccagtgcygaggagctgcrgcagaggctggcgcccttggccgaggacgtgcgtggcaacctgargggcaacacygaggggctgcagaagtcactggcagagctgggtgggcacctrgaccagcaggtggaggagttccgacgccggstggagccctacggggaaaacttcaacaaagccctggtgcagcagatggaacagctcaggcagaaactgggcccccatgcgggggacgtkgaaggccacttgagcttcctggagaaggacctgagggacaaggtcaactccttcttcagcaccttcaaggagaaagagagccaggacaagwctctctccctccctgagctggagcaacagcaggaacagcakcaggagcagcagcaggagcaggtgcagatgctggcccctttggagagctgagctgcccctggtgcactggccccaccctcgtggacacctgccctgccctgccacctgtctgtctgtctgtcccaaagaagttctggtatgaacttgaggacacatgtccagtgggaggtgagaccacctctcaatattcaataaagctgctgagaatctagcctcaactggttgccggatgaatcctccttgcagctggggaggtggggaggtaaccatgactgggcagagcttagcagcggcctggcaggagacacccaggattggggagatgagactgcaggagaggtaagggcctggtggactggaggcgagtacatggggagtcctctaaggggaggcagaaaaagatgtcacacattatcccaagacaaaatatgcaacctacttatattcatttagccaacaaatatgcattgaatgcctccgatgcgccagtcattattctaggcaccggacaaccagcaaacagcttttgtgcagccatgtgcccgactctgcctcacactgagggggacacctggaggcgagcagaacagggtccctggccctggggggctcacagtacactgggggagatggttcctccttgcacgagatcttcagtgcctttaacttattcatgtagtgtcatttaacccaccccaccccagttccattatgaaagcgattcatgcttatttcagaactttcttgactgctaaacctgtggtctccatccagaattggggattgaggcttggggaccgagacgagtctggggaggaggggcagagcaggtgctggagcctgcggggccctggtctgctctgtccaggggcctcctgccaggtggcctgccagtttggggctgagtttgcagccactgggrttaggggcagagagtcagggggcctgagcagtctcatcagcacagccagctgtgggcagctgcagccttggagtggtctttcaccccacccttagagactcgaaaacctcacaaggaaagagccagttcaagcgtttgtctcaaacgactccacagcctgttacccgtggaccccagccctgcgagtctagccacctccctttcctcgccacagggggatgcaggcccttcagggctttcctggaagaggcctggaacatgctaaggaggagggggaagtccccttggagggtgtcctggggcctcctccttccctctcaaggtgccctcagggtagtggcccccagcatggtctggcccaggcctatacccctctggcccctggtgctggcctggtgggagggatgtatgcttgggaatcagacaagcctaggtttgaatcctggctttttgaccgactaccgggtgatgtggggcgaataattgagcttcttttggaagacatgggtaatgacaatcctctgcttagagaggagttgtgctgaaggtttgatggagcaacggagtcaagcacttaacatcaggcacggaataaccgtgcaatagctggtgctgcagtaaatgtgacttcctcatcccgctcacctccaggccacactctattaatgagaccgccacagctggccaagggtagacccccgggtctcccctgccccagctgctctcgctcctgcataccaggccagtaaggctgctgcggccactttgatacctacccccactagaagcacaggaacctatggggaaacaccttgacaaacccaccaggcacctggaggtttactggatggctttaggaaagggccaatgaggccaaacagagcaacgagtcaccaaaaggaagtgagatgcagggtgggccgggttccaagagggtctggaagcttctgagatgctctcagacctcacctgagggctgcctggtttagtgctgactccagaacccctgggggcctcagtgtctcccagaacttggttcttaatatgaaccctgggccgggcgcggtggctcatgcctgtaatcccagcactttgggaggccgaggtgggtggatcatgaggtgaagagatcaagaccatcctggccaacatggtgaaactccgtctctactaaaaatacaaaaaattagctgggcgtggtggtgggctcctgtaatcccagctacttgggaggctgaagcaggagaatcgcttgaacccaggaggcggaggttgcagtgagccaagatcgcgccattgcaccactccagcctgggcaaaaagagagaaactctgtctcaaaaaaaaaaaaaaaaaaaaaaaaaaaatatatatatatatatatatacacacacacatatatattcatatataattcatatatatattcatatataattcatatataattcatatatatattcatatagatattcatatataattcatatagatattcatagatattcatatatattcatatagatattcatatattcatatatattcatatattcatgtatattcatatagatattcatatatagatattcatagatattcatatatagatattcatatagatattcatatatagatattcatatagatattcatgtatagatattcatatatatattcatatatagatattcatatagatatattcatatctatatgaatatatatatgaatatatctatatatgaatcctggattagacccgtgcacctctcccaccacccttagggccatcctgcaggtctctgagggtcctgccacagtcctcgtcctcctggatgaggaatgccttctctttcctgtaccaagatgtctcatcaatcccctgggtctggcagaggtctcttggtagtaactttgcttttggctgctgcagtgaactgaatgtttgcgtccccctaaattcctatgttgcaattctaatctgtaaggtgatggcattaggagagaaggcatttgggaggtgatcaggtcatgaagggggagccctcatgaatgagattagtgtccttataaaagaggccccacagaaatcccttgccccttcyacgtgcgaggacacagcgagaaggtgccatttatgaaccaggaagtgggccctcaccagacacgggatatgctggtgccttgctcttagacttcccagcctccaggactatgaggaataaatgtctgttgtttgtaatccacccagtttttggtgtctcgttatagaagcccaaaagatctaagacactttcccagcctctgaagctctcctgttttgtttcgaaagtgtctcgctgatgagttttggtgggagtcagaggctgcctccattacagacactaacaactccagtcgcctgccttctagcctcgcttacctccagcatgggacatgggacctatgctcagcaaatcagatgtaattgccccagactggtgtaaagaaacagagacagtggagaatcttttctggggtgggcaggaacagtgcggcagcaacaggcagcttgcggccaggctagagcctcaggccagggaccaggcgtggcagtggctggtgggcaaactgggctgtccccatcctggctcagtggtgacagcacagccgtccccatcactctagttctgtggcatgagcatggccatgtttctccctcagctccccttattcttgtttattttccaaaccaagtactccagctttcctagacatttccttgaaattcctggaaatatgtcagtaagttcatcttctgattatgtcttccagagtaggtttctgtggctagcaattaaaaaccttgattgaggccaggcgtgatggatcacgcctgtaatcccagcactttgggagactgaggtgggtgaatcacctgagatagggagttcgagaccagcctgaccaacatggtgaaacccccgtctctactaaaaatacaaaaattaactaggtgtggtggcacacgcctgtaatcccagctactcaggaggctgaggcaggaaaattgcttgaacccaggaggtggaggttgcagtgagctgagatcaggccattgcactccagcctgggtgaaagagcaagactctgtctcaaaaacaaacaaacacacacacatcactttgattgacacaccccacacaccccttccctcttagggatgtttctcttgctttgggccttggaagacacaccctcatctctggcctgttccagttggtcaattggtttgtctgagatacacttattagtcctcattagggttggtcccatcttccaaggaaagcagccttcctcctgttctgagctagcaggtggacttagtccccctgtggccagtcagtcctctgctcctctccagcggctgagctgactggggacctgggcaacagcctctacctgcccttctcagagattctctaacagctggtctcagatctctcatgaggtcctgagttcaagcaaaacactctggtttggtttggggaatctgtttatttatgggaagatgtccaagatattttatgaaaaaaaaaaaagcaaggtttcaactattatgtactttacaacccggtcaaggaacacacatacatattggtatgtgaacgtgtaaggaagtgaaaatcctgttagcttaacagttagacctagaatacctctgaaagagagaatgtcattgacagtgcatgctagctgttgaccaggacacccagaggaactggctggaaagagaccacaaggcagagagatggagtcaattgttccgtgcattccctgcactggcatttgaggtggtaatgaagagtaggaaaggaggggaggtcacagaagggaaaacagggaatacatgaggaggtgaaagccccctacaaatgatggccaataagaaatgcccagtggcaacggttgtagagcttttcaatgcaaggatggcaattcattgctgactgcaatgctggtagtgtgaggtgcttttaaaaaccaccttatattaccatattggctcatataattctcatgatcgaccatcacatcaaagacacaatagatgaggaagaggcacttcagaatggtgaggtacattacctagcaagtggtggaatgggattttttttttttttttttttttttttaccagcgctttgggaggccgaggcgggtggatcacttgaggtcaggagttcaagaccagcctggccaacatggcgaaaccccctcctctattaaaaatacaaaaattggctgggctttgtggtgcgtgcttgcaatctcagctactagggaggctgaggcaggagaatcgcctgaactcgggagacggagatttcagtgagccgagatcatgccactgccagcctgggtgacagagtgagactctgtctccaaaaaaaaaaaaaaagaagagaaagaaaaaaatatgccattttaggccaggtgtggtggctcacacctgtaatcccagcactttgggaggctgagacaggtggattgcttgagcctaggagttcgagaccagcctggcaacatggcgaaaacttgtctctacaaaaaatacaaaaattagccaagtgtggtggtgcacacctgtggtccaagctactcgagagactgaggtgggaggattgcttgagcccaggaggttgaggctggggtgagttgagatcatgccactgcactccagcctgggcaacagaggaagaccctgtctcaagaaaaaaaaaaaaaaagaagaagaagaaaagaaaaaaatgccaccactttagtattacttttataacataaaatttaccatttaaactatttataggtgttcaagtcagtggcattaattacatttacaatgttgtgcaaccaccgccaccactatttctgaaaatcttttcatcaccccaaacagaaaactctatccattaagcaattgtgaaaactgccgctatgaatgggggtgtacacatatctttccagtccttgctctcaattcttctgagcaaatatccagaagtggaattgctgggtcacacggtaattctatatttaaattttggaggaaccgccaaactgtttttttatagtagtggcaccatttcacattcccactggtgacgcccagggttccaatttcttcacagcctctccaacgcttgttgttttctgttattttttggttttgttttattttgtttttaacaatagtcatcctgagagtagtacttttaaaaccagaaataagtaagaaaagaaatattcc

SEQ ID NO: 17800 - DNA, 38830 bp, Homo sapiens
ctgctggcaatccctggtgatccttaacttgtgggatccctccagtcacatgactttcttcttcctgtgtgtcttcagttgttttatctctagggctgtctgtctccgtgtccacactttccccattttataaggacatcggtcatattggattatggcccacccataagacctcattttagcttgattacttctgtaaagaccctatttccaaataaggtcatattctgacatactggggattagaacttctgcatatctttttgggagacacaagccaacctcataacagagggtgtcagtacagggcaggacccaacccagcatggaagtgggctatattcagtggggcaggaggaggggagaagctatgtaaatacactgacaacaatagtgtagtttcacacagataagaagggaggtacagatatagacagagagaaagctagaaagaaccctgtggtgttggattggaactggcagtataagtgtgaactcatggttttcaaaatgataggtatagaaataaatacagctggtcggacgtggtggctcaagcctgtaatcccagcactttgggaggccgaggcaggtggatcacttgaagtcaggagttcaagaccagcctgaccaacatggtgaaaccccgtctctacaaaaaaaaaaaaaaaaaaaattagccgggcgtggtggtgcatgcctgtaatcccagctacttgggaggctgaggcaggagaatggcttgaacctgggaggcagaagttgcaatgagccgagatcgtgccattgaactccagcctgggcaacaagagcaatactccgtctcaaaaaaagaaaaaaaatatagctgtaagtacaatatacgcatttgttcattcattctctggctctgtccagtgagagacctgaggacagtgacacttgggcagcagggagcaagatcaccttgtgtgtgtatcttggctctaaataccattctctactatgaggaacccaagccccttggagaaaattcccaagtccgagcccagggcaaggtaaataggagaggagatgagcatttcatgctgcctgaaagtcagggaggtcttaaagaacgatggggatcattgaaaaggacacaggagcccatttgaaggagctgtcactggccaaagttggcatgatttgagcattaaaataaatcatggtaggtactgactgtaagccatttaataaaatagaaatccgtgagtccacactgattatataagttaacaaagaacacaagaaggaaaacaaactcttccttaggtagaatgccaactattaaatacaaaaggaatggtgacattttatttatttatttatttaacaatagcaacttttattttagactcagggggtgtacgtgcccctttgttatctcataatactttagcattttagaatagttttttctaattctgtgaaaaatgataattcatatcccaaaccacatggtaagtgtagtacccgggtagttagttcttcaatccttgcctctctgcctcacccctctaagtagttccctgtgtctattgttgccatctttatgcccattagcacccaatgtttagctcccacttataagtgaaaatatacagtatttggttttctgttcctgcattaatttgcttaggataatggcttccagctgcatctatgctgctgcaaaggacatatttcattctttttatggctgtgtagtattccgtgggtgtatatataccacatttcctttatccagtccactgttaacgggcaaccaggttgattccatgtctttgctattgtgaatagtgccgcaatgaacatatgagcacaggtgtctttttggatatatactcagtaatgggattgctgggtcaaatggttgttctgctttaagttttttaagaaatctccaaactgctttccacaatggctgaactaatttacattcctatcaatagcatataagcatttgcttttctctgctgcctcaccagcrtctattgttttatgactttttaataatagtcattccaactgatgtgagatagcatctcattgtggttttgatttgcatctctctgatgattagtgatattgagcatttttcatatctgttggctgcttgtatgtcttctttggagaagtgtctgttcatttcttttgcccactttttattggggttattttattttattttattttttgcttgctgaattgcctaagttctgtacagattctgaatattagacccttgctgcatgcagtgtgcgaatattttctcccattctgtaggttgtctgtttactctgttgatagtgtcctttgctgtgcagaagctttttagtttacttaggacccacttgtcaatttttgtttatattgcaattgcttttaagaacttagtcataaatttttccccaagaatgatgtctagagtggtgcttcctaggttttcttctaggattcttataatttgaggtcctacatttaaacttttaatccatcttgagttaatttttgtatatggtgaaaggtaagggtccagtttcattcttttgtgtatggctggccagctatcgtatcaccatttattgaatagggagtgcttcccccattgcttatttctgtcagctttgttgaagatcagatggctgcgggtattcagctttatttctgtgttccattggtctatgtgtctgtttttataccagtgctatgctgcttcgattattgtagccttagtatagttttaatttgtgtaatgtgatgcctcaggctttgttcttttggctcaggattgttttggctattcgagcttttttttggttccatatgaattttagaatagttttttctaattctgtgaaaaatgacagtggtagtttgacaggaatagcattgagtttgtggaatgctttgggtgtatggccattgtaatgatactgattcttccaatccatgagcatggaatgtttttccaattgtttgtgtcatctatgatgtcttttaccagtgctttgtggttctccttgtagagatcttttatgaccttgcttagctgcattcctaagtattttatttgtgtgtgtgtgtgtgtgactattgcaaatgggattgcattcttgatttggctctcagcttgaactttattggtgcacagaaatactactgatttgtgcacattgattttgtttccaactttatagaagttgttcatcagttcccggggacttttggtggagtctttagggttttctaggtataaaatcatatcatcaaggaagagagaaagtttgacttcttcttttcctatttggatgtcttttatttctttctcttgttagattgctctggctaggacttctgaatgacagaatttttaaaagtcaccatttggcaatgatcatcatgataatgtttaattaaattaaggaacatcattgcatactgaaattatacaagtgtgggagtgggatgagaaagcttaaaagtatctccctaccaaatgcttataaattacgatgtggaaggggaagtaactttacaatagagaaacttgattggtgtcaagttaatcaaatgatcagagcgaacgacattagtgatgggacagattgacaatgaaagctaataggactcaccaagaataatccagcatcacttctgtgctattttggccaaaaaagcataacccagttctaatcatcagacagagccaaatcgagggacattattcaaaacaaccaacctgcagtcttcgagatgtcgaggaaaaaacaaggcatctgtttcaaactggaggcccgaaagacatggcaactaagagccatgcatttagagagaatgcaaagtcccggatggattttcttgttacaaaaccattattgagaagcttagcgaaactcaaagggggtttccacatgaagggtatgtgagagttctttgtatcattcctttaacgctctgtattttgaaatagtttcagaataaaaatggaaatggaaaaaaatgcaatgttaacatatacgagttactactttcaacaagttatcttccttttcatgcctcaatttcttcatctgtaaggtgaagacagtaacagctacataaaggttattgggaagagatggagaagcccccagccgaaggtctgctcacagcgtaaatgctcaagccctggtcattatgagtactacgttcttgccaacattttcttgggtttcttagtctctaaaagatcgtcaattgcaagacacggtattttacataccactgaaggaaaaaacaaacaaacaaacgaaaacattcaatgaattcctgacggtgtgattcttctcgcttagaacttttaatacttattgagagaactctgttagactcattcaaatgtagatttttatcccctgctgctctatgatgacttttaaaaggaaagggtcagtcaagtgaattggctgaggtgttcctaaagctccttcacattttgggtctggtgtccggagtgattttgactcagagtctcgggttcttcgtttctccaccagacagcatcctctgtgctcctgagggcatccaggcccgcagcctcccagtcccacagaggacctcagcaaagacaggcagagtggggacacctgggagaaaagagagcccgggacgtcactttaattccatcctctccagccctggagaagcccctgcagggtttttccatgccaggcagggacctcacactgaccggagtgcctgagagaaccacacatgccttcctctaccctgggctttctctgctagggtgaggccctgccagctcttcctggccaaccctgcccttcctggtaggaggaaagcaaagaacaacaatcaggccagaattccagtggcttcgaggcaggttcctgcccctccatttcctccattcccctcattcttgccctccattcccctcattcctgcctgctgccctttctcctgggaggcagccccatgtaggagaaatatgactgcgttttgttgtgtcttggcactgtgattcatcttgtctttattcaaacttttcatatttggttcaccgtgaatagtttctgcatcagttgggatttttttaaaccatattgcattaaaatattacttacaacaattactgaatttttaaatgcctgtttaaattttgagcacgagagactgcctcactcacctgaccttaattctgctggccctgctgtgctcatggagccactcattcattcattcattcattcattcattcattcattcatctattcatttgcacacagtcaaaggtgcaatttctcctctgtaccaggccatgtgctaggtatttgggagggaagtgcaagccggacacaagccagcactgaagatagtgtcagaagaaagacagccatgaacacacatgaccatatgacacatggtggggtggggcggcagggcaaagaggacatcggggaaatcaacatgccaccagctaccacttgtagggggttctcctgtggccagctctgagctaaggtcttcctgcacagaatctcactggattccctcaacagtccttccaggtttgtagatgcttctgcaaaagtaacagacagatggatgtcccgaggcttggggaagtaacacgcagatgatttgcacaaggacacgctttaagaagcagtggacttggaagtccaacacagatctgtctggctctgggctcaaaccagctattgttattgcagccacttccacctgcatccccatcaagcagtcagggaaggctgcatggaggaggccctgcgtcagctgaggcttgaaggaggcctaggagtttataggaaggtaaattggagtaggaggctttctggaagtaagaaaagtcacgtgcactattagcaaagtaggcctgggccggcactgcttcctctttctgcttctctgtttcctgatgacatcaacataaataggaaacgtgggaggctcactctgcctagaggctccagaagaagactggtctctcccaccacacagaggtatggcccggcgtccaggagcagggctgaggggtggggtcagagcaggggggaatgtggggagtccaggatgaaaaaggacagggggagcctggggggcgtcctgtgggtagctgtgccctggggacttggaggagttagggcttggcctcttaggatgacctgagcccagactcctagggcggccagtggatggrgaggcagccaggggtgccaagctgcttgggtgttgtaggagagctctggggaggactcagcctcgctagcgggatctggttggtcctggtgggaaggacgcctagtggggtgaagagagctcaggcctgrgagtcaggcacctatagtctgtcttcgctttgtcactaagatgctggtggtagtgagagcaccccctgtccaccctgggcttctgtctcctcatctgtggaatggggagcatggatagtccctgacatcttggtttagaaagagagagaacgcatgctcgtgtgtttgccygtgtgtgcatttgtgtgtgtgcctgtgtgtgtatgtgcatgtgcggatgtctggggatgcaggagtgcagagagactaagaggcagagggtgaaacctggaagcttgctgcgctgaggcccagagctgggtgcggtgtggcttgagaagctcactttgaacttgagaaagagcccagcactttgcccagagacataccaggcactatccagcaatctctctctctctctctctctctctcagtctctctctctgtctgtctgtctttttagttatgacactctgccctgctgatttgggttgctgatttgggttggggcccaggtgtgtgtgttctgtacccaagtatgctggctgggtgggtgggtatctggggtgcctgcttcagggtgtgtgcaggtgtgtgtactggccctgagaatgaaagggcaggtgtttcactgggaccttgtcagacaggtgctagcgacaagctgcatatgtgcaatttttagtcttcaaaaaccctgctgttatatttttgtacagcccaattctaatttttttctatcatctttcctgctttgtaatcattttataatgagtaaacatttcctattagcttttggtcactctttttttcatccagcagttttatttatattgttccagtatacagatataccaacaccacaggataattcatgagttgtataaggaatgtatttaatgctaaacaagcaactacacagaaacctaccttcatgaaaattagaataatctagaattatgtagcacaagagacaaagtccccagcaatttcttttccctagttccatagcttattcttttcaccacatgtattcttccagaacattttctaagcatgatacragcatatagtttttcttttcctgtttgttttttgttttgttttgttttgtttttgtgacagagttttactcttgtcgcccaggctggaatgcagtggtgcaatcttggctcactgcaacctctgcctccygggttcaggtgattctcctgcctcagcctcctgagtagccgggattacaggcatgmgccaccacacgtggctaatttttgtatttttagtagagacagggtttcaccatattggccaggctggtctcgaactcctgacctcagatgatccgcctgtctcagcctcccaaaatgctgggattacaggcttgagccactgtgccaggctggtagtttttctttttacagaaatgggattattttatttatatatatatatatatatattcctaattttttcacttaatattgtattttggaatatttccaaatttctacaataatacatacagatttaactcgttaagtaaccctaagaaatatgtggcatttattaggatgggtacaccacaattcatctaatctcacgttgatcgacacctagattgtttctaatttttccacatctgtgaaagtgtttctgtagcctaaattactaaatgcagaattgctgtgcagaggttgtgcgttagaaattataataggtattgtcaaatcagcctcaaagtagctgagctaagctgacgtccccaaggtagtgcataaagggkccaatttacctttagagaaattatcaatcttctaattttgtccaatattatgtatggaaattctcaatgtygcgtgatttttttctttccctgattatgggtgaagttgtacattttctatatgtggattggccttttggatttcatttatgatgaatgtggagaaatttttgttcatctcctgttgaattctcttttacatcttaacttttggagtgactcatttattacgtgtattaataatccatttatatatgttgaaaatatattctcccaggttatgacttatctttttctttaccatgtttaagatgtcttatgtcatataaaaatgttttcattgttaagtcaaacctgtcattacttyttactttatggtttctgattttggtgtcttgtaaacctctaagatcacaggtgtcttgtaaacctctttttactttatggtttctggtttkgtgtcttgaaacctctaagattacagaaagagttttaataattttactattttggttttgactttgagatttttagcccacctagaatttagagaagtgagtaatgtgtaaagtaacttttaaaaataattaccatctaattgtcttaacattgctaattatgagtgtgtgatttctcctctcttcaatgatttgaagtgcccctattacatcctaggcttctatacatacttcgttattttctttattgttttctcttccatttggctgtcactacattccttattatttttctarcgaatggagcaagtctctcatctctggtttgttataatttagaatcagtttgccaaggccaggcacagtggctcatgcctataatcccagcactttgggaggctgaggcaggcagatcccttgaagttggacgttcaagaccagcctggccaacacggtgaaaccccatgtctactaaaaataygaaaaattagccgggtttggtggtgtgcacctgtaatcccagctacttgggatgctgaagtgggagaactgcttgaacccaggaggcaaagtttgcagtgagccgagatcacgccactgcactccagcctgggcaacagagtgagactccaactcaaaaataaaaataaaaatcagtttgccaagcccattaaattcctttttggaattttcatgttgattgcattgaatttagagatgatctgagggacattgaccactggaagtaaagacaatagtgagagcctcctgtgtgaggctttgacaggaggacactaacgtgcccccttgactctgtcatcgcctttggtttctggcagactttcagtgatgccaacgtttccgccactgcttcatttgccagggtttgtttgttcatttaaccagaaatgtcttgtttattattaaatatttaggagtgtctgtcaagatcagcttatccttttttcccttttaatccgttcatctgtttgtttgaatcataaataggtttcttaagggttctccttccatgtatggagtaccctctacttggccatgatgtcttcttcttttaaaagtctttgtcaggttgacctatgaaattgtttttgtctggagtgaatttgtattttgcttttcccccctagtttttatccctgccattcaatttcttcataagcttgggaatgtttatccctgccattcaatttcttcatgagcttgggaatgtaatatgtgcatgtttattttgagtaagaaggtgtttggtttttctcttctcttttctctctcttcctttctctgtccctcccatcccttctctgtcatcctcctgtccccatgcttactcttcattcttagtgatttttaatctttatgtttttagggatttaaaatgtattgaacttatattttctgggtcgggcacagtggctcacgcctgtaatcccagcactttgggaggccaaggtgggcagatcacttgaggccaggagttgagaccaacctggccaacatggtgaaacccagcctctactaaagatacaaaaactagccaggcgtggtggtgcatgcctgtagtcccagctacttgggaggctaagtcacaagagtcgcttgaaccccggaggcagagattgcagtgagccgagatcatgccattgcactccagcctgggtgatggggtgagattctgtctcaaaaaaaaaaaatagtattttttttaaagaaaccatatttgctrccagcatttgggtttatttagcacatatatgatcttccaaaacaagaggagatctttagcaagttttcagttctcttccattctccaccccagcctcacagcaaactcccacattaaaatcatctgagttttagttcaatattcttctttaacttatctgtaagtgttacwggtttmtttacctcagtatttcagctttcttggatttttttttcctgaaatataacctagagtaatttctttcagaaaagatctgaaaaactttctttgtccttacatacycaaaattttttgtgtcctttaaatgtcaaagaaaacttggcattttgtgattctaggtttaagcataattttcccttggtattttcaagacatctatttaaagttcagagtctcttatgtgaaayctttagccaatctgacccttgttgcattcaaagtatcctatttgttttcttctggaagcatttctgggatcatcctcatattcttgcaagasgaaaagtttaccagtgagaactaggyatggctttattaaaaggaatcttgggagttaaccctgatctctgtcccctactacaaaacctcatcgtagtagcctccccccttgaatacagattccttactgtctttgaaaaatattttaaaaaggagtcttgttctttattgagtggcctcttgtctccttgaaagccctgtgaagctttccccatttgctgttgtatctgtttggctgcacatggaaaatccctaagcaacagwggcttaacaacatagaagtttctttttcccagcatataaaagatgcccagaggtagcagtttcaggctagtatggttgctccagagtgagagtgggaatccagcttcctctctttctgttgcatcatcttcacatatggcttccatcctcaaggtaacctcatggtccaaaatagctgctgaagctccagctatcacctccaagttgcaggctggaagaaggaagaaagacagagggacaaaaatgaacccctcccacctaagtcaactgccattgagcagccttttttggaagacatacacaatgtttctattctcatctccttggatcacgtttagtcacttgactgcacctagtggcaacggagtataggaaggaaatagacctttttattctgtgtagcaataaactcagctaaaaccttggcttctgttgccaggaggaaagggacacggtcttccattgtctttcagactaggtagctgacattgtctgccatacctgctcttaattctctccaccccctgcttctgaatgctggaatttttgaatttctttcccaaacctaaagttttctctaagacttttcatctccttgactatttgctctattttatatatctatctttttcatttgtggtatccattctgtggtttggcccactattgattgttgttgtttttttgtttgtttgtttttttgagacagagtctcaggctggagtgccatggcaacggtctcagctcactgcaacctccacctcccaggttcaagcaattctcctgcctcagcctccagaatagttgggattacagacgtgcgccaccatggccagctatttttttttttttttgcgtttttagtaaagacggggttctaccacgttggccaggctggtctcaaactcctgacctcaagtgatctgcccaccttggcctcccaaagtgctgggattacaggcatgagccaccgcgcccaggctttgattgatttttttttaaattatggatctcatatcttcaaattccaagaactctgttctttgcatagaagtgtcttcttttaaatggctatgattctcaaatctccctgaggatgctgatttagatgtcttaatgtactcttttatttttgctgtatctgtacatgtctgtagaagtgtctgctgggttagcatatgtcagaatagatgtgcgctgttttgacatttgggaaactgaatcactattggcatagaggtcagggacagagtctagaggcagcccactgcgggctcgaatctcaacctgttccttaccaaccgtgtgactgtcgaccaattacataacatcccacccctgttttctcatctacaaagtggagcttctagtggtaacctatacatagatgtattcatatccgtaaaaccttttgaataatgcctggctcatggaaaacactgcaatattgtcagccactatcatgaattctctctgtgtatgtgagtactgtttgtgctctttgatgatattgatttgttttaaccttttaaagtaaaagacactaacctgtcctccataattctggttggtatggtctatatgttgaagtgcacccaagtttatgttgcaacctaakccccaatgtgagaatatctggaggtagtgcctgtggcaccctataaaataccccagcgagctcccttgcttattccatgtgagattayagggagaagactgcaaggaacaggccctcaccagatagtgaatctgcccgcaccttgatcttgaacttcccagcctccagaactatgagaaataaactttgttactagtaagccactccatctatggtatgttgttacagtagcctaacggatgagtacattggtgcaaagattttctgtttgcactccgtcctttccttttatggttcagtcagtttgacaaattacagaagatttcacttttatgtacttctgccagcctttgtctctgtgatgtctcctatgcttttaagcttaaagagttcaaaggcattcactcctctggtttgcagctttcataggatgtaacattttacatttaaatttataattaacttgttatttggggaatggtgtaaaatggggttttagataggcatttttatgttgttaatcaatgattttagcatttttttaaatttaatatttcatcgcttcacattgattcctgattccttctcagtctggggtcaagtagagtttgtttccagccagcatgtccattgatagattctgtgtgtgtgtatgtgtgtctgtgcatgtatctgtatgtgtgtgtgtatgtctgtgtgtaggtggtatatgcgagtgtgtatgtgtgtgtgtgttgtgcatgtatgtgtatgtgtgtctgtgtatgtgtgcctctgtgtgtgaatttctgtgtatgtgtgaatgtgtgtgcatgtttgtgtgtatatgtgtatatatgtgtatatacatgtatgtatctgtgttgttcatgtgtgtatgtgtgtctgtgtctctgtgtgtgtgtttgtatgtgtgtgtgcatgtttgtgtgtgtatatgtgtgtatattgtatgtatctgtgtgtgtctgtgtctgcctctgtgtgtgtgtctgtgtgtgcatttgtgtgtatacatgtgggtatgtgtgtgcatgttttgtgtgtacgtgtatatatgtatgtatctgtgtgtgtctgtgtgttgtgcgtgtgtgtgcctgcrtgtgtccgtgtgcttgtgtgtgtgtgtgtgtttgcrtgggcatcttgagtgaagcttccaacaatctaacagaagaaaaggagccacacttgtctgttctgctctcttgggtacttcccagaccagtgaaatgaaagggaggaaacccccggcctccgaggagaaaagggaactggcaagcagagggtggggggatgacggtaaaaggagcaggggtggggagagcacaggccctgtggaagtgaggacatgtgtgtgtacatgtgttcatgtccaggggatgacactgtggcatccaacagccgtggaccagcagcccacggggagcttagtaggagtcaaatcctaggccccygtctcagctgctctgctgtctagcgcattgtgcagtggtaggtgtcagtgatccaagtggggaccyagtccctcaggccacacagcgcatgtccattgccttcatgccgcaggagactgagrggtcatgcatgagggccacttctctgggttgtccccacaacackggcggtgtccctgggacaygtggaaggggaggggcagctcactgctgacatctccttctgcaggcctggaggaggcagaggccaggagggagaggtcccaagagcctgtgaaatgggtctggcctggctcccagctgggcaggaacacaggacttcaggayactaaggaccctgtcatgcccatggccagcacccaccagtgctggtgcctgcctgtccagagctgaccagggagatggtgctggcccaggggctgctctccatggccctgctggccctgtgctgggagcgcagcctggcaggggcagaaggtgagtcccgtggctcccacccacttccctgtccctgtcctcactgctgcaccctgggggagggccgcagcgtatcctcaggatcctgcccgccagccctyctcctgctcccctccctctrtctctccccctggccttccctgggcctcccccrcttccctcctcctgcacattcctgctcatcctgtcytggaaagtccagctgagcgtgtctggcttccttgcccacatttctcagggcggcactcccggcccctaggctccaggatggctgctctggccgtttccctgcccctccttccccagcagacactctctgtgcctcagtggttcccacctccgggactttgctcctgcagggccttggctggggttctctccctgcttcagccgctagcaccctccttgtgcctgaagcccgcactgggatgctcctgggctcttgaggtgaaayggcccctcccaagggctcccagagacctggcttctgtgataatgctgggaccacagtccccttaacaaataccaggctcctgaggacggggactagagaggaggtgggaggttgcagggtagaactctgccacgctgcatcccagggctgagtgtgtgccccctcccaggctgcacagtcggtccaggggccaggcctgtgcttgatgcatgtccctgtcctggggtggrgggaggggaccgtgcccaggaacagcacactgcggaggcccagaaaccatgctgagaaccaacagaatgtcktgcttctgccaggagaggagggtccgcaaccaggagcccaccccggcagacatgaacacatgtacatgtgcctggccacctggtgcctctgcagggacctgggagacccctccccagagcgggacatcccaaagcagctgggggtgatggtgacaagggtccctgcaggaaagagaggtgacccccttctacccctcttgtcagaaaccatcccgctgcagaccctgcgctgctacaacgactacaccagccacatcacctgcaggtgggcagacacccaggatgcccagcggctcgtcaacgtgaccctcattcgccgggtgaatgagtgagtgatgctgggkgcaggggccacgggcaggggctacgacgtcccctgtgcctggcatggggcgacagtgtagagagggacctgtcaggtcagcctcggggtgggagtggacagaggacagaggaggagggaggccctgcaagagctcctgctccgccaggcacctgcgaggccggstgctgccgtctgacctggggtttctgcggagtgcctcctacactgatgttggtgacaatggtggtggtggcaatggtgaaaatcttctcttgtttcatcacaatttaacacaattgccccacatgacctatcttagttcctcctcactgtgaggtgggcagggccaggccacgaagccccagctgtgccactgcctgcctgtccagagtagaccaaggagagatggcgctagcctgggagttcacagatgggaaaactgaggccctggaggtgaggtgccagccctggccacggggtagacagtggcagagcaagctgtgtggacgtgtctgggagggggctccgcgctctcccaggscccccctccgtatgtgggctgccacctctcccacccaagctctcctgggcacgtgccacaagggaaggggaccagaatcgctctggggtgttggccagggtctaaatcagccataaattaagtaattaaatagctggaaccagagaggcagatgacaacccattggaggtcaccccagcgttggggggcggggccggctctgccacccccacccctccaccgccttcagttctccagggcgtctctgtcggaccttctccattctcctcaaagaccatcctgcccctccctgtgacctgcttcctgctgctctgacacaacaggggaccagggagaagctccccacccaccccacactcacactccccaccccctttgcccaccgccggggcctgggcctggaccagggctcctgtctgaggcctgagacacgatgctgtctggtcctgttgctcaggaacatcacggcccccaagtccccactctgccctgtgccacccaccatgccctctcccaggatctttcccaattgccttgcaaacctgccccaaccccctctcagatgcccacaggagtgcagcgcctgggcatctcctgacctggcaaccctgcggcccctctttctctgcttcctttgacagcagcattccctaaagagttgtccacattcaccacgtccagtgtctttccagccatttcctcctgggcccactcccctaggatgctgcccccaccaggccacccaaactgctctggtccaagtcagcaaatgtcccagggagcaggatctcatggttgggcctccgccttcttcctacttgaccaggggcagcccctgacaaggaggaccaccgcggcctccctgcagtttctcttgcacctgactctgcccacagctcacccagtgcccccggggccctgcccaycctcctctttctccttgtctgctgcctcctgatggcaagacacccaggcccagtccatggacctcctctctgctgtatccactctgcagagaccccctcaggcccctggggcatctcccaaaggtgacctcaagcccacaattcccctaagctccagccctccaggcgtactggcctctccacctgtcacttagacaacaggtgtcyccgactccaaacgtcctcaaccaaagtcccgctctcacccgagctgcgctgctgcctctgtcttccccatctccctttctaaatgggagctcctagtggctcaaactaaacaacagggaggattttgttttgtttttaagtctcttttgtcaccattccttcctgactgctacatccctccaccagcaaatgctgccaaccttatctcaagcagaacatgaatctcacccacgccagcctgaccaccctgttgcacgccacttcctgtcacctgaatattccagaagcctcgtaactgggctccctgcttccaacattgccacattcccacctcagtctattcgcaaccgaggaccctcaggaatcctttcaaagcatttatcaaaatctacaacacctctgctcatgactgtttcccactcactcgcagtgagatccaatcccatcatgtagatggatgggtctcctagacctccctatcacacgctctactccctgcgcactggttttaggccaagccacgcagcacaccaaactctgcctgtcccagggcctttgcacgtgctgttcccatttcctgaaatcctcacaatttgcacagtccctccctcaatgcctttaacattctgcccccaggtcacctccttagagaagcctgcttgtcccatatttcaaattgcctccctggcccagcccttcctscctcctcacctgcttcttgctttatttttccacatgaagttctctccactgcacacgctacacactttgttccatgcrggtccccttctcccaggatggcagctccgtgggcaggatttttgtgtgttttatcactgctggcccctgattctgaacagagccaggcatgtggtgagcactcgaggaacctttcgtgagtcagtgatacccatacaccctgggctaagccgtgtcctctcccaacagggacctcctggagccagtgtcctgtgacctcagtgatgacatgccctggtcagcctgcccccatccccgctgygtgcccaggagatgtgtcattccctgccagagttttgtcgtcactgacgttgactacttctcattccaaccagacaggcctctgggcacccggctcaccgtcactctgacccagcatggtgaggggctgggggccctgcccggggcttggtttcctgtgtggacagcgggggcaccaggggtggtccagggagtcttcaaggcagaaggctgtggcttggggttgggtgagggtttcttgagggatgagggtatggtctggttacatggagacttcagagcagaggggcccctgacaaaggcttctcctgtgcccctggctgctaccacctcccactaagccatgggcttccagcactgcaggcttgtcttgaagaaaaccgttctcaccactcacttagaaacctaccaagttagaaaactctgtccgcttagttgtttcatctcatctctgaagcaacccatttcctggatgtggcccttgaggcccaggaggtcagatgcctcctctgaagtcccacagctgagcagtaatgacagagatggggtcagccttcccgggggcttcctgcatggtagacagggagcttgtctcctcgctgccctggaggaggggccccggtgtgggccgaaatcccacagtggtccatgaagccatctgtggtctagggtggggtagatgattattttatgtagttaggttttatttgcctctatattagaaagaaatataacctgcacttcgaagtcctggattcaaggaaatggttgcttagaatgaagctaaacctgaaaagggacacgttttatgaaagttttcgttgacgtggcaaaaacccatgctggtggcaggctggtaggaggtactgcaggctgtcattgggagtctcagaaccacggcaggcttggtgctgttattggtgcctttggctgctgctgaaacggagacagagggaggtgactagtccaaggcctctctactgctgctggcagagctgagatccagtgcaggatggtctgagtccccggtcctaaccaccgaaccacctggtgctctttgcaagggtcacacggaaggggctctgaccatggcttcctgcccttttttgccacaacatcataaagccactgccagaggaggggatcagttaggccaccaggagtccatcagaagcaacatttccacacatgggtttgatggacacgagagtcccttccttcccgaatggagctcagggggcccaggctggagggaggggaaacactgtatgccgtccaccgtgagaacttactgacagtggcgggtgggtgcctcatgcagggggtaaagggcagggcccctgggagatcagaacaggcttcccagagggaagagctttgcaactcagatctgaagggtagacaggaggggagggcagtaagagcctctctggcagggtaacagctgtgcagaggctgggggatcagaagggcatgggcagctggggaacctgctcaccattgtgtccagggagcatcagcttcaagggctggacagyggtgggaagaagcaggagacacaggtaaggacctgtccctggagaggcttctgtctcctgcagtctcaggtagaggggaccctctaggcatggagagcactgaggggaaatgacatgatcagatgtggatgtgagaatgctggggacaggggacttacagggtagattggaggagcattagttgggaaagaagttgaaattcaggctgtggcctaaagcactcattcctagaaatgatgaggacacaactggctaggagatggggacatgagggcatgcaaatcatagttcagatatacacacaattcattcattcaaccttctttccttgagcgcctacataagccaaygaagcagtcaacaaaccagccagcaaccctgcccttggagcttacagcctggaaacaaggaaggtttctaaggcgatggagacaacttagatatagggagagaagtgtggcccttggcctcctggagcctgtgttgagtagcgaggtagggtccagcctaatgcagattagcaatgaatcaaggatgctgggaggtactgggcaggcgacaggcatgcatctgatctgctctgagtctccatgtttggagaccttggacattttacttcctctatgagtttctccgtctgtgaaatgagctggtggactcaagaggtttctcttgagttggctgagcaggtttctgatggggctcccagtctgcgcagtttgtggcagcttccgagagggctctgccgggaagagctccccctccatgacagcctcgggggctgggagtgcagtgacccatgagggacgcctgtcctggctgtgggtgaggaggggcggttcccctgctgtgtgtctgccgttctgggttgatggttcctgacatgctctagcatgccataacccatgtccagcagagagcacttacatcctatgtgtgaggatgttttcgtttgaaagccatccctcagcaagcagacaccagaaaccagaaatcaggtgccgtgtcttcattctgcattttcttgaacaacccagagttcccaggagatagatgcttgccttgtggctgcaaggatttcatgagaagccccaaagttgcttacgcgtatttgttcattcattcactcattcaccttgccccataattcactgagaagccgcatctcagcctggaggtagggaagggggtcaggaccaatcccacccacccccatctcctcacaccttaggggaggcagacacagaagcataggaatccctcagctgtggtaaggccctggtggagggaattccactgagctatggtgaaatgagagaaggaatgagggattccgcctggagatgcagatccgaggatgttcctagagccggaggcatttgcccggggcactgacaacaggaaggaccctgggcaggaggaagggagcttggacagcaggaggggggaggccgctgaaccgcaggcccctctgctagcaggagccacccaggccgcagcgtgggcagtggggagcctcaggacagaggaggctccaatgagtttcctcgccagcgctttttatggagttcgggtcacgtgcgcattgcaatctgcacggctttccattgctttcatgttgaaaccctacagttttgcagatgaagggctgaggctcacagaggagacgggtcttgctcaaggtccctcagctgctgggggcaggggtggcctggaaccccctgtgtccacacaaaaggccatgcaggccctgactgccccccagcrgtccagcccttaggtgcccttcacttcctcccctccagtccagcctcctgagcccagggacctgcagatcagcaccgaccaggaccacttcctgctgacctggagtgtggcccttgggagtccccagagccactggttgtccccaggggatctggagtttgaggtggtctacaagcggcttcaggactcttgggaggtaggaaccacggccagctctgccccascccgaagggatgggcagcacccctcctccagcacccactgtctcctgacaggacrcagccatcctcctctccaacacctcccaggccaccctggggccagagcacctcatgcccagcagcacctacgtggcccgagtacggacccgcctggccccaggttctcggctctcaggacgtcccagcaagtggagcccagaggtttgytgggactcccagccaggtaatgttgccagagcccaggaaatgccccgtggtgggagggcaggctcatcaggagctcctggcacagcagggttcctgggctccacctgggggcttcccagatctcctgctgccatctttccagtagcgtccctgggccgtcccacctctactgtgaccactgaccagtaggactctgcatctgttcactttgggtttccagttttctgcacgttctctgccaatggcaattacaataataacaacaacagtgctattagcagctgtgtgttaatggaggctacaggatgctcagggcttacccacatttttcagttcaatccccaaacactgaaacttagatactatttccattctcccgggagggcgtgcaggtgcacagaactctctctctctctctcggagctgttggacacacagctggcaggttcaggctgaagtttcagccctggtcttttggccccagagctcatgacctctgtgtgatgaatcacacggtgggcacccactgagagctatgggagggatgaatgacggagtacatgaggacctgtctccaacccaggggatgaggcccagccccagaacctgsagtgcttctttgacggggccgccgtgctcagctgctcctgggaggtgaggaaggaggtggccagctcggtctcctttggcctattctacaagcccagcccagatgcagggtgagcatcttttttctccatcccctcccctcctcttggccttgctctctccaagcttcctcctgtccctggggccccagcagaagccacagcccaccctaagctctcctccctcccgtgtgccctccctctccctgccctcagctctgctgtgctcctcagggaggaagagtgctccccagtgctgagggaggggctcggcagcctccacaccaggcaccactgccagattcccgtgcccgaccccgcgacccacggccaatacatcgtctctgttcagccaaggagggcagagaaacacataaagagctcagtgaacagtgagtttgctcctagcccgctgtggggatggtctgggaccagcacaccctcattgtgtaacccgaatcagttcagggttcctcctggccccgtcttcatgtttgtcactttcaaagagatgcagtccagtgaccaaaagtgaacagagaagcaatgaaaccacgacggcagtggccaaaaacaggagcagatctttaaaacctctgatctcttgtccttttcttctgcttccctctcccatcctgcagctctctaaatctccactgctagccacaccctcctggtcctgtcaccaaaaccttccctttcattcctcattggattttcctctttctgatatccgaaattccccaccgactgatattctatctttaatgtaattgatctatgatgtacttttcaactggagcctgtggtgtgtacaaatagtgttgatccttggaggttaacatccctcgtttctgtgatgtaacaaggaccccagtgcaatggaacctctcacgttgtttcatgatgaccaagttcttccatccagtctttagcatatgtgaagggcagaggccaatttgtcttaattacctgggtttgaatttaccattaactctcttgggatcctcactggaaaaaggaattctgattgttcaaaagcacaggatatattaagggcctcatataatgcctggcacataagagacctcagcaaattacgggcattcatattatgtttatacagtgaaggcatcaaggttataagcattctcttttttcttttgggtagactgaagctcagagaggttgagtggcttacttaaagctgcacagctattagtaggcagatcaagattagagttcagaacttctcactccctgcccagtttctgctttctttaccctttgcctctttcaagttgtgggtctgccggccaggtgggaggtgctgtctgcaaagggcttccctttctctttggccactatctggctggggagaggcctcacctagatgttgttgaaggcctgttacagccgctttattggggattttctggcgatgagaacgtgtgaatgtcctggcctttagtcaactccctacacctctgagagtgtcagacaagagagcccatcacactggtgggattgcaatctttgcctctaccactgcttagctgcctttccttagggcaagttacttaatggttctgtgactcagtttccctgtttgtgaaaagtgaaggttaatagtacccaccatatagggctgttagaatggagtggaataattcatgtagaataagtatgtataacagtggctaaaacatagtcaggctgggcgcggtggctcacgcctgtaatcccagcactttgggaggccaaggcatgtggatcacgtgaggtcaggagctcaagaccagcctggccaacatggtgaaaccccgtctccactgaaaatacaaaaattagctgggcttggtggcgggtgcctgtaatcccagctactcgggaggctgaggcaggagaatcacttgaacccaggaggcagaggttgcagttagccaagatcacaccactgcactccagcctgggcaacagagtgagactccgtctcaaaaaaaaaaaaaaaaaatagccagttgcctagaatagaaccaactaacagtggttttatttttactgcaaaaaataaaaataaaaataggagtagtgcaagcactgggccacatcactacaaaacaagtgtatctcagcatctcccacgagaataccactcaggtcaaaacatgatatagtgaagtggggatgaaaaggatccaaccatgggcagaacctggggtctggtgccagtggagacagccccagtgtctagcatgagacayggggratgttccgttggagggtgggtatgatgactctcctgaaagcttccctccctccagtccagatggcccctccatccctcaacgtgaccaaggatggagacagctacagcctgcgctgggaaacaatgaaaatgcgatacgaacacatagaccacacatttgagatccagtacaggaaagacacggccacgtggaaggtgagggcctttgcccaggsasgggagaaacactggggagggcgggagaagggaaagcarccagaggcattccacctgcaaggcgtcgggcccttggcaggtgaccagtgagaggtagccactgggacgtggtgatcactaggctgtgtggtcagcaggtcactstcctgtctcttggtgaagtaactgaggtttggaaaagtggcgtggcttggccaacgtgaacagctgaccctgagtccccaggcaacagaagaccctctgggcagggaggggttgaaaggccactgggaagaaggttttcaaaagtcatgaaagtttggggttatttcctcagaggaatctcatctggacacacatggaggctcagacagagctgcttctaatgagtcgggggtgcgcccaggccagggctcggtcccctgcctccacagagcccagaacagaaaccacagaaccaaccccacaccttcagtctagaaatggggcaactgaggctagragggaggtgggccagtggtggagccaggagcgggccctggggtcctgaacccccattctcagggtccagagtccagtcggcctgcactgcgttcctraaaaggccacaatatgggtgcaagctgccccagaagggctgggagctgagaaggctcaaaatagggtgggacaggtggcttcagggttctgggcctcagtgttgtcaatgtcaggggctgcactgacaggyggagtccccggtgccatccgaagtgctgtccgtgggtgggccctcagggaggatccacggtggtgagagagaagccgcagcaggcctggggtatggcaggagctaggagccagcgaagccgagggtccaggtgggagggatttgcagctgctcccacgggcaccgggccaggcctcaccctcagtgccaacccacaggacagcaagaccgagaccctccagaacgcccacagcatggccctgccagccctggagccctccaccaggtactgggccagggtgagggtcaggacctcccgcaccggctacaacgggatctggagygagtggagtgaggcgcgctcctgggacaccgagtcgggtaggtgaaggctggagtccagagcttctggccaggaycagctcayagtttctcactgccagaaaatccccaatgcagcagccgtagcaggcctgcaacaacttgtaggtgagccgtctccccgattagatggtggccaaagrgaaagggaaggcctttgcagagagcacctcccacctggtcatcagacccgcaagttgaaagaggcaaagrgtaaagcaggcagaaactgggcgtggagtcagaagttctccacccactcttcatgagacagcacagctgggcagaggatgccacatctctgggtgggcacagagatgtggggctccagaccccactccactcaggcctccttccctcccttggaccactagtcgttggaaagtgacacctggtgttcagtacagactgcaagtgaggacttgagggagcagaggagagcaggtctcatgatcgctcctcctttaaactgggacttaggcttctgttaatatggcccttggtttcttagcttttgggactaccaagtttttgtggttgctcagcccgagtttcctgttaccatggaagcaagaaaatctagagccacagactgggtccttggattggaaggttttgctgtgattccttcatcttcccacctccctgcacttgctgcgtgcactgacccctcacctttcaccayagtgaccaccaggcgactcccgcagaacaagacaagtccaaggggtggtttcagagasagtaaggatacaggagatattgggagcaacccaagtccccagccaggcttggtagcggcaggggcccagggagagggccacaaccaggtagaaaggaggccggaccaatgggcccaagagaggaggaagaggggagtcctggaggaacctggcctgggagctcagggctgggcagcaggtgggatcaggggcctctggaggggcctttgctcctgctggtgcctctgccactatgcctttccccatctccacctctaatccttcctattactggaggcccagctaatatgccacctccttcaggaagtcccctgtgattgccatgaacagtggttcttgccctccctgtagcacctcctgtgctatagatcctggaaaggatctgaccctcctgtgtcctcccagcactttgaacactgtgggggttcagaccaatgcccttcccagcatggatctggcctctctcccctaatcccccaaggcagtaagttccagagccctgggcctgcacagagcggggtcttarggaatactgcaccaaccccactccctgccctgaggtcgatttcccgcccagatgctgacattcctctttctccccggctgctggaagtgctgcctatgtgggtgctggccctcatcgtgatcttcctcaccatcgctgtgctcctggccctccgcttctgtggcatctacgggtacaggtgaggggactctgtggggctggaggtggcagccgagaccccagagggcactggggaatcccacccagctccctccaggccctgctctgccgctcccttcctgggcctcagtttcccctctgggcatgagcatgggagcagctggccatgaggtctctgatggctgtcacctccgtggtgtcttccaggctgcgcagaaagtgggaggagaagatccccaaccccagcaagagccacctgttccaggtaggaactggctgcgwggggcggagtgggggcttctctgttcctgcctctcttgtctctgtccccacctcctccttcccttcctgtgggctttgggtggtagggatgtaggtggactgggctttgggagctttgggagtggggccagcacttggaaattcattcccgggattccctggagtgcccacacctggccctgcctgccagagctctgcatggagcccagtggagagaactgagtgtggggatgcctgggacagggtgggctcacagagggggttcctgctaccaggatggatggggtgtcaggaggcagaagggctccccaaggacaagatacctgggctgagctttgagggtcccagtggtgccaggtggcaaaagttkctctggctcagggcatcttgagggtggagacagaaacccttcaggaagggagctgaaggggtgggacaggaggctgggggccatgttgggaggctgagatgaccatggggaagacaccagcgtgtgggtgatgggagccctatagtcaggcaggcagggccagctttgcctgtggaggggtctcttggctggtgtggaggagaaatgggggtgagcatggagacaggcactccaggttagaaaaatcacaggaaaagggccctgtcctcaggtagcagggacatgggggaagtccccgcccctctctgggcctcactttgctggtgtcaaaaggccgtggccagtcctgaagaagtggagattcttctcttgtctgggggctccttgaatcctcctgcacccccgtcaccctctgccttgcccccacctcggacctcctgatgctcaccggcccaaatgtctctgctcttgcagaacgggagcgcagagctttggcccccaggcagcatgtcggccttcactagcgggagtcccccacaccaggggccgtggggcagccgcttccctgagctggaggggtgagtgggctcgtggatcactcctgacctttggggttcatacggggggctgactccattgtggaaatcagggactcaagtgaggctgcctgtggctcactgtgaagggatccaagggagctggtttgcactaaagcaggaggcacctgggggggatgtgaggaagaacttcctctttccaggtaaggaagtgccagacaaggggagtgaccggaagtgaaagagggaaacagttggccttcccctccctggctgcctcagaggcgtcacactgcagaggcctcatggggtagctggggctgcagactcccgggaactcggcgcctgagccggcagctgaccaccaactcggcagggagaaggkggtggcatggttgatagaatgatggaagggttgcccagtgcacaggctgggcatgagcctggtgctgaaggaggatggactttaaggtcaaaagggagagggtaccagccttgcagaggaagaccttgagctcagcatggaggatggagctcctgagccacggaaagactgaatccatgtcccatgtccttctctggggcccctgctccctcaaccctgtcccgttcaggttctctctgtgagatctgggggacatcagggcttccagagaaccatctccaccccaccaagacccttgtgcctgacccggatcatctgcccagggtggtcccaactcttctgcccatkttcttcccacagggtgttccctgtaggattcggggacagcgaggtgtcacctctcaccatagaggaccccaagcatgtctgtgatccaccatctgggcctgacacgactccagctgcctcagatctacccacagagcagccccccagcccccagccaggcccgcctgccgcctcccacacacctgagaaacaggcttccagctttgacttcaatgggccctacctggggccgccccacagccgctccctamctgacatcctgggccagccggagcccccacaggagggtgggagccagaagtccccacctccagggtccctggagtacctgtgtctgcctgctggggggcaggtgcaactggtccctctggcccaggcgatggkaccrggacaggccrtggaagtggagagaaggccgagccagggggctgcagggagtccctccctggagtccgggggaggccctgcccctcctgctcttgggccaagggtgggaggacaggaccaaaaggacagccctgtggctatayccatgagctctggggacactgaggaccctggagtggcctctggttatgtctcctctgcagacctggtattcaccccaaactcaggggcctcgtctgtctccctagttccctctctgggcctcccctcagaccagacccccagcttatgtcctgggctggccagtggaccccctggagccccaggccctgtgaagtcagggtttgagggctatgtggagctccctccaattgagggccggtcccccaggtcaccaaggaacaatcctgtcccccctgaggccaaaagccctgtcctgaacccaggggaacgcccrgcagatgtgtccccaacatccccacagccmgagggcctccttgtcctgcagcaagtgggcgactattgcttcctccccggcctggggcccggccctctctcgctccggagtaaaccttcttccccgggacccggtcctgagatcaagaacctagaccaggcttttcaagtcaagaagcccccaggccaggctgtgccccaggtgcccgtcattcagctcttcaaagccctgaagcagcaggactacctgtctctgcccccttgggaggtcaacaagcctggggaggtgtgttgagacccccaggcctagacaggcaaggggatggagagggcttgccttccctcccgcctgaccttcctcagtcatttctgcaaagccaaggggcagcctcctgtcaaggtagctagargcctgggaaaggagatagccttgctccggcccccttgaccttcagcaaatcacttctctccctgcgctcacacagacacacacacacacacgtacatgcacacatttttcctgtcaggttaacttatttgtaggttctgcattattagaactttctagatatactcattccawctccccctcatttttttaatcaggtttccttgcttttgccatttttcttccttcttttttcactgatttattatgagagtggggctgaggtctgagctgagccttatcagactgagatkcagctggttgtgttgaggacttgtgtgggctgcctgtccccggcagtcgctgatgcacatgacatgattctcatctgggtgcagaggtgggaggcaccaggtgggcacccgtgggggttagggcttggaagagtggcacaggactgggcacgctcagtgaggctcagggaattcagactagcctcgattgtcactccgagaaatgggcatggtattgggggtcgggggggcggtgcaagggacgcacatgagagactgtttgggagcttctggggagccctgctagttgtctcagtgatgtctgtgggacctccagtcccttgagaccccacgtcatgtagagaagttaacggcccaagtggtgggcaggctggygggacctggggaacatcaggagaggagtccagagcccacgtctactgcggaaaagtcaggggaaactgccaaacaaaggaaaatgccccaaaggcatatatgctttagggcctttggtccaaatggcccgggtggccactcttccagatagaccaggcaactctccctcccaccggccacagatgaggggctgctgatctatgcctgggcctgcaccagggattatggttcttttaaatctttgcctttcagatacaggaaaaataatggcattaaattgctttaatttgcattattttagttatccagtttgcacatatttttataggtatcttaggcatcgattggtattttttaactgggccaagcccattaaggtctttcttctgttgggtgctatcattttctgattaagtctttttgactattgacatacagtctttcacrgatggtggagtgtttttcccccaaatctgttgtttgtcttataatgttgtatatgaggttttatggtgtatgaatatgaatgcttctgtaatgtcaaacagatccctagtaaactccttcttcacttttactgtcagatttacaaaggtcctcccattgcaaagcagtgtttgtcctaatttatatattgtttttctagttcattttgtgtttccaacttttcatgtaaaattttaattatttttgaatgtgtggatgtgagactgaggtgccttttggtactgaaattctttttccatgtacctgaagtgttacttttgtgatataggaaatccttgtatatatactttattggtccctaggcttcctattttgttaccttgctttctctatggcatccaccattttgattgttctacttttatgatatgttttcataagtggttaagcaagtattctcgttacttttgctcttaaatccctattcattacagcaatgttggtggtcaaagaaaatgataaacaacttgaatgttcaatggtcctgaaatacataacaacattttagtacattgtaaagtagaatcctctgttcataatgaacaagatgaaccaatgtggattagaaagaagtccgagatattaattccaaaatatccagacattgttaaagggaaaaaattgcaataaaatatttgtaacataaaacaaagtgaaaccctgaatttgtgtgtgcatgttggtgtagttggaggaaggggttgctctttgaaacctcaattgctattgtaagtgatacagctccagtgactggaggaacaccagggtccttagtcttgcgccgatttaaataaaacgacacggaaacacatggagtggttttaaggagtggagagtttaataggcaagaaagaaggaagaagctcccctgtacagagacagagggaggggggatccaaagctgagagaggaaaccctgagtgccacagaaataagccagttatatgaggaggctagagaaggcagtatctgatttgcatagggctcaggggattggtttgaccaggcatgtcattcatgtaacccctgaaaaacctggccctttcaccctagcattttaatatgcaaatgcagggcgccatgatgttctacacaggtgggactatgtgggggtggccatattgccaggcaaacatggggacaaggaaaagatggcgggaatccccatgtttgggtggacccagtttctaacggtctgcatttgcatatcaaaggttgccagcctgattctaagagccggggctttcctgctagacaagaaacgttttttggagctgcttttaaaacagaaacgaaaacttcccaaggaccacttttcctctttatctgcctcaaataattttttaataattcctataacacaaggaaatgaattctgccaaacagaagggcctttggtctttggggcactacagtgggtacatgatggcgtgtggaacaccacgcaatggagggagacgcagggcactcctgggaaaatccaggagggatgagggaagaggaaagacagtgagggaaaggaggataaagaacacacttttaaaaaatcgttcattattatctgaaattccaacacaactgaacgtcctgtatttttccctagtcatgagagtgaaaaactaaatagagactgagttccccatacaaataactgagagtgatcgagagcttattcctggcaggccccattcgagtgacctctaagatcaattcatttagatactatggaagtggaagatactatctttatcatttttgtcattgaggaaactaaggcacagagatgtcatacaacttgccccaggtctgccagcaggtaaggggcagagccaagatttgaactgtagccctgtgtctcagagcctgccctcaaaaggtaagtctctcacctaaagatccatacggagatgtaagatgatccatgttggttggcaagacagaaaaatccataaaccaaataaattgatttggtggcagggggagattgaatcagaggtgaccctgaaaagtgtctgtttatctgggagctgaacactgaaggtgcaattctcacccattggagtccagagagaccttccctggaggactgcagctccctcatctgtcttcccctgagaacccagcccagagccatgcatgtagtaggtgatcattgaggtgagcaaggcctgcaggaggctgtccctaagatggaggagaacaaaaaacttattagggggatgaaagggagggcaggaagcagaagtgggctagggaagccattggccatccagagttgacatttgtccccccatggggaacttgggggatgaattgcctgttggaagagcccatgttgggtggaaatggccagtcccggagcccttcatggtggggaaccctgagaacacactacataaggaaggagcagggctggagaccatcagcagcttgggcctcacaagcatttcacatgtttaattgatcacacagaacccttgcaccaagacaatcgtttgctcctagagggagcctttccttcgtttggaaacaatcctttcccaaccccaacaaggcaacctgcatccggtggtgctcaatcaatagaagctgggcagcccgggtgcagggtcagtgtgcccaaagcattgaaatgcggtgatttgggccatgggtcatgctgggtgtcctgagcaggggtaacttcatctacccagtgacgcaggtagcaactctctgggtctggtggcacaggaggtaaaggaatttaccaagccagttgtaggtaaagaaaggcagatttattagagaaggtatgaaaatacgttgcaaggtcgcaattacaatgagcagagaaggggctgtctgcaaagaggcagtggctgaagggaagtttcatagagtcacgttgaagagggctacatgcagaacaagcagaacgaggttgttgtgcctggttgtttgtgattagctgtctctcagaacaattgatgacttttctccccacttggggccctccccaacctggggcctcttcctcattgttgcttatttatcaggactccaccagggacagagtcaccctacaagtcctaactcaagtgtgggttcttcttagaacacagcccctccagctcccttggaaatccccaagtcttcccaaacgatgtaggacttttcttcttggtcactttgcaagccggggcccccagtcagtgatgccttgcccaggtctcactcggccacgctatcgcgtataacttgtataacttgtacccatgttcagtggttcctgagcccttgtacctcgcccaagaagaatgaagatatactggacattggagggtgaggagggctgagaataattttattgagtgatgaagatggctttccgtggaaaggggattcaggggtgggaggtggggtgtagggggaggttttgccacgtggctyggtctggggccctttatggattcaaaatgaggagtgtatgctgattggtttgtgagtatgcaaaaaaggttaaagtgacaacaccactcaaagctgtgcacaatggtgtaagaaaaccaattaggaaagggtagggaggtatatgtaaaataggtgaagggtgaggactaatcagaggtaagcatgccaaacagaaagacaagttctcaatccagtccagtcggatgatttaacttgtagcttggctttcaggctttaaactgtctttggcttggaggtggggtttcacggaggacctgccccatctgcataggcatttgtccacctcctgcttctatcacagagcatgtctcagcctctctgtcctgccactcaactttgtccccctgcctttattacccatcttgtaattcctggctcacagctttgtgttccaactagactgagagctccctgagcccagctactgccaggctcacttcaggcttcaatgcccagctcagacgcagtgcatctgctagtgtgtgtgtgtgtgtgtgtgtgtgtgtgtgtgtgtgtgtgttaaaagtgtttcttgctggctggttctggaaatttgtcattctctgtcctctatcttcctgttaaaaacttcagctgaattaaatttaaaggagtttaattgagcaataaacaattcgtgaattgggcagcccccagaatcacagcagattcagaaagactccaggggtgcctcatgggcagaacaaatttatagacaaaaaaaaaagtgacatacagaaatcagaactgaggtacagaaacagctggattggttacagattggcgattgccttatttgaacacagtttgaacgctcagcagcgtatgagttgttgaagtttatctgctgggattggccaaaactcagtgattgttacagatgcatactcctaagttaggttttcaatcctgtctacctattaagttaggttgtagttcatccacaaggactcaaatatggaagtacagagtccttctcaggccatatttagtttgctttgacatccccattgagatgactcaactattcggctaagggctgtagacagtgaagaaatgtgactaattgctggatactgtagtatattgagtgtgcaagagcattatatctaaaaaacaatgtacatactgcaatttaaaatgctttgctgctaaaaaaaaataatgctaacagtcatgtgagccttcaagttgtcatctttttgctgctgggggttcttgccatgatgttgatagctgctgactgagcggagtggtggttgttgaaggctggggttgtgttgaakgctgtggcaattttgtgattggccaccaatggagtttgctgcatcaatggactcatcctttcatgaaatttttattggtagcatgcaatgttatttgatagcatttctttccaaattgaagttaatcttcttaaaccctgctgctgctttgtcaactaagttgatttaatattcttcatcctttgttgttatttcaacatgttcacagcatctttaccaggagtagattctatctcaagaaaccactttctttgctcctctgtaagaagcagctcctcacctgttcaagttttatcatgagattgcagcaattcagtcacatcttcaggccgtacttctaattctagttttctttctatttccactacatctgcagttccttcctcccctgaagtcttgaatccctcaaagtcatccataagagttgtaattgacatcttccaaaccctgttagtgttgatgttttgacctccttccatgaatcgcaaatgttctgaatgatatctagagtagtgaaccctttctagaaggttttcaatttacttggctcagatccatcagaagaatcactgtctatgacagctatagccttaggaaatgtgtttcttaaataacaagtcttgaaagcaggaatttctccttgatccaagggctgcataataactgttatgttcacagacatgaaaacgacattaatcttgtgtatcttcatcagagctcttgggtgaccaggtacattggcaataagcagtaatatattgaaagaaatatattttctgagcattatatctcaacagtgaacttaaaatattcctaaaccatgctgtaaacagatgtgctgtcagcctttactgatccatttccaaaacacaggcagagtagatttagcataatttttgtattagtctgttttcatgctgctgataaagacatacccaagtctgggcaatttacaaaagaaagaggtttaattggacttgcagttccacgtggctggggaagcctcacaatcatggtggagggcaaggaggagcaagtcccatcttacatggatggcagcaggcaaagagagaatgaggaaggcgcaaaagcagaaacccctgataaaaccatcagatcttgtgagacttattcactaccaagagaatagtatggaggaaactgtccccatgattcgattatctcccactaggtccctcccacaacacatgggaattatgggagtataattcaagatgagatttgggtggggacacagagccaaactgtatcttttttttttttttttttttgagatggagtctcactctgtcacccagtgccacgatctcggctcactgcaagctccacctcctgggttcaccccattctcctgcctcagcctcccgagtagctgggactacaggtgcccaccaccacgcccagctaatgttttgtatttttaatagagacggggtttcacggtgttagccaggatggtctcgatctcctgaactcgtgatccacctgcctcggcctcccaaagtgctgggatgacaggcgtgagccaacgcacctggccaactgtatcaatacttaaggggcttagggttctttggaattgtaaatgagcattggtttcaatttaaagttaccagtggcattagcccctaacgagagattctgcctgtgctttgaagcattgcagcttcaaataaaaggctattttgtctacattgagtatctgtgtttagtgcagccaccttcactaatcatcctagctggatattctggataactttgtgtagcttctccatcagcacttgctgcttcactttgttcttttatgttacagagatggtttctttccttaaacctcacgaactaatctctgctagcttccaacttttcttttgcagcttcctca

SEQ ID NO: 17801 - DNA, 35067 bp, Homo sapiens
caggatgcctctagctttgttctttttgcttagagttgccttggttatttgggctcttttttggttcaatatgaattttaaaatagttttctctagttctgtgaagaacgtcgttggtagtttaatgggaatagcattgaatgtataaattgctttgggcactatggcaattttaatgatatggatttttcctatccatgaacacggaatatttttccattcatttatgtcatctatgatttctttgagcaggggtttttagttcttcttagagagatctttcatctcccttgttagctgtattcctaggtatttttttctttttgtggcaattgtgaatgggagctcatttgtgacttcgctctcatctcatcttgactgttgttgatgtacagttgctagcaatttttgtgcattaattttgtatcttaagcctttactgaagttgcttatcagcttacaaagcttttggactaaagtgatggggtttcctagatataggatcatttcatctgcaagcagggagagtccagtttatgaaatgccttcctcaaactacattttattacctgtgggaccaagaggaagttatctaaaatctctgagcccttgtttcttaaatgcattcctcaaaggatcattgtgagttttcaataaaataacccacaaaaattgattatatattagtgtctggcaggtagtcggattactcaaatattaaccctcactcattcccagggctgacatctatccgatatgcctggaaatggcaagtcagctggcatctattaaattaagctgtggatgcactgattgatcagtgccatgtattttaggttgataaatattttgaatattttgaatattacatctaccaatcgtgtttcttatgcggaatctgttcaaagttatagtgccaggcagtatatattaacaaattggtaccttgtttatcaatttttcatgtacatgattaatgtgaatcagattccagaatctaatcaacctcagaatctaatcaaaatcaggctctcaaacttacatagctgagaattttttagacccaagataacctcatcatactataggaatcccagggagatgggattcaatatcatcctggatctgcccttaaccaccttaaaaacaatctaaaactcatggggcacctgggtggagaacaaaagcagaaatacccggttcactgtaagagcagtattccttttgttctcggaaggtccagacagcagtgaagctttcaccagttcaataagatgaaagaaaacagttaagaagttaatgagagttgtggtttttatcacatttataatattgtattaggttgttgcaaaagtaattgcagtttttatattaaaagtaatggattacttttgcaccaacctattagcaaattgttgtttttgcctcctcttcctctctttcaccttcctcgcccatccttgcaaatactcctacatttcaaggttcatgtgatataattgtatttggagacttagacctccaaggactttccagttcacctcctgggacatgttgatccatgtttggatccattctggcttctgatctctagcagccagaatggatctagcagctcactggggtgaatgaaggaagtcacaatgacctctgttggctgcagcctagatgagtgctcttcactatcccttgcatttccaattatcagtccttatgtttcatgtcttaggtaatactgaagttagtctaacctctcccacagtgcaggagtttggtctgtattgttacttgcagatggttgtgaccttttcatgataagcagctcaaaaccttcataagttaacctatttaagcttggaattctcttctccatatatataacaagttagtctcaagagtttctctcatgtttctacttccaggctttagaaaatacaagggggtaaaaccatgaggaacctcttttctccaaataaaggcttgcaaatgtgaaacaggttaaagcaaaacttcaagagttgaggtgcggtggggagtcactgaggtttcttccaggcttgcccctgaccacactgctgcagcgtaaggtgaggtactaagtacgtgcaaagctctgcaatgaagaattggtccaaggccacttccgctgctaccataccattccaggagcctgctctatattttagtgacatgagtcctgaggggaccttcggaaacagatgcaaagagagaaactttaacttgacttaatgagatactgaacacctcccagagccatgtctgtcttcttcgcaaggttgtgcctcccatcttccagtttttaggcacgctccctttctgattgctgtgttttgatgccggtccttccctgccagaaacagcctttaggctcagtctctgtaaagaactgctaggccttagtgccttggggtcattttcaacaaatccttagttgcatacatcacaaaactgattctcctgtgcttttttttttttttttttgagataatgagtaggaaaaagaaaaaaacttgggtttatttttttcacaatccttgacctccttgaaatgaaattcycatcagccagcacaccgatttcatgagctaagtgaaatggagagtttatgggaagcagatgtgaagccctcatcttgtgaaaaatctgctttggattcttttcttgagtagggtgtgcatgcagaagcaaattttctgaaactactaggcacaatctcccatggcagttctgaaagctggcacagtgtgcctgaaaaaggattagcaaaagcgtgacaaatctgggcagagctgcagaggcccgatctctgccctactcgtggcacagcctcattcccagttggcttggcagagctgatggtatgaaaggatgagtttcagcttgcatctagccataggatttaccacctgagtttgcagtgttggagaaagagaattttagagacaatggcaagaatgaaaccccaccctcaaggtttgtagtttactaaagtggagtgtaaatgagcagcattcaccctaatacagggtgtctagttatatcccactcagtaagtacaattgcataactatttatgctattaagaatgatttagcaataaacagatcctttcttcccttcttaaccttagggaaatacctatttaattttcagttactgagtgtttgacagtttaataagcacttccgcacttgtgctttacagcaagtcctgaagtgggtattattttctccctttgtgaaggttggagcatttagttttctcgccataagtgcctaccagtccctatggagcagatacctagctcttttgactgtagtgactctttcacttctctgctgtcattatgagactggagtgagaacacttctggacagggtccataacagaaagctgttaccgaagggcgaaggagcaaggctgtaggagagtagtgctgataacatgaccctgtaagcctcccacacttacagactcccacactcacaggtgctgcagagtatggacagggtaaccgactagtctccatttgcctgggactctcctggtttgggaactgaaaatcttgcatcctgggaaccccctcaattctgtgcacaccaatggctggtcaacacctgtgtggatcatattttgcctcttaggtttcatctaaatttctggtagcacttccaggttcaaaagacttagtcctcaaactcttaggaaattctggcggcttccaggacctcacagtcgattgctgcaagacagctttactgagtcaggactccgggacatttggtctcatgtggttccatatttaaatatttgagcaaacaatccataataataataataatccaagcagccaactggagtcaagttaataataatgacatctgctactgattatgaatcaggcagtatacttcagtgctttctgaccctcactaccagtcctcaggacacccatgcaatgtggttatcattagtcttattttatgaatatggaagctgaagtcatacatattcaagcaaggctccaggccctgaaccaagtgactctaattccaaagcccatattcctgtagtacacttttcaaagttcctctaagttcccctgtatcttgacctgaggaaattacagttgcatgggtgctttgaggtaatcattaaaggcttttgtaaactttgggagtaggaccaggctcacagtaactaggagattgagtaccctgagggttctggccccagaatttcatagaaatatggtgtttagaagaaagaagtcatctgttaaattctctaaacctaaaattaagacttagctgctatatatccaaactgacccattttttttattaccttccaagattcagcttttggcactttatcatccaatcaagtttcatggagactggattaggaccataagacttattcagatattaagcctcacatgatacattattttttgtaaaaaattttttagattaatatgatacaaagttttgccaagcccttaagagggagtttatcaattcagcgcttttgcatttatgctgtcaccacccatgtttgaactcattttcttttgttcataagtaaacaagtttttgtttgaaagtcgagactaagaatacctgtccttgtccacacctgtttaactttgtcttatagtgccagcaaacatactggagttcttcagcactactgctaaagcaatggtgcttactcacaagccaaatcaactggcaatggtttttcctggtggatttgatttggttaatgagttgtagtaacaaattctaattacaaattctgaatttgacataatatatgttaaattggatgtacatttactatgttatattgaaagagagatgtgtggaaaaaatgtatacttatttttgaaaagaaacttttgtttgtatctgaaaaataaactcttagcaaatttcatctctgggttgttaagagtccaggttctggacttcatagcttgaacagctttgtctgaagacttagaaaacctgcttcactggatcacttaacaaaagtaaaatatcctttgtgtaaagttttcttggaggtgatggtgtaccagtatgctgaccatctggtgtaccagtatgctgaccatctactgtcaaaaataacatctatactggacattctcctatcaaataatagatccagaagcttctggagccattgcaacttatattaagaaataatggtctgtaatggttaaacagctactcaagaagacctaggtacttgcccaagtagatgaaaaccctctggcattcgatagccagtatgcaggctggatttcaatttctcttgagcccctgcactgtgttacattggtgccgtaaacaaactgtacaaccatatgaggcaactctgtggttaatgggatttggagtcagatgataatttctctatgtgcagacacagaaagttttacttaactttctacacctaaaatacttagaaaccatagtcatccatattgatattttatatcatctcaacttctcttgcccaaacttgacctactgttgcaattattttacatttccttggctctgttttcatttatatttaattccagaaaccacatcaagtctttgcagaatgaagtagagcattaagaagtagagatgtacacacgcatctctaaaatcagccatgcctaggcaaagcagcttgcacttaaacacccaatacatttttcatgattgtgttgaagtgaagtaacctaacccgtttttatatccttcaaaataaggtggataggaatgctttcagcccttttcaatagctttgattatcttgtttttgttagatccctcctcttggtttgatcatagtagttactgtatttctttttataagttggtctgcaaagggtagggcttgcagaccattgcaaagttgtgacggctgtgagtcatattgctgaaggtggaactctgaagccagactatctatgtgaaggcacaagctgctgttayatacaacagagtgaactgagcatcagtcagaaaaagtctatgtttgcagaaatacagatccaagacaaagacaggatgggcactgctggaaaagtaagtggaacatttctgtcccctcctcatcatgayctaatgatgtgaggctgatacttagaactttgaatccattaaagtaattaaacacttggagatattccttgaggaatgaaatgcttggtgagcaggcatacagtgagggaaacactggatatggtgtttcagagaatgtcagtggaagcaggggtaarttggaaatagtatatccaatgtcagcaagacattggtggaaaatagagaaattgatttatattggcattattcataatttgatttccggatagctgggcaattgctccaggaagccaaatgtttccacaaggacacttcaatcgtctcagtagcatgtgctgcactygctgcagtagttcaatgggaaaccagggtctcatgcccagatgttggaagaaacgttcctgccattaagaatggaaaatgctaattctgggatgcaaaatggccaagaaagtgtcatgaattttaggtttcttacaaatgtaatttttatcaaaatatatatttaaaaattctttaaaatcaagactatattattggtaaagtatgtttatcgttctaaaaacaacagagttagcagagttggtattaactttagaaacagctttgctttgtttttttttatttgaaaataggtcagtatatttccttactttaaatgggtacataattgcttaaaggactaaatttttttgtttgttttgttttaacttgaacaattttgcatttagcttgcttaaggttttggaaaaataaagatgacatgagaagtctgggtaatgtgacaagtcaggagactctatgatgttagaatttgaaataagttttactagaattggatagaactggaataaaaccatcctaatttgggtcagaaatccagcaaaactagattacttgggaagttaattttgcactacagaaactagcaactctacccatggatattaatgaatcttagaactgaaaggaatcttaaaaatttgcaacttttaccacccaacagatgcttcaggtctggttacactatttctaggaagtcgatattcatccactgtaagaacatttctgatgatggagaaagtagcctcaaggcagcactttccaattaataatacagtatataatatataaagagtataaaagttatatgattttgatatatggtcatgcaatagtgtggtttgcctaaggattatatatttcccaactttctgtagtgttccagtgtagctcttgaaaggagtttccctttacattgggattgattttttctctttataataaatgttttctttttcattaaaaaagtaaaagataactgtattagtttcctagggcttccataacaaaatatcacagactgggtggcttaaacagcagaaatttgttttcttgtacatctgaaggctgcaattctgagattaaggtgtcatcagggttggtttcttctgaggcctgtgtccttggcttgtggatgaccctcttctcgctgtcttcacatgatcttcccttttcctaatctccccttctaataaagacaccagccatattggatcaggttccaccctgattaccacattttaaattaattacttcttgaaagaccccatctccaaatacagtcaccttctgaggtacggggggttaggacttcaacatacgaatttggagggagacacaattcatcccataccaatgattattctagaaaatttggaaggtcagaaaatatgaaggaaaaaaatcaatcataatatcacatccccaaactaccatttttgtgtgtgtgtttccttctatttttccatccatagtttatgtagctgtactcatacaatatacaaatattttatcctatttttccatcttaaacatttttcaatttataacaatttataaacatttttaaatgtctaatttctgcatttagcacaatttatttcatcattcctctattattgtttatgtattttcctttgtaaatagtgctgtgatgacatctgctatatagagaggtttttctaaaattaatatttcttcgaggtagcctttaaaaatggaattacatgggtaaacatgccacaacatccttaawtatcttgatgtaccatgcaaattactttctaaagggttgacataggtaagatggcccattttaccatttatctgacaatactgtgtattctcattaagttctcattaagtaaaaagtcattttcagagcatggtggcttgtgcctgtagtcccagctaactggggaggctgagatgggaagaccacttgagcccaggaactagagtacaatctgggcaacagagtgtgatattgtcttaaaaaaawttttttttttaattcattacagacttgataggcacagaattgtatctcatttttatttttttaaaaggcgtttttatgagtgagaacaaacatgtcacaatctattcattaatctgttgcagttttttccataggtcctttgcctgctatgtatctcccaggatgtaagtgtggtatgtggaagtgggaaggagtgttaggagtgaagttgttaacacttcctctgtaaatttgagtaagcattgtatttatcaaatgtggtaacttttatctatttaatattttccctcagtactatttgatgtcaatgtggaaaatttactatttctcaacacacaaaattttaattcttagaagctgtttcctttatgactttttttaacttttattttaggttcaggggtacatgtgcaggtttgctacataggcaaattgtgtatcatggggtttggtgtacarattattttgtcacccagataataagcatggtacctaattggtggttttttcatccttaccctccctccaccttccaccctcaaatgggccctggtgtccattgttcttttctttgtgtccataggtactcaatatttagcttccacttataagtgagaacatgtagtatttagttttctgtttctgcattcgtttgctcaggrtaatggcctccagctccttccatgtccctgcaaagaatatgatcttatttttttatggctgcatagtattctgtggcaaatatgtaccacattttctttatctagtctagcattaatgggcgcttaggttgattccatgtctttgctattgtgaatagtgcttccgtgaacatacgcatgcatatgtctttatggtaggatgatttatatttctttgggtatatacccaataatgggattgctgggtcaaatgttaatcctgttttatgttctttgagaaatggccagactgctttccacagtggctgaactaattaaccttcccaccatcagtgcataagtattcccttttcgctccaacctcaccagtttgttttttgactttttagcaatagtcattctgactgatatgagatagtacctcattgtggttttgatttgcatttctctaatgattagtgatgttgagtattttttcatatgcttgttggccataagtatgttttgttttgaaaaatgtctgttcatatcctttgcccagttttttatggcgttgtttgtgttttgcttattattttgtttaagttccttatagatgccggatattagacctttgttagatgcatagtttgcaaatattttctccacttctataggttgtctgtgtactctgttgatagtttctcttgctgtgcagaagccctttagttaaattaggccccttttgtcaatttttgtttttgttgccattgcttttggcatctttgtcattaagtctttaccaggtcctatgttcagaatggtattccctaagttatcttccagggtttttagagttttgggttttagatttaagtcacatcttaagttaacttttatgtatgatataaggaaggggtctagcttcaatcttctgcatatggctagccagttacctcagcaccatttattaagtagagcattctttccccatggcttgtcctttgttattttttctatcactcttaagcataaaagttactccatgctcagtatgatcaatatttacatcttcactgattgataaaatagtttgactttaaaaataaatcttgggccaggcacagtggctcacacctgtaatcccagctctctgggaggccgaggagggcagataacaaggtcaggagatcgagactatgctggccaacatggtgaaaccctgtctctactaaaatacaaaaacatattagctgggcgtggtggcacacacctgtagtctcagctactcgggtggctgaggcaggggactcactgaacctgggaggcagaggttgcagtgagcccagattgcgccactacactccagcctagcgacagagcaagattgcgtctaaaaaaaaataataaaaaaataaaaatcttaacaatgaatccagcttgaatttgtttgggaatgtggtgtgagatttctaacgtcaacattgggccatattacactgtaacccataacattttcattagtaaggcagagggtaaatattaaattgagctactgatggctttcagccgcccatctgttaccagtgtatcatttttcacatttaacctttttacaaaagagccacttaagaatccataagagctctctaggactgttgtgtttgttgacaagttgaaggtaacttattttgcatctgaacaaattaattaaaatattttataggagtcctagacagattgggaggtaggaaggtggaaacaatttctctatgtgtgtctgtctctgtctctctctctctgtcataattcaataatcttagcaaaaccatttaattgaataactacagcaaaaccagttgaacaactggatgccagtcactggtatctccacacctagtgtccactactataagatgacaagctttaacctgcctatcaagccctaccaggtgcaagaactgggctaggtgcaaatgggatgcwgagatgcagacacaaattcaatcatccaggaactcacagtcataatctgtatgcttcatgatgttcatggttctcttcatccttaccatgctaatagtctaatttcttcaccattgctatgtgattatatgcagctattaaatactggtttaaattcttacagacaagtcagcagcattttctgttttataaatttgtctcttgtgaataagcgatacacaaaggacaattttgttaatctattagatttgaaattgtaacaaaataacctatttttgggtgggggtgttatgtgaacagcaaacaaaaatcaataagttgggaaaagtacctcaggtctagtccagctctgcatgtcatgtgctaggtgaccatggatccatcatttagtcactctgggctgcatttctcatgccttaagcaaaggcacacacaagatgatttataaggcttataatactagtgtttgatgaaaatcattctggaaaacttaaaatattatatatgctcttctgttcatatttatactagtcagggagtctgtaagttaaaggcataattcagacccattataatacttgcytatttcttaggttattaaatgcaaagcagctgtgctttgggagcagaagcaacccttctccattgaggaaatagaagttgccccaccaaagactaaagaagttcgcattaaggtaagcgtgagccctagagaacttaagccaaaagcgttatcaaacttatattgaatatagcactgttgtgaggctggattcttaaataaggagrtgcttcccatgtttggagtattaattcctttactggctcttatatattgttaaggatctggttgtactcgatgtgaaattaatgagttcattatccttttaaaaaacaacagtgctaacatgctttattatacctttgatttgttgaatttttattcatatagtgtctaatttaaaatggttaataatcatagctaaagacttcttttaaaatcttctgggagtcagattgttttgaggttactttttgcaaagaatgaggaactymmttgtgcctggagaaatgacaacttcgtggaacgttttcctccctttctttggacagagcttaaccttggctttggacaccagttgttgagtaggcattgctaccaatctttctttgaccctcttactgttacctgagcacaacagtagcaggaagattttgctctttgcttaccttcttgcatgccatttcctctgttctttgttaagagagcccaataagggcctagctataaaaatctactttggggccatcacatagtaacatctgtattctggttccctcacaagagcaccaatttactacagacaggcaccaagattcaacctagggtataagggagcaatattataagttccgtcagagagggatcttgtctgatggttgatttttggctcagaatagtctaagagtaaatgttgttatattaggcaaagatattgattaaacaattataatttcttcaagaagttaaatattctcccaacagtgaaatgatcagtttgttgattggtgcaatgtttttgtctttgaacacagattttggccacaggaatctgtcgcacagatgaccatgtgataaaaggaacaatggtgtccaagtttccagtgattgtgggacatgaggcaactgggattgtagagagcattggagaagsagtgactacagtgaaaccaggtatatgcaggtgtcaaaccacaagtttgaaataattaggctttgattagcctatcaaaggaaatagcacacactaggaattattagagggatccttaacacaattcagggaattaaaaggatacaagaatggattttactgagtaatgtttaatttggcaaaacctcaacctttagaaggcraaccttacggtgtttataaaccttagaatatatttttaaaagttttacctatagtatgggctcaattcacatttgttaatttcatattttaacattaatgaacagcatcttatatcatgatttttttcctgtaggtgacaaagtcatccctctctttctgccacaatgtagagaatgcaatgcttgtcgcaacccagatggcaacctttgcattaggagcgagtaggtttcagtcatttttactttaatgtatttacatttktcctatgctaatttttgaattgaattaattaatacgtgtatttgatgtatcaaacagtattactggtcrtggagtactggctgatggcaccaccagatttacatgcaagggcaaaccagtmcaccacttcatgaacaccagtacatttaccgagtacacagtggtggatgaatcttctgttgctaagattgatgatgcagctcctcctgagaaagtctgtttaattggctgtgggttttccactggatatggcgctgctgttaaaactggcaaggtaagaaacagggtaggctagtttatttgttcttctttccttttcttaaatgatttgyttggaatcttgaagagttttggaaaaaaaaaaaacatttaaaagaatgtattgcatattcaggctgccaagcaacacaatgccaaatcaactaaaagaaaaataaaaaattcagattagaaattttatttcttctttttacacttgagaatatttattgactatatttgcaaactgcatcatttctccatctttaaaatataccccttccccatatgttaagtttgttaagataggacaatctcagtattttagttacagcagaggctttttgtcagagcttttactcctagtttcttgtcagctaagtaagatttattgtataactacaaaatacagtagtaagtacattaccaacttctcagaaaaaagtacaattttgtcagatcacctgttatagataatataaagagcaataaaatcattaatcattttgattaccacctataatgcgtatcagaaataaaatacagtagtgtttgttgcctattatcagtaatgctgttactgttcaccaaaactgatttctcagtatacatttttccatcaactgtgatgttagataggatccctggaattttaagttaatcacatgaaatttcacaagtaaattggagttcaaggaattaagaatctttgacctcttattattttgagatacgtcccatcaatacctagtttattgagagtttttagcatgaagsrttgttgaattttgtcaaaggccttttctgcatctattgagataatcatgtggtttttgtctttggttctgtttatatgcagattacatttattgatttgyatatattgaaccagccttgcatcrcaggtatgaaagcccatttgatcatggtggataagctttttgatgtgctgttggattcggtttgccagtattttattgaggatttttgcatcaatgttcatcaaggatattggtctaaaattctcttttttggttgtgtctctacccagctttgatatcaggatgatgctggcctcataaaatgagttagggaggattccctctttttctattgattggaatagtttcagaaggaatggtaccagttcctccttgtacctcttgtagaattcggctgtgaatccatctggccccggactctttttggttggtaagctattgattattgccacaatttcagatcctgttattggtctattcagagattcaacttcttcctggtttagtcttgggagggtgtatgtgtcaaggaatttatccatttcttctagattttctagtttatttgcgtagaggtgtttgtagtattctctgatggtagtttgtatttctgtgggatyggtggtgatatcccctttatcattttttattgcatctatttgattctcctctctttttttctttattagtcttgctagcggtctatcaattttgttgatcctttcaaaacaccagctccatgattcattaattttttgaagggttttttgtgtctctatttccttcagttctgctgtgattttagttatttcttgccttctgctagcttttgaatgtgtttgctcttgtttttctagctcttttaattgtgatgttagggtgtcaattttagatctttcctgctttctcttgtgggcatttagtgctgtaaatttctctctacacactgctttgaatgtgtcccagagattctcgaatgctgtgtatttgttttcattggtttcaaagaacatctttatttctgccttcawttcgttatgtacccagtagtcattcaggagcaggttgttcagtttccatgtagttgagcggttttgagtgagtttcttaatcctgagttctagtttgattgcactgtggtctgagagayagtttgttataatttstgttcttttacatttgctgaggagagctttacttccaactatgtggtcaattttggaataggtgtggtgtggtgctgaaaaaatgtatattctgttgatttgggctggagagttctgtagatgtctattaggtccacttggtgtggagctgagttcaattcctggatatccttgttaactttctgtctcgttgatctgtctaatgttgacagtggggtgttaaagtctcccattattattgtgtgggagtctaagtctctttgtaggtcactcagggcttgctttatgaatctgggtgctcctgtattgggtgcatatatatttaggttagttagctcttcttgttgaattgatccctttaccactatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtctcctgaatacagcacactgatgggtctcgactgtttatcgaatttaccagtctgtgtcttttaattggagcatttagtccatttacatttaaagttaatattgttatgtgtgaatttgatcctgtcatgatgatgttagctggtyattttgctcattagttgatgcagtttcttcctagtctcgatggtctttacattttggcatgattttgcagcagctggtaccggttgttcctttctatgtttagttcttccttcaggaactcttttagggcaggcctggtgctatctatgacaaatccacagccaatgtcatactgaatgggcaaaaactggaagcattccctttgaaaagtggcacaagacagggataccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggacacaaaatcaatgtacaaaaatcacaagcattcttacacaccaataacaaacagagagccaaatcatgagtgaactcccattcacaattgcttcaaagagaatgaaacacctaggaatccaacttacaagggatgtgaaggacctcttcaaggagaactacaaaccactgctcaaggaaataaaagaggatacaaagaaatggaagaacattccatgctcatgggtaggaagaatcaatatcatgaaaatggccatactgsccaaggtaatttatagattcaatgccatccccatcaagctaccaatgactttcttcacagaattggaaaaaactactttcaagttcatatggaaccaaaaaagagcatgcatcgccaagtcaatcctaagccaaaagaacaaagctggaggcatcacgctatgtgacttcaaactatactacaaggctacagtaacaaaaacagcatggtactggtaccaaaacagagatgtagatcaatggaacagatcagagccctcagaaataacgccacatatctacaactatctgatctttgacaaacctgagaaaaacaagaaatggggaagggattccctatttaataaatggtgctgggaaaactggctagccatatgtagaaagctgaaactggatcccttccytacaccttatacaaaaattaattcaagatggattaaagacttaaacattagacctaaaaccataaaaaccctagaagaaaacctaggcattaccattcaggayataggcatgggcaaggacttcatgtctaaaacaccaaaagcaatggcaacaaaagccaaaattgacaaatgggatctaattaaactaaagagcttctgcacagcaaaagaaactaccatcagagtgaacagacaacctataaaatgggggaaaatttttgcaacctactcatctgacaaagggctaatatccagaatctacaatgaactcaaacaaatttacaagaaaaaaacaaacaaccccatcaaaaagtggrcaaaggacaggaacagacacttctgaaaagaagacatttatgcagccaaaaaacatgtggaaaaatgctcaccatcactggccatcagagaaatgcaaatcaaaaccacaatgagataccatctcacaccagttagaatggcaatcattraaaagtcaggaaacaacaagtgctggagaggatgtggagaaataggaacacttttacactgttggtgggactgtaaactagttcaaccattgtggaagtcagtgtggcgattcctcagggatctagagctagaaataccatttgacccagccatcccattactgggtatatacccaaaggactataaatcatgctgctataaagacacatgcacacgtatgtttattgcggcactattcacaatagcaaagacttggaaccaatccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcacaaggacaaaaaaacaaacaccgcatgttctcactcatagataggaattgaacaatgagaacacatggacacaggaaggggaacatcacactctggagactgttgtggggtggggggaggggggagggatagcattaggagatatacctaatgctaaatgacaagttaatgggtgcagcacaccagcatggcacatgtatacatatgtaactaacctgcacattgtgcacatgtaccctaaaacttaaagtataataataataataaataaataaataaaatagatctattttattagaaaaaaaaataaaataggtctattttattagaaaaaaaaaagaatctttgacctaatacattattaaaagaaaaacctttatcaagaaatgcaattgaaaatgaagtttctagatttaatttttgtttcttccacatctccttctgattcaaatttctaaaatttatatttgtatctaaatttatttacaaatgactcagagttatgattttttatttcttctattaaaaaatgggatatatgtgcagagcgtgcaggtttgttacacaggtataygtgcgccatggtggtttgctgcatctgttgactcgtcctccaggttccctcccctcaccccccacctcctaacaggccctgatgtgtgttgttcccctctctgtgtccatgtgttctcattgttcaactcccacttatgagtgagaacatgtggtgtttggttttctgttcttgtgttagtttgctgagaatgatggcttccagcttcttccacgtccctgcaaaggacatgatctcatttctttttatggctgcataatattccatggtgtatatgtactacattttctttatccagtatatcattgatggccatttgggttagttccaagtctttgctattgtaaatagtgctgcaataaacatacgtgtgcatgtgtctttgcagtggaatgatttatattcctttgggtgtatacccagtaatgggatggctgggtcaaatgatatttctggttctagatccttgaggaattgccatactgtcttccacaatggttgaactaatttatattctcaccaacagtgtaaaaagcgttcttatttctccatagcatcacgagcatcgattgtttcctgactttttaataatcgccattctgactggcatgagatggtatcacacggtggttttgatttgcatttctctaatgatcagtgatgttgagcttttttcatatgtttattggccacataaatgtcttcttttgagaagtgtctgttcatatcctgtgaccacttttggatggggttcttcattttttttcttgtatatttgtttaagttccttgtaaattctgcatattagacctttgtcagatgagtasatcacaaaaatctcctcccattctgtaggttgcctgttcactctgacgatagtttcttttgctgtgcagaagctctttagtttaattagatcccatttgtcaagtttggcttttgttgcaattgcttttggtgtttttgtcatgaagtctttgcctatgtctaagttctgaatggtattgcctaggttttcttctagggtttttatggtttggggttttacatttaagtgtttaatccatcttcagttaatttttgtgtaagatgtaaggaaggggtccagtctgagttttctgcatatggctagccagttttcctagcatcatttattaaatagggaatcctttccccattgtttgtttttgtcagatttgttgaagagcaaatgattgtagatgtgtggtgttatttctgaggcctctgttctgttccattggtctatatatctgttttggtaccagtaccatgctgtttttgttactgtagccttgtagtatagtttgaaggctggtagcatgatgcctccagctttgtttttttggcttaggattgtcttggctatatgggctcttttttggttctagatgaaatttaaagtagtttttttctaattctgtgtagaaagtaaatggtagcttgatagggataacattgaatctataaattactttgggcagtatggccattttcacgatattgattcttcctatgcatgagcatggaatttttccatttgtttgtgtcctctcttatttccttgagcagtggtttgtaattctccttgaagaggtccttcacatcccttgtaagttgtattcctagatattttattctctttgtagcaattgtgaatgggagttcactcatgatttgtgtttttaactggaggcccttttcaggtttcactttttgaccctaacacctaacatgttcaagaacattcctctccacaggtcaaacctggttccacttgcgtcgtctttggcctgggaggagttggcctgtcagtcatcatgggctgtaagtcagctggtgcatctagratcattgggattgacctcaacraagacaaatttgagaaggccatggctgtaggtgccactgagtgtatcagtcccaaggactctaccaaacccatcagtgaggtgctgtcagaaatgacaggcaacaacgtgggatacacctttgaagttattgggcatcttgaaaccatggtaagacccaaaatttgagaagccacaaaatacccaagttattagayatgcacaaggtaaatttaattgtctataactttattaatagtcaataatggaaatatctctgcgatagtcagttttactcaggcaaaaactgataatcacatagcaattttgcctaaaawgtcaaacacttaagagcaggttcactggaccaaagttaaataccatatcataccactctcagctgactagatggcaaggtagtcaacccttctagataattgttttaagtaggatcttccttgtatatgtagatttcttggygaaagcaattctgtctcttgaatgtcagcaaagtaagcatcagaaggtgactgaggagaggtgaaaagggattattccaaatgttgtggtctattcccccaaatctgtgatccatcgaccttctcactctttacatctgagctttgtttgccctcatctgaattcccttagaatatgaaccttcaattttctaaccatgccacctgtatggcagcccgcagcaccagaccttcagttagacctgtaaaacagatctgagattcctggaactagaaagytccaacctggcatagcgtaaagagactwggaaaaatggaataaagccacttttgctcaagattgagtggcagattaactcaccttaatgcttttggtaatttaagaataaatagtccttaatttatcattgctgtcatatttctttcctagtgaatcacttagatttatttcatatcaacaaatagcattctaggtcataagtttttgaagccatatgtgatactggatatatcattagagcctactgatttccagttgctacttgatgaaggctggtctctaaaaacaatgccatctgttgctccaatctagcaagtattaaattattgcttaataactggatgggttaatgaccagaaaatgtgaggttagtctcagaaatgctcccaagaaaagggactcttttgtcccacattttagtattttatttaattttaagactaaacttaaaaaaaaaactacgctaaatgatttggtatacttaattcaatttagtttggttcaaatggctttctaaggcttatctgaagtggtgatattggtatgaaaatatcacaagaatttcccttgtattttagtscatggtacactaaaaatgccacaaacactgaccacattgattgctgtttctgccttaaagggcaaatgtgtatagaaatttaattaaggactaaagttgcactgaaatttttttaaagcaagtaaaaaacaaggtggcttaatttaatttcatgacytkgtcatagtacataggtcatttcagagcttatgtcacactgtaagagacacaggaagcaaacgatctcctccgttttaaactcagattgatgccctggcatcctgccacatgaactatgggaccagcgtggttgtaggagttcctccatcagccaagatgctcacctatgacccgatgttgctcttcactggacgcacatggaagggatgtgtctttggaggtcaggaaagcaaagcctctggatggggagtgatggctttcactctggtgcttggcaagtgggagaagcctgtttcctcaggcctttcttccaagaatgagtatgaagtgatctaaaatggaactgtgatcataataacacaaaagataattctccactcctcaccttgatgtaggactaatattggtggacgcatttttaatattaacatctgcaactcaagttccccaaaggcctgaatgagagacaccagtagtgtttctatagggatgaattatgtaacaggaagttccgatttaatccattattattaatatacacaagaatgtgtattaaagtgaatttattcrattcataatagcaccaacaaaaatcctggacccaaagccaaaaccaacaacaacaacaaaagggattgtcacattttatgggaacagttcagattcacactggaaggacttagattatcactcaacaattaatattgttttaggagagatggagccagggccactctgctcaaggtaggtgacacagtgagtccttytttttccctccttcacaaagtctcgttttctagtgccttcatacagagttgtactgggtgctttgaaggtactcccaatattagagtctgctttatacaatataagagaatagtaactattcaagtacttgttaagagtataaaaaggagaaaatgattgttcttcacttagagaagtacataatgtagcgaaggatacaaaaacaaatataaaagaaagaatataaaaataagtgcagctataaatattataaaacaaattataagaggagttttttagcatttattctatgttaaaagttttacattaatgtgtttgaagtttattttatttctcagtaactctctgaggaagctacttaatgaataataaaactgagacttggaactattaagttttttgcccctatagctctcaagttgagaactgagatttaaagctggtccatgggagaacaaagtttttcctctttctgcaacattacttggggcataaaaaagcaagaggctagttggtatggatgaggttttatagagaaggcttttyagggaaaatgaaacttgaagaacaaaacaataagagatataagaagttgaacctccttgctttgactatttgtgggaagtgggaagattatagattattcaggaatattagaggtaaaattcagttattcagcaaatatttgttgagtgtatactgagtacaggtaccattgtgtacatagtgtaccattccaggagctaggaacggagaagagacaaaacataccaagtccctgatctcaggaagtgtgagaatcctctcactttggtatagagagactgacaataaataaatgaatgcagaatataccataaggttacaagtgcaaaggataataataaaggatgggtaacgggcagtgccagaggactggggtggaggtggaggtgaawgctattttataaagttcaaggaaggcctccttgataaggtaacattggarcaaaaacataaataagatattcagaaatcttgggaaagaatattccaggaaggagacgtagtaaatacaacagggtgttggcaagaaccataagaacggggaaaaggtcagtatggctacaacagagtgaggacagaagaacagtcacagctggggtcagaggaccttaaattatatggggcctttgggccattgcaaggttttaggagtttattctgagagagaaataaaaccacagaggcttctgagggaggtgtcacctgayctgacttccattttaacactctccttctggctgctctatggggaatactctaaatggggcaaagggcacaagcagggagascatggaagaagtcattataatgctggaaggaaaggatgctggcttggagtgatggggctggtgagaagtagtcagctcttggatacattttgaagatagagtcaacaaaatttgccgaaatagttattgtatggcaaaaagagtagcatccaagatttttgggcctaagcaacaggaatcatgtcaccatcatcatttattgagaaggaagactatagaaggaatagattgggggctagggtggaagtggtagaaaccaggagtggtttggggcaggttacacttgtgcaggtacctgtgagatacctgaataaagatgtctataaaatgtaggcaattggctatgagtctgtagtacaggtagaggtttaggatgggtatagaaacctaagtattttaagaggagtatatcgaaagccacaagaccagaggaggtcaccctagaagtaaatgtagataaagaacagaaatggaccaaggaccaagccctaggaatcgttggagttagaggtctgggagatgtagaggacccagcaaagatctgtggaagaagtaactagtgagcaaggaaagtgacaatgatgatgacgatgtagtatctagaagctaagggaacagagtgtttcagaaaaggggagccaccaacagtatcagttatacctaacagttcatataagaggaggactgagaaatgacccctgtctgggtcaaaatggagctcaaagatgaccttgatgatatccattacaggacagtgctgggggcaagagcgtaatcagagtgggctcagagagggtgagaggaaaggaacaggatccagaaacagtgaactgaagacaattctttctgtaaagtaaagaagtttctctgcaatagaagcaaagatatggggtgactggaaggagatgtgggtatcagaagagtttttttaacctttgtttctttttaatttaatttaatttttattttactttaagttctgggatacatgtgcagaacgtgcaggttcgttacgttggaatacaagtgccatggtggtttgctgcacccatcaacccatcatctaggttttaagccccgcatgcattaggtatttgtcttaatgctctccctccccttgcctgccacccaccgacaggccctggtatgtgtcattcccctccctgtgtccatgtgttctcattgttcaactcccacttacgagtgagaacgtgcggtgtttggttttttgttcctgtgttagtttgctgagaatgatggtttccagcttcatccatgtccctgcaaaggacatgaactcattcttttttatggctgcataacttttgtttcttatgctgggacaaatacagcttatttgtacactgctgggaatgatctaacacagggaaagtcatagtgcaggaaagagaaggaataaatataacataataaaagataaggattatttagtaatgtctaaagagaaaatgtgtgcttatttgcaggtttgaaaagcagagatgatgtcccaaaactagtgactgagttcctggcaaagaaatttgacctggaccagttgataactcatrttttaccatttaaaaaaatcagtgaaggatttgagctgctcaattcaggacaaaggtaactgtttcttatgatgatcttgtctcttctccacaggctacttttaaaatttagtacttataaatgtgcctgttttcttcatattttatttctaattatttaatctagccagattgatacagctaattacttctctttacccactgcattagtgtattttcatactactataaaaaaaaaaaactgcccgagactgggtcatttataaagcaaacagattcaattgactcacagttcagcatggctgggggcttcargaaacttataatcatggtggaaggcaaagaggaagcaaggcaccttcttcacaggctgcaggaaggagaagtgtcgagcaaagcrggaagagccccttacaaaaccatcagatcttgtgaaaactcactcactatcatgagaacagcatgagggaaactgccccatgattcaattacctccacctggtctctcccttgacatgtagggattatagggattataattcaagatgagatttgggtggggacacaaagtctaaccatatcaccaayttagtatgccattgtactatattaatcaattttttaaaatcttttggattttgtttacctagttgatttcattgtggctatttttatttcatcataaagctgctatttatttcaagtargccacaaaatttccttattttacagttttcaaagtgctttctcaaatgtgcattattcagatccctgtaagccaggtattatttttaccatttttagatgaagaccaakgttgtgaaagcaaataaataactggtcaaacctcctggggtagtgccaggatataaactaattgcaaaacttgtgctcttttgaccatataacaaacttctctgacagagcttggcaagctttgggtaaacatgggtgtgatgattactactcttgttgcttctgagggttgggcaaggatagaggtcaagtatgaattcatgcaaattttatctacaacatctacctcatggaggtctcaaacagcaatcaaaaagcctgtctacaagatgaaatgactttcactcrttgggcctataaataattattgagcttccactatgtgccaaggacgtggatttcattagtaaaaggaactgtatattgagatccaaatttttactaatttttttttttacctgagagatttttcaatgttgtgtcttgtctccacatttggtctagcctacaggatcatcatattatgaacatacatttttttaagcaagtaaacaatgggattttgtaagaaaaactgtcagaaccactcagtactactttactcagataagcaaaactaacagcttagtatggcctgcttggaaaataattactatttgttttccaaagaaacataaattctgctttcaggaattttgcttcaaatatcaccttaaagcagggacatccaaactaacatttgtaaacctaaactcttcaatttccacctacttcctgcacagctctatttgaatgtcccacttggaaatattttttcgccagtaatttttatctcagtcattatattatgcgttcctcttttatagatgagaagccatagcatcatgtctgacttctttttcactcttgcctaccacatacaaaccaattctaagccttgatgatgcaacccttgatttctccttcagaatccctcatctcattgcccacgctcattgctttaattcagtctaatcatttctgacatggacatggtagtgagataataggttttccaccttctgtattaaaatacattccagttagtctttcactaagctgccaagctcaagttttgccaaaatgccaatgtcttagcatggttttgaaagcctttattattgaactaaaacctattttgtttcaacagttaagaatttggcattcattctatcaccctctgcagcaggcttttgggataaagtgagggaagtaggtctcatctacttgcaggatctcttgggcacccagaaatctaaacatattggattacctttcctgttcacatgttcctaggcttgttcatgctttctcctcaacctggaaaccacttccctcttgttggcatactgaaattatactgatgctttcagaattagctcagatacccttatcagagttgcgtaacaaagaaaactaattgttaaggactttgagcccagaggwtttccaataacagaatttacttgaagtttctatgacagatagaaaggacaattgtttaaactatcctttcttgaaagatatgaaaacaagtcattaaaaactctcattttacatttcagcattcgaacggtcctgacgttttgagatccaaagtggcargaggtctgtgttgtcatggtgaactggagtttctcttgtgagagttccctcatctgaaatcatgtatctgtctcacaaatacaagcataagtagaagatttgttgaagacatagaacccttataaagaattattaacctttataaacatttaaagtcttgtgagcacctgggaattagtataataacaatgttaatatttttgatttacattttgtaaggctayaattgtatcttttaagaaaacatacacttggatttctatgttgaaatggagatttttaagagttttaaccagctgctgcagatatatawctcaaaacagatatagcgtataaagatatagtaaatgcatctccyagagtaatattcacttaacacattgaaactattattttttagatttgaatataaatgtattttttaaacacttgttatgagttaasttggattacattttgaaatcagttcattccatgatgcatattactggattagattaagaaagacagaaaagattaagggacgggcacatttttcaacgattaagaatcatcattacataacttggtgaaactgaaaaagtatatcatatgggtacacaaggctatttgccagcatatattaatattttagaaaatattccttttgtaatactgaatataaacatagagctagartcatattatcatacttatcataatgttcaatttgatacagtagaattgcaagtccytaagtccctattcactgtgcttagtagtgactccatttaataaaaagtgtttttagtttttaacaactacactgatgtatctatatatatctataacatgttaaaaattcttaagaaaattaaaaattatataaaatgttttgtggtgatatatttttaaacaggcatatgttgttattaagcttttatttgttataaacaaagtgttgaagcgcctgaaaacataaaaatactttataagacatataagaagttgggtggtcatagcagaaattgaggcttccaatgttagggcataatatagattggacacttctaccatggtaaattgcaaaatgtccaggtatttatgaaccacttttacatgatgaatatttcccagtgaaaagtggcatgaactcgaggagtaaaatttcctttttcttttaccagtttgtcaatctaggcttaatctaggtttaaaaaaaatagctgaaaagtgtaaataattattttgaagtatcttcatcatcagctgagtttagctatggcaattctcaaaacactatgaatatttacagcttataagaattatatttttatgtatacatatatatatctatatttatgtcaataaatagatacatagatagatgatagatagatagatagatagatagatagatagatagatagatgatagatatagataagtatagaaaatctctatccaagaatcatttggagacatttcctctgtccattagcaatatctgtagctaggatctcagaatccattaaggaaggaaaactgccccccaaaaaagcatttttaacaagaaaaatatgtagaatggattaattcctttatgtctcctgcctcaaattttgaaaaacatgtaaataaggatactaaaagtaatatgcaaatataggtacatcaaaagaaataaatccaagaaggaataaacacatttatattctcagatcacagctttttaaatgaaatccactttatgcttagataaaattatattttgacaaatatgctgcatatgtgacaattttatttatttaatatttattatgatactttgtggaatcattcctcatgtctgagcttgtcatggccaaataatgaacagaaagaccttctactatctttctcagggtaacctgcacatgaatagcattttgagtcatcagaaaacactggttctaagaagagatcaggaaatctgattatttttgcatatttcttatttctggtcaatgaaaccacaaagcattgtcaaactgagttcttgaatataaatcaaaatataagtaagcaataaatagctagaggaatgctaaaagaaatatccagcttcttctttaaagaatagtctagacttctaatcatttaactgatatgtggagaacattcattgggcaattttttttttaatttcaaccagtattaagcactgagctaggtgtttggtatacagtaatgaataaaacagaataatgaatgtcctttggagcatatggtctagtagtgatggcagctcctctctgctaggaactgaacactcttcgggacaccctggctgcagaaaggagtgacacactgcaggtctcctctgagctgttctatcactcaataaagctcttcttcaccttgctcactcttcagttgtctgcatacctcattcttccagttcgcaggacaagaacttggggcccaccaaatagccgggctaaaagagctgtaacaccaacagggctgaaacacgccccttgctcaccatgttgtgggtgacaaggagagaaaagagatggagagaagagctgcgaccctttggggagcccagacctaggagctccctaagccaggctgtaacaccctctttggaactctatggttcctgatgtctccaagcttccaggcaccactgcattcttggtgtcagctgtggaagctgcttatggtatgcctggtccagccacagacttgcaggaagcgggtgctcatgccagcacctggagctgcccaccctgctgcagccagcatgcctggctgtgtgcagtggccagaccccatacttcctcacacacccctcatcactccatgacgggctcacccttggcaggtgtgggacccagaccagtagcatgagctgagcatagcctgccaggccgagtgggccgaatgagcccagcaggccagagcaaaacatgagcaaaggcgccactggccacagaggtttctggctggcaaagtgacaccccaaggatcctgtaacagtaggagatttaataagtaaataaacatataagtatattacttcaatttttgataaatgataaataaggcaatgatcaaggtgctgtgttagagagaaaaaagaggggaaacaggaaggtatttccagctttccataaggtacttgaaggcctctctgaggaggtaaatttaagcttacatggaaggataagctagagccagttctgtgaagagaagagaaaattatctcaggcaaaggaaaaacatggccaaaggccattaatttgggaaaagcatacccatttattgttgggaactataaaagggccagtgtagctggtatttgctgcaaaacattaatgatattgtttaggttcacgaagctgaaaaagatgctaaaaccttgtggacatttttatacatttacctcaataatcagcttccttatgtatatttcccaaagataatgtgatttgattagtgccaaaattgatatgaaattattttaatttagaggaagaaaaggactatatagaaatagcattcccaagagtaccctcttgcccacgacttcaactccagtctctgcaaagatttctttcaccagcaatttcttttttgtttctcattgctatttacatctaaaattatttatatttttatgtaataagtaactaaccaaggccccataaactagtttatagtattcatcttcttcatgcataggtatttgtccatttttttattccttactccctcacagagttagattcccttcattaaggaaaatctcgattacctaggccaccagctttaggttccagtagttctttccaccatgtatctgactttgtctgttaccctatagggtacagaaaagtgacggatgccttcactgaaagtccattccgttttacatgtaaagtgtcagaagataagaattatgttctaagttctttctcaaaacagtacctagtattaatagaacgttttgtgcccaatggacactacgcaaacattcttagctgatttaacaattgaattgagaagattatgtatttctggctgtgtcacgtgtccagctcattaaatgcatcttcatgttagccaaagaattgagtgaaataataaagcatgtttttggcaacagctctttcaggtagtcaaatttttaattttaaatttggatttatttttctgtttggtaaaccaatgagacttacacttcagattcaagtcaacattttaattaatgtttactagcattaggacaaatacctaatgcatctggggcttaaaacctagatgacgggttgataggtggagcaaaccaccatggcacatgtatacctatgtaacaaacctgtacgtactgcacatgtatcccagaacttaaagtaaaatttaaaaaaataataaggcttacttgaatttgcaatggtatatttgaaaaaaaaaatggatatgttgttttaatttcactagcattttacaaatttcaatgcaagttttggcaaagaaccacatagttacataactacctggcatgcatcattttagtactatttattcagaaaggccttttataaaacaaactttcctgccaaaaaataggaagtacaaatattgtactctgattgtgtattacaacttgtcaaaagtgtgatgtggtgacctaattcaggaggcctgggtttgattacaactctacctccaattaaaactcacagtagctattttctgaagtctgatatagcattctcaaaggttctaactagaatgaggtttcttttttattattaataacttttctgtacctactatggttttgagagggtttctgaaattgtcataaaattggttattggttttcctttaccttccaaaagaagactgaggggtgtctccctaaggaagaaaaggtgctaaagcacttgcaatttgctgcttcaaactaggagacttatctagtgcatttgttctagaaaattagaatcatagacatagtctctcctggaagacactgaaagttctaggaagcacttggctacatttgaaagaaacactcaaaagagatagcttaatcgaagatgaaatccctcggaagaaacaagagaggactcggttctaggacctcagtcccagcaccatcaggaaaccttattttatccctatctgcttagaggatgcttggtatggcagaattctaatcctactttggggtgttgtccctttgaaacttaaaagtattgaaacaatcaattctctcttcctcttccctgctagcttgttgccctagttcattcctttatctcttgcccatattcctgcaataaccaccgaatgcatgtccctgcctactgtagaatggccttggaattaatttgaatggcttattcaaatcccccaatcccacccatgggaatgctaaattcagcactctcttcctctgtgctttaaatacaaaaaggatttttgagagcaaaggagaaagcagcatcacactcattctccactgatatggttaggctttgtgtccccacccaaatctcatcttgaattataattcccataatccccataatccctatatgtcaagggacagaccaggtggaggtaactgaatcatggggacagtttccccatgctgttctcgtgatagtgagtgagttctcatgagatctgatggtttcataaagggctcttccttctttgctcttctccttcctgctgccttgtgaagaaggtgccttgtttccactttgccttctgccatgattgtaagtttccaaagccgtgctgaactgtgagtcagttgaatccctttcctttataaattacccatccttgggcagttctttatagcagtgtgagaatgaactaatacatccacattctctcacttcaagccttagagcaggatacctcacggtcccagcatggacaggatgtgtagaatgtagaggagatgctctgttcattgtgaccagctctgcttgagccccagcagattcttgttcatgtaggagagaggggaatagaccaccacctgaaaaggatggaggtaatgccaaacacctaggcgtaggttttatctctgccctccttctttccatcagagcaggaactctttcttattcctccgttttctttaagaagaaggatacttatctttcattggcttgtttctctcttaaaatcaaggcagaggattcagggtctaattaccatggatttacctccattatcattcattggagacaagctcggttctaagcttagttctactttgggaattacgatattcttctggtgagatttactgagtttcaaaatgtttactcagtactcaccaaaaacatggtctttgtgacttaatttttcatttttctttagaaaatcaccaatacttaaagagaaattttgctatcttcttgtctttcttcaggataattacaaagagaacttcaagaaatttcacataccttgcctcttgtcttactcccttcagatatagctttcccactgtccccagactgtaatatccaaaaggcaaatctgaccatgccacttctgcttaataaatattcaggggctttactttgcctccaagattattaataggcatcaagggcccctcgagatgggttcccattgctccctgcactacccaacattctcagacaacattaaaatgctgcgcacaccatgcagggttttattttctttcttgctttctgtcttgctactcctcctccttgaatattctctcatccttcccctttgtcttggcaaattcctgctcattttttagggtttagttttatcttcactcctccagaatatctcctctgatctcaatgtgtctgctgtctctttg

SEQ ID NO: 17802 - DNA, 32572 bp, Homo sapiens
aaactcagatcatactcctggcccatttaagagatggttatcaaattccaattaaatagagaagtgggtatatttcaaagtgtatcgtacagttcttgtgtaatcaccctcctgttcctccctgaaaatctggcaggtgtatggggtggtggccacgaggctgcagggacatttgcccaggatgaaacagttcccagtgaaagggtcatgttggtcagggttcagcccctctcaaaacccttctgcctggggtaaagcagaaaagtccgccagcaatccgacagcacgccttcttagccacgggactgtggctgagcagtgggcttaggccccttccctctaagtgttaccaataatcctgcactgggatggattcttaacagaggtggggattaacagagctggagctctggaccagcaatctcagttcctctgatagtgagcgaagaattgcagactaacaccaaaatgcaagctcaaggcaaagtgtattgaagcacagtaatatactctcagagggagagcggaatgatttctgcgaagtgaaataagcccctctttacagggtttaaggtgcttttatggggtttgtggggaggagtcaaggtttgggttgtgtctgagtaacaggatgatgtcatttgattggcagtttatggttatataactaaaattaaactggcatggttttacccatcatttataaagaaaagcccactctggggaaaggagggtacaaccacatgtaaattttattataatgatggtataatgaacttggggtgacctgagggcatgtttttgtgttactgggcatgtgcccctttaggagacttccacctgtgccttactttctctttctttgggatgtgctggccacagactttaccaaaaactccatccattaggatggcattaggacggttctggggctaaacttaggtgggccaggggctgtttcactgtcagcctttctactctcttttcttacccactcctagctgctaatgtctatttaactacctaatatttccccctttagagaaaaaaagccaaatttttgggtagatcggtgacaattaatctggctacttcctgctgacaagaggcagtggtaataattgggttctcttttttgctctcttgtagctggtaggttgggcagagaaaagtggtggccatccaaggggcccacgtagatatcagacatggttgagacctcgcggtaaccttgtgtagaatcatttggagttttatggattctaggtgggaagaaacaaaacaaccttgtaaatcaaatgagcatcgtttgaaagctataagttgtataaagctgttttaggaccaagaaagggggctaaccaggaaaaccaggaccagttgttaaatttccaccagtcaaagcctcctgaaactctgttttccattaacttgttggccctgtctgtaatttttttaagttggtttgcactttacctgattggttgatgaaaacagcaatgtttatcaagtgttgcacaagctcccccttgattggctgtgagcaaattaaaagctcatcaatttcataagactatgcttgctaatgaagcaatttgttctgaaagggtattgacctggttagttagattaataatttgttgagtaatttttaagaagagtttctgggcagtaaaaatggagttaaggaggtcctccagttcccgtgccaataccagccagaacgccaattatagtcagtgctgttaaaactcctctttcagttttaccagattgagcgtgtatagggaggggaatgctatcgataagagtgagtttggggatgatgtaaactagggccaaatccccgtttaattagcagacaagcagagatatgccttgtttctatacaaaaatgtgatttgtcatgttaagacaaatatcaacagtgatactaaagtagggtttttccatgctgtgtaagtctgctttaataccctcagaagtggaagtcaaggctagttcatgtaatgggggaacacaggcagtacttgacagaatgaaagaggaatcaaaagcccaattagaggaaggagtgatgggatcccaaccaatattgtgaaattatggggagctgcagttttttgcaatgattttgcccgaagttgtgagactgaaaccagaagttgttatgtttaaaatgatattctggtgtgggtctggggaaaagggtagatccagaatagctggcttctttccacatagtggttctgttggggggcttgggaaatgaataaaacacaaagaagaattagaatatcaggtatgtttgcattttttgttgtcagtgactaagctgacacataattgggtggaaaatagggtacaagtgtgattgcaagccttggaaatattaggaaaaaatccaagtaatggcctcatcctcaatgaagatagaagacaaaggagtgcttagtcagatagtattacagatagacgacaggtcctcggaggttgtaacaggtttgttggtatagacttttaaggagtatgcaattgactgtgggctcgaccctaggattgacagcttattctggtcggttaacagaagtgggggctggaaatgtttctgattgattccactcagaagcaggaatggaaatggctgatagacctctgctagggaaggtgtaaacacagattcaacagtttctgtgatgttgtgcagtccgttgatgttgtgtttaaacaaggttttaaaacttctttgatggtagctaaatatgggtgttggaaaaaaacattaggagaaatgattgcaagggttaatctagtttaaaaagcaaaaatattggttactgcatttaaaacagctattttagcataaaaaattatttcacccattcaggaggaggcaattgaactgcaaatatatgagaataactataacaatccaacttaaagctaatatttaaaaaaaggcactagggaaagtcagtgggcattacttattttttggcagtcttttaaagagaggcttgaggtccactaaagtctcacaagtgtatttgtctgtggagacatcatcagtttgggcagccctctgtggttttacataggagtgtggatgcagctggcaatccagaatacacagcactgagatcaaggtagtctcgacatcccaatatccttgaccattaccaggagagagtgtcccctgctctttagatggaggctccgcctcccctggggcagtctgtgtgtctctcaagttgtacctatgtgtggaccatggctgtgcccagcatggagaccccttcctacagtgggtactacagccttgctgaaaacatttgtcccctagattctgaataaaagtggttagaaagaaagaaaagaaatgaagctctgttcaaaagaaaaaggaaaaaaaattgcaaaacgatcttcagaagctgtgctgctgcctatggcagtgtggcagggagggggcctcgggtggggtgagtgcccaaaagggtgggcraggacgatttggggagttctccaaaggttatgacccactatgggcctacccttcgttcccggctgtaaacctctaaacttagcatttatccaagctatcccatgatctgaatcccaatcggctctcttaatcagtaattttaaaaattgcatccagccaaaatgcccagtctaaagggagttgagggtgattcctggctctgtggccagagcataagaaaccattttgcctctcaaagcttccctgggctgttaacaagctctgggcttcaatggccactacaacctaatgaagttgtttaatcacgttaaacagctaattaaacctaaatccagagaagatttctctaagcccttctctaaaagttattggtggcatgttgggggatataccccctctctaatgcagcaaatacaacactcattgcaacttctcttagccaagcagcgaaacatagcacaaacatcttgacccaaagcgaaaggaagcattttagcaaaatatgtttcagttccccaagctaaaatcaagcacatattaaaagccatgctgaacgtaaatcatccaggtcacagcactaagatattaccaggaattctgcgctgggatggatcctttaactgaggagattaacagagctggagttctggaccagtaatctcagttcttctgagagtgagcaaacaattgcaggctaactccaaaatgcaagctcaaagcaaagtgtattgaagcacagttagacactctcagagggacagtgggctaatttctgtgaagtgaagtcagcccctctatatagagtttaaggtgcttctgtgcggtttgtggagagaagttgaggttggggctgtgtctgagtaaaggacgatgtcatctgattggcagtttatggttatataactaaaattaggcaatgcatgtttttacccataattttcacagaaaagcccactctggggcttttgtataataaaaccacattttattataatgatggtataatgaacttggggtgacctgagggcacagtttcatgttactgggcatgtgcccctttagggaatttccacctgtgccctagtttctctttcttcaggatgtgctggccacaaactataccaccaacttcatcagttaggggggtcttagaatggctctggggctgaacttaggtgggccaggagctgttgcagtgacaggctttctgctctcttttctcctcccagctgctaatgtctacttaactgcctgttgggagctgaaaaggccaaagggattgtgaccaactcagcatttcactggaggctatatgatcaaacagcaaactgtttatcatgaatgcgggatgtgggtaaactcacactgcacccgccgccagaaggtttcctgagggccatcactccctggtgctgggctccttgaagttatctgttgggatatctagcacctattatttgaaggatgcagtcttgcaagcctgctgtgaaccaaacggctgactgacaattacctgacaatcaccccccacctttttctcgtcatctcttttacctaataaactcagagagcttgaaaagctcagagcccttgttcactagaagcaaggaaccccctgaccccttcttcctaatatactcttttgtctttgtcttttactcccacatccaccccccactttgttcagtcaacctgggactgtggccaattacaacagcctaacaaaagtgccacaggagtggaacatggggcagtgggctctgctgaagaggatgctagggggcttctcaggggaggaaatgctagatttgcattctgatagaggagcgtgacttttccaggtgaaggtagcaggtgctcctggcagaagaacccacataaggaagtgtccagaagccacacaggtatggcgttcgacaagagcaggtctggaacggtggctcatgctgaggcaggaggatcatttgaggccagagtttgaaaccaacctggtaaaaatagtaagatttcaccccttcaaaatcattttttaaaagtagccaggccgagtggctcatgcttgtagtcccagctactcaggaggttcatttgaaccctggaatttgaggctacagtgagctattattgtgccaccgcactccagcctgggtgacagagccagaccccatctcaaaaacaaaacaaaacaaaacaacaaaataaccccaacagcaatacaatcaatatgcaataagcgtccacccggcatgtgtgatggactgtggtaatgctgatggcatggagggagtgaggtgggcatctggggagtgtggtgttattgggggtggggagtaatctggagggtctcatagtctttcagtggtaggtctttcttcctgaagacacagcaaacccccaaccctaagtatgggaggcaggtgggttggccaagaaggacgtctggggctgctcttggatcagcaggagggtgggaccaagggtgctgctggaccaaggatgggactgggccaagggtggggctgggaagcatcctgttttgcatgtttgatcaggagctgctgccaagttgtgactttcactttcccttttgggttccagggtatatctcagagmctggagaacgtgtctggttattatgcagatgcacggctggaggtgggatccacayagctcagaacagctggatcttgctcacactctttcaagagaagcttccttggtaagttaggggtggtctgaccttccccatctccccatcctcacagcagctctataagagaagggtcattcaccttttgtagatgagctcagagaggttaggtaactgactgaggtcacatctcggtccatggcagagcctgaatttgcacccaggttttagctggacttctccctccctctctctgggcccccaaacagtagagacagaggcagaatcagctcagctgggttcacaaagcttcctagggctcagctctagttccagcctgcgtgagacatggcccggtgaccccagaaggaaggcagatgttgggactgtccattcctttagaatatttggaggaaccagagaaggtggaggacaggaggtgatccagagcctggcctgtccttcttgtggcctggccaccctgaggctggccccagggtgctgctgctgaggcccgatggggacagaggatttcctttgagatacaaggaacctggctgggcgcggtggctcatgcctgtaatcccagcactttgagaggccgagacgggtagatcacttgaggttaggagttcgagacctgcctggccaatatggagaaaccctgcctctactaaaaatacaaaaaattagctgggcgtggtggcacaagccagtaatcccagctacttgggaggctgaggcatgagaatcacttgaacccaggtgatgaaggttgcagtgagtcgagatcgcaccagtcactccagcctgagtgcactcctgacagagtgagactctgtctcaaaaaaaaaaaagagagagagagcgaaaagagataacaaggaacccagaggttgtttcacccaccctgactctgagcacctacttgagccaggccctgtgggtaaactgaggccatgggagatgagtgactcgctgagggtcccatrtcaggaagttgagcaggtagatcacaggactccatgtccctgacactcacctggttccttttcaggcctctgggtgatagagaagaaagaagctgtgctgttccctagtgggaaagatggcccagacaggggcagtgagaacggcatgttgcagaatggtgtctgccacatgatcccagcttgacaatcatgagattaaaagtcaaactgtggaagcgtgagcataactgtgggagcgtgagcttagccctctgtgtttgtagaagcagaaacaaacctggaagattttggattattaacattatactttcttgcttcaatstcagagtcaggaggtcaggtgttgaccttccccctgccctccaagaggtgtgtgacactggggaagtcacttcccctctctgagcctcagggtttttcacctgccwkagggggttaggatgccctaccctgctgacycccagcaggctgctgaccccatctggggtgaggtgggaggcggggcagtgcgagtcaggggaaagttgacattgcagcccagatgcctgcaggggctgcaggaaagtggggagagctggaggcctgcatgggcttctcagatccaggtgatgcccagcaggtgagagggtgggcctggctcctcagagctcagatgacggaacatttgctataaactcaggtgcaattacatttgacatgctggcaaccaaataaaaggcaaaccttgcatatgccacacacacactcacaaattcacacacacacacacacacacacacgcacactcacacctgctattcagatttcacttcatggagccctgtgtttctcacctctgtgtcgtggcctcgaagggtctttgattctgtgcagcttcttttcctcctcatttctttaagggaggcatcgcattcattagtcttttttttctgayggagtcttgctctgtcgcccaggctggagtgcaagtagcaccatcggctcactgcaccctccgcctcctgggttcaagtgattctccagctcaccctcctgagtagctgggactacagaggcgtgccaccacgcccggctaatttttagtatttttagtagagacggggtttcaccatgttagccaggatgttctcgatctcctgaccttgtgatccacccacctccgccacccaaagtgctgggattacaggcatgagccaccgtgccagrcgcattccttagtcttaatgggcatagtgttagggacccgcctactccctatggcaggagatttagtgatttctccctttttggtgatagaaacaacgctgcatggcaccctctaaagcccctgtccctgcacacttgccctctgctccctggaggctgagacctaggagtgggtgctgtgccatgacgtgggggcactttgtaaagtgtgctgagtatcgctgacgatcctccaggacaccagaacctttcacactccatcaacagtgaaggggcttgtgccacctttacctccctaacagtggacattattagtcactttaggtttggcttatctaatgtttcaaaaacgtatgtctctgtgatcacttacatatatggttcaaaagtgagcttgagtgccttttcatatggttaacgttaatttctatttcttcagatcctatcttttacccatttttaaattttatttatttatttatttatttatgagatggagtctggctttgttgcccaggctgaagtgcagtggcgcaatctcagctcactgcaacctccacctccggggttcaagcaattctcctgtctcagcctcccaagtagctaggactacaggcgcgtgcctccacacctggcaaattttgatatttttagtagagtcagagtttcaccatattggtcaggctggtctcgaactcctgacctcaggtgatccacccgccttggcctgccaaagtgctgggattacaggtatgagccaccgcacctggctatatttttagaaacttgatttcagtcttttcatgttgatttgagcatttcttgtggattgtggacagttacctttgctttaagtattgcaaaccgtgcttcctattctttcattttattctggctcttgaatgatgttctttctaatttttaatttgtaagaggtaaaactctattcaattttccctttaagtcttctgggaattgagttttgattcgaaaggtcttcccaactcaacattgtttttaacatttcttctagtatagttttaattttttctttctggggtacacttagatccctttgggattgatttacttatttttggagaagaatttgtttcttcttcttttaaatgtaggacctatttcatgggtacctactacagacaaagaagaacaagacttttttgtgtgtattctaaggcacaacaagtgcaggaaggaaatgacctctttcccgtaaaagtccctggcagtagttggttgctgcataagagtgtcatggacccggagggagctgggcccagatgcaggcctgggccattgccgtgggggaggggaggcttggaaaccatggctatgattcagaggttagctggctcgcgtgtttttagaaatttcttttttctttcycctcgtacaaaagtaataagactggggaggacacgggagaaaataaatggaaactcagaaacctgatagagccaccaaaagtacatgaaatcagagtcatggtcttatttgttcttccccaaaaagagatgagcatctagatagcaaggaaaaacattcaatccctcaactgaaagtgaaactgaagctgggccatgttgtccagaggctggttgcttttagtccaagtgctgcctcccacacctcggatttcagccaggctgtgccacggagggcagaggccacccaggtcagtcataggggatgcagctgggaacaccgcagggtccctgccggatgctcagagtttaacggggagacagaggcccaaagagccacacagaggtagagctgcccccggaaagcagagtgctcagggagcctggggagggctgggggacgctgcagggtccaggcagctttggctgagcctctgaggatgggtgacttgcacatggtggggaaggtgggggaggcattccaaggggagggagcagcctgagcaaaggcctgaggctgggaatgggagtggggggagtagatgggctctgggaggcagggaagcagggcgtcagtgtgtacctggacccaaggtgactgtgtgggcagggagcagtgaggaaagtaggagcccgtgtgcccagttaaggggttgaacttgaccctggcaggtcattaaagattcctcaggagacctaggtattgtggctcagggctgtaattcccgtgctaatgcacgraggctaatgcaggaggatccctcgaacccaggagttcaggacaagcctgggcagcatagcacraccccatctctgcaaaaatgaaaataaaaagattgactgacatagtgatgcacttgtagttcccactactcagaaggatgaggcaggaggatcgattgatcctagaacgtcaacactacagtgagttatggtggtgccactgcgttccagcctgggtaacagagcaaaaaaaaaaaatattgaaaataaaaataaagattcctcaggaggagcacggtgtcttcacccctctctccctctctctctgcctaaggaggaggccccacagccacttgcagggagctgctttgctgagagtctctgtcctctgcatctggagagcttggctcagagctgaggcaggagggagggctccctgtctgggcctcctccaggaactaaagtccctttccgggaattgaccaaactgcaggcttgcccagrgaggacatgctgtgtcctagttcagctcgaggggcagtatccagcttcaaccctcagcggatgccccagacaagattccgagccaggccaacaacgcctaaggaggacgagaccctgggtgtagctcatcagaggtgtcaggtgtggtctgaggccccagctctctctgccctcctgctcctctgctctgtgctggctcctggtccttatggctcatgatgttgagacagctgccctggcctagggggtcacacactgaacaaagcaggaagaaggggaaggggagccctccttctatcacccttatcccttacagcaagaagcacccagaaacccctcagcacactcccctagtgcctctattggcctcactgtcaccatggttgcatgggggccccagacaatagacacctggatgcaagatccctaagacagaggcaggaaataggaagagggaggtgagaggctttcgatgaggatgcttctacacatgaccttgaggatgaaaacgcatcagggggtcccgggaaccactgcgttgttaacataaagtctgggagcaaagaccagcggctggaatggatgtgcctgggagccagctgaaacagatgcagccgaagccacagtaaagaagaaagagataggggcctgcttggagccaacccctacctttgaggggcctgacagggccacctcacagctgcctgggcttgttgttgcctcctcactacagaaaccatggaagtctctagagtcartgtttccaggctggggctgccagatcactcctgtaggtggttgaaccagttgagttcattcttctcagtgagggggacacaggtggaggtccatcggcacctccataaggggtgcgagaaggaacctgttagaatatctgggttctggctgggtgattggcaggagggcctatgaaatggagcccactctggattgggtgttgcagaaagtggggggcaagtctaccagtgggtatctcagcaaatctcatctagagagagggagaccaggaagaggttagagttgacttggtgtagaaaaaacaggcattctatttagccaggagagggagtgtttggtattttgtgggtggagcagagactcagtttctgtctatacttagacagtattatgaagtctaattgctctgtctcatttgctcacaatctcagagtcaccctgtgtgtggttactattctgtgacattatttctgtccataggagaataacacagcccttctgggagtccacgccagcttccaaatgtctgtggcagctcttccttcattctcaacacttacgaacaggaacataaataaatagaaggaaaaatatccatttatattaagatgctcttcttgttaaaaccaattaacaattaaacattctctgttacgataagtctttgcatttcaagtaccctgttttagccttttctgtatacttttctcaaatgttctcacttgaatgttagtatcaacccaaggcctttcacagattcatcttggaccaagtaaacatgatcataataatcacaatcaattattactgttgaatataagcggtataaaccaaaagtaagattctaagcctccccctcatttaaaggacttcctcctcagccagggctcttaaaatttaacctgaaagactggttcaggccrtgaagggaaatgggggtcagacatgcttcattatgcctctctggcattaatatcaacacaggctttcagtctaataagaaacattttacagcctgtttctctgtgaagcctgctagctgaaagcttcatctgcaggataaaactttggtctccacaacctcttatcrcaactcaaacattccttcctattgatctccggtctttagacaaactcaaccaattgtcaaccagaaaacgtttcaatttacctgtagcctggaaacgcccactttgagttgtcccgcctttctagaccaaaccgatgtatttctcaagtgtacttaattgatgtctcatgctccctaagtgtataaaatcaagctacaccccaaccaccttgggcacatgtcatcaggacttcctgaggctgtgtcacaggcatacgtcctcaaccttggcaaaataaactttctaaattaactgacaccagtctcagattttccgggttcacagcggttgggactgaccagtgggcatccctttgaacactgctctgaacatctttggaagcgtccttgctttctggggtaacacatatcacagtctggggaatttggttccccacaagacgtcttggttcctttgggtggaaaagaagcccgtatgttgagtggcaaggtgccactggaaattatactgattcaagataggagttcactctgattatgctgttaatattaacagtttaacataaaatgacaacatccgtacttttcttagcagcttggttaccccagccaccgaggtttctctgaagctgacatttctcccatcaggaggcaggtgtatttctctttggcacttgctcacacttctccatcaactttaaggtggtggcaccacaatccaaaccattattgaggttagcagttactaactactataaagtaacttctgttttgttaaaatttaaaaaaatcaattaataagtgtatacggttcagacaaatcatttaataaagagggctccactcactcccttcccaattaaaagcagctaattttgatgttcagattttcctttttttwttttctgagacagaatttcactcttgttgcccaggctggagtgcaatgtagctatcttggctcaccacaaactccacctcctgggttcaagcgattctcctgcctcagcctcctgagtagctgagataacaggcatgcaccaccatgcccggctaattttttcatttttttagtagagacagagttgctccatgttggtcaggctgctctcgaactcccaacctsaggtgatccacccacctcagcttcctaaagtgctgggattacagatgtgaaccagtgtgcctagccagcttttctttagggagtaaatcattttctttacataatattcttatgctagcagatgaaatagagtgagagtgcatgctctggagattgggcacttgagtttggcttctggctgtcactagctaggggctccaggtgaattacttaacttctccaagctttagttttcccctcagaactattaagatgataacagtgcctacgtaggatggttgttgtgagaactaaacgtgagtttatttaactttatttcttatgcccttaactgtagccagtatttcttgactcttcactttacaaaatggccatattaatcctccccctccttccttcagtgtttcacctcccacctttaccatggaacattaattatactgactggtaacaagtagatttagttctcatatgtaaatgttctgttttgttctaaaagttaaaagttaaccaagtgtttacattttggtgacgytttaaatcttgcttactgttgagctgagttgtacaatatggttgcacatgttttgctgcacggctttagtttttcctgatgtttctaattgcctttgttttttccccctcttgtactgtttgccttcatgatttcctcagtttttctcaaactgtgaattatatgcaatgttctatcgagtcccctttccctacagagccctttccttcttattctatcctggactggttgctttctaggcctgctgcatgcccagctgtgatccttgcatttccttctccctgggttgatttttctctttcacgtctttttctctcttggttttccttatcccctctccatgagtgtgcgtgcacacacacacacacactcacattcttcctcctctcagcctccacagctcattctcaagtaactttcttttctgttatttacttgtttttcttttaacagagacagggtcttgctctgtgacctcttgggctcaagagattctccccagtcagcttccagagtagttgggactagaggcatgcatcaccacacctggttcatttttgtattctttgtaatgatggggtgtcactatgtggcccatactggtctagaactcctggactcaaagaattctcctgcttaccctcccaaagtatggggttataggcatgagccaccatgctcagactcaagtagctttctatgtaattattatgtatggtaactttcttattctatatctagctctgtttttgtttttgtttttttctttttctgtcatccttttagttgattttctggaaagcttccttgcctatctttttgaatcttgtcctagagttgtttattttctcaatcaccttttaattctcaagaagtcttttttgttccatcatctttgttccttttcagtacataatgttctcatttatgaataaaacatttttatgtccctgaggacatgggtttgagtttttaaaaattattttctattttcgcaatcatccatttcttctggactcattttttacttgttatcttgaccttttccccattttttgtctttctgctttatctgatcctagatctattcatattaaagaaaggggcaggtccactggcagtcttccctgtagagtgatgaaatgagaactccttggcatcaggatacaaagatattatttctggggcctttagatgcagttatgaagtctctaattttttccattggtgtagactcacggctactgtgaatcctgtatgggtcgtggggctggtgaacttctcccctctctgaggctctgcttagcaggcaattcttggctgaatgtgctcttggtgttgctgtggattgcagatccctttacccctctctattcagttgtcacttcttcagccagttctgtcttccaaatatctgttgaagtctctgatctcctgttttcctcattcaaattttcatatgtatatattttttgagacagagtcccagtctgtcaccagggtggagtgcagtgacccaatctcggctcactgcaacttctgcctcctgggttcaagcgattctcctgcctcagcctcccgggtaactgggattacaggcacacgccaccacgcccagctaatttgtgtgtgtgtgtgtgtgtgcatttttagtagagacagggtttcactatgttggccagcatggtcttgatctcctgacctcgtgatccacctgcctcggtctcccaaattgctgggattaaggcgtgagccaccacaactggtccattcacattttcattggcagcagagggtgcagaggcagtgtgtgtgttcttgagtccgtctggttgggtgggaacccagtctttacaccttagtagatttctgagattgggcaagtcgctgaacatctgtttcagttttcttatctgaaaatggaaatacaaatggtacccacttaataggctcttggaagaggactgtgagttattatttatamcatcttagagcaattagtggtgcaaagtcgagtccacaaatgttcacccctatttctcattgactgttattatacctataagtgccttgactaacactgtagtcagatcttgaagggatagtcaataaatgttcttctaccttcttagaacaatgcctaaacataatcaacatttgctttcttttttctcatttcccaaggcaagatcatcacaagcagaatgtgaagagtgtttctctgtataaagatcagcatttatttaggctggttgtagtggctgatgcctgcaatcgcaggactttggggggctcaggcaggaggattgcttgaaaccaggagttggagaccagctctgggcaacaaagcaagatccacatttctaaaaaaaatttttttttaatgtgcctagcgtggtggtatgtacctgtagggacaactacttgggaagttgaagcagaagcatcacttgcagccaggacatacaggcagaagcaagggggacaaagggtgtccagcacagcaccagtgaattcaccaagacagacacttgggcatagagtgcaagacacagatttggaatgaggagtcatttacartaagcatgtatgcatgagtcaatatttttatatatttaagggagtrgagcccagtcatggaagacatgggatttgaatcagaagtcctggctctacccctattgtgaaaacatggcaaggttgcttaacatttgaggtttcttctgtttcaaaatgggagccacrgttgcacccatctcctggcctgtgtgtgatcatcgaatgaggcacatatgaggagccctgcagatcacagacacccagtacacactggctrttatcaattagttatcacacatgttgccaggcccaggtcattgtcagaacgttccttcccatctctatttcggtgtatagactctgtagtttctgtgattatcagatgtccatcccttcctctgattatcttctcttcatacccctacaggacaaaaggaccctgccttggtgtgagagtgagggcagagggagctggagcaagtagaatttctctaaataccagctggctggggcccaggagattaaaaaacaccgggctaggttggtcttggcatttgctgacacgcaaagggattgcagagatccagcccctccaacctccctctgtccacaggtggctcacattcagtcccacaatttgctttctcctcctcaagggttaagaaaaaaaacgaacccttccagtcaggtcagtgactggagagctccawggaaagtctctcagtgacctggctgctggcaccatggactcaggtaggcttgcttcttcctcttccctggctggttcctactcgcacctagaatggagggtggcgtttccacaactcagtsagccccagaggaacccggatggtcaagcaggccgatgagtcttccctgagccccaaaagaggccacatggagtcccccgacccaagggtctgtgggggcatctatgtcctgacctctcctcaggggagcatggcccaggtgcccacttcctccctgccctggcacctagcaaaygactcaagtggggcaccacagccttggggaagtggaaacagcagggtcggggagtagggggagagcagggtccaggaggtgcggagggctgagagaggaggttgaccagcagycccgacctctgacctcccgctctgctcccagctgaccctggggtgtttccagcacaggccagtcccctccctccagctcttgccctgcaccagcccctctgctctgagtggccctgtgaaaagagtgactcagcgtcccactgaactgagccccattctggccttygccacgtcttctctgtgtcacctggagcttcttacctcccctcacctggaatgcgagtataatatttccccatgtggtcatgaggatcaaatagtacatgggtacctggcccagccagtgcctgccacacagtagggcctccctaagagttggttcccatcccctttacctgccactgttgattccaggtggaagcccctttttgtcccccagggcgcctgccctgcacggcccatcacaagcacctgcttaccagggatgactgcctcaggcagggcctcattcccatgatctcaaataccccttgtcaaagaaaaatctgaggtccaatcgaattttgaagactttatttgaggaagaagcaagtcatgaagtgggaaacatcaaaatgaaagacatttcatgttatgatggaaaagtgtcagaggcaggtatttatagggtgaatatggaagtggaataaggacattatttgatttgttgcagttgtcaaattatgttttttggtttaccttgttggaaaattcctagtcgtgtacccgtctgtcagctggctgctcatgactggccgaagttaagttttgtttgtgcctaacgtaagcacccatctgaaacgactccagttaagttccccatagttggcagtttaaggggggttacagccwttctgaaggcctgtttgcttttgtttgcccaggtgttcattttaagtttgctttaacaccctggtactcccaccccagcaataaatacacagatctagtgctggaggttccctccatccaaccctggtttccttcatcctttcagtgaaggaggaaaaaataaaagcaaaatacccstcacccaagtcagcactgtgttcatttccctaaggcctgttttctcccctcactgagttgccttggcaaccaagtcacatctgctcaggagccgccctggacagcaaactgggctctgctgagtcctgtccaagatgaggagagggcagggaagattagaagccgggacctaccagccaaccccggaatccttcagaagggcttggctgggaggctcaaggaagaaactctstctccgaaacaagatgatctgtggtttaataacgcggccagctgggttcagaggtgatagtggggagccatgtcccctgagaccagcctgcagaggacagaggtaacacagaagggccacagggatcagtgctgagggtcttgctcccctgcccgcctaaagaaccccctccactgcccatctgagagcgcccatgagcagcaggaggaatcctctgtgcatggtagtttattcaatggtgtagggttgaaatattctttttcaataaaatgtttaaaatcccacaggtatactacagtggagaatgcaggaaccacaggcattttcaaaatatatggagtcttcaaagtaatggcaagggaacgctggccttgagtcaaatcctgagcttcctgcttgctgggttgggtggtgtctttcgctgtctgggtctcaatttctccttctgtgaaatgagaatgaggcctcgcaagtgtgtccacggcaggaaacgattttacctcatgtcccagtgcatacataaatccatactgcttcccagtcccttctctgcagttccataattcccaaatccctgcaaaccacacatttttggggcaactcmtctgggcagtaatcctgctgtgtactaagatgctttgtactgataatattatgtatcccatttaaggtgaatattcattggtttctctgttgaaacatttgtacctttgattacaaggttgaaacatttgtagcgttgaccagtgtgggagtggtcagtgatacagcatatgcaccctgtgtcatattgacacagattgaaaatgctgccatcctaaacacatctakatcccaggaatttacataagggtatatatatatacacccttatgtatatatatattatatatatttcaaatatcttacaaaagaawactcactcttgctgtgttcaatacactctgatattttcaatgctcttttctttttaaaatgctgctcttgacaaaatgaactattttcataacccactgatgggtcgaaactcagattttgaagacactggtgtaaagcgtttgacaataggcacatggcagraggaagcgatcactggaatatttcccgtacatggggagaaarcatggtggaaagctcactttctggtgattctcagctgaaatagatyggttcctccacaaagcaccrtggcacttccctggtgaatcactcttctcaggatgccttagtaaaacgccacaggctgggtggctccaacaactgatgtattttctyacagttctggaggcaaaaaktccaaggtgaaggtgccagcagggttgatgtctggggagggctctgctcctggcttacagagkctgcctcagggctgtgtcctcacatggccttcccagtgtggggggtgtatgtgtgtgtgtgtgtgtgtgtgtgtgtgagtgtgagagagagagagagagagagaaagagagacagggagagagggctggaaggcaagagagacagcgagggcggggtggggtgaggagagagagagagatcttctgcctcttttttttcttttaactagacaccagtcctgtaggattagggccctacccttacgactctctttaaattaatgacttccttaaaggctcaatctccaaatatagttactggggtttarggtctcagtatatgaatttggagggcacacaactcagtctatagcactgatgcctccatcaaaaataccccatgtgacagctggttgaggaggattaacmtcgaaccaccttattctcaatgccatttaggctgtagcacactttcttccaatcttatgctttttgtttccaagtagaaaagaaacgctttactgaagaggccaccaaatacttccgggagagagtcagcccagtgcatctgcaaatcctgctgactaacaatgaagcctggaagagattygtgactgcggctgaattgcccaggtaacctccgtggggttacctccatggggcgccccggctatgccatcctgatctcccctgggctagttttctctggcaggcacacctcctccaggcagccccctctgctgaacttgagaatgtccctctcagcagtccaggaggaatatttcctccaagtccttcgctggcagtgagtgacctcaggctgaggggagaggaagcccacaagggcagggtcagttctgccatctactggtgatgggagctttgcaagctacttgactactttctgccttcctttcttcatccattgagctttattgtgagaaaaataagctaatgcatgtaaagtatttagcataatgactgacacatggtaggtgctccgttaatgttaccttttaaaaagattgctggggagagaccaggaccaaaagtgtttttctttttttttcyttttttttyttttttttttttttttgagacagagtcttgcttgtcccccaggctggagtgcagtggcatgatctcggcycayygcaacctccgcctcccggtttcacgccattctcctgccccagcctcccaagtagctgggactacaggctccggccaccgcatccggctawttttttttgtatttttagtacagacggggtttcatcgtgttagccaggatggtcttgatctcctgacctcgtgatcctcccgcctcggcctcccaaggtgctgggattacaggcatgagccgctgcrcccgaccaagtgtttttcttagagttggatgcccagcaggactttctttgaaaaaagccagaaaaatcttgacctgatcaatgtgtgttcctggagatgctgtccggggcccttttcttccacctctgaggaactgcacaaacacagcaggatcctcctgctgacmcagaacacagagaggctggaatggagttggacagagctgggggtggatcttggctctgtccctgcacagctctggggctgttgttttatgtcttggagactgggacctgccatctctccaatgctaatagtagttcaatcagatgggcrtgtggttaaagcctgagaatgaacagcaggtcaraggtggggaaccaagtagcatgatgccatscaaagacccagagagacgtttcaggggcagagccaggggtcaggatggggcaggggtgggcctgggttggaggagcagcaggaaggctcgggcaccaaggctgggagtagggtgagaagagggaggcactgagggcatgaaakgtaacgtggccatggacttgcagaggaccagtgagtgggagagggatatttcttccctccctgatttgatcccatcactgatgggcatagtgggccatgggtgactgtttccctgacagcatgcctgggaactggggcrttctgaactgccatttgggaccctcttctgttctacatagagtagaggaagtgtttcttcgggccagcttggagagttggaacaagtgtctgccaactgggtaatttgaagggttctcaggagactcacaagtccccaaccaaagagaaaaacactttctctatcatcttgtccaaatgcaggtcttttcagcattagtgatttatagagatgattttcaaagtctcatgagtccataagaggttccatgaaattgcacatggcattggyatgcacacaggtgaagctgtcacctgctaaggcattagtttggctggygacatgtgacagtgagaccctgaagcttggaggtgccaggtcaggaggcmgtcaagtggcttgagagttcatgtgcagccaggactaatagccaggcctttcacttttcagtcaaagggggcagtggctggacccagtggccttcagtcagaagatcaaagggcatgtggcattggaagagagaacatgccaggcaaggtgatctcttccagtctgaggttttatttgatagcttaaggactcagagttagtcaaaatgcaatgtctgaaggcacccttcyttctgacaccagttgcagatttgaaggtgtttcttaagcccccactcaggtttgataattcactacaaagacttacgtaactcactgataactgttattgcacgattgtggtttatcacagggaaagaacacagattaaaatcagcctaaggaagagacacacagggcagagtctgggagggtttcaggtgtgaagcttcgttgtcctcaggacgctgtgttctcctgtgtgaatgtgggacaaaacacatggggtgttgccaaccagagaagctcacccagttaaggaaaaattcctgtgaatcacattagatcaggaagcctttattcaggattgttgttacaggggagggagactgagcccagctcccaatatagtaaagacagagggggagtcacagccaacaccagggtgaggagtgggagatggaccagttctgactggagacaccagaatggggggtttctgctaaactggcctaacaagctgctcaactaaaggcaggtaaggagcgggtgaagaccgtgatcagacagcaagaatgctcagacagcaagtggggaggaccctccctaactgccttgggggattcttgctgaactggggcagtacaggcccagcaagcacgggatgggcatggaaggtcagcgcctagaggagaaaaggctcagagcagcctgactggagtttggccaaggagaaagtctttctcaacctatgcctcaatgtacagagctctttctggggctggatcacaagctgtcctgatggctgacatggagtccccagcccctccctgaggtctaacacccttagttcccagttcctttggaaggcagaaaagatacgtaatagccccaaaacccatcacccataacattgctatactgtgctgtagccaaaccaccagggaaacaaagatgttcctaccaggcaggacattccagggccccagagatcccttcccagggcccaaagacaaaagaacgacctctcttctaataaagttaatccttcactgttctatgatcctctgaatgaaggtctttttgctccgaacccacttctctttgttcatctacaaaatttcccctctccacacactattggagggatgatgttgacctctcttgcttgaggagccatctttatcgaatacctaccactaaagagcatctgaagatgactttaagttttttattcccatacagaataagtactgtggcatatctatgatatacaaaacatgtttaaccttggaaaaattattttaaatttttccatttaaaatttaaagctttatttccatttgactcatagtaatagctctgtgatttatgtagaacagatcttattgagctgattttacagataagtaagctgcctttcttaatcatctgtcctttattggtacagggatgaggcagatgctctctacgaagctctgaagaagcttagaacatatgcagctattgaggacgaatatgtgcagcagaaagatgagcagtttagggaatggtttttgaaagagtttccccaagtcaagaggaagatccaggagtccatagaaaagcttcgtgcccttgcaaatggtattgaagaggtccacagaggctgcaccatctccaaygtggtgtccagctccactggcgctgcctctggcatcatgtcccttgctggtcttgttttggcaccatttacagcagggacgagtctggcccttactgcagctggggtagggctgggagcagcgtctgctrtgactgggatcaccaccagcatcgtggagcactcatayacatcatcagcagaagctgaagccagcaggctgactgcaaccagcattgaccgmttgaaggtatttaaggaagttatgcgtgacatcacacccaacttactttcccttcttaataattattacgaagccacacaaaccattgggagtgaaatccgtgccatcaggcaagccagagccagggcccgactccctgtgaccacctggcgaatctcagctggaagtggwggtcaagcagagagaacgattgcaggcaccacccgggcagtgagcagaggagcccggatcctgagtgcgaccacttcaggcatcttccttgcactggatgtggtcaaccttgtatacgagtcaaagcacttgcatgagggggcaaagtctgcatctgctgaggagctgaggcggcaggctcaggagctggaggagaatctaatggagctcactcagatctatcagcgtctgaatccatgccatacccactgaccccagaccagtgcagccagcaggggaggtgagccatacacaggccacgacaaaatgcaggcattttattagggggataaagagggcaaggtaaagtttatggagctgagtgttagtgactttggcatttctgtagctgagcacagcaggggaggggttaatgcagatggcaagtgcaccaaggagaaggcaggaatgctggagcctggaataagggargagaggggactggagagtgtggggaataggaagaagaaatttcctttagactaacgaatatattggggggaggaatagaggggaggtgtgcaggaaccagcaatgagaaggccaggaaaagaaagagctgaaaatgcagaaagccgaagagttagaacttttggatacagcagaagaaacagcggctccactaccgacctgcccccggttcgatgtccttccaagaatgaagtctttccctggtgatggtcccctgccctgtctttccagcatccactctgtcttgtcctcctggaagtgtatctcagtcagccagtggcttcttgatgatggcggtggaggtggtggttgtagtgtgatggatcccctttaggttatttaggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaagctggacttattcgagtcattccttggtctcctggctcctttctcgctttgggagcaagttcctgtctgaagtttttgtctgaacagtggtaaaggtgatggtgatgatgtcagcagacagcaggaggacttgacaaatgtcagccctgcttggggccaggatacactgagggaacgatgacattccaatgaaactccaaattctgtattggaaaagtcattgatttgtgaagaaaaataaaaggaggctgggcacggtggctcaggcctgtaatcctggcactttgggaggccgaggcgggtggatcacctgaggtcagtagttggagaccagccaggacaacacagtgaaaccccttctctactaaaaatacaaaaattagctgggcatggtggtgggtgcctgtaatcttagctactaaggaggctgaggcaggcggattgcttgaactcaagaggaggaggttgcagtgagccgagatggcgccaatgcactccagtctgggagacagagcgagactccatcccccgcgtcccccccccaaaaaaaaacaaggaagagaaaagcaaaaccagatgccaggaaccaatcaaggaactttgtggtgcattgaggagatgaaccagcctgcagtcaagagaccccgcctctctgagcctcagtttcctcatcagctgggaaagaggggctggacaagatgatatctcaggtccacctggctctctcctcttgtgttctggagatctgggttcaagcaacactgatctatgcctgtgcctttgtggtgctgatggatgggctcccctgggctctcggtgcctgacttcacttcctcatgatccttcttccagggactcagggagctaggcctccatggccccttctgcttgttcttctggtcggtcatttctgggcgaccccagtgcccagtggcctgtgaggcactcagggaaagcttgtagacatctggcttggcccaagtgcaggcatggtccccatctagcagccagggcccacgaatgacatgggtcacacaaggctgactaaaatcagaggggcctgtgtgtaggttgagagaaagtccatgagaaatagaggaacagagagagatagccagacagcaaacaccctcatccagtctgcaaacaccctcatccagtctgcaaacaccctcatccagtcagccctctcatttcacccagactcctgcaaaagcttccagaatggtcttccctgttatacagcccttgccactatccctgcccatcctccacactgggccaatttgccccgtaagaacatagatttcttcaagcccatgcttccatgtcttcaatggcttcctattactcttagcacaaaagcccagagccttcatgctgtctaatgtaggctgctgtggcctgagttcccctgaagggagagccctaggcaaggctcccaggcagaggatttgtttgggaagtgattctaggagcaggactggggtactgggaggagtgacacagagaaggacagaaggctgatgccgggagaaattcttgatagggtcacccatgtgggcgactggagacctcctgaggagtcttcaaggagcgtcttcagaatgttcctctacagggaggagagagggaggcctgtaaccactgctcctgtcccccatggccttgccccagtggacattaattatctgtatttccatgcatagaatatagaactgctgggcgcctcagctggagcccagagcaggggcaagagatacagaatgcacaaaatcaccccagaacctctcctaagtcactcgtaaagtgcacccagggcctacttagtccttttttatgtagcatcctgcagaacacttgcctcagtccctgtaactctccatcagccaaggcttccctgaccttcagttgattcatctatttcttcctgaagaagtcaacagagcaacggccaccgacttgcctaacgccagaacattgtgtttcatttgtttgtcaattgttcatcaattcctggataattcccattcttttcatacatttcacttaagctttgaatgtttctggcactgagtaatttacttcttcagtgatccagccagcatttgccctgacacttagagttgaaatgccatcaggctacctgcatttgatgcaattccactgtactgctagtattgtttaaaaatttttcaattgcaagcaacagaaacagaaactatctgtcttaaacaaaatagaagattcattggatgaaaactagagcaggtcagaggatggaaggaagaacaaaatctacagaatttggaaggacaggagcagaccattaccaacatcaggaatatatggtttgccctttcagggctctgcctgcacctggcttagctccacacactttgattcctagtgtctctgattaaagtttcacatactcagtagacagaatagcttgggttagtgactcttcttgaactaatcagtgaggctatggtatcaggaatggggatgggtaacagagacacaaaccctaatgggaagcctctggccaaacagccacctgaatttgtgctcattgtatacagtcaatcgcttgctactgcacacacactcttcttctcatacaaacaaaaagaactctccttatctgctatgaacccagccatcccaaggaaaaaggcaaatgcacttgcctcttccccagtgagagccacacacagcatctccaccttctgcatgctgaagttatgtcacaggaggagggcctcagcacacgatcaatttttcttttggtccattggcagcttctgtctcagaatttttgtgtgtgtatatttgtagaaaataaagaggtacggtcaaggctacagccactactgaccattgctgccaccatcagaagtcttgaattgttccactcaatgttcctcttacttatgggcaaagtcattctcgtggtgtctaagctccttgatggtctggcctcagtaagttggtgaaatttcctattcacatttacactaatactctaacactttagagtattacaaggagcaatcctaggggatccctcaattcctcctgtcctgctgtgtaataacaacatgagcttccctggaggaacatgatgcatgattatatccaacccagtgacgtcattgctatccctacatcagggagcatgagaagccagctatggtttctgctgaaacaacttttgtcaaccttagatactgaaacttccagacctaaaagtctgtgagttaggagtatgtatcataaacaaaatttttgaaagtggtttattgtgggtaaccatagagctatcaccctcatcttaacctctgactgcccagctccatgaattctggctattacaggaaatggggaaaattctgggtatggattcaaaacatatcacatcctaagggcagctcccagcctctgatatggagctgagtcccctttgggccatttccatgggacctaaggctgtcatttccggggttgagattcactgggtgccaagtggtcagccttgatgagtggggtccgtgttgtgtggttacatagagctccacattaggcaagttggttaatgagcccattctgaaaatgtcaggctgcctggggaacagaggagatttgagccttaaagagtgacttcttcccttgtttattaacagcctctgagccaggcatggtgactcacgcctgtaatcccagcacattgggagaccaaggcgagtggatcagttgaagtcaggagttggagaccagcctggtcaacatggtgaaaccctatttctactagaaatacaaaaactagccaccagacatggtgacgggtgcctgtaatcccagctactttggaggctgaggcacgagaattgcttgaacctgggaggcagaggttgcagtgagccgagattgcaccactgcactccagcctgggcgatacagtgagacccagtctcaaaaaaaaaaaaaaaggagtcttttttgatggtggacatcttccaatgagcattcacatgggacagatttttttttacttctaccgttgttctgaaagctctatgtatgttcctcttccctaaaaatctttgtcaccaagcctccagatttattccttctaaaatgttgaaattccagctaattccttagttgttacccaggaaacaatgcagatcctggtccgaggatgcagctccttccaggcagcctggactgtgaggtgtgctccattgctcttcaggaaccgtccttgagaggcgttccacagcaggccagacctggggggagcaggtgggccaggcggaaagcacagcacaatttgagagatgctgagtactcatgactctgtgtaagcacctgaattcagccctcatggtcttttctgagctgtcagtcatttatctctatttagtcattttgcgaattggagttagcttccttccctctacactcaaagacggcatgtcaacattttaggcctctgggtggaatgaactcccagtttcctgggagggagctgattggcatctattcgcctcttcctagttttgtggggtttcccagcatgtggagtcatagagaaagactggtcccaccttctatgtaatgcccaagagaatagatgactctctgtccacccccaccctggcatccagggcttctggacaagacctaggctggctaattggctgcttccacatgggatcctgaatctggagcaagtgaggcaaagcccagggtgcttagaatccattctcagtgagagcagcaggactgcccgggaggggaatagagacggggacgaccgagtcctgcaccagcagagatgacgtccgcaggtggcagggcagcgctgtggccgtgtcactcctcacaaagcagggctcttgtgctcgcagccttcgataccgtctcactgtcttggcttctatttatcttccaagccaatttccagcctcctacacacgtggggttcttctggtatcattccagtgaatttcatgttgttttctgccctaagaaaacagagttggtacctctgctcgaccaagaagcctgattgatacagactgagagctgcaggctgtgtttatttgcttcattaacaagaacaacttaggaatggcaacttccattgatgagcttcctactttgttctgcggttggaaaacaaacagttgtttccctgttgacgactggccacactggagaggtgaacaggtgagtcacaggaatcactgcttctgctccctttaaatcttgatgatggcagaaatctctgtaactgcctctgtaactcctccatgaagttggtgttgactttgagtaaaatatttaggcaggtatgtaaaaccaatggcctccactggcgtatgtcactgaaatagtccccgtccgtgggtctgggtgaacaatctgaagcttccaagagtattctttccagttatccacccaggaatttgaaaaatgatgaccaggtgagggtgggaccctgatggacttaatcaaaggtaaacgaatatagatattcactaattacttgtgccctataatctccccctctgacccaggcctaagaattgggtgacaagcagggactatccagcctgatgacctgtgacaggtatccactcaccagattgggggttttgtaaagtcagtggactgtcttccagctctattttggaaccttgttcctatcaaatgtcccttgagccatgatcatgcgccctcctggtgcgtgacctggcgcccgcactctcttttcttctggcagttacctgcctcccctacagtcggcctcttggaatttctcccaccctaaagagaccagagtcccagcccctcccctattatagagagttcctggttatccattgactcttctcgttaaaggagcgggaaatcttttgggccctggcaggaaacagtgtgggcaggaagtgcttgagaaatcaaatctagcatttcagcctcctacacacttt

SEQ ID NO: 17803 - DNA, 86361 bp, Homo sapiens
  misc_feature (1)...(86361): n = A,T,C or G, or insertion/deletion polymorphism (see Tables 1-2)
gcagcaaagggaagccaagccttagagaagcctcatggaagggcccagaacatcctgcacccatcagttactcggaagtaaggggacaagaagcagctggaagagagctgggtgtgggggctgggaggagtgctggagaaatttccccatcagaaggcccctcactgggcagtggaggcagggcagtgtggtgggactgactcaacagacatagtttcatctccaccctgcccttctcaggttgtgtgaccccagccacatggacacccgagtctgtgaactaaagggctggtccatggcattaacagtggagggtgtccaggttcttgatgtcttgaacaaagaattgggcaaaatgcacaaagcaaggaaggaatgaagggttttactgagaatgaaagtatactccacagcatgggagagggcctgagcatagggactcaaggggcccgttacagaatttttgggagtaaatacccactagaggattccattggttacttgaggtacaccctatgtaaatggaaaggatgaagtaaatttacaaattcatttacagcatataccctatggggaggatattccctgttatagctgaagcgtgaattggccttatgttccctgcctccagaccctattttcctgcatcaacgggaaagggtcagattcactggctcagctgtttaacctgtcctggtgccagcagctggagctgggtgtcaggaccagcccgcaagctcttccctgccggaaggaccaggccagtcgctgtccttttcatgctagagagtggttgtggttgctgacttagcagagaaggtgcttggctttccccttaactggagaaaaaactttctaagaaccaggcctggttggcagcagacctagctttcttggggtggcagggaggctaaagcatacctcaggacagtcagtggtgggtccagcttcggctggaggttctttctactgaataacttctacgggctctgtcattagcaggatttgtataatttgaagcagagctgggcaactgcagagcaatggggaagccagcccagtgtggtggcaagacctgggcaacttgggaccagcctgggctgtctcttgccagctgttgttatcagaaccaggctcttcacactcagatccttgggccccccatctcagaatgcccagtggttgaaaggatgaaacctggaatttaagtgacttctcagtgatgtgtgcccttctctgacggttccttgttcatcccatgtatttactgactgcctgctatatatgcagagccaaagagtggggcctggtcttgaactatctcctcatctgccccttctggcacctccttcctcctgggctctttcctctaataccgtcatcctctctccaacctggttaatcctgtcctttctgccctcaaatgggcaccttcaaagaaacaaatagaactactccactcgctccctctctccctccctttactgccactattgattgttatagtcacttgctccaggaagtccacttgctgagtcttactgcagacagagcccaccccctgagctgtaaaggccctagggcacatgtttgtccagctgcctcttgcagctgggattgttaggtcactatagcgctaccaactgcatataccactgtgggagtcgtgctggtggcggtagtggtcacaggtaccaggggcagcagtgaaggggtggctctaatgccaagtccagtgaccagtgccagggtgcccagtggtggcaacagtggtgttttcagtgtgatcttggacattgctcctgtctactcagctgctagtctgtgagctccctgatatcctttaagacagcgttttccagcagcggcactattaacgtttggggctaggtaatcgttgggggtgtgagtgtgaagagggctgtcctgtgtgttgtaggctattttagcagcatcccggcctctccctgccaggtgcctgtagcagtcccccagttacgacaaccaaaaatgtgtccagacattgccagatgtccactgggagggaaaacctctctggtccacagcccttctccttattccagtcccacatcttcctccccttccccatcactgtcctcagagagatgctgttgacagctccttgaggtgattctctcaggcttgttgttgtagttctctgctgtcaagtctgagctgactctctcttccggattcttctttcctcacctgcccccgtttgcatgaagttttttatggagctgtttctattttctttttgggcagccatactctctaagacctaaaagctgaatactcgcccggttactacctgataattctcatcgcttatgtttccaaaaccaaactggttatttccctctctaaccccatctctgtgtcaaacagtggagtacatgcttttggttaatccaattggaaggcttcctagaggaagtaatatctgaactgaatcctgaaagattaggggaagaggaagaaaaggacaggtgctgtgggaaaaaggggaaagtgtcagaggaagtaaatgaaaaaccatatacaaaattatcttctgtgacccgtagcacatgcccaatccatggtagatatcgaaacatagtggttacccagtctaatccatcccttttctttctttctttcttttttttctttttttttgagacaagtctcactttgttgcctgcctggagtgcagtggtgcgatctcggctcactgcaacccccgcctcccgggttcaagtgattcttctgcctcagcctcctgagtagctaggactacaggtgcttgccaccatgaccagctaatttttgtattttcagtagagatgggtttcaccatattggccaggatggtctcgatctcttgacttcgtgatctgcctgcctcggcctcctaaagtgctgggattacaggcgtaagcaaccgtgcccggctgtccatctcttttcagatgaagagctcaggttctgaggagtgacttgtcaaaagctgttctacctctcagagccagcccttgtcctcctgctagccagagcaaggtaccacctggaagagatgttcagttacatgggatccagggccagagggaaaatatcagtgcttcctgaggttcgggtccagccacccttcttccaccatttctactgagccttcagttgtaccccttcagtccacttggcgaggcatcacgccctctgggcaggctcagtggggaactatgggagcaggtgctgtgtgccacctctggagggggtcactgaggttctgggttgtggggggtgccctgggccagagtgagttgtatgggagttgttgctgaatccccccagagtaccagtcacacaccagtgtgaggggccttgcaagagccactgggcagcacagttgaaggtggcaccttcctgctcagtgctgtgtccagagcagggtttagttttctgtgtctttcagggtgagactggtgtattctataccagcctccctgtgtgtgaacaatgacgagaacaatgttgtcttgctttcccaaaaaataagacactatctatttctcattagttatacacgttcattataaaacgtaatttaagcaatactgaaatgccaaaaagaaagtaaaattcactccaaaagtaaaattcaccccaaatctcactactcctgtaactatgtctgacagccagctgttgggtcttccatcgtttttaaccttcaggtgagcacacagatccttattttttcttttcttttctttcttttttttttttttttgagacgcagtctcctgttgcccaggctggagtgcaatggtgcgatctctgctcaccgtaacttctgcctcccgggttcaagcaagtctcctgcctcagcttcctgagtagctgggattacaggcatgcaccatcacgcctggctaatttttgtatttttagtagagacggggtttcaccaagctggccaagctggtctcgaactcccgacctcaggcaatccgcccacctcagcctcccaaagtgctgggattacaggcgtgagccaccttgcccggactctctttgtattttttctttcttttttttgagacagagtcttgctctgtctcccaggctggagtgcagcgacatgatctcagctcactgcagcctctatctcccaggttccggcagttctcctaccggttagctgggattacaggcatgcgccaccacacccggctaatttttgtatttttagtagagacggggtttcaccatgttggtcaggctggtctccaactcctgacctcaaatgatctgcacacctcggcctcctaaagtgctggaattaccggtgtgagccaccgcgcctggccagatccttattttttcaattgcaatacagcagtatgcaaggcacttactgtatgccaaagcttatgccgagagctggctgccagcagctcctcctgcctcgaggcctttgtccatgtcatcatttcccctttggctgtaacagctgcagttctctcataattttaggtttcatcttaaatgtcacttcttcagaggcttcttgacagcacaagtcagggcccttgttagtttcatcacatccattacctttccttgatcacttgtaccatcatctgtaatttatttttatgtttaatacgggtgtgggatttctgattttttttttgctagactggaagctctcagagggcaggaaccatttgtttccctgccacagagatgttcaataaatattgtcaattgaatgtgcaaataatctcacttaaccacagctatgagggatgctattttatccccattttagagatgactaaactgaggcttagaacaattaacccaaggtcacagtgaattagtggatccatgtgtctgcctccacacagcctgtgtgttcttaattattgatcactaagcaacagctgcctctcacaaactggcaggaaacttcaacttttcccttttatcaatatattgtgaacgccttttcttgctaataaatatacatttgtgtgcgtaatttttaatgatcccatggtattccatcgtgtggatgtaatttacatattcatttccttattctcacttcttcctagttacagcacttctttaagcacttgtaatttttattcctttggataaattcctagaagtttacaacacgaccagctgcaagatggggcagtgaggtgcttgaagsagtgggtgggctgcacttcagaatcccggtggaactttttcaaaaaactcgtgcccggggcccccctctcaggaggccgtcggtgggcctgggcactggcgtggttttcaggtcctcagtggttccgaggtgccagagattgaggaccactggagtaagcgcgaggtcacggcgggtgcaaagcagaagacgtaaaatcctgaccgccctgggacaatctgcaaccttgtcaagcctccgtgcccgcctttgtaaggaggctgggagaagcgggacttggatgacccggactcccgtcccgagcgctggggtccaggtttgactccgctggctttctcaggcgggcagggcgggggtaggcagctgggaagatgacgtaatgtgctcccagccaggcctggaggcggccagcggtcgcaggtggagggtggcctgttaacccttcactcccaggccagtggacggacttgcgtgtggcgcagatccaacggagaaggcagcggctcctttaaacaaggcggagaaggttaagatgatgaccggacggctactccaggcattcgctccgaggccgcggggggagggacctcactatgcaaatctgagctgctgatcgatgacgcgccatcaccccacgcaccgcttcgctcgcccattggctgagatgagcctggtcccattgacaacaaacaggggggcgcgcggcctggaggcggggccgcagggggcgcgggctggggcgggggaatcccgccccgccctttctgtgcggcgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacggtgagtggtgggtgggtgggagtgcgggggccgcgcggggaggaaggggttacggcggcgcgcccgggtgcgcgtgcgcccaccccccgacagccccggttcgcgcgggaagaaccccgtgcgcacggtgcccccggcggtcctcaacccttccggcgctgcgagcgtgagcccgacccagctgcgccgctccgggaggccgtgggatctggggcgccgcggggccgaaagcggcgcgagggtcgcgggttccagagcgcggggctagggacgtcgcgggggcgtctcagggagcggcctaaggagagcgcgtggccgccgcctccctcgcgcgcccacacgcggtttccgtggtccgctctcccgccgcccgcgaccgcgcgtcgcacctgtcactcccttcctggccgcggggacgtctttgggattcccggggcccagcccccagtctccgcgccccgaatccctgggcttctcaggattgaccgacggccaggtcgccgggtgctccgcgaaactttgggcagcgactgcagaagcaagttgctgatgaagagagcagtggcggcggagtgtggacacatctctccgggatggagacccgggcgctcctgctgtcacgctgcaaggggaattgagcagaagaaattttgagttgtggcccctcgggtacgggctggggagcgggtggcctttgttccagcgccttaacagcggagtggaagagctggtaggagcccagggatccactcttaaaatactaattttgcgaccacgggaacaacgatttggagagggtcagcggcttgctcaaggtcacccagctggttagagcctagttcttgcagttccttggccagtattggtttttttatacccctcctttcaagaaagagtccagttgactaggctagtaatcttattaactggatagttgcactcttatgtttaggccccaaaatgctttgtattatttcacttcttcctmaacaatcctgtgagatactcttattacctctattttaatacggtaattaaagaagccgaggccaggagatgttgacttatctaaggccactcaccttagagagcttaggcagaaacacaggtgcattgtacttttcagttttcagaatgctttcatgtccaggatctcactacagccttgcaggcatgtatgatggctacatccccgttgtgcagatgaagaagcagaagcagcagaagattctcttttgggggaagagataaatgcagcagctaattgaaaaggatctgtttgccattttcccattttgcttttgtaatatttctccccttggtttgtccttgatttccattttggtcatgtgggcagtgtgataagacccttaattgaagccccagttctaaccacagactctttgctaagtgcttctaaatacagaaatgggttaacaaatgggggatggggtaggtgggggttgggaacatagcaagggcagctaacatgttttgagaacttctgtgccagacggtgttaaacagttatacacgttaatgttctcaatcttcctaacaaccctgtcaggtagagagaactgttatacttgtcatctccctctcactgatcctgaaagtgaggcccagggtggttcattaatttactgaagattacacagccagtagaaagtactgtatgtctatagctgcctacctgcaagggcacagaaagaaattcatgtgcattttgcattcctattccatgatcaattcctatttgtcttattttgtttatctgatttttaaatttaaatttttatttatttagttattttttgagacagggtctcattctgtcacccaggctggaatgcagtggcacaatcacagctcactgcagccttgaccttctgggctcaagcaatcctcccacctcagccgggaggctgggaccacagaacgcatgccaccacacccagcaaattttttgaattttgtagagatgaggtctcactatgttgccaggcacaaactcttaggctcaaatgatcctcctgccttggcctcccaaagtgctaggattacaggtgtgagccacctaaattttttttttttttttttgagatggagtttcgctattgttgcccaggctggagtgcaatggcgcgatctcggctcaccgcaacctccacctcccgagttcaggcgattctcctgtctcagcctcccgagtagctgggattacaggcatgcgccaccacgcccggctaattttgtatttttagtagagacagggtttctccatgttggtcgggctggtctccaactcccaacctcaggtgatccgcccaccttggcctcctaaagtgctgagattacaggcatgagccactgtacctggccgagccaccgtgcctggccgagccacctaattttttttagagacagtgtctggctgttgcccaggctggagtgcagtggcacaatcatagctcactgcagccttgaactcttgggcttaagcaatcctcccagctcagcttcccgagtagttaggactaaggcatgtgccaccacacctagctaatttatatatatatggtagagccagtctcactgtgttgcccaggctagtcttcaacttccaggcacatgcagtcctcctgtcttggcctcccaaagtgctgggattactggcatgagccactgtacccgaccctgtcttaatttgtaatgagtttaaattacctagtggttaatactgtctttatccccacagatttctgaataaaatggaaactaccaccctctggaaactaccacagtggttcagtggcttcataggtccattaggtttgatcccagtggaagaagattccatttctctgtccttccagaagacctggtttataacagtgcataaggctttttctcaaaatagttatataccgcacaaggaagaggtgtggctgttgtgtcacaggagacctaggggccaggtttgggaaaagtggttccatgtcttcagttgatcaacaagtattcaagtgctggctgtggtttctgagctgtaaggaatcrtgaaagatagcatagaattttatggcttcatggagcttgagatgagaaactctagtgccagtatggaacagcttaaaattgcacagcacaacaagtaaaagtcagcagtgagggtagcttggtaaaggctggcttagcaggaagaccacaccaaagaggtggctcttgacctgggccttggaggacaaaaagagttgggcatgctgaaggtcagtggtctgaagataaaattatcccttgattctcacccctgtgttcccattactgaatgttagctccttgaggyagagaccttcgtttcattcccactaaattctttgaacctagaacagtgcctggcacagtgagagtgcccattaaatatttgtggaatgcctgagtgatccagtgatcttgggctgggcaggatactaattgtcttggacatggtttggagttggattagatcaaggaaatagccagcctggatgcttctaggagccggtcaggtgaggaaggggagaggcaggcagggtgagtacatttacttcctttgtatgtgtatggtggggataaggggtggatgcaacctagagagcctccaggaggtgcaggcaggcaaggatccattcattccacaatgtctgctgtgttccagtccattggtacccttcaaggatatgggctcagggaggccacattcatttactcattgaatggcttctaagtattcatgatggacaaaggataacttgagcgcgacagatcatgtgtcttctctctcacgaagcttacattcttgatggaggaaatacaagttgagtaaaataaatgaacagtttaggcagggcactgtgagcaaaataaaattgggccatattatagagtgtgactgggctagcctacttagattcggaagtccagggaggcttcttggaagagaggtatcagtgtctgtttttcaagagatgccgaagtctggatttttatttgaaatacccagatttttggccgggcacagtggctcatgcctgtaatcccagcactttgggaggccgaggtgggcggatcacctgaggtcaggagttcaagaccagcctagccaatatggtgaaaccccatctctactaaaaatacaaaaattagccgggcatggtggtacacgcctatagtcccagcaacccaggaggcagagacaggagaatcacttgaacctgggaggcagaggttgcagtaagctgagatcatgccactgcactccagcctaggcaacagaatgagactccgtctaaaaaaaaaaaaaaaaaaaatgctggacacggtggctcacacctataatcccagcactttgggaggccgaggcgggtggatcacctgaggttgggagtttgagaccagcctgaccaacatggagaaaccccgtctctactaaaaatacaaaattagccgggcgtcgtggcacatgcctgtaatcccagctactcaggaggctaaggcaggagaattgcttgaacccgggaggcagaggttgcagtgagccgagatcgcgccattgcactccagcctgggcaacaagagcaagactctgtctcaaaaaaaaaaaaaaaagaaagaaagaaagaaatacccagatttttatatgttggctcatttaaaaaaaaagtactataggcacccaataaagcatgtgtgctagttgatctctggggtcttgtactactgcagaacgtcctgttgtcccaggcccccaggtttcccataatagagtaagtctaccatttcattttgtgttatatatctctattttgagaaagggcctcatgtgccattacacaccaggtcttctggaagggcagcaaggtgggatcctcttccactgggatcaggaaagaaacagtcatggaggtgacctttttgctgggtccaaatagatgggtggcaggagcagcctgacaagtatgtgggaggagttagaacaagctgcctttggaaatgaaagtttactagagatttcttggaatatagtgtgtgtgaggaaacagtagaagatgaggtctgagaggtgaggtggagctaaattgtactgtagatgcaaggtgttttatggaagatagggaattgttgaagattttcaagtagggggtgacatattaatcatgggtttttaagaaaattgaattgtgggctgggctcagtggctcatgcctgtaatcctagcattttggtaggccgaggagggtggatcacccgaggtcaggagttcgagaccagcttggccaacatggtgaaaccccatttctactaaagatgcaaaaattagccgggcatgatggtgggcacctgtaaccccagctacctgggaagctgaggcaggagaatcgcttgaacctgggaggcggaggttgcagtgaacccagattgtgccactgtactccagcctaggtgacagagcaagaccttgtctcaaaaaaataaaagagaaagaaaagaaaattgaacggtggtgataggcaaggaagattggaggcagggaggccaattaggaaactgtagccatccaggtgtgaggtgatgaagggtgacaaatttggatgggaagtggccctcattcaaatacctttccatggcactgacttgggcctctgcttgcttctccctgcagaaatccagtttgacagagtaccctgcagtacctggcactgactaggtgttctgtaaaggtgtgtctgatgaggaaaggaaagcacctcaagttcagtctgagtgttcacaccattgggaaggttggagtggccaactgggtgagcaaggagtgagtgttggggatgtgacaggacatgtcctcactgaaggcttgtccctgaaggcagagcagagggagaattctaagatcccattaagactttgagcctggagcactgggggagttaggagtcagcagaaagagctggttaggggaaatgatgaaaatttatcttaattgtgctgaaattggggtgcctgggggtcatccattaggaaatgagatgtagatacttaggagaaggtaaaactgggatggagattgaagagagtcactgytgagtcaagaggagagaactgggagattagaggttaggaaagtgttagcttttcaaggagtagtctgtagatggtggagacaatgccacagagaacaacaaggatgacaaggccatgcaaggagtcgtgggacttggtattaggaggccaaaccttgccagaacagtcagatgagggaatccaaggcagaaaggaagcaggggtgagtgggagatgggcaggtggaagcaagtagttctctttggagaaagtagaataattttttcaatgagctgatctactttctgtcttgatgagtttgcctgttctggacaactcataaatggaatcagacaggtagcataatattgcttaggttcatcatgttgcagtgtagtgttccattgcatggacacaccgcattctgttttatctactcttcagttggtggacatttgggccgtttccactctggctacattatgaatgaagctgctacaaacttgtgtacaagttgctgtgtggacatatatgttcatttctcttgggtagatcttctacattttttgttgtttatgttttccaagagcttataataaatagtcccatttattcacatgcttagtttctttttttttttttttttttttgagacggagtctcactctgtcgcccaggctgaagtgcagtggcgcggtctcagctcactgcagcctctgcctcctgggttcaggcagttctctgcctcagcctcccaagtagctgggattataggcacccacctccacacccagctaattttttgtatttttagtagagacggggtttcaccatcttggccaggctggtcttgaactcctgwccttgtgatccacccgactcggtctcccaaagtgctgggattacagacgtgagccaccgcgcccggcccacatgcttagtttctatgttcctgtaactaatttgccctaaatcttgtgacagaaacttgcaatgtggtggtcaattcctttctttcctgtcccatctgatggctatggtttaggtctgctctcccttcacttatcttgggacaacccctaaccatcacccttgggggcaatgttgaagctcttctttcccagttcttgatttttactcacttattttagtggagcacatcctccagtggcttcctgagaaagagtacatttaggtaactcttcgaggccttgcctgtctaaaaacatctttctaccaacctcattccactttggtagtttggctgagtttagaattttaggttggacagagttttatgtcagaattttgaaggcattgtctgattatcttcttgcttctagtagagaaatctgatgccatttccattcttgatcctttgtgtgacctgttttcttctctggaagcttttgggatcctgtctttatgttctgaattccatgacaacgtgccttgatgtgactgggccgacagtcactgtcccaacttgttggggctctggagagctgtgtctgatacctgaattcatgcagtccccctgccatcagcctccttgtcacctgagcctgcagaggaacttccagtacctgagcctttccatggcactgatttgggcctctgcttgcttctctctgcagacacccagtttcatctttggcagagtatcctgcatgcagtacctggcactgaataggcactctgtaaaggtgtgtctaatgagggaaggaaagcacctcaagttcagtctgggtgttcacaccattgggaaagttggagtggccaactggctgagctaggagtgagtgttggggatggttgtggtcagcacacccctaggaggtggaggtgggagaagagtggaaactgacttcacatttctccagggagggatgctttggaaaaactgctcagtgagatgaagcacagatctgcttttcatcccttttgtacctttttaaagacataaggtatgttttgacactggagtatatatgagggttgctaacgtttgggttgaaagagctgctgttgtccacagcttatttattttccacccatttttgtctcctggtctcatccagttacatttcctgggatatgtttttggaggttgctcagatcacggcactagagtccctttgggtttctcctccctcctctgtctatttggcctcgcccttgacaaacattccccacattcacacccaggcctttggcctaatgttcttgaatgytgcttgcctctcattgaataggcttttatgtagctctcatattcagttcatattttggcattttaaaaaatatatatttttgcttctttctcaactagatcatttcactcctcaaatttgtaattaaaaaaaggaaattctcaagcagttttattcaattagaactttgcaaatatcaaattgtccgtatccttctggattctygtctgaacattgcttatctgcgtacatatcacagtgttttcacatagggattgctgtatgttgaagtagttgaggtgtaatagccatataatctaatgtgatccatctgaataggcaaacccttgcacacctgtgtacctgttgaacattttcatcatttgcagttttttcttaacataagcactgttctgaatacttgtgaacaagtcacttgggagtttgttcatgggcgtgtatcttccaaagaggagtcttcamgttcagctgggtaacacactatcagctgtagccctttcattttaaaaacatttccagtgctgcaaattactatggtgattgggaattacaacttggaaatatttttatttttttaaaagatagtacattcatatgaatcaaaataaaatacataaaaaggtactatgaaaagtcttgctcccggccctacccactatctgcgtagtcccaccgctccctcacaagtaattaaatttttagtttcttttacctgcttcaaaatgtatttgttattacaaaagaagctaataacaaatattgattttagtttttgctttgctttcctttttgactgaaaaagttagcatgctataagccctgttcttctgtgccttgccttttcctttctgcttaccaatgtatcttatagatcatcccagactttttcactgctgcatggttttccatttgatgatgccctgtaatttattcatccagtccttttttgatggacatctgaaggtattttcagtcttctgctattaaaaacaatgctgcgaatagctttgtaaattcttcctttcacacatgtgcaagtctagaggcaggagcggttaccagaagtgggattgttggatcaaagccagggtggtgctgtctccgacatagttgtcgcaagaatccagttaggtaaaacataagaggggctggtcacagtggctcatgcctataatcccagcacttggggaggccgagccgggtgaatcatggggtcaggagatcaagaccatcctggctaacatggtgaaaccctgtctcgactaaaaaatacaaaaaattagccgggcgtggtggcatgagcctgtaatcccagctacgtgggaggctgaggcaggagaatcgcttgaatccaggaggtggaggttgcagtgagctgaaatcgcaccactgtattctagctgggacaccagagcgagacgtccgtctcaaaaaaaaaaaaaagattataatggagctattgccataccatctaggtgtgtgtaagtatactctgtgatgtttgcacaatgaagcagttgcctaatgacacatttctcagaatgaatcctgttgtcaagtgacacatgactttatttgataatgaatacaagaccatttcatcttgatcccagatagatacattgagatgcattgatgttctctaagtgaacgtgactcatcctgttctttattagttattgactgtttccgtagtcacctctactttttgatcgttcaccaggttttgaaatcactgtgtaggcagcacccactatgcagttcaaaactttatgtaggcctsttttgtactgggctccaggttcagtgctggcaaataaacaagttccttgttctcacagaatgtgtatggccttgggtgccaggcaccgttccatgccttaacctacattcgtctcataatacgtttttgcatgcaatcttttcttcaattctgtggtatgctgcaggtgaagaaactgaggcatagatcacgtagcttgtaagtgatggaacagtggcctaaatccaacatgtgcaactttagaacccatgtatttttcctctgtcccatgccctgtctgatgtaagcaggcttctaagttgcaaataccaggtggtgtggtgtgctttgaagctatttattcaacatgtgtttatcaagaagtgtctgtccaggcgcagtrgctcatacctgtrrtcctagcactttgggaggccaagatgagaggatcccttgagcccaggagtttgagactagcctgggcaacatacctggacaayatagtgagaccccatttctgtaaaaaaaaaaaaaatacaaaaattagccaggcttggtggcaccagcctgtagtcccaactacttgggaggctgaggtgggaggatcactygagcctaagaggctgaagatacagtgagtcaagatcacaccactgcacttcagcctcgtcaacagagcgagaccctgtctcaaaaaaaaaaaaatacatacacacacacacacacacacacacacacacaygtatatgtatatatattttttaaattaagaaaaaatgtctgctctatgctggacacttaaagtgacttcccctgggtcctagggtactttctgagccttaatttcctctgtaaggtgggggttgggtaccttagctcacttagttcttgcagcacctatgatgtagctaaggtacaaaaaaggaagaggacaggacctaacctcttttggctctatttaaaaatgaatgaggaactgaatgaacttcagtttgcacattgatgtaggactaggggacctgtttttagaatatgtttggaaatgtttattttttccttttgaaatggcttttgtaggtgtggtagtgggacacagaggagcagtcacagagtgtggtgcaagtgaccacaaaattaagggttaaactttgttgacatgatggaattttttagagtagcagaatcccagagcctgtgccttaaggtaaggctccctggggaactttgtttagaaatgaatcctaaactatcgaagggcttgcaaactagaaaatttctgcatatctcaggccttgagaattgctaatggatatgtatctaaatgtcccttacaagcttgctcctccacgtggccctgtggaacaggtctgttgggttcaggatctagtttggaacagtgatgaaatttcgagctgctgaaccagatatggaactgctttgctaacctggtgtctgcccagcttaagcccyctccatcccacagctgtgaaaggaaatcatgcttcttcccaagtgctaacattcctgtgaggccttacactttacccaagtcctcctgatacatttgtcttcctaataagtgctataaaattgaggcttgatttccacccccaccccccacccccacaagagtcctgctctgtcgcccaggctagggtgcagtggcacgatctctgctcactgcgacctctgcctcctgggttcaagcaattctcctgtctcctgtaatcccgagtagctgggattacaggtgtgtgccactatgccaggctaatttttgtatttttagtaaagatgaggtttcaacatgttggccatgctggtcttgaactccttacctcgtgatccacctgccttggcctcccaaagtgctgcgattacaggtgtgagccactgcgcctgcccatggcttgatttttatgcccattttccatggacatagatgaaggcactgagacagagaaattagatgatttgccaatgcttcctatgctgatgacggggaatgaacttggattttctgatgtgggattccatattcttcrctgtcctatgaaaatgaggtgggagatgccttgattcaggaagcctgtctgtctaggagccccttctctggtcaaaagttgtttttaaaaaatccttgctgcatttcaacgtgaatgagtatccactgtattcatagcacagtgctagaagctgttagagttgaatgaaatggcctctgctttcagggagctaacatgtaaacatccagtcataatacatgggaaaatacaacagaggctataacagaggaacaactctaaatctttggaggactgaggaagggaattagaaaaatcttcacaaggactttggcatttgggctgaattgtgaagggtgagtaaataggattttagaaggtaaaggagcaggcatggtgtttatttagatagatttagacaaagttgggaataatttggcatgctctaggaatatgtgtgtcagagtactgcataggacagaggttctcaaacttgaatgtgtctatgaactcccagggtatacccccaaagatctgaatgtggaaggtctgggatgttgtccaacaggaacacctaactagtggagggggcaggatcagaggagccttctcagggataagctgaggtcttaaagggtggaaggagagagcagctgtgttccaggctgagtgaacagccattttgaagggcttgaccagtgctggtgctcgagtgtctgggttttgtgtagaccacactcttgataactgtgctgttcgttatcttccacaaacagggttttggtcaggtgcctccttgcttcagtgtgttctttatcagtcaggattcttggtgataagcagcagaaaccgcttctatctagcttgaacagaaaaggatttgttagaagggtggttcttggagtgactagaaaagctggagagccaatttggaaaatgggccagaaccaaggaggctcctgcttagtactcctccgccttcatgatctgtatattgtctctgctttcctgggtcattccctcaagggtcgcactcctggtgggaggatgcattaatcagagctgactggcaggaaaccttccctcacatgaggactgcccaatggggattctccaaaggaagatcagggtgctaatgggagggtcgggtctgatgatggacaaatggaacaaaagtggcaaatgcccaccatgtattctgtgcctttccttgcctctgaaataaaagcagtttctgccgccaaatatacatggtagcattaagtcaggcctttcacaggcagctccatctctccattttgcaccgtgctgtctctacttcagcagctggcaggacatttcctgatactgtggttttgctcaaactatttcctttgcctggaatacccttccctctctctaatttataaacccttttcatccgttaagctcggttttcactgcctgccaggatggatcagtcctttctctgctctctgacagccctttctttgtgaggcacttgtctgttcttgcccttgtcgcagtttatggagttggttaggtttctctttcttctctgtgagcatgggagatgggaagaaaacgaatacttttcagtctttgccctgtgcggagttccacacaaggcacataggatcctccagctcccagcccagagtacatagygtatgcaaatttgagtggatgtttgtatttgtagcgtgatttgataacctgctttgcaagtattctttttctctttagttttagggagatttgggggcatggtaatggatggaagggtaagatggtgggatgttggggtctttcatttttgcctgaatggtttaagggctgaaaaaggttgagatctcttgctttgtagactctgcccccaggaggaggacagttcaggtgaagtggcttgtgcctgattttgttggcagtgggtcacctgaaatgtgaaatgtgagggcctccttttgcagaacagggtcatgcaggatcagttccttggagtctcactctgcatctcactcaattttgtagtctcctgctaaaagagagtgaaagagggaacagtatgatgccagggcagcagcaggtgaagagctgggagatacaggaaagacctgggatgacacatccttctctgtctgagcttggggcattcactctactcattcgtgaatgaagcacttactgagcacctgtccagtgtcaggctgtctttggtgatatccgtatgatgatagaaccaaagcatctgcattatgtggtagctaagagcttgactttaaatcccagctccaccacctgctgactgggtgacattagacaagttacttagcctctgagtgcctcattttccttacctgtaaagtggagatgataatggcatctacctcaaagtgtcattgagattaaacgaaatttgtgtaaagtgtttaattgctgatacatagtaagagctcagcaaatgttaattcctgtactttttaaaaatcattactactaatttgctcagtttttcttcttgattgttgttctcaaagtctgtttcttttatttattttcattattattattattwtttttttttttgagacggagtctcgctctgtcgcccaggctggagtgcagtggcgcaaactcggctcagtgcaagctccgcctcccgggttcatggcattctcctgcctcagcttcccgagtagctgggactacaggcgcccgccaccacgcccagctaatttttttttgtatttttatttatttattattattatactttgagttttagggtacatgtgcacaatgtgcaggttagttacatatgtatacatgtgcagtgctggtgcgctgtacccactaactcgtcatctagcattaggtatatctcccaatgctatccctccctcctccccctgtatttttttagtagagacggagtttcaccgtgttagccaggatgatctcaatctcctgacctcatgatccgcccaccgtggcctcccaaagtgctgggattacaggcgtgagccaccgcgcctggccttcaaagtctgtttttaatagagcagtcatttaaaaataataagtgggataagagagacagcctttcaaacatgggatgacaagaatctgatgtctgtgttttagcattaggcaaggattggagtccctggctgcagcaagggtggggctcttgcatgggtcgggactctggttgattgcagcatcgtagagcctaactgctgggaggtggggcaaccccagcgagaaactcctaggaggaagcacctccctgtggtggttggggcaacttgtggagcagggtgcttgagaaaagagcacagggcttagaggaaggagtaaggctcctatctctgtctgctactcgctccccacctgcctgagatggtgtgcaggtcaccccctctttggacttggacttttcttcctgtgtaaaaaccaccaccaagaccgcttttcaagcacttactgccaggcactcactatcccaggtgatttacatatattaactcacttaaaacagtgcttgaaatggctacctcacagggtgattttgaagattatataacacagtgtgtgaaagtagaagtgttaaaaggaaaaataagggagccacagtgttaatgaagttattttccagtaaaaaaaatcatgtttaaactttgtatatgaatatatacatacgtatatatacactgaagtaaatagtactgaaaacagcaacaacagctttttaagcaacattccagcaggttcctcttgtaccatgtatccctttttatcctaacactttgcatgcagtcctggcagatttattatttatttatttatttatttattttttggagatggggtctcactgtgttgcccaggctggagtgcaatggcgcgatctcagctactgcaaactctgccttccagattcaagcgattctcctgcctcagcctcccaagtagctgggattacaggtgcttgccgccacgcccggctaacttttgtatttttagagaaatggggtttcaccatgttaccaggccaggctggtcttgaactcctgacttcaggtgatcctcccgccttagcctcccaaagtgctgggattacaggtgtgagccaccgcacccgccccaacagatgtttttacagaggttttctaccataacatgtgcctcttgaaggcatttatttttgtatctggcacatagtaggatctcagttaatgtttcttgaatgcgtgtcttaagggatgtatcttttattaaaatgtatacttaaaaagagagagattgttctagaaaacagcatcttgtcaaggcatatggtctcatttgaagaataatttaataatttggataggaaggtatacttgtaaaatacagccagtcaaaaataycttttccccattccccttgatgcgtccattacatacatgttcaccctgagattgatcttccatcagcattgaaatgaacattgaaagtaataagatgggccgggcttggtgactcacgcctgtaatcccagcactttgggaggcggaggtgggtggatcacgaggtcaggagatcgagaccatcctgactaacatggtgaaaccccgtctctgttaaaaaaatacaaaaaattagccgggcgtagtggcacacacctgtagtcccagctactcgggaggctgaggcgagagaatcgctttaacctgggaggcggagtttgcagtgagccgagattaccccactgcactctagcctgggtgacagagtgagactccgtctcaaaagaaaaaaagaaagtaatgagatggggctgggcgccgtggcttacgcctgtaatcccagcactttgggaggccgaggcaggtggatcacaagggcaggagatcaagaccatcctggctaacatggtgaaaccctgtctctactaaaaataccaaaaattagccaggtgtggtggcgggcacctgtagtcccagctactcaggagggtgaggcaggagaatcacttcagaaccagggaggcggaggttgcagtgagccgagatggtgccactgcactccagcctggcaacagagcgagactccatctcaaaaaaaaaaaaaaagtaatgacatgattacctaagtgcccctccacacagccccaaatctcctttgttgtcactccgagtctgtcttacagcttttccccaagttgtgatgagcataaatgtaaaatccaagaaatgtttattttgtaaggggaaaaaagtgtgggtagaggagagactcagacaaacctaaatatagatataaattcaaatctcagttcagccactttgtagcttatgtagggggctttggcaaattatctaatttctttgaatcttagattcctcacttttttctttcttttttttgagatagcctctgtcccctgggctggagtacagtggagagatcttggctcactgcaacctctgcctccagggttcaagtgattctcctgcctcagcctcccgagtagctcggattacaggtgcccaccaccacgcccagctaatttttgtatttttggtagagatggggtttcaccatgttggccaggctggtcttgaactcctgacctcaagtgatccgcccacctcggcctcccaaagtgctgggattacaggcgtgagccaccaagcccggccagtttcctcacttttaaaacataataatattggtctcagggttgatataacgtactaagtgggtatcagtggtagctacttttatgttgtcctcatggaggacatgaatgaatttaatttcagtaatattaccttctgtactggtaatatttattctgtaaataaaatataaatatgctttctacccagaaaataagtttattagctttgtcacttcattggttttgttcttaaatatcaatagtgcaaccactggcttttattcaaaggtttaattggaatctaacctggggattttcccctttttaaatttatrtttaaaaaaaaaaactatggaaagtcggcatggtctgggctgcttgggagcctgaggcaggaggatcacttgagtccaggaatttgagactctcctgggcaacatagtaaggccctgcttcttttagtctttttgtttgtttgtttgtttttttgagatgaagtcttgctcttgtcccccagtctggagtgcaatggcgcgatctcgcctcactgcaacctccacctcccgggttcaagcgattctcctgcctcagccttccaagtagctgggattacaggtgcgtaccaccacgcccagctgattttttgtattttaagtagagagagggtttcaccctgttggccaggctgatcttgaactcctgactgcaggtgatccacccgcctcggcctcccaaagtgctggtattacaggcatgagccaccgcacccagccaataaggccttgcttctaaagacactttaaaaaaaaaacaaagcggccgggcgcggtggctcacgcctgtaatcccagcactttgtggggccaaggggggtggatcacaaggtcaggagatcaagaccatcctggctaacacggtgaaaccccgtctctactaaaaaatacgaaaaattagccgggcatggtagcggatgcctgtagtctcagctacttgggaggctgaggcaggagaatggtgtgaacccgggaggtggagcttgcagtgagcagagattgtgccactgcactccagcctgggcgatagagagagactccatctcaaacaaacaaacaaacaaaaggcaaacctatggggacctggcctgggagtgaaggagggagggaggcagggagggaggaaggaaaaaaccagaaaaaaaaagtgaaaaaattaaatacattttattatgtgcttgatgtatttttctgtgtattgatatatatccatcagtttggattattcccatatttacaattaagtaactgagtctcaaggaaattaattaatttttcaaagatagcacagtgattacattattggagtcacagccacttctctttgaatttaatcgtgacatctccattcagtttggccttgcaaaacgggccttggtttagctttttgacatcttgcctttctccttaaatctgatcccttgtcactctttttttatttttttgttttttcctctcctgactttcatctgaaaccctgaaccctacaggccatgggagatgacctgtttcccagttttggtcactttttgggccatatttataaccaaaactcttatttaaccagttttcagaaaattctcagcttcttcatcaattgatgaagttatctgactgactttttattccagccattctcatactctcagaatgattttttttttttttttttttttttttttggggtagatggagttttgctctttttgctctttttgcctaggctggagtgcagtggcacagtctcagctcactgcaccctccacctcctgggttcargtgattcttctgcctcagcctcccaagtagctgcaggcatgtgccaccatgcccagctaatttttttatttttagtagagacggggtttcaccatgttggccaggcttgtctcgaactcctgacctcaagtgatccacccgccttggcgtcccaaagtgctgggattacaggcatgagccactgtgcccggccagtgattcttaattagttcatgatattttggagttctaggcaggacagcagcctctgcctcctcaaccccatgtaaaccagaatgagcaactgctgggctggaggagctctccttcttagagcattgtgggacaacttgctatgagttctccttcattttttcatttcaccaccatgagttgtagggccctttgtgctttggcccctaacaacttgcccagtatggtgccctgcccatcacccattgtcttcaacaacctatcatgcagctccatgtctccctgccttggctcttgaggttccctggcctagactgtactttgcatcctgatcagccttcaatccaactccttcagggaactattgacttgctggattctgtgattttgtcatgttccctgtgtctctttggtgtcttgcagatgcacatctctgctgtgacaatcttcacaaaccatattgtgatcctttcactaactctttgaggtcaaggactaatttattatctctgtgcctggtacacagtggatgcttaacccgttgaaatccttctgtatttacatacttacctccctaaaagtgaaagctttgcagaaattacatagatctgtccagattttccaggctagtctaacttttaaaaatatcttattccattatgaggtgaaacatcccttctagtttctggttcagaaagcatgatcggtcaggtgcagtggctcacgcctgtaatcccagcactttgggaggccgcggcaggtggatcacaaggtcaggagatcaagaccatcctggctaacacggtgaaaccccgtctctactaaaaatacaaaaaattagctgggcgtggtggcgggcgcctgtagtcccagctactcgggaggctgaggcaggagaatggcgtgaacccgggaggcggagcttgcagtgagctgagatcacgccactgcactccatcctgggcgacagagcgagactccatctcaaaaaaaaaaaaaaaagaagaaagcatgatcaccatttttataagttgcatgaaagttgctattgagagcatttcagtgagtcagtgccagtttttttgttgttgttgttttgtgttttgtgtttttttgtttttgtttttgttttgagatggcgtttcactcttgccacccaggctggagtgcagtggcgcgatctcgactcactgcaacccctgcctcccaggttcaagtgataactgcctcagccttccgagtagctgggattacaggcacccacccccacactcagataatttttatatttttagtagagatggggtttcaccatgttggccaggctagtctcgaactcctgacctcaggtgatccacccgcctcggcctcccaaagtgctgagattgcaggggtgaaccaccatgcccggcctggcttttgttttttaataccagtatgcttggtgcttgaagcggtacagggaaaggaacattttctccatgcactcatagaacacaagacataagaaaaacatctttaagatttatttatttagaatccgggggtggtggctcattcctataatcccagcactttgggaggctgaggcgggcagatcacttgaggccaggagttcaagaccagcctggccaacatggtgaaacccggtctcaactgaaaatacaaaaattagccgggtttggtggtacgtgcctgtaatgccagctactcaggagcctgaggcttgagaattgcttgaacgtgggaggcggaggtggagccagaggctgcagtgagctgagatcacaccactgcactccagcctgggcgacagagtgagactctgtctcaaaaaataataaaataaaatttatttatttagtgaccttgtctcactttgttgcctaggccgaccttgaattcctaggttcaagcgatcctcccatcttagcctcccgtgtagctggaccaacaggcatgtgcagcattaaaaaaaaaaaaaaaacttactatgtgtaatatagcaaagttttttaaaagttaaaaacatagccttgaactaaaacatcatgagcacatgtcagaaatttattaacattgttaatgaagataacaggatgacaaatggatcaaaggagactgcaagaaactgatatttacatagaaaaaagaatgcaggaataagattgcaaatttaaatacaaaactagggccagattccgtggttcatgcctgtaatctcaggactttgggagactgaggcgagtggatcacttgaggtcaggagctgaagaccagcctagccaacatggttaaattaaacttcgtctactaaaaatacaaaaattagctgggtgtggtggcgggcacctgtagtcccagctacttgggagactgaggcgggagaattgaaactgggaagtggaggttgcagtgagccaagattgtgccactgcactccagcctgggtgacagagcgagactctggctcaaaaaaaacgcaaaactagttaatgtcctacagtgcaatgaaaacaaaagcttaaaggttttcttttctaccagacagaaatgattttaacttaacaattttctgcaggctaacatctaactttacagaatgggagccttaatcggtagtaaatagaaagtcaaacaaggtgatggttccatagagcatcagataacttttaggcaggcagcttagacagtgctgtagtatamctttttttttttttttttgagtcaggggtcttgctctgttgttccaggcttkagtacagtggtacagtcgtggctcactgcagccttgaactctggcctcaagtgatcctcccacctcagcctcccaagtagctgggactacaggcatgtgccacgaggcctgaccaagtttttttattttttagagagatggggtctcactattttgtccaggctggaatgcagtagcatgatcatgcctcactgcagcctcaaactcctggccttaagtgatcctcctgccttagcctcctgagtaactggaattttagtataactttaaagaggcatataacgtttttttttggtcttatttccaagttttagttaatttttctttcctgttttcttgagacatggtcttggtctgtcacccaggttggagtacagtggcacaaactctgctcactgcaaccttcacctcccaggcttaagcaatcctcccacctcagcctgccgagtagctgggcctacaggtgcgtgccaccatgccccctgctaaagtttgtattttttgtagagatggagtctcgctatgttgcccaagctggtctcaaactcctgaacttgagcgatctggccacctcagcctctcaaagtgctgggattacaggcatgtgccaccacacctggccaataattttctttaacaaaataaatcacaattgagttcaagaactaaaagatgactagatcatctgaggtggaaaagagtccctggtaaaagtaattttaaatagttttgaagtagaattgtgaaattcagagtttggagaaaggaagagggtggtsacaagtagaaaagagaagacatggcacttacattcaaagaaagattgccctaccccacccctcaaaggcatgtgcagaagagggagtgagtacttttccagggtggatgatgaactaaagtgggtgggaagtgaaaacctttggaacagaagggagcagttcataggaagcttggaagcttgtgttaaagaatttgatttgattaagggccgggcacggannnnnnnnnnnnnnnnnnnnatttgattaagggccgggcacggtggcttatgcctataatcccagcactttgggaggctgaggcaggtggatcacctaaggtcaggagttcaagaccagcctggccaacacgaagtctctactaaaaatacaaaaattagctgggcgtggtggcaggcggctgtaatcccggctacatgggaggctgagacaggagagttgcttgaacctgggagacagaagttgcagtgagctgagatcatgccactgcactccagcctgggcaacagagcaagactctgtctcaaaaaaaaaaaaaaaagaatttgatttgatttaaaaggctgttggatgaacaagatactcaaagaagatgttcgtcactgggtaggaggctatggttgaaattaaggcagagtgtggacgggagtgaagaggtaaatccatgatgctaaggaaggagacttgagtgaacttaaggcaggaggaaaaagaaagagcaatggaaagtggagctgcagatccctctcctgttcaaactatgagagctggctcaggtcccctgctatagtgggccagaaaagcctggacttccactgctttttcctgcagagctgagtccctccagggctgccatgagaggcggggagagagagcactagacagagaagaccagaagaccatttgagaattcctttgggtttccttcatgattcctttttcttctcattctgaattgttttattttattatgtaatattcggtatatgcaaaggaatatatgacacctttgtgtgtattacaaaacaagcatttgagaatccgcacctctccacccaatttttctttgtggtttctttgccagtaaaagagttcactcatctgttgcttaaaatataggatgcttgagtcaccagcttgccatcctgtgtcattcaacacctcctccagactcttcgcagraaggtgacccagaaaccccttgaaggacatgatacygtccctgtgctctgatgtgccccctggtgtttgagtggagtgatttttagatagcggtttgcctgttaaaaccttccctttgttccctatattattgcttgcattttagggcttctcagttgaaggatgtggttgaaagagcccagttcctcagctgctcctctgggtgactagagtgtgggtaactgatgttttaggtcctggagaaagcagtgatgatcacaaatagtagaatggagaaatggttatctcatattgatcttcaggtttgttactagtctacatttggttttttaaataattattagaaaaaaacattgtgggtggggagataggatcattatgatgaaacagttctgtacattcaatcaggatacttgttgggaattagattttgcatttacctccctcactggtgtggtccatctcattttcagtggcctacacacatcacacaccattattatttccatgttcttgtacttgttgggcagctctaatatgaaagataaaatgaacgaaaagtacaaatgaagaaagtttaggtgactattcctctgatcttgaggatgarggtttttcttaagcgttacacagaagccatgtaatttcactatacaatgtaaaaatggtgtatagtcagttctgctatagttcatcatgtgcatttctaaaaatcatgccatgcgaaatcatgcagtaaaaaacacggagtgggcatgttggctcatgcttgtaatcaggaggctaaggtgggaggatcgcatgaggcagggagttcaagaccagcctgggcaacaaagcaagacccagtctctcttacaaataaaaaataaaaattatctggacatggtggtgtgtgcctgtactcccagctacccaagaggctgcagtggaggatcccttaagcccaggaggtagaggccacagtgagctatgatcacatcactgcactccagcctgggtgacagagtaagaccctgtctctaaaacagaaacccagaacttactgtgaaatggagggttaaggatcacaacaataaaaaatctcataggtgaccaaaaaaaggaaaagatttattttttaaaaaagatagggacctgccgggcacagtggctcacacctgtaatcccagcactttggaaggctgaggcgggtggatcacgaggtcaggggttcgagaccagcctgaccaacatggtgaaaccccgtctctactgggcktggtggcgggcgcctgtaatcccagctactcaggaggctgaggcaggagaagtgcttgaacccaggaggtggaggttgcagtgagccgagatcccgccactgcactccagcctgggcgacagagcaagactccgtctcaaaaaaaaaaaaaaaagtggggggacctaataaaacagtcacacagttttatagaccagaaaaactaagaaatatataaataccacaatgaaaaggcactttggcttgaaaaacacctgaggtttgcttgtgggaagtaagtgtcattaggttacagcttgggagttatcaggaagtggtggaaggagggctgtctgaagtccaatggaaagttctgacatcaatgtgatgaatgtgattcataacacatgcagtgacctgatgaagctggtagatgtttaaggtgcctgtgtatgtgtgtgcacattttgtgcattcctgcatggctcatttcagccgaatatggttttctgcacttcctagtgtttttctcatgcataagcaaatgcaaaatttatrttatgctcagattgtttctggatgtatctgatgcatttgaacaaattcacattttcaaagtaagagttaaagcaaaagtgtcaaaaaaaaaaaacccactatgaataatgtgtactagctaatactaagtgccaggcatggtgccatagattccacatgagttatctcatcaatccgtgagttagctgtaattgttagccacaatgtacagttgagaaaaactgcagctgaaagaggtaaaacttgccccaggttccaaggctaggatatggtgattctttttttttttttttttttttttttttttgagacggagtctcgctctgtcacccaggctggagtgcagtggcgcaatctcggtgcaagctccgcctcccaggttctcgccattctcctgcctcaaccgcccaagtagctgggactacaggcgcccgccaccacgcccagctaattttttatatttttagtagagacggggtttcaccgtgttagccaggatggtctcgatctcctgacctcatgatccgcccgcctcggcctcccaaagtgctgggattacaggygtgagccaccgcgccaggccgacatggtgattcttaattgctatgtcattctttttttctgaacatattaaaagagaaataacaaagtgggggaagtacttgcagacatttaagaagaataagtatctataatatctggaagttttttaaatcagtgaaaaaaaaaaaaagacaaaatagcctgatagcaaaaatggacgaaggtcaagagcaggcggtttacaaaggaagaaatgcaaatgctcaataaaattgggactttagaaaaaaaaaagactttcagcctcagttagtactcagtcatgcaagacaaaacaattccatgttggttttttccactatcagattgacagaaatggctgtgaggaaacactagcaggagcatagatttttgaaacctttccaaagcatgtatagtggtcctttgacccagccatctaacttctaggaatttatcctaagaaaatagagaagtgggggaacaaaagagttgttaataatgccgaataacttgctgggtgtggtggcacacgcctgtaatcccagcactttgggaggccaagtcaagaggatcgcttgagcccaggagtttgagaccagcttagacaacatagggagactctgtctccacaaaaaaaagatttctttaaagttagccaggtttggtgatgcatgcttgtagtcccagctactcaggagtctgaggtgggaggattgcttaagcacaggaggtagaggctgcattgagccccaccactgccttccagcctgggcaagagagcaagaccctgtctcaaaaaaataaaaaaaaaagataaggctgaaaaatttaaagcaatttttcatcattaagttaaacaaattttaatacactggtacagtacaatggcacacagaatgataccgtgggactctgaaaaggatgatgttacgtctgtaatggttgacactgaatgttcttcatatttattaaccaaagggaacagggtgcaaagtagcatgttcagtgtgatctcatttttgtaaaacaatttgcatgcatgtgcatgcttaagtgtgcaagcaagccttgtagaggaagaaatctggaagggcacacattaaaacattgacaatgggccgggcgctgtggctcacgcctgtaatcccagcactttgggaggccgaggcaggtggatcacaaggtcagcagttcgagacgagcctgtccattgtggtgaaaccccctctctactaaaaatacaaaaattagctgggcatggtggcacgcacctgtaatcccacctactcagtgggattacaccgggaggctgaggcaggagaattgcttgaacctgggatgtggaggttgtggtgagccaagatcatgccactgcactctagcctgggcaactgagtaagactccatttaaaaaaaaaaaaattgacaatggatgactcaagaatagtggaactgctggatgatttttatttttgttcttttcatttatatgctttctaaatttttctttagtgaatatattacttttatgattttaacaaattattaaaaacagggccaggcgcagtggctcacacctgtaatcctagcactttgagaggccgaggtaggcggatcatctgaggtcaggagttcgagaccagcctggccaacatggtgaaaccctgtctctactaaaaatacaaaaattagcagggcgtggtggtgtgtgcctgtagccccagctacttgggaggctgaggcagaagaatcacttgaacccaggaggtggaggttgcagtgagccgagattgcaccactgcacgcctgggcaacagagcgagactttgtctcaaaaaaaaaaaaaattattaaaaacattgtctaacacaaggtgcataataaatacaaaatataagaataaatgacctttgtaaactaggtttcccagcccctaatagggctgggtaacaaatacctrttaaaggattattgactgaatctgtaatttggagaaactgtaaccctatttggaggcttcacattctttattcttgaccagaattaatttaaccagatttcaggttacctcattctcaggtagatgctgaaggctgagctgagcaaagtgatatttatgttacctccaagccacaagctccataaagttcatgtgaactcagggtctctttgtgagtcatggggctgcttgcaatgcacggatgataacaggaacctctaattttggttatttgcttttagagaccagaacccagatacagtttcctggggcctcacctactttgttaagcaacttagctataagtttacaaagcagctaaaaacaggagcaggggagtgagatgagcttgagcgtgccagcctagctcgtgggaggcctgtctctggccctgagctttgtggcctgccgtaggaactggagcttcattttcaaagctccataaaactcgccttctcccgggcctcccttttctgagtttcatggctctctgtggaaatgacagcctgtgtaatcacagaatgtgaatgatcagagcagggaacagtgaggagccattaggacattcccatgggtgtagctcacagttacaaagcacaactacaccctggttctccaggcctcctctttcctggcaccgcagaccagatggggtcctggagaggctctgcgtgcccttctggagcttcccatcactcctttctgcagatgttcatcttaacagcccctctgtgccactcagcccagtacccggctgcccggctgactggagatggctccactggagctttttgtgtgtgggttgaaagggacttttttattttaatttaagtagtctcattccatctgcctacacactcttacgcttcgtgaactaagctttctgacctgtgtaggttacttcaccacaccagcccatatctttcccacaaaagggtttcaagagtacttgacaaaatgagatcagtgcacccacatgcctgtgtagtgggtgctctggaagtaccgcyaacattgacctgcataagggtctacccttcaccaagcacttcggataaattatcttattaatcctcagggcaaagaggccaagtgtgtattttcaaagcagccttttgtagtgaggaaaccaaggcttaaagagaagtatcttgcccacgctcacaccactgattaggtgggcctccagagactcacacctaggcctgactaccaccaaagcctgtgcgcatctatgaggccaccctggccttctgccctccttagctttccatggatggaaactgtcggccagtgtgtgatattcttctggctctgtgttacagccctctgtattgatttcttacagagttgggattttgggggaattctaaaaggttcaacaaattcttagatttctcttagtcattttcttaaagcattttataatcttgtacttggagtgtgtcagcactaaattatgttttgtttaaatgtactgaatttgaggacatttctcagtttaatcatgtcacggaattggaattggttagtacaagctgcaatatctgtagcaatctgcccatttctccctcgcacaaggctgagtgaggacagagcttagtgtcaagatgttggtaaataataccactatgtaggaatgtagtctggtgagatgctgtttttcccagcaggtttaactgactgaatacttaaggtgcccagattgaaatgcaaagctccagttatcccatatggagactacactagaaagccccagcagctttatttatttacatttatttatttatctatctatttatttatttattttttgggacggagtcttgctctgttccctaggctggagtacagtgacgcagtcatctcggcttactgcaacctctgcctcctgggttcaagcgattctcctgcctcagcctcccgagtagctgggattacaggcacccaccaccatgcctggctaatttttgtagtagacaggggttttcaccatgtttgtcaggctggtctcgaactcctgacttcaggtgatccacctgccttggcctcccaaagtgctgggattacaagcataagccaccacccctggcctatttacatttaattatgatttatttttcctatccttctgcaagcatatatatatatatatatatatatatatatatatatacacacacacacacacacacacaaaatatcaaaatatatatatatatgtatatatatatatatttttttttttttttgagactgagtctcgctctgttgcccaggctggagtgcagtggcacgatctctgctcactgcaagctctgcctcccgggttcactccattctcctgactcagcctcccgagtagcttggactacaggcgcccaccaccacgcccagctaattttttgtatttttagtagagacggggtttcaccgtgttagccaggatggtctcgatctcctgaccttgtgatccgcacgccttggcctcccaaagtgctgggattataggcgtgagtcaccgcgcccggcccaaaaaatctttgtgtttttttgtttgtttgttttgtgttcagagaagggatctggctaggtgccctggctcatgcctgtagtcccagcactttgggaggccaaaccgagaggttgcttttcaggagtttgagaccagcctgggcaacatggtgaaatctcgtctctacagaaaatacaaaaattagccgggcatggttggcgcacacctgtggtcccagctactcaggaggctgatgtggaaggatcgcttgagcctgggaggtggaggctgcagtgagctgaaattgcaacactgcactccaacctgggtgacagagcaataccctatctcaaaaaaaagagagasagagtctcgctgtgttgcccaggctgttctcaaactcctgacctcaagtgaccctcccaccttggcctcacaatgcactgggattacaggcatgagccaccacaaccggtctcagcagctttctgtttgtcagatatacaaatataccccaggctccaggcccccacatcccccaaaaaacacacacacacacacacacacagcatcagagacctgagaaggacatcttggtggaggtttgggggaatggagatggttccttttatttttttatagtggtggtgtggtggtttttgttgttttggtgtctaaatcagagcatcacatggccttgaaggtttggaaaggaggggccatagttcaagaacaagcagtagcttcttgggaacgtattggagagagaaaagagaaaagaatatggacaatgtagagaattgtaggtctgaaactatctgggacaaagctgaggctcctgacttctatagggaccagtcatatgaaaaagaagggagtcgtgagagatgatggggtagttgtgggttaagttgggttttggaaagcctttgggaagattgaccagggaagaggccctggaagtaggcttgagaccctttgggctgggaatttaagggtcccagctacttggaacatgatctagaaagggaagcgaggtctccaggtggacaaatccctttggacccaagactccttgcccagagaaaaggggcacaaccagacaagggctagcatgggccctgggaagcacggagttcagggtggggcaggcttgctgtgtcctggcctggcaacatacctgcactgtgttgtggtagaagaacacaaagctgggaggcagagaactggttctaatcctagctgtaccctgacaagctgtgtgaccttggccaagttactttcctctcctggacttcatatatggtttttccattctttgcatccctgaagctccatgacttaggggccatcaacttggttgtccctgagtgtttccaagaataccaacagtgcccagggttttactcagcttggagaggaggcctagagcctccctgtggtgaggaggaaagaggttagagcaagtttgggtctgcagtgctaggattagaggtggcctcacaagccaaaaccgctatactcacagccttaggacagtgactccctrctcgctgcctcagtgtttccagctgtaaaaaaggacccttggtaccttcgacagaacagcacccatctagtacaaaggtagttccttttatgatcaaaacaatcaggaaaaagagagaggctgggtgcggtggctcacacctgtaatcccagcactttgggaggctgaggtgggtggatcacctaaggtcaggagttcgagacccacctatcaatatggtgaaaccctgtctctactaaaattacaaaaattagccgggcatggtgccgtgcacctgtagtcccagctactcrggaggctgaggcgggagaatcgcttgaacccaggaggcagaggttgaagtaagacaagttcgcgccactgcactccatccagcgtgggcgatagaggaagactccgtctcaaaaagaaaaaagaaagaaaatgagagaaagggcctggaggtgagtgtgaggagggaaaagaacatcaaacagataaagtcctgtcctgttgtcctgggaccttgggcagccatcttggcccagatgatccccacaagaaagaggtaagggtttcctgacccatttctgccatggtcttaggaaagtcattgagttttcatgccttagtttcttaagcaagtttgaaagttcactttttggatagcaataaaattactccttttcttttgttcacagagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcmgcagcagcggagctgtggacccttcagtgcaacggtcattcacccaggtcacattaccttccttctctccctcggcggcctccccacaggctccaactctgcaagtcaaggtttctcccacctcagttccmaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaaggtgattcagaagttagaatggtagtggttggttggttccaatgtttatgtgccagtttgcagacactgtaaatatttctgtcgtcttcaggaatggcaggtatatcaatatggtcctgtctgaatgaggttctggtaactggcaataagaactggtacaggagcatgtcacattctgcagcttcaaataccttaatatctattgcgcctaattcaaaaatacttggttaaaaaatccagcaagcggccgggcgcggtggctcacgcctgtaatcccagcactttgggaggccaaggcgggcggatcacgaggtcaggagattgagaccatcctggctaactcagtgaaaccccatctctactaaaaaatagaaaaaattagccgggcatggtggcgggcgcctgtagtcccagctactcgggaggctgaggcaggagaatggcgtgaacccgggaggcagagcttgcagtgagcagagatcgtgccactgcactccagcctaggcaacagagcgagactcccatcttaaaaagaaaaaaaaaaatccagcaagcatagtagacacagggccattctgataactagtggtggagacttgaataaggcttgaaattggctaggcggcagccagatctcagctgccacagttgagaactattcattcagcaaacatctgagcatccactatggtgatgaatatgacttttaatataggtgcagcagcttcaagtagcaagcctcatgctgggcccttagtatgtgttgagggaatggatgactgaaaggggcctgttctttctgtgatgtgctgcatcccagtgccttttcatcatatttccctctgactctgtggggagcccagggtaagattagtattgctttgaatttcaaagaatcttatagttcttcaatggagttcaagaattgggacaggtgggggaatgtaaaggcaaaaagctgagacagtcctcccaaagtgcacttkccgtccagaaaggatggaagaaaatgaagccccagggagttgttgattctcaacatctgttaactcccttgctgggtgcagtcatttgctgattagcttccctttcccccaccctggcacccagagtaataaaacaatttgtactcgttccctcagaaattgatgcagcccttatgggatgttcttgttgtctaagccaccttgtaaatggctgtgcacatcatcttcagcagtaggtggggagttggaatcattatgagatactccatcctcaggtttctgctgcagctgcagtgacagaatgcattcctcatctctgtgccttctttctcctcttctcccaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcrccacaggtgcagcaggtcccggtaagtggctggaaaggattcagggaggcactggttggggctgttaactggtccttggttgaagatgtggtctacatactaagaaggaccaaccagagtgtacacaaagcagcttgtagggcgccaggatgcacctgtgagcagcgtatagtgacctggctgagtccatatctgtagatagacactggcactcaggaaaggctggtgcagtcacttacgtacacatgtaatgggcataaaactggaaagaaatgtgctaaattggtatttcccagataattttctttttcatagttttgtgttgtgtttttttgttgttgttgttgttttgagacggagtctcattctgttgcccaagctggagtggagtggtgtggtctcagctcactataacctccgcctcccgggttcaagcagttctgctgcttcagcctcccgagtagctgggactacaggcatgtgccaccacacccggctaatttttatatttttagtagagacgggatgttggccaggctggcttgaacttctgaccttgtgatccacccgcctcggcctcccaaagtgctgggattacagacgtgagccactgcccttggctttcatagttttctgttctccatattttctgctrtggatcctgaacatatattgggttggggggagggggggcatgtattattaatcttttttttaattttttttttttggagacagttttgctcttgttgcccaggttggagtgcagtggcgtgatcttggctccctgcaacccccgcctaccaggttcaagcgattctcctgcctcagcctcccaagtagctgggattacaagcacctgccactgcacctggctagttttttgtatttttagtagagatggggtttctccaggttggccaggctggttttgaactcctggcctcaaacagtgcatcgatctcggcctcccaaagtgctgagactacaggtgggagccactgtgcccagctgggggacgtgtattatttttataatcacaaaaaacgtctttatgttatatatcatcgtggactatatcctcttttttctttttttttttttgagagtcttgctctgtcgcccaggctggagtgcagtggcacgatctcggctcactgtgcaacctcagcctcctgggttcaagcaattctcctgcctcggcctcccgagtagctgggattccaggcacgcgccatcacgcccagctaatttttgtatttttagtagagacagggtttcaccatgttggttaggctggtctcaaactcctgacctcatgatccacctgccttggtctcccaaagtgctgggattacaagcatgagccaccacatctggcctatattttcttactaacaatttatcttaaaaaaatcaggtttattatttttgcttctcagccatgtgtctggctttcctgagtcttttctctcctctctgccatccaccctacccatctctgctctgctcctgctgggccactggcaccaccctcttgaaagtctttcaacctaaaaacccatgacctggctgagcaccatggctcacgcctgtaatctcagcactttgggaggctgaggcaggtggatttcttgaacccaaaagttcaggaccagcctgggcaacatggtgaaaccctgtctctacaaaaaaatacaaacaattagccaggcatggtggcacacacctgtagtcccagctactcaggaggctgaggcagcaggatcacttgagcccgggaggtcaaggctgcagtgagctgagattgcaccactgcactccagcctgggcaacagagagcaaccctgtctcagcaaaaaaaaaaaaaaaaaaaaaaagccaggaccctcattagctagcccctctttctccacctgaacccggtattcaggctgtacaaaatagccggcttttgaaatggcctctatgaaatttcctgttcatttttttattctcaatttcataaaaattatatcatttctcattctttcttggaaggtctatgcagtaagaaaggaatgcataacagaaggataatgctatcatccttttacttttcttccttcttcatccaggtcctggtccagcctcagatcatcaagacagattcccttgttttgaccacactgaagacagatggcagccctgttatggctgcggtccagaacccggccctcacygccctcaccacccctatccagacggctgcccttcaagtaccagtaagagctgccttctcccccaccctcctccctccccctttattcctggaggtgttagtcttcagagatgttaaatctctatatgctgagtaggtatgggagggtctatagcacaaatcagtcaaattgtaaatgtcacccctcttagttgtttttcgctcgaaaaagtattagcaatgtgtgttcgatgtgggagtactggagtctacaaggaggtagaaaagaatagcagaaggaccctctattcttggctaatagctccacacaagaccattcacctcttagatcctgctgatgacttctgaaggaccctagggccaccaggcagggaagggctccaaggtgaagaacatggaaggtaccccatccttcagttgtaggttcttagccactttcagcatcctatagcatgagaatctgatagagtaaatggtgattaaaatttagaagcactagctttattcataaaatccaagaactggaagcaactcaaatgtccatccacaggaaaataagcacattgtgatatattcatacaatgaaattatgcctagcaattaaaaaamagaactgctgacaggcayggtggctcacgcctgtaatctcagcactttgggaggccaagaggggtggatcacctgaggtcaggagtttgagaccagcctggccaacacggtgaaaccccatttctactaaaaatacaaaaattagctgggtatggtggtgcatggtgcatgcctgtaatcccagctactcaggaggctgaggcaggagaattgcttgaacctgagaggtggaagctgcagtgagccgagatcgcaccactgcactccagcctggatgacagaacgagactgactctcaaaaaaaaaaaaaaaagctactgatgcatgaaacaacatggggctgtccctcagaaatagtgtgtcaagccaccgggcgcagtggctcacacctgtaatcccagcactttgggaggccgaggtgggtagatcatgaggtcaggagatcgagaccatcctggctaccatggtgaaaccccgtctctgctaaaaatacaaaaaattagccgggcatggtggcgggcacctgtagtcctagctactcgggaggccgaggtaggagaatgtcgtgaacctgggaggtggagcttgcagtgagccaagattgcgccactgcactccagcccgggcgacagagcaaatctccrtctcaaaaaaaaaaaaaaagaaatagtgtgtcaagccaaaggagttcatgctaatgagtccatttatatgaagtttaaaaagaggcaaaatgaagctatggtgctggaattcagagcggtggtgacaaggaggggaggggcatgcggggactttctgagctggtagaaatgggctatatcttggtctgggtggttatatacattgtgtacatatgtaaaattcatcaagctataaacttaagatttgtggtttttattgtgcatgacgtacttattggcaactaatgaaattgggcacctttttatttatttattggctgattagatattgaggccattatttaagaaattaaactaaaattggtccaggcccagtggctcacgcctgtattcccagcattttgggaggctgaggtgggcagatcacctgaggtcagtagtttgagatcagcctggccaacatgatgaaatyccatctctactaaaaatacaaaaatgagccaggtgtggtggtgggtgcctgtattcccagctactcaggaggctgaggcaggagaatcacttgaaccaggggggtgcaggttgtagtaagctgtgatcacgccactgcactccagcttttgggcaacagagtgagactttgtctcaaaaaaaaaaacaaaaacaaaaaaacaggacgtggtggctcacgcctgtaatcccagcactttgggaggccaaggcgggtggatcacctgaggtcagcagtttgagaccagcctgaccaacatggagaaaccccgtctctactaaaaatacaaaattagccaggcatggtggcgcatgcctgtaatccaagctactcgggaggctgaggcagcagaatcacttgaagctgggaggcagagtttgtggtgagccgagatcacaccattgcattccagcctgggcaacaagagcgaaactccgtctcaaaaaaaataaaataaaataaaataaagttagaaaaaataagaggagaaaacagagatgaagaataaaaaggggagacctccatggttggcctatttacttaatcaaatggctcttattgagagtgtcacttctgcccttgagctttttgatggcaaaattgtataaagaaatgcagtaatttgcttaattgtcatttgagaggaaaaaatgtgtcatacactaggagaaagttttctctggtgccaactcgtggttcaccgtgtacaactttagaagtggttaacagtttgacagcaaagcagaaatcatatgacttgtttctggcataygtagatcaaaacttaaaacatatttagccatgttaatcctcttgtggtgtagtttatcagcagtgattcttgaagggaggtagtaaccaaggttcygtggctcctgagacttcttggggcctgatttgattaacccaggaagagtctcagacctcatgaagtactgccaggtctggcagcacttggccaaagcgggcaggtctgtgttgaggttgctttatgcagactaacaaagggatcattctgctgtgtacctgtccctattctagaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaaggtgggtgccaagcaaaattgtgttttatgttccaccatctcccctctacctgtttttgcctcaggagcctagagaagtcccaggctcaaggtaagtgaatacaagaccgagttagaggtgcttttttattaaagcatcttggtgtcatgtcaagattataaaatattaaaaaacataagggactggtgagggttgataaggcagtgacccgctgagacctttgactcctttggctatgctctgcagtgatggggactccactgtcagaggcagagaaagatgcctgccactcagtagttccagatacaggactgtgtgtaccttggagtcagctgatggcatagttttagctgtgtttaggggttaccttttaaggaaaagaaagaaaaaagaggttgagtctttgaccagcaacacatagaggaaactgatgttccaaatgtttctggtgtttcagtgtatgtgtcttctagaaagtaggagattttatttttaaaacctatctatgtttaaaccctattttgaaagaaaatttcattttccttgcctacaaatctgaaagctgtacatcctaagtaaaaatctatgccttaagataactgtccaggctaggcactgtggcttacgcctgtaatcccagcactttgggaggctgaggcgggtggatcacgaggccaggagttmaagaccagcctggccaacatggtgaaaccccgtctctactaaaaatacaaaaaattagccgggcgtgctggcaggtgcctgtaatcccagctacttggaaggctgaggcaggagaattgtttgaacctgggaggcagaggttgcagtgatctgagatcgcgccattgcactccatcctgggcaacaagagtgaaactctgtcttggaaaaaagaaaaaaaaaaagataactgtccaacaatgctgtggttgtttttttcatttgttttcgttaaagtttgttatggtgctaggattattataagaagtgggaacaatagctaatatttattgagtgtcaactatttgccaggctcagggctaagccctttacactcattatctcatttagccctgctgcaagcctgtgattcacgcgctttcattatctctgtgctaatgaggaggaaagtgaggttctgaggtatggaataacttctcccgagtggcacagctaatcattgggaggaccagcatctgaacttggtttctcctctcacagagccatgctgtcatcccaagtgctagggctctgctcttttcacactgtagcctgcactggtctcactgtgttttcactcatcttcctacccagatgcacaagtctggcgttctgaggaaggccattgattacatcaaatacttgcagcaggtcaatcataaactgcgccaggagaacatggtgctgaagctggcaaatcaaaagaacagtaagtgtgctgagaaaaggcttgtcagccctggcccaggtggggctttgtaaaagcagatcattttcaccaggtggggttttctttgcagagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtacagacttttgaaatctcctgatccctggaatctttcccatttcccctaagaagatagctgggaggtcacagttatgaggccaggccgcatgttaagagggcctagcctggagaaaaacaggaattctgtgaaattagccaggtcctggagaataaagaaagaaaaaactgactccggggggaaacagtccctcaggtttaactggtccttgccgataggccccgtcagagaggaatgagtgccagatccagaacgagaatgcagagtagctgttgtgggggcgttgggagctgctggaggcacctcattgcttcactctgcctttaatgggcctggcaagaccactttgggaggctgatcagttggtttaggatgaggctgcctctgggtcctcttttcagaaatgattacaatttgcagtctaacagataacattttacctatgggcctttaatcgtcaaagcccctggcaatggtagtttaatggaattacttaagagacgctctgagcctaatgatcttcctgggaacctgtagagaccactgggttttgtactgtattttgacttcggcagtttctgactctgaaagcacaaagttccctcctagtgtttgtttttgactaagctgtttattgtatcatatacttaattttactaaggaagctccatttttgaaatattcttataaatgtggttctgtttggcaacaacaggctgtttgacatataaattgaattagctgggcttctgagtcatcagaagaaaatcttaaatggttttaaaatattgaaaagaaatgacatgctatatacacattggggcgcaggggagatctggcttcagccctcctgctgtaaaatggagagtggggtgggtgtagacaatgatacagttttagaacaggtaaaatcctttagatagattcacactaaatacggtctttgatcaacttcattgaggtgtaatttaaatgcaataaaatatacctactttaaaagtacagtaccaagagttttaacataatgtacagtgctatgtaactgtcactgtaatcaagatatagaacatttccatcaccccaaaaagctcttttgtacacctttgcaggtagtttcccacacccctctccagcctcagacaatgactgattcattggtttcctgttactttagattcattttgcctgttctggaattatacagaaacagaatcatacagtgtgttctcttttgtggtagatttctattttaaaagaaaatctcttctacctttgttctttggaacatgtacttttctcagttagcaagcaggtgaatgtgccaatgtttgagcagcagttagtgaattataggcttctcagttcccatctggccttagtcctgagttaatcgacttgaatttaaacctcataaccatttctcaatatatatatatgtatttataaagtgctgtaaaaacctatgcagtatttattccaacctcgaggccttgttttgaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggtaggtggaggccccttgccccacctgggcatggctrgaccactatggcaggagaaggaccctgtgtacaaacttcttggcttggctaccaggtcccaaagggcttttatagtgggcccccacctgcttgcttctgatagggactggcataagttccattttagaagtaacaaggcaagcccaagttcagtcagaatgagcaaaacaaatcagggacccacactactctaaataccctggggtggaggggtggtacctatttgaaggaggatatcgtgttttttatctgaggttgcaaaaccaatgcctcaaccctttcaaaacaaagatttttatggcactcagctccataatgagaagggctacagtcattagccctgtttagattatagaattatttgccctttcttctgaaaatgaggtagaagactctttcctgtgatagtgctggggtctgtcaggtgcctggctgctccgcaaggcctttcctagcagactctgctgagacgctccttcttaggttctgggggctggtttgactggatgatgcctactcttctcttatggctggtaaatggtgtgattgtcctgagcgtctttgtgaagctkctggttcatggggagccagtgatccggccacactcgcgctcctcggtcaccttctggaggcaccggaaacaggcagatctggatctcgccagagtgagttctgtgtccgcccttccccatcctcccccagacttgacaaataattcagcaactcgtgtcaaagaaagtcctatgatagatgcttgtggtgagaggaaaaagggaccctgctgctgaatagtcacagggcagtggagtgggcgcctctgcatarataattaattccagggacatgagatgatctatgtctccggtatgacaggaataatgaagttgagttctgagggaggggttctagggcttgagcggggctgccaagagtaggaaggaagggcagaggtggcagaaggaccttccaacccgaacacatgaatggacaggctgtttggagactggcaggttccagggtgtgttgagtgtaggttatgtcagagagagttgaaggcaaaggctggtagtgtgtctaggcccaaattggagagggctttcactaggaactgatttggggctttattcccaattctctatagaaccaggaaaggtttttgagcaggaaaactagctgaaagttttcatttgaaatcaacagggagtttacggaaaaaaatctggggcaactcacagcattgaggaagagttaaacatccacatttcaagaggaacaagaaccagaacactcctcagcagcagtgagccatgggcctgccctccccacctctgcaagctgcagggccattagtgagaatctgattggccatcctggatctgtcagccttgctggggctatgggtctcagaatatagatgtgattttgagaggcctgttccttgagtataacatcccaagatgtatatcctagaggcaggttcaggtgtgtgttttacaagcatcattatggtggctgtgaaggataggtaggagggagatgtgaaatgcatggaacatggcaacaagttagggtgctcttttttaagtaaagacaaggtctcactgtgttgcctggctggtcctgaactcctaggctcaagtgatcctctcaccttgacgtcccaaagtgttaggattacaggcatgagccaccacgcctggctgagtcagggggctctatgaaatagactgagtaagagatgatggcaaggacctggaattaaaaggaaaggtttgaactgaataagtatttgaaatgtaatatttggaagggaagtgattagtgacgttgactcaaggataagagaggctccaagatggagtggactccatctaggccatgttgcctggaaaagctggaagaggcccctgtagagtgagcagtgattgagaggcaggccatggggactgagcaggggcggggccagagtgtttgggaagcatgtctgtcagcagagggttcttagggagaattggactggggagtcaggaggggtaagagccaaagactgggacttgggaatagcccatctttgagggaaaggcaggggaggagccagggaacacctgcctcctttggaatctgcaaatgcaggtccttctggctggaaagatagaggcaccttagagactgttgctgtgaggacatcttttcttttcccttgtccagtcctgtaatgatgtgggaaacaaagcacagatagtgtaccagctgcccaatagaggaaaataggagaatttactttcatttcccaagactatatagcctgtcctctagtttccagcagtgagagagagaaagcgagcggtctccagtacagtgccgtagactctccattagaccctctcaggttgacaaagattagttcatctgaatcctagagtagggtagtttagctgtgagtttgcctaaaaccatggttctcaaacttcagcaggcatgaagccgggtgctgtggctcacactgaggtggggggattgcttgagcccaggagttcaagaccagcctgggcaacatagcaaaacccccatctctaaaaatgaaaagaaacgctttagcagacatggcatgagaatcacctagagggctgcaataccagagattctgattcagtagccctggggtaaggtccaagtgcttgcatttctaacaagctcctaagagctgatgctactggcctctgggggccacactttgagaccctgaaagcctaaaggatcatgcagttcatctaaatctgtgtcaccaccttatgtctaaaagctactgctggccgggcatggtggctcacgcctgtaatcccaacactttggaaggccgaggcaggtagatcacttgaggtcaggagttcgagaccagcctgaccaacatggtgaaaccctgtctctactaaaaatacaaaaaaaaaaaaaaaaaaagtgctactctgagggaactctgaccagcatttgctcatagaacaaacgcacgcagtacaatctcaatcgagtaaaaagtctgtaaggaaatacctcagaatgtcagcagggattcttcctgggggatgagattataggtggttttgttttactttcttgtagctttctgaagtttccctcgtttttatgagtgtgcactaattcctctgataattgggggcagggggagtagaagtctatatcaaaacaaaaagccggagcaaggccagtgaccattaacaccttttgatactttgtagggagattttgcagctgctgccgscaacctacaaacctgcctggcagttttgggccgggcactgcccacctcccgcctggacctggcctgcagcctctcctggaacrtgatccgctacagcctgcagaagctacgcctggtgcgctggctgctcaagaaagtcttccagtgccrgcgggccacgccagccactgaggcaggctttgaagacgaagctaagaccagcgcccgggatgcggctctggcctatcaccggctgcaccagctgcacatcacaggtgagggggcagctgctgctgcctggcttgctgcaaggcatctcatgctacctctcctccttagcttgatttgccagttctgcaccctagctgaagtccctttaacgctactcttttagagtggctagaccaagcttctacctgttttcacagctgtaaggttggctctttgctttagctcatcagttctcagatgcacatgttttcacaataacatcactatactcaggatgtgtcctataaacagtggcacattgtagataagttggcagtgtttttctttagtgatacttaaattaatggtgagacttaaaattgctgacatcttakagtcaatgaaatatgatcatctgtttcattcagtaagctcctgctataataggcagagaggtcaacaaatgaatgacagttcagcgtgagtatgttagacttagcagaaggaacatgttttcgttgggagggagtgggtacccgtttggagggtttcaagaaaggttttctggggaagtagagtcttggctttgcatggaaggatgcatagaggtcaccagctctgcaggagatgagcctctgggcagagggatgttcccaaggaggagccccacctggggtggctcttgagaataagccttcagtggtcctagagggagccagggcacaaaggcagtactcagaccatgaaggatttggatgccaggctgaggatcttgtagtgtatcagtaggattcagtgaagagcattaggaaaatagtgatatgatcaggtttgtgcttctcaagtttagaagagtcaggctgggcatggtagctggctcacacctgtagtcccagcactttgggagactgaggcaggaggatcacttgcactcaggagttcgagaccagcctggacaacgtggcaaaaccccatttctacaaaaaatacaaaaattagccaggcttggtgatgcacacctgtaatcccagctacccaggaggctgatgtgggagaatcactggagcctgggagatcaaggctccagtgagccaagattgcaccatagcactccaaaaaaaaaagtttagaagattcactctgatggcagataaggagtggatcccagaggatcaaggctagagctagagaggccaaatagaagctgatgcagattaaagatgagagttgctgaaaggacagatgagaggaaattagaaggtggaattgactggactggggactcattggactgatggatggggacagtagtcagctaagacggttccctggttcttccttgggagtttgggtgagcgatggtgccaccaacaaaggtaaagaaaatagaaggaagagcaactttccaggaaaagggtggtgagttcccttttggacacttgcctgtgagatgtggaggtgagctggacatgcaggatctacagcccaaagaagactacaggtgagagtgaaaagcaagggagcctatgagagtggataggtgaaaaggagaccctcagggccattcagaagaacaccctcatctaaagaacagataggccatcgcggtggctcacacctgtaatcccagcactytgggaggccaaggcaggtggatcacctgaggtcaggagttcgagacctgcctggccaacatggcaaaaccctgtctctactaaaaatacaaaaattagccgggtgtggtggcacgtgcctataatcccagttactcgagaggctaaggcaggagaatcacttgaacccaggaggtggaggttgcagtgagccaagatggcaccactgcattccagcctgggcaacaagagcaaaactccatctcaaaaagaaaggataaaggctggcacagcagttcacatctgtaatctcagaactttgggaggtcaaggaaggaaggtcgcttgagcccaggagtttcccatcagcctgggaaacacggggagactccatctctccaaaaaaaattcaaaaaattagctggtttttgtggtgtgtgtctgtggttccagctacttgagaggccaaggtgggaggatcacttgagcctgggaggtagatcgaggctgcagcgagctgtgattgtgccactgcacatgcatgcagagatgaacagatagaggatggggagtcaggggcagaggctgcctgagaggagcagttggagaggtctgaggagacactgagatgctaagtgttggaggagcaaggtcagagagttgaggaggggagattgttgctgggacacccagtaagatgagggccaggaataacagtaggatgtggtaactggaaggtgttagataccttgatggcagtaaggagcttcagccaaaagtggaacagagccaggcaagtgatgtaggagtgaccaggagatgagacagtggggccattgtgcagctttaatatgtgggctcatggtagaattttagcagaaggtccctatctgcaaatttgccccgctgttatcttgtctgttcctcagtgtgcccttgggacagaataagcccatactcasgtctctgatcaggctgtgtcctccttgctgccaaattctggagaattccagctgagaagctttacgtcactcattccttccatactcactggcattccctgtgtgaggcactgaggggacagaggtaactacagtatggttgccacrctgccctctcacctcccttcctgtgtctcctgcaggaggaacacctgaggccagtacagaatggagtgtggaggctgagatctccctaggctgataaaaagacagggaggcaaggcagcccaggagggggaacacagggctggatgagcacgggaagcctggctttgccactgtctgcaccttgacatgggcacttcctcccctgaggcaaggagactgcttgcccttgtagtgaggaccaaagccagcaacagtatgaaagcctcacgagagctgtgatgggcccttgtgcctgtgcaaggatactttgttccctgattaggggatcagccccagatgggccactgtgcacctctcataggggagggtgtggtaagccttcctggcctcccacccactaacccaacatgtgttcagctgtccttgctcagtttacgtcacttccccctcaaacgggtatgtgtttgtgtattgtgaaggcgggtttttttttggcttttttgggggacagagtctcgctctgttgcccaggctggagtgcagtggtgcgatctcagctcactgcaacctccgcatcgcaggctcaagcaattcttctgcctcagccttccaagtagctgcaattacaggcgtgtgccaccacgtccagctaattttttctatttttagtagagatggggtttcactgtgtttgccaggctggtctcraactcctgatcttaagtgatccgccggccttggcctcccaaagtgctgggattacaggtgtgagccactggcacccagccacattgtgaaggttttttaatgaaaataaattcaaatcagttcatctaaaaaaaatttcattacctctgttgaatgtttggaaacacacagtgtggctgtgctgctgacattgttatgttgcactgtgcgcctctgagtcctatacaacaacctgcaattgtgacagctctgggtgygacagaaatgggtgccatgttcccagctaccctgtgaggtagacaggaacacacagccagtatatcacagagcctggcatcccatcctgtgatcaggcctgtctgatcacaaagttcacctcgcttctcccctggttcctctcttactttgatcgtgctggagagagcaggaaaaagtttggttttggggctccatcaacaatagtgtctgtttctgcccaccctagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccgtgagtacccttcggttcccttctgtaaacctcccctgagcacttacctagccaggagttaagatgcagaagcagttatgaacccccttccccatcaggtgctgcccacctggaggggtaggcaggcattcatkcagtcgctcatttcaccaggactcccagcaaccgataaaacagaccaaaattcctccccttgtggccttaataccataagccttgtaggcaggacattttggtccmctgaggtaatatgaggtaatatgaagattggttcagcartagcagagctactgtacttgggggttaatatgcaacttttctgttcttcaagtggtcataaaaattcttagaatcccctggttatgtctcatggttctttcatttactcagaaggtatttattgggcatcttgtrttgatcacagcactgtgaatccagaaataaaagccagtgcctttgccaagctacagagttaaagaaaagaaaaatgaaatgaataaaagtaaaagaaaacctgtgcctgtctacaaggagctcaggtcagacgagggcagggattgtggctatcaagyacctcccatatgcctagctaggagccaggcttgggaactctcaaatgggtaattcccggtccttgttatcagctagctcacaacatgctgacctcaggctttctcttactctagcagaaacaggtatgttttactttgtgtcccactatggatagactgctgaatacatcaggtatgttcaagcattaccacatctctatttgtttccgtatctcagtaacagcagagatgagctgagaatgaatcagaacgtgccctgtagtgacattgatatatttcctgaggtacatcacgatagtctaggggacaaagggcgcagggaagcccagtgtactctttatgtctacacttgatcttagccagaaggctgagaagtgatactttttatgtcttacctctgtttctggtgactacagataagagactcatcccttgattcactcattcagcaaatatgactgagcaccgtctctaagcaggacatttgccttgtcctcagggagcatagttggcaaggaatctagacagcagcccttcttgagcttgacattgatcttctcatgaggaggactgggctccaggtggggaaagaaccccatcctcacttgtgggctagacgacctgggagtccacagacactgaagacacatcattcttcctattcatttcaaccttccctcgacagatcttcctgggaccaggtcttcaggacagtgtgagctagggtgagctcctgagctggtcttgggggaagtcagggtgggctttctggggaaggtgaatctaggctgacagcaggaggcattgatgagatctctctccttttcagtttattgaagtgctctgggctgatgtcattacatttgtaacttccatgccccccaaaaatgttttgaagacattcattttatcaaaatacaacatacatgcagaaaaatgcccacattttaacttacggcttgaagtgaagttacccatgcaacacccacccacatcaagaagtagaacattcccagcacccccagaagccttcttgaggccctccctgctcttcctgccccaaccaaggtaaccactcttctgaattctgtcactggagtttaatctgtctattgttcatcatttcagtaaacttatcaaagtacatgcttagaagtctggctgggagggccgggcacggtggcttacccctgtaatcccggcactttgggaggccaaggcgagcagatcacctgaggtcaggagttcaagaccagcctgaccaatatgatgaaaccctgtctctactaaaaatacaaaaattagccaggcgtggtggcatgtgcctataatctcagctacttgggaggctgagacaggagaatcacttgaacccaggaggtggagggtgcattgagcggagatcacgccattgcactccagcctgggcaacagagcaagactccatctcaaaataaatacatacgtacatacaaacaaaaattagctggatgtggtggtgcacacctgtaatcccagctacttgggaggctgaggcaggagaatcgcctgaacctgggaagtggaggttgtaatgagccaagattgcaccactgcactccagcctgggtgacagagtgagtgagactccgtctcaagaaaaaaaaaaaagattacaatatgcatgtcaaaaagtatacaaatcataaatacacagttcagtgactccacagagtaaacacacccttatagccagcagacagatcaaagtacagaaccaagaccccagaaacttctcttgggccctttgcaatcactaacctgccccttcccccaagccttccagccttccaagggtaaccaccatcctagtcacctcagatgctttgcctctgtttaaactatattaatataaggagagtcttgcagtatacactgttttgtgtctgacttattttgctcaatatcatgtgtaagaatcatkwtgttgttatgtagaattatagattgttcgttctcatatttatagtgttccattgtatgactagattattgcagatgaactttttagttgttttctggctttggttattatgaagggtgctgctgtgaacctccttgtacacacatctttcaggaaacrtgactgcatttttaggaatggcatcgctgggtcagaggttgtgcgtatttccaaattgttggccattctccactccatcagcagtgaacaagacttctagttctacatccttaccgaacacatataatgtcaatttttttaagcccttctagtgtatctcattgtagttttcatttgtacttcccaggtgattaatgagattgagcacctcttcttacatttattggcaatttggatagtctgtttcgttacattcaattcaagtcttacctctttttcatttggactatctgtcgtctcattgattagaggaattctttattctggagattacccctttattggatatatgcttttcagataccttctcccactctggggcttgcctgttctgtcttaatggtgtctagtgagagcacaagctcttaatttcagtgaaatccagattattagtcttttcctttacagttagacattttaagtcctgttcaataaatctttgtcctacctcaaagtcatgaagatattctcctatgttgtctgctagacgytttattttttactctttacacatatgtacctaatccacctggaattaatttttataagagttggaggtaggagtgcaagatctgtttttctccataaggatatctacctgacgcagaacctgttattttaaaaactatccttcccctgctgcaccaagtggcacctttttttcataaatcaaggatccgtgtaccgtgggtctgcctccagatctagtctgttccactgcaccatcaccacccaaccctaacggctgagttttctcttacgtcttgatgtctggaagtgttggtcttccagatttagtgactaacgatgaatcttgggtgtttctttgtagcctcttcattctacagaggtacttgatgctgctgatggacatttgggttgtttccagtatttgccgttataaacagtgctttagggaacatttttgtccattgtcttcatgcacctccataagagtttcctcagaccaaatctgtagagatggtgatgctgtgtcaaaggatataaatatttgaaacttaatagtattaccaaatttgcatattcagtaagatggaaaaaggagaactgtcatctttaaagtaactgctcttctctgtttacttctcttgagagaggataaagagactcagacagtactttcttataaaggaagaagctttgaatttggtgagatatatttagctacaaatgagccagttgttgggggcaagtggagggctggcctctgtgaaaatggtttagactagaggttcccaaacttgctcaactcatgactcaagattcccaaacwttctctactcactatgtctcagtaaatttttcatggcatcccttagccaaaagaaatacctaacggttctggttttcgttttttgaaacagtgtcttgctctgttgcccaggctggagtgcagtggtgcaatcacggcacactctagcctcaacctctctgggctcaagtgatcatcccacctcaccctcccgagtagctgggactgcaggtatacaccaccacaccgagcttatttttgtattttttgtaaagtcagggttttgctatgttgctcaggctggtctcgaactcctgggcttaagcgatctgcccacctcagcctctcaaagtgctgggattataggcatgcaccaccgcgcctggcctctgttaagtagttaagtttgaacatcctaataggtatttaaattgtcttaacagcttagtggtcatttgaaaaaatcatatgtcaagttgaaagaagaaataatattttttgctaggagtggtagcacacacctgtggtcccagctcctcaggagactgaggtaggagaatctcctgaaaccacgagtttgaggctgcagttagctatggtcacacctgtgaatagagccactccactccagcctggacaacatagtgagaccatgtctctattaaaaaaaaaaaaaagaggttgggcacggtggctcatacctgtaatcccagcacttaaggaggctgaggcgggtggatcacctaaggtcaggagtttgagaccagcctggccaacatgatgaaactccgtgtctactaaaaatacaaaaattagccagggatcgtagcacgcacctgtaatcccagctactcggaaggctgagacagaatcacttgaacccaggagtcagaggttgccgtgagccgagattgtgccactgcactctgggtgacagagcaagactctgtctcaaaagaaagaaagagagagaatattttggattcttaataatttcttagaaatcatggttattaagaatccaaaatattcttttatttatttatttattttttgagatacagcctcactctgttgcccaggctggagtggaatggctcttcacaagcatggtgtcactgtttcttaccaatacatgaacctgtcaagcactgcacacctcaagctttggaatcagactagcaaccatcactctctctcttttccacattrattttcacacagtactatgacagatatcacatctccaaaggaagctagtgtggtctcaatgctgaggctgcatgctctccccatctagtcacttacagtgcccagctgatgttgagcatcactgttttcctcgaaagtttaaaatagccagtggctcccttgatcacttgctgtggcacctcagactgccttggcacacgatttgagagccatggggttagaccgatgttaggggacacaacctggggttgggactggcccagggatactgagtggctctcaggatctaaacagttgtggggttcttgccacagcctctttcacatcaggcaattagcagatgagttacagggggaggctcctaggccccagttggggaagattctggtgtctataaaatttaggaaamcttaaaaaaaaatttttttttttttggcttgggattacaagccaagccaccagcgtggccaagatggtgaaaccctgtctctactaaaaatataaaaattagctgggtgcggtggcgggtgcctataatcccagctacttgggaggctgaggcaggagaattgctagaacccaggaggcggaggttgcagtgagccaagatcacaccactgcactccagcctgggtgacagagcaagactctgtctttaaaaaaaaaaagaaaagaaaagaattaagcttaaaatacatttttacttagtgatttccacatttgcctttctggttcctcttgccgtatgacctggactaggctttgcttctacttgtaacatttgggccctcgtgagggaccagttggtcctcagtttctcctggagcagccaccaggctcccttgctgattggacatgtggaattggctgttcttggaaagagagttggagtcaaccgttcaaatgttctgggacctccgaagcccaggaatcacgccaccaccccccaatctccctccctgctcagctcctcaactgctattctcccaccattgcagttatcagctcagattcagtgagtgctttgtggaaggttggcagagggtcgcgagggtcctctacatttgttctccagtatccagtatcaacactggttaccaaagaggaaggacggactattggtgcccctggtcccagtgattagaaatgtaagtgaaacaccccacctcatctcataagctgctttgagattatgagtrtgtgtctatagaacaggttgttttctctcagactcaggcagtgtctccaggttccccctggagagagatagtcttctctgtctgtgtcctcgagtggcactctgacagtgctatttctgaccctggcattcaagtcttctgaagccgttacattcgctgatggctacttagagcccagtaaaggtcagaaccatcagactgaaccagaccatgaaacagcgctgctcctgtgggggcgagggctggggtgtggaagcgatgtctgcgggcctcggcctggcagccccgcccctgggctccctgggctttctatcttatgcttctccctccctcctgtcttctgtcctcagttcctcactcaccctggcctgtttcggggagtggttatgggttggaagtcatgggtgttagtgtgaaaataccctcactcaaaaagtgacagaactgaaaacgtggtagatggtattgtccctgcagttcttgtcagtggggtcctggaatgatgttatcccggcaagtggaggaggggcccagtgaccggggccctggctctttgaattgtcccacaaagaggctttccaggttccccctctgttctttctcgcaggctggtgttcacatcaggggctcatgcaggggtgccatggggtttctgtagggggccgcccttgcagggccagctttgtggggggagtctctcaaccacctgcacacagatacttgcctgtacagggcctgggctgtcctcccagctgccccttcactccagtgccatctgatgtgaccctgacggctggccatgtgccgagcactgttctaaactttacacgcaaagtaaaagtaaaagaaaaattagtcaaagcagaataattttgcctaaaatagtctaaaagatatgtaattaaaatgacatgatgggccaggcacggtggctcacgcctgtaatcccagcactttgggaggccgagacgggcggatcacgaggtcaagagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcagagcttgcagtgagtcgagatcgcgccactgcactccagcctgggcgacagagcgaaactccgtctcaaaaaaaaaaaaaaaaaaaaatgacatgataaaaagtcccaggatagaaggggctgcctggcttggcactctcggggccgaggggaaagtacagcagccagggggcccctgagacccctccttgggaaaccgccttcctagtttaccctgcaggttgaatgccagtaggatcaggcagccccagcaggacaggatgcagcaggggccccacgcgtgccttgtggctgctccctgccctcctgctgggatgtggacctagtcagcaagtccagcacactctactggtgggcttgccctagtttccatggtgggctttactttcaggtacctgtgggagtcctatccctgtgctgatctttcccagtctcccccaaagcccacctccaccatggtgctttctgcaccccacagtggctgcagccagcattctgccaccttggtgttrcccctggtccttgtccttccacagagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccaggtgagaataccttggagccattcagaattggagaaagccatgcaaaccgccggtactacagagtcactgcaccagacacgcggagacacgggttgtctcttaatcttgttgagtccgtttgtttgtttgtttgtttgtttgtttgaaccaaagctcagggaggttgagtaacttgcttaaggtcacaagcctgatcagaaattgtcagtgrctaagctgggtgtgcagctctgctctctctaacattcagagcccatggtccttacatcacacagcaataaattgtgattaagctccaagggtactcttagcccttgttttgggcactttggagacacaaaggatgtgtgaggcttgctttccctggcctccaggtctctcccattgggagagcagacagacataaatggagagtttgggaacaataggtggcaggcagtcatcaactgctcagagtggtgacagggacgaggcttcaggcattggaaggaggtgctggctttctgtccctggcatttgatagtgattggagttgactcgcccggccttggagcagtagaggctggtcaggattgacttagaccttgagtgctcagtggctgtctgctttctgctgtacttttcctcccctctcagaattggagtctgtggggagagtaaggttctacaggtataggggtgtgtgtcacacattgggggagttcactgtccttttcttttttaaataataactgtattgctcaacgtgagaattgtgtgcaacaccaaaatataaaggatgaaagcaaaagcaatcctaaatctttctaccccacccctgctggctaaacatggacttctcagtggctttgtcatctctggcagtctctggctccaggccttgttacttggaatgtgttcataagtgtccctcctcctggtcattagatcgaggcccacatatctgccacatgtgaggagagagaaggggctggtgatttgaggcctgccagtaaagaaacttgctggtgacagtcagctatccaagcattgcaaggccccgtgtctagccagttcagacaggtcactgctgatggcacgttccatgacaaggctctggaaaaaccggagcatgttcttcgttgtcatgagcgtggcagcagctaccacctttttttccttgcctggtggttctccttagccacatggagaagagaaatcctctgagacattccattttctgttttctgatccaactccacctgacagctcccaaccttagagtactgagcactgtgccaggagacacagcaccctcccccacaccccctccccaccggagctcatccagaactagtcttgagctcttcaggctgggagtgaacactctcccccatcctccaactgtttagcacagtagttctgggctttggtggagaaggggcatctgatccccattcacaaggcatggctgtgtttggagtttctctccgtaaagacaaagtgggctcataaatgagctccatttaaccccccttgcctgtctcttttccagctgaccccattgcgcaggtccaccaggccttctgcaagaacctgctggagcgagctatagagtccttggtgaaacctcaggccaagaagaaggctggagaccaggaagaagagagctggtaaagtccccagaccagtccccctgccttaggacctgtccacgcaggcaactccaggacagcctgaaggcctgcactcctggagggaaacaagcctggcatcgggttggcagggcaatcaaatggttcctttgtatttaatttctcaaaaatgagagccctatgttaactctgacctggcctttcctcctagaccaagtgcgttttttttttttttttggagacggagtctcgctctgtcactcaggttggagtgcagtggcgcaatcttggcacactgcaagctctgcctcctgggttcacgccattcttctgtgtcagcctcctgagtagctgggactacaggcgcctgccaccatgcccggctaattttttgtatttttagtagagacgaggtttcaccatgttagccaggatggtctcgacctcgtgatccgcctgcctcagcctcccaaagtgctgggattacaggcgtgagccaccatgcccaggcctttttttttttttttttttttgagatggagtttcgctcttgttgcccaggctggagtgcaatggaccagtctcagctcactgcaacctctgcctcccgggttcaagtgattcttctgccttagcctcccaagtagctgggattacaggcgcccaccaccatgcctggctaatttttgtacttttagtagagatgaggtttcaccatgtcattcaggctggtcttgaactcctgatctcgggcaatccgcctgcctcggcctcccaaagtgctgggattacaggcatgagccaccacgcctggcaggtgcacccatttttatgtatccctttaccaagcggagtcagtacttggaccaagtcagggatttcattagcttgctctgctttttggggtagggagcaggggcctgttgaaaggggatgggggctgggtgcagtggctcacgtctgtaatcccagcactttgggtgggaggccaaggtgggcagatcacgaggtcaggagatcgagaccatcctggctaacacggtgaaaccccgtctactaaaaatacaaaaaattagccaggcgtggtggcgggcgcctgtggtcccagctattccggaggctgaggcaggagaatggcatgaatccgggaggcggagcttgcagtgagccaagattgcgccactgcactccagcctgggtgacagagctagactctgtctcaaaaaaaaaaaaagaaaggggatgggaatgaaatgtgacgagctcagcagaaggcagacacatctggcctggacatcttggggacccagcccctcatggaatgtgccgggcaatttttctctctgacatacttactgagcacagtccttctttcacagagtaagacctgagaggcagataggtgccaaagtcacttttgttttttgttatttttgtttgttttttggggggttttttgagacagtgtctcactctgtcacccaggctggaatgtagtggtacagtcttggctcactgcaacctctgcctcctgggttcaagcggttctcctgcctcagcctcccaagtagctggaattacaggcacgcgccaccatgcccgactcatttttgtatttcttggtagaggcagagtttcaccattggtcaggctggtctggaactcctgacctcaagtgatctgcctgccttggcctcccaaagtgctgggattacaggcgtgagccaccgtgcccggccccaaagtcactttcctacaaggcccagatcctgattagggtgcacctgaggagagggggagggggcagttctgcctgggagataagaaaacttttgggaggagatgacactggacttggggcttaaggagaggagtgagggtaggctgtgggggatgctagggaaaggcccccagtagagggaagagtgtcagtgacagcccagagacacggaggaaggatgcctgaggaatayaaagggtacacatagacagcgcttgcrtgtgcctgggatgacaggaaagggacagaaatggccattgggtcttagagctggagagctgaacagctaggccatgaggtgggccttgtgtatatgttttgatgtacatgggaccctttcttttcttcctagtgaattctccagtgctctggagtacttgaaattacttcattcttttgtggactctgtgggggttatgagccccccactctccagsagctccgtgctcaagtccgccctgggtaagcacctgcgggtggcccacagtctcagggtgctcagttcaggtcttcacagtgcttttgccccaggggtccagggcgttaggagtgtagatgccagcatcttctctggatcccaggttcatacctgtggctccagttcacagtcaccccctcccaaacagcactcagaggcaggaaactatggttttcagagaagtagggcaatgagtaattgaatgtcttcctcaagccctagctgtgtgacccaggtgaggacccttcttaatgcccagaagaacaagcaatgagtggcccaggcaccagggatggtggggagtcacctttcagatgcacagtggcccctgaggcagctcttgggccttatgctctttgctgaagagacttttcatctgggcctctctaccactcctcagcccctcatcacatcagtgtcacagcacagcccactgactggattgacatcatgacatttctttgcttctgtccctaaactgccatcaggatgatagcacatcagctgccaactcttgggcttctgtggccaccctggaagatgggggtaccaagctaccgctggtcactctccctagggagggagggatcccagaaaatcagccaccctatcatgatccctgacctgtggcctctgttttcaagtttagggaagcatgaccatccccgctggttttgtgggatcactactgtcatcattttgcagttgagaaaactaaggctgagagaggagaagacttaaaatattctaacaggagcctgttccagatactttgaagataccattctttatggctattgaaagcttaggttgtatccatctttttatttaaaaacaacactgcagtcaaatatgtgttaaacttttttctctctaagccagtttcattatgacagactgccaaaaatgggattactagcttaacgggagtgaacttttttattttttttgagacggagtcttactcttgttgcccaggctggagtgcaatggcacgatctcggctcactgcaacctccgcccgcaccgaggttcaagcgattctcttgcctcagcctccctagtagctgggattacagtcacccgccaccatgcccagctaatttttttgtgtatttttagtagagagggggtttcaccatgttggccaggctggtctcaaactcctgacctcaggtgatccacctgcctcagcctcccaaaatgctgggattacaggcgtgagccaccgcggccaaccaggaatgaacatttttaaggctcttgatatatattgccaaacactttccaagattgtgctggtctattcccctcccccagaatcctgggtgtgggagcccagaggctgctggcccgttcccagcaggcaaagatgttacccatctcctaggaaggaagtgtagcagcctctgagcgccacaggtctcgtttctgtgggtgctggagtgcgtttggtgctgttctcctctaggtccagacatcatctgtcggtggtggacgtctgcaatcactgtggccatcagctggctccagggagacgatgcagctgtgcgctctcattttaccaaagtggaacgcatccccaaggccctggaagtgacagagtgcgtaaccctccttggcmactcacttgcttctctccaggggaatcttgtttgagttagcaggagcaaactggactgggtgggcgtgttggggtgaagggtcaggactgcatgacaggtgggcggctagaaaagtcgggggtgagggcaccatggagaactcaagttgggccagcaggtcctctgtgcaagtgtcctgctctgcacaacacgacagttgtcccagcarctgtcagcactgtgtccgggtcctcctccctgcagccttcatggcgccacaggctgaaaagaagagacgagagcagtgtggcccccagcatcttcagaagctttgtggtggaggcaggcactggtggttcacaatcagtgcagagaggccactgttgcccccaaaactcatgtgcactggagcatcttgcccctgtgtgctagcattttatccactttccttccagccacctccasccccaccatcaaccctggcaactttgtcctgtaactaaaatagcctttagcacatggcataaccggagagcttttgacattcctctttggagattcatgtctgcgtcttgggggcattcggcactagtgatgggcagccctgcctgctgactccccggctgtttctaattggatctgagtattctaagagaaactgtaaaatgctccaagacagaaaggccccacgaggtcctatccttagagccaaggctgtagcatttcctatcaagcagacccttaaccggcgcacaggaaggagctgagaagagtgagtatacacaggcttgaagtcctttgttccctgaagtagatgtgacaccctaatttcattgaagtagccccatttgtaagcactctgactaggtaagcacccagcccggtatagcattccacctgtatgtgtgtctcccccagtcgatgtgcctgaggacactgagactcagcaggtaagttgtccaaagtcacctcgctccagagcagcagagcttccatggacagccaagacacccctgcaggcactgctgcctgctggattcacttacccctgggtccctctgcttttcagggactaggatgctatgagaaccctcccccatccctagcctccccttccactcccagtctcctctacagaaagaagctaactaagtatctccagagagtttaataccacatctctgsgggggtggtcccttaaagaacgggtacaacaccttattgtggccactttataggtaaggaaactgaggcacacgttggaatgactatcttgggtggcttcttagcagcagacgtgatggtgaagcctgtgtctctgacttccagcattgaatgaaggtgctaaagggtggggcgctaaccctagctcagggctggcatttcagatctggagctggtggcatggtgccatagtggcagcattggagtcaacagatgcacatgtcatatcagtgtggggcgtggcagtcactggcttgggcccctctgcctgtcacgcaggtgacacatagtgacctgcctctcgactccctgtcactgctgcaggagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtgagtgggagctgagttggcccctgggggaggtgctctgcactggtttasgagaacactcccactcacctcatgctgaccctgcgggtggggccatccgaaagacagagaaaccaggacagcagccccctttcaaaaaagttacggcttattggcctaggtggactcctttttcatcccttttcagcctctgaggcaagtgtgtttctacctgcacctttcttaggctcccagagtcccaggtcctgctggcccatagcctctgtaagcccaggtgcaccccagctggccaggggttcacctgcatttgctccagcggtttgcgtgacttcccaggcctctgcaggcagccttggagtgggttcctgccccctcgggcacacaaacagagctgaagaccaccctgggcacctccttggctggccgcatacctcctggcgggcagctgtggtgcattgtagttgcattgcatgttctggtggtacccatgcaatgtttccacagtgcatcacagaggcctgcctggccctcgagagactgccctgactgaaggccctatcaggtgggggaggggatcctgatagagggcactgctgccactgttggggcccaagtcacagccatcccaggaaacaggagggcacccagctgaaagtggagcatcacctggtctacggggaacatgtccttagctccagagtgggagggaccgggagagtcctggagattcagattctcagccactccctggggcttggtcttagctggctaggctagtacttcaagctagatattgtcagtggacctgggcactgggatgaacccaggacagcgtggcagcccctacagggacaggcaatgtgcagaaaaggcccaaactggctggacgcggtggctcacacctgtaatcccagcactttgggaagctgaggtgggcagatcacctgaggtcaggagttcgagaccagcctgaccaacatggtgaaaccccgtttgtactaaaaatacaaaaataagccaggtgtggtggcatgtatctgtaatcccagctactcaggaggctgaggcagaagaatcacttgaacccaggaggtagaggttgcagtgagtcgagattgcaccactgcactccagcctgggcaacagagcgagactccatctttaaaaaaaagctggtgggggtgcccaaatgccctgggctgccaagaccaaaggcagatggtgagccacatttcaccttctcttttgggctttccattagtctcttccgtatttgtcttcatgagagaaccaaacagtacaggctcagtttggggaatgagaggcttgcagccaccctttggactggggttccttggtagcagctctgtggtaggaaagtgagcctagaagacaacgccatgcagcctgatggccctcggagggcagaatccagacataggcctgctgcctccatgcccacaggtgcttctgcagcatgcacagcttagaagtgccaggttttgaggagagggatccttttccacatccccttgaagcacacaacagccagaaaacagtgtaggcaaggatcaaggccttgtgcagggacagggcagggtcttcctcaggcccagtgtcctgggaaggaggaaagccagggctgggtgagatgaggctcagcctgagggagttcatcaggaccggagggctgcttgcggcccatctcaacaaggactcctcactgctcggtgtcgtgcaggtgtgccactgcgagccgggtgggcagcccagccccataggtcgtaggcagagagtatgcatggcccacatgcagtaccttctcatatgatacaacagccctgtgatggtgccatttacatttttttgaatgaagaaactgaggctcagagagactaagtcctatgccagggtcatgtagctagtaagtggcaaagccgggtcagtaggcctagtccccaagcactaaggcactctgtggttctgtcttctgagacacctgtctccctctcccactcctcctcctccttcccccagccccatcgacaggctctgctgccacttcaggcttttccttggtaccttgtgggtatctcagcctcctagccagccatggtgggactcccatggggtggaagaacctgcgccttcaacccacaagggttttatttctgcccctrccacctgcctgtgctgtattccctatacaagctgctgtccctgtcagagccttgctttctcacctgcagaatggggagggcttgtctcccacytcctggggccatggaaggaactggttctcccctgagctgttccctcacgtcctgcggagttcaccagactctggggctctccacttcctcccagagctgctgagtgttggtctggggagaggcctggtaggtgctargatccttgcctcagggatgggccagtcacctgtctcccctctctcgtggctgaccccacaggtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgaggcccagctggctggtggggcagggcagattggagcctgtggggcctgagcccagaacccagcatgggcaccagcatgtggttgtggagttggccctctgaggtcagcctggtgacctgtcgagcacctgcttggctcgtgcccaacactgggctaggcgccatgtgtccctgtgttcagcacacattggttgagtgcctgctgtatgcctggccctggagctcagcagggagcaggccacactttgctgccacagacaggggccagcagggagctgtgcctccccaggcacatgctgggtgggagggctctgagggcaatggtggcaagtcagggctcctggcctggtcccgagctccacgttgactttcattctttttcacagtagctagaggcttcggttctgctgctgggtaacatccccttggcagtggccacgtgatctgaactaagtcacggaggaaagttctatgactgggcttgccaggctccagctatttccttttttgtttatttgtattgctatataatgtattcaacatatttgtacctgtatttttttctaaaaatttgagtgagatgactcaagtgtcattgagggggcacgggctgggctggaagaaggcctcagagcgaggctgctgccgtggagcttgggattcagcccccacacccatcaccctgaggtgctgcggggcccacccagggttgcactgtggccactgtgtgcagcaagccaagacagacacaacagacagtatcatcggagagccattccttactgtggagaagagggcatgtaccccaggcctggagcggcacccctgcctcctggagcccactctggtcagctctctggtctgctcacagcatggctggcatcagtggcctttttttcataatagatggggtcttgctatgtggcccaggctggtctcaaacccctagcctcaagctgtcctcctgcctcggcctcccaaagtgctgggattacaggtgtgagccacctcgcctggtccaaaggcctcctcttaaataccatttccattctgctgctccctgctgagagcccatcagcggctccccattgcctaccaggaccagaatccacttggcagcactgaagaccctccctgaagactgagatataaaggcatcaaaaagagcttgagattttaagaaatgacagacctcagccttgcccttcacccaccagtggctcatacctaagcgctgcagactttacccgcacacctctagactctcttcctttctaaagatacggaaagaggataccaaacctctctggtaccagcccaactgtccctcctcacccctctgtccctgtcacacctgtccttttgtcaaactgcaggcagcctccagggccttggggcttcacccagggcacttgtctaccagccccacgaggtgcgtccagggctttcttgtcaccagttgggaaaagcaggccttttgcctctctctcctctcatcctgctcctgctgttcagccaggtttcctgcctggctcagggtcagagtaygggacaacagaggttgcttttcaggggtgagcaaggcagggtggtgtgggaagggatgtcatgaggtggcaggcgagatggctcagggagagctaccctgggcatagatgggtggggaccaggggtgtgatggatgtcaccccggcacctccccaggtgttcctgcatgaagccaccgtgcgcctgatggcaggagccagccccacccgcacccaccagctgctggaacacagcctgmggcggcgcaccacgcagagcaccaagcacggtgagtccacccctccccagctcacaggctgggccrggccctgcgccctaggaagagaggagaagaggggccagcccagctcccacatctggcattggtgcccagcacacctctcgcctctctgagaatgaaagaagcccgaggccgcccttggygggttgcaggggttggggtggtcatgggtcatgctgtgatcagggaaggagggttggggtggcgtcccagcacaggtgcaggcatagaagcagaagctcgagccaggtcatgtgggcccatctcagccccaccacgggctggccgtgagaggctggacaagttcacttcttttccgtggattgggtggggcagcagacyccacctcccaggatggatgtgagcgttcagtgaatgagtccaggtaacgccaaggaactgcaccaacttcatggtagattctcggttgtgacacacatctccttcccacaggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctcyccccctcagcatcttcccgctgagagtggtggggargagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgcyaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaattgtcctgttccttcccactccccgcctcctaggatgttagcccaagctcagggtaggcccagggggctgggagaaatgaagccacccatggggactggggaccaggggccttcagcatggcttctaggttccctcctccccctaccccatctcctacctccacagtacagactgtccccaacttaacagtggttcaacttaaaccatgtttcaactttacaattggtctgttggggtattaaatgaatttgtgacttaggatattttcatttatgatgggtttatcargaagtaaccccatggtaagttgaggcatatctgtatatatttaaacctaattaattcttgagctgaaaataaataaaccaggatggcagggaccaacccctaatccctccccagcggcaagcccctcttttcagagtgggcagagggttgcctatggtgggcactaggaatgaggtcccctgcctcgatgcgggtcctaggagaaaaagtcctacttttctgggtccccaggtgcagcacctcccrgagactgtttctcccatggcctcctgagtgatgggccctgcctccctgtgcctcatcctcaggctggttggagcagagggtgggcaggagccccagcacagactggggggtgctcacagcagggccaccttgatgcaggctggaatgttatccctggggtgtgcttggaccccacctgctttctttctctcctgcccctcccctactctcactgtaatttatggaccctgcccgcctgcgtgttgtgtgtatgtcctgtgccttttctcactattgtttgggtgtgggagggggtggtttttcactgaaaaggggggtacacctatagctttcttgatgttcaatcaatcagtcactgtgtcccagacatattcaataaacacagattggtaccacccagcacgaggtgtgtgagggtctgtagtgcgactgctgtggtgcccagccaaggggctgcgtgacttggcaggcaatgggccagggactgagggcagccccccaactgctgagagggcccctggcttcagtctaatgggcctcccttgtccaccttccttccggtgcctggcgcaccctccagcctgggataaaagggctgtgggtggcactttgggggtcagaggtcactgtatccaggttccagcttgttccctggatgtaatgcaggctggctgacagatttggggtgctgaccctctcccccactgggtaaactgctccttagtttctccctccctgaagtcagtgatcctctgagccaggaggctcactggcccacaagtcagatccaagtccaggtcctgtgcttcccagctgggtcacctggggtgggacctggcctcagtctccacttccacgtgtgcagaattgggaagctaagctcagccatgaactgcagctccaaaggcttgtctgccaggactgagtgatgggatgcaagtttacagcgagtgccttgtgtggctggtgaggccaggcttggcgtaagacacaccaggggacaggaccacagactgggatgggagtgctgggcctcgtcgcaagaggagtcaggatgtgactgagcatgtggctgaatccctcagctatgagccacatccttctctgaagggtagtcacagcaggctaccctgagaccagagcagcccggtgaggcccaattgcagctggtcccgtgcacagctccatcattttcagggatggccactgcccacagcctcagcctggctccactgggatggagatccagggcccttggaactgagaatgagcagggggaattgcccactcttggcacagcccagcagggggtgggaggtggggtgagaagcaaccagattcctttgtgagtctgtgtaggctccatgcctcagcccccaccctcctccagctctgcacagctgtgggacaggggcaggaccgtgggcccagagctctgtcctggtgcttctaggccttggtttccttaacagcctaaagggacagggaggtggaccctttgtggcaggagcggagaccgggcctggtgggttctggggcctcagggcagcccaaccagcagaaggaaagctccagactgtttatatataccctgggaacagggacccctccctaccaaccctcagaaccctccctcccagccaaactgcctgttgcttgccattccagccgattcacagcaattcgggagagtcctaacctgggagtctgctgggtgaccttgggcaagctacttaggtttcaaaacccaaatttcctcctctgtaaagacacacccacttgaggcgcttgtggatttcctgagaaaggccaacaaatggtggccattgttcttaaaacagtacaccacacttcaggtactcaggagggaaacagacccacctgggtggctttgctgaggtcacacacctcaaccagccacagccctggcccctagcctccccacatcacacacctcaaccagccacagccctggcccctagcctccccacatcacacacctcaaccagccacagccctgacccctagcctccccagtgttacctggcggagaggaactctgtggaagatgcacgcagactgctagcagtgctctggaccacagccaggtgcaggaagccctcccggagggacactgccagggaccctgctccagcttttcccccatttccttcagagaagctcctgggaggaggcgcccccatccggagcaccagatgtccacacggcccacacccattaaggggggtagcccggggccaatctggccaagcgacctgcaggccaggggctggcccacagccagtggtcagtgagcatcagccaggttcagccaactcaagctgcagagtggcggctggagggggctcaccttcagtacagggcatggaccccccactgggccttggacccaacagccctctctcctgtgcccgggcctttctatggctgaagtctaactgttccctctctcccagggctcccacgggggtgggcattaaccctgacattcaaccctggcccccctctccagccacttccccctggctctggccggtgcactggagcagtcctccaaccttgcactcgccgtgccctctgcctgcactgccatctgtacagtcagtgaccaatggtgcctcgcagccacgctggggcttctttattctcaggggcaggaaccacataaaagggcttatttacaagacgaacccgcggcctgcaggctccaagacaccactgccgttgaggcagacagaagagctggccttacggcaggcgctcctctccctgtggcctgaggctccgacgggcagacaggaccccagcccatgcctcgagggcaccgcggccccgcttcacacggtgacctcggtcttgctattggtccttaggtaccgggacccgcggcccgcgctgccgtaaaggccggggagctgcgggttgaaggtctcaggcatcttcacactgaactggcgccgggccgcgtgcccgggtcgccggggtacctggaaggcccgagccgtcgggtggctgagcggggcgggccgggccgggcgactggaggtccaggcggcataggggcccggcgcggcagggggcgcgtagaccggcggggcccaggggcaggcgtccagcggcgcaggcaagtccggggatggtcgcggagcccgcgccgggggttgccgcggggacggctcgagggcggggaaacgctgacagaagtcccgcggggcggcctctgcggggacagggcagggaagagtgacgccgcgccgagcacccaagctcaggactggacaaggggtcccggccggggactgggacggggaccgggccggggcgggccgggggcggggcccgctggggcgagggagccgattggccgagcggcgggcgcgcggaactgggaatttggcgcttggagctgcggccccgcgcttcgcagtccgggagctcgtgcgcccaggtgccctgacgctgcccgcacccgccactcacctgcggccttgagcgcggcggccttgaacgtggcgtacttggcgtagtctggctgcagcgtcaggctgccgccgccctgcagccgcgggccgcgcgggggccccggggcggccgacccccggggcgcgttgttgaggcgcttcttgtctggagcgaggagtgagacgcggctcggtccgatgccccggttcactccgccctcgctgtcacctctccgtagtcctctccccgaggccgttcggtgagaacctgggggaccgttctccgggcgaggctgcgagccaagcctgtcttcgccgcagcctccagcgcctggaacagggcctggctccgagtcacgcgcagcggcggcggcagccagcccggggggtgccaccctcatgaacggctcgcccggaggcgacgctcgagccaggcgcggagtcctgggacctgctcccgccgagacgggggatgtctgaggaacagaacccagacggggcgtgggggctgccaagcctgcctgcctctcgagagacccagggggaggctctggagcccgagcctcagatcacagccccggccagcaaatcctgcatctggaaccttcctcacacatcacagccccccagactcgaggccgcaggacccgtggggggtccctttccaccctggcgagctggctggccggtcgggcccctcacccgcagaggccgcggctcatttccaccggggaagcctctatgccccagccgagggaccgcctctcggcctctcacgcccctccgcgtgctccgccgccgctcagccccgcccgccaccgactcacctgcgctgttgtggggggagccccgggggaggccgtcccccatctgcacctggacacagccacccaggggtgggcccagggtgggaggcagtggctcctgggggcccggctgcttcagaagctctgtcagcgccctgcggggacagcagtcaggggtggccctctgtctcccacctcatcaaaagccagccccggccaccaccgtctcaccgtgtggccctgggcagttctttcggcctctccaggccgtcctctccggtgctcgaaatcacgcacgagtttcccctcccaggcagtatctgccagcctcacctgtggccccaagacagctgcttcccagagcaggtcaggaaactctaatgaggctccccttccctcccctcccctccctggagcccactctcagggaccttccccaggtgagcctcccctcccaatgcgagctttctctgctttcctgcctcttctcccaaaaaactgctactcattcttcagaccccatcagcggcctcctccaggaatccttttttttaatttttttatcttttgaagcagagtctcgctctgttgtccaggctggagtgcaatggcrcaatcttggctcactgcaacctccacctccccggttcaagtgattctccagcctcagcttccctagtagctgggattataaggtgcctgccaccacacctagctaatttttgtatttttagtagagacggggtttcaccatgttggccaggctggtctccaactccgccggtctcggcctcccaaagtgctgagatgacaggtgtgagccaccgcgcccggcccaggatgccttatttacctgcctgcctaactgcccctgcagccgcggcttctgctgggacctgggataaagctgccatcacgggcatgaaggacagatgggtgacggaatggggatgttgggagaccccctggtggcagcccaggacccacaggctgtgtgaccttggacagccacctccttggacccaacacccagcccccacccagctgtgatgtgacagtgtctgcagcccagctgccttcagaacccggaacccatgattttctcccactcagcctgaccctccttccggggctagagcctcaaatggctgattcgtgaaggtcattcaggaggcaggacaccagggatggccgaggtttggcttcaggtttggtggcagggtctgaaaccatcctagtacctgcctgggctgaccttcctgccctgccctctccccagaggctcacctctgtggcctcatctctgggcaagcacctcaagctcctgtctccctgacagctgagtaaccaccacgcctctgggcctttgcacaaactctttccagatgccccgcccaagccctctgagaagccttccctggccttcaaccccaacacagcagaatgaagggtgagactcgaggggaggacagggactcaggacacacccacacacaagcctacgtcccattccaggtctccccagcagagaaaagggagttggggccatgggagcctgaagcccagaaaggagaagggactggcctacaccacacagcacagcaagggtgggcatggctttcctgcggcatcaccaaacctgctgccccatccccagcaggtgcagggagttcaggatgaacatgtcagctgggctgctgcagccacccctcaccatcgcagccctaagttcctttttccccgcccctgtcaaagacatatccaggcctcttccaagctaccctcacccatcatgggggacccccaaatttgggcagcccagcccctacccctgcagcatccagaagccaggccaggaggctccacctcctgaaggcagtgcagaagctgagggtggaggccagggtgccagcccgggcttcccttagagctccctgggagaaagtgggctacgtggtttcgggagcgaggggtgctgaagtgccaaggaagccctcaccccctgcctctgaggcccaggagggggaagtgtccacatctggcctgccagggtatgaaggcttctctatggtcacttttaaataccagcctgtcacattcggtgtcagcagcccac

SEQ ID NO: 17804 - DNA, 67088 bp, Homo sapiens
  misc_feature (1)...(67088): n = A,T,C or G, or insertion/deletion polymorphism (see Tables 1-2)
tacataaagtaggtgttaaagcacaaactaaccagactgcctgggtttaaattctggctctgccacttattaagtgtgtgaccttgagaaggttgcttagtcaatttgtgcttcaattctctaagaagggatggtaatcctttctacctctgaagaattattgttaagtatatctctcatggagtaagtgctaaataagaattggttataattatgtgttggtctcccccatgagattgtgagcaactttaaggcgaggactttggctttttcatttctctggaatattaagtattcagtaagtgttactgaatgaataactggtgagacagctctatgatgatgggagggattacccagtttccttctttgagcagatcctacacttttttttttttttttaattgagacggagtctcgctctgtcacccaggctggagtgcagtggcacaatctcggctcactgcaagctccgcctcccaggttcacgccattctcctgcctcagcctccagagtagctgggactacaggcgcccaccaccacgcccggccaattttttttttttgtatttttagtagagacggggtttcaccatgttagccaggatggtctcaatctcctgacctcgtgatccgcctgccttggcctcccaaagtgctgggattacaagcgtgagccaccacacacccggccagatcctacacattttaaaaaaaattgtattgtttccaattttgtggctccagttttgtttaattcaaaccaaaatcctgaaaacatcacaatcatataattgaaattcaacaaaatgaaaccaattttaaaaaatcataaaatgcatgttcattctaagaaacttaactccatttttaagctttaagattcccccgatcccaaataacctaacacaccaaaagccttgccatttcacacatgctgttcctttgcttagaaccttttcaatgtctagctcactctgtttgggacttcttttttcttttcttttttttgagacagggtctggctctgtcatccaggctggagtgcaatggggcaatttcggctcactgcaacctccgcccttccaggctcaagcgttcctcccacctcagtctctcgaatagctgggactacaggcatgcggcaccacgcccagctaacttttgtattgtttgtagagacagggtttcgccatgttggccaggctggtctcaaactcctgagatcaaacaatccgcctgcctaggcctcccaaggtgctgggattacaggtgagagacattgtgcctggcctctttgggaagttttttctgatcttagggtgaggcagatgcctcttctgtgctgccaaaacagcctatacatacaacaatatggtaccaataatgcatcatcccaactgtgatgctctgttaccacacttaaggcagatattgcaattatttggctcccctgctttactgcaagctccttgacatcagggcagtatctcagtcattactgaatgtctgacatttagttgatacttgatgagtttttgaatgaataaatgtttaaacaggtaagttttattttgcttatcaattttttgtttatttcaatcatggcaacttttatatagtggttggaaattaaaattaaaattaaaatttaaagcattttcccatacattatacaactgatctcacaaccaccctgagataggtatttttattatcctcattttgcaaatgaagaaacaggttcagtggctgacttccccaaaactgcttatcttgtaagtagaagctgagactcttgattcaaagccctaagtttcagtttgtgtaaaccagacaacactcttctgaatatgactattagctgaagtgcccctttggaacattctaagcctcctagagtcacctttttcatgaatctaaaagctctcatcattctcttactgctccatcttgcaggaagaatgtccagtcccttccctaaatccccttccatctgctaactccccactgtccaccagagcatgcctcttctaatacttcagattcaaagtggggatggaactcatctctaaaaacgactgcatgcatctcatatagacaaaagaaaatctggttaattctttaatcttcaaattttattttgaaaactattttaaattcaaagacagagtagtataaaaaccacccacgtccccaacactctcaaataaccaatgttgtaattaactttctatgtactattttggggctctgtttttagatcatcatcaacttcttcacagttcattcttcttaaatacacatggctaaggagtgagaccctgccgcttcctccccagtatcagtctcttccatgccacatctgaaaacagcggtcattgacccttctttcgtccaatttcctttccatatgttcagcatgcaatctttggtgctgatcaagaggaaccccatcccatatcagcacagggatatattggcagtggtcttcatggcaagtatacccactccttcctaattataaattatgaaactctctataaaggtgagggtttgcttttgttttcatgtgtttggctgctgtaaatcaatccatcagaggctgggcaacaacattaacatgaacaaagtatgaaaaatagcccaccatgatacagtaagtatttaataaggacaaacctaaaatagcagcccagttaatcaaataattttaaatcagcccaatgcaaaacactcccctttcctctacctggcaattcttaccaacctgagtaatgtgaacagagaacatgagtccatgaatcaccayaggccatccccaggcagagtgaggcacacacagctgtgatcaaatgttgccttctctcgttttaaacaaggaattaactgtacanggtgattatctctggggagtgggagtcaaaatgactttcatttttgtattttatgtacttcaatacaggctgaatttttcaaagagcatggattttataataaaaaacatttccattttgagaaaaaatagacacgagtaacccttaatttggttcacataagaatatgagaaaaaataatttcaccattttagcatgagatactagcacagaagaaaatgtcaggagaaaacattctatagagaccaaagtgacctctcaagaagatgtttctcaaatatacctcattttttttgggaagacaacagattgcagcttattaacaaaaatctatggaaatttttctgtatttctataccaaatagtttcctctcctttgcaccaaaggcttagtgcttttcctggctagagggcaagtctgaaagcaggtacttcttttctcctgcacattagaaagggaaatgatgctacaaagaaaacgagatactcttaaaaaggtcgatgaactatatcttccccagagcctggcaaaagaggagaatgaggaagcagtacaaaaatttagaagtgttaaactgaaatcaaagcacaaggtcaagagcaagtggctgtgactgtgctcatgccctgctaaggccctggttaaatatggtttctcttttctctgacaatgatacaccagtcccttccccacaaaaaccccaaaaaagtaggccatcgtattaggagtgggaagaatagaaaggcttcaggaaagactgttcaacctgagttattcaataccatgaaaatgtggtattaatggagaaagcctgcttgctcataaaacgaatgtaagaggttaactgaagactctactgtagacgttatgtttattaacctttggaaaagcatttcacctctactatgcttcagtttcctgtttttgttgttgttgttgtttgtttttttgagacagagtctcgctcttgttgcccaggctggagtgcagtggcgccatttcggctcactgcaacctccgcctcccaggttcaagcgattctcctgcctcagcctcctgagtagctgggattacaggcgcccgccaccacgccaggctaatttttgtacttttagtagagatggggtttcgccatgttggccaggctggtctcgaactcctgacctcgggtgatccacccgcctcggcctcccaaagtgttgggattacaggcgtgagccactgcgcccggcccagtttcctgtttctttaagaggaggaaccccctttctagctcccaaagtcatccagttattattgagactttattagatatccagcaagtgattcaaaagcaaagttttgaggttctgagcaaatgttggccagccatcattcaagcctcatctttttgtactcaattttccccgtttctccacatcatatctatctgcactgacaaaatttcatagaatctaatttctccgtttcaaagaaggctgtgattgctctgtaaattatgagacctgcatccttcaccaaatctgcttcagagacattgatcctacgttgcctcaaaaagcctcggaccactccttgggttcgagtgtcaaagggaacactatttcttgtactgatacataccgtatggaaatacactaacaccaatgaagaatctgcgtgcactgccacactgaaattcgacttaagaacgttatcacacacaaatgtcctatccccagaaaacgtcaaggattttcatcaacctcttcctgattcgcccaatttagaaaatgtcatgtcaacccttcagatcatgtacacgcgttgcttaggtagaaagggagactgggtggggtggctgagctcagaccctgcctacatactttagtagtaacgactcccgatctgcatccaacacatttaccgaacttctagtaagcgcccaccgctgcaagcgaaagcactcccttcccaagaaacagatcttttccacttaaaattcccaaactcagaccttccactttttactgaacaaaaagcgtgtgtgccggcgagagggggtgggaaacagcgtaacaagaatttgcacggatcttacgcctcctccctcggagcgcgcccaagtctgcagcctcgggctccgggacacttcccctcccacccgccgccgagccgcagctgtaagttgagagaagcgggctctaggcacgtcaatcaaccgggttctcccgcctcccgtctacacctcccctcccccctcgaaaaaaataaaggcagagaaagaaagaaaagaaggtaactaatttgggaactagtctccgtaggggcttcgcctccgactcagggaggccgcacgcccgggacctgacgcgccggcaacaagcaggcggcctggcagccgcccgtcaccgggtcctcgcagcgcgtccgccgcgctccggctccccgcacggatcggcgcccctccggccccgcastccgccaggcccgcggcccgtcgccctccggcctgggccaaagttgcgcaaatagccccacaactggcaaatacttaccggccgcaacaggaaccagagctgcggagattttagggagtttaaggcaaatcagccgcgggaaaggcgggcgaaggcgaaggggccgcgagctgcagtggcggcggcgcgcggcgctcggcgctcgggctgggctgcgcggagaggctctggctctgccagggactgtgctgcaacaaaggacttccgctgccgcacagccgcgcctgccgcaccgcactgagccggccccgcttacgcggcgactccgggtctgcccaccagttcgctgcggcgtccgccagccttcccctccctctcgcccgcccacccactctgccgctggctgctaggggcacccgcggtcgcctgtttgttgcaacaagtttctgcgtcgagctccgaggaggctggcgcaacccgcaccgcgggggccgtcgcggcggcggcggcttgaccacccctcttgcccctctcaagggtaggcttgggacctcctcctcctcctgtttgcacagctggatggaactgggctcctcccgactccccagggcaggatgcgaggctgctttcccactccgtccagatgtcagacccctgcccgttgggcccagcagctgggccgtcactcgcggtccgcctcgagtgctccggcaacctcgccctgccccgtcggttcagggtcgcccagtccccgcgcccccccgaccccaccttccgtgggcctgctgcctctggccctgagtcacttcccccgccatgccccacctcgcccagtccgcctctccacccaggctcccgcggctcggcctccctggccccgcgccctcatcccttccccagcgaacacgcgggcgcatccttccccacccccaccttcaccccagaactgagggggtgcctgtgcttttgcacaccctggggaaagtccccgggtcacgcggttgtttgtggggagcctgtgacgctcaggcttgtccctatgcttccgcctacagagtcacaactgckaactgtggcggcrgcactcagagcgcgggccgacccccgcccggccactgaggcgggcgggcgggagggcgcgcacgtacgcacgcacgcacgcacgcacaccccggccctggcgcccctctttcccctgctaccagacacgcggtcacgtggggccatcgcgggctgccggcgcgggaagccgcgcgagaggcggccgaggggtgcgtgagccggcgccactgcttgcagtgcgcggcttgggagcccgcccctcctgcacggaggagtcggcctgccgccgcggcggcatctgggtaagcgacgcggtcctgcccctgtgggctgccccgggctcagtccctcctgccgcgagccacccagggcggcggcctgcagctgcaccagtcgcgggacagatgcaagtagctggggagaggggtgtttttggtccgattgagatgtcaggcagggcacaggaggaaaatacatccgcgagtgagcgctgggccgacaatacccagaaccaccctttgctgctcgtaggagcggctgccggggcctgattcagggtggcacacggggtgccgcgaaggtgcagagccgtcccggccgcgggtccgggtgcgacccccagcaggaaaccccagtaggcctgcggcctccctcgggtagcgccgacccctcttacgagcgggcgactttccagatgctgggaggacgctgcggctactgtttccactcccagcttgtgattacctcgtttctagggcaagaagacatcccccccttttctatcttcaaattatgtttatcttgttctaagcatatccggtttttctttttgaagcttgacccatcttatcaccgtcttctctggcactcagtatttggagtaatcagttgttaccagttgcggaggcagcgcatagcacaacgtagtacctggaacctgacggcacctagcatgtttcaacagttagcgcccgcatcaccccaagggattaaatttggcattctttctcttgagactcaagtcctggcagagctgttgatcctctcacaagattctgtcatgtatgtaaagtacactttggaatcttaaattttagagccgagaggtgccttatagaaaatctgtttcatccctctcgttttacagagaagacaccaggcctgaagagcgtgatgtagctggagctagctacacctcttgatagctaagactccaaggctccagacaccttggtgattgcactctccaccatgccaggaccgcagtgccagtttaccccactcacctgtagagaatgtatccggcggaggtcattatatatacttggcttgattcagkttatggagaagtcaggcatggccactgtgtgggtttgatggtatttctaggtgaggtaggccgcctatggtgtatttttggaactaaaagcctacaccccccagccacccctgaaartttcattgctgttctctattatttgcagcattggttgcttccttatgttaaggcatcaaagtcttctttaacaatctggatatattttagttaagggtaaatcgtgaatccgttatcggacatcaactccttaatagggaacagaacactgatgggatatgacatggaacagattaattctgagagctggcagtcagtgaaatatcaaggtgtggtcaggaagaaaacagaaaggaacccacgtaacctgctaacaccttttttgtccagtcctaccttgaatgtcttatttgcatgtagtagagatggattctgctcaagttggccgctgtttactgagtacttgcagtgggccaagtatcatactagctgctttcgtagatgaactttgtgtctttaccaaaaaggagatggtactgtcttcatgttacaagcctgaggaaacaggctcattacctgggctgtggtaatacagtcattcgcagtagaatttaagcctagatcgcttatctctcaagtccaatcagtgctgttttgcattatatcttgctcctgtttcagccgggaagggaatgagagaatcgcctgtggctgatttattggcgcctgtggttgcccagagaggccaagcaggactttcagctgccctctatgccttacaaagtggagctgtgagcttccaccctatctcctgaggggaatgtgaaggagccaggctgtctagctggggaggaggtgccttggccgtaaaatatcctggccagggctgtgctgggaagtgttgcataatgtcctccccaccactgaaccaaagtgatttatttgctatggtccgtaggtggtgcctgaccaacttgtccattttagcaataacagggccagaaaagagttgggggttttatattattgcagggtttttccttgttttaaaaaagcagtgcaggtgctcttatcttgataagttataaagtgcttctttctgcaccacttcctgtgccccttttctgtgtatttattccaaatagcatgtgaacttcagtcttttaagaagagaaagctaagaaaatattgctccagtttattagcacaggctatggagacagacctggctttttatctccactttataccatttgctgattgtgtgtcctaagcttaggatttttcctcatttgtaaaatggaaatgaaaataatacattagtcatcacagtgacgattttaagagatagtgtatatagagcacttagcacaaggcctcgcatatagtatttattataataataggttttgaaaataaccagaatagtattctccctaaaaaggaaagatattgctacttgaacctgcttagggatagaggaggaagaagaaagtgtttgtaacaaacatcagtttcaggattattgattaaatttttttatacttctggggttttttttgtttgtttgttttttgagacagagtctacctctgtcacccaggctggagtgcagtggtgtaatttcagctcactgcagcctccgcctcctgcattcaagcgattctctggcttcagcctcccgagtagctgggattacaggcgcctgccaccacacctggctaatttttgtatttttagtagagacagggtttcgccatgttggccaggcgggtcttgaactcctgacctcaagtgatccgcccaccttggcctcccaaagtgctgggattataggtgtgagccactgygcctggtccatgttttctttatccatttgactatccatggacatttgagtttttcccccttattggcaattcttctgcctcagcctcccaagtagctgggattacagacgtctgccaccacgcccaactaatttttgtatttttagtagagacrgtttcaccatattggccaggctggtcttgaactctgacctcaggtgatccaccctcctcggcctcctaaagtgctgggattataggcatttatttaccgttctgctttccctttgctagcaggaattttctttctctctctctctctctttttttttttttttttttttkygctttattgggagaaaaagtgcttagagtgttcagttattttttatatttttctaattcatttcttctctggttacaaatcagtcatgcatggatgttttattttttctgaaatctccaagcactttaagcaaaggtttttattagcccacttgagtagtgtgttcatgggagtatacttccattgcgaaagaagtattggtttacttgtatccagaagttttagttactcttgcctgtactgtattctaggtctgtactagcattataattttccatctttctcctgtcctttgagtaccttattttttcttttagaaatttggtttgtctttaatggactgagaggaatcttttcctttctttctccgggttctgattttttttaaaggtctattaacaatttgtgcttactgttgttagtattcttgtgtgcttggctttatcaggcatcctacaatgtaatgttggttagatgggaattagaggtgcttggaggttggctatgtctgccaacaggcaggaggccccaaactaacgtttcccagttccattaaaggtttctagagcataactactcttcctgtttcatctaccccctccataccctctttgctaacattctcagtagatcttaataagcagatgtctggaattacagcagattttacctcaaacagtattttcagatttagaatttctgtatcatttttaggtgttatgaaatccaatctaggtgtaatggagtaagagagtaaatatttctttttcctaaatactatttgaaaagaagtctgaaaatagtgtgttcctccacccccccacccatgcccatcctgccagtttaggagcacttttgattcttttttttctttttctttttttttttgagatggagtttcactcttgttgcccagactggagtgcaatgacacaatctcagctcaccacaacctctgcctcctgggttcaagcgattctcccgcctcagcctcccgagtagccgggattataggtatgtgccaccacacctggctaattttgtatttttagtaragacggggtttcttcatgttggtcaggctggtctcgaactcccgacctcaggtaatccacctgcctcggcctcccaaagtgctgggagcgagccaccatgcctggccatggagcacttttgtttcttaatctggccaatattttaaggttacaattagaattacagttgtttatatttgttcatttaatgtagtcaacataatttccatactttgaacactcttacggaattgtttatttatagagactagtataaagttgttctatcttacttagtttgaactaatccagagttatacaatctagaaagtaaagaaagtttttattgtctcttaaatatcaatgtaattgtagagtgtgaaataatttcttgggtttccttggtcccgtgttcttctgaggcagtggttcttaactgagcagtcacgttagaatcacctgggaagctttttaaaaaaagaatctgggctgggcgcggtggctcacgcctgtaatcacagcactttgggaggccgaggcgggtggatcatgaggtcaggaaatcgagaccatcctggctaacacagtgaaaccccgtctcgactaaaaatacaaaaaaattagctgggtgtggtggtgggcgcctgtagtcccagctactcgggaggctgaggcaggagaatggcgcgaacccgggaggcggagcttgcagtgagccgagatcgtgccactgcactccagcctgggcaacagagtgagactctgtctcaaaaaaataaaaataaaaataaataaacaaataaacaatctggccgggaacagtggcctacgcctgtaatcccagcactttgggaggccaaggcaggcggatcgcctgaggtcaggagttcaagaccagcctggccaacgtggcgaaaccccatctctactaaaaatataaaaattagccaggcgtgatgggcacctgtaatcccagctactcaggaggctgagtccgggagaagcacttgaacccaggaggcggaggttgcattgagccgagatcgcgccattgcactccagcctgcagcctgggcgacagagcgagactctgtctcaaaaaaaaaaaaaaaagaatctgtgcctcacccctagcaattcaattctgtttgggctaagcctgggttgggactcagacatcaatacagctctgcatagaaggttttacagtatagtcagcaataagaacctctgtttcaggataaaatgatttctacaaacattgtttcattctctacataattaaatgtcacacctctacagtcatgtgaaagttccattaaaaagttagtcgctatataaagtcttttatcatatggcacttgaaatattttgcttttgcctttgtatttatagccatgagtaagtagctcaaaaaagatgtacatattcctctgccaactttcctgtctccttgtctgaatgaaaattcatcataaagtctcagtggtaagcattgacagagaaaatacctaagactgttttcctacagaaacagtcgtcttgctctttttgttccttttttattaaggattcttacagcctgagagaatgaagagctgtgtagtccaggatatccggctggctaccatagatctgagagtccagtctagtacagtagatttttctaaatacataagaatcaaagatatgtattgaatatcaagccagctttaaacaaacatagatactagtataaagttgttccatcttaatttgaagtaatccagagttactacaatctagaaggtaaagaaggtttttgtaatctcttaaatatcaatgctaaaactattatgataatgtatcactttgataacagataaaacttttaaaaatgtagcactcatattttgattctggtatttataagtataataaaatactttatttttccataatttctctcacatcttaaaattctcaccagaaattctcaaatgtaacttctaagctctttctgtattcatgggaaactttagctatttcacatactagagaaaataaaatagacagtcaaagaatgatgagcaaaggctatacaaaaagtctagctaataatttgcagagtaggttgtattagaaaatgttctaataactcaatggaatggggctattgatttgaagtaaaatctggtatattacaacatcaaagatctcctattatgcaaaacaagtttgaatgcacctcatgtgtacttggtgttttttttttaatagattttaatttgtttcattttatacacttgaaaagtttactcccttatttgattcaacatatttgcaaaatctgccaacagtgtaaatgttgaaagttctagatggggttttgaagaaagggccctgggtttaaactcagtcttgatgtattatcagcaccatttaatagctagttgtttgacttcaggtatgtttcctgccttctctgagcctgtggtttctcagccataaaatagagctgatagtacctgctctactacctcacaagatttaaaagaaaaaaagatagtgtagggcagtggttctcaaagtgtagtccaaggagccactggaggtttcatgggtcaataaggatctcccttatgtaagaacagattctcaatatacttgaaccaaaacaagagatgacaacagattgaatgcagaatcagataagagagtccagctgtatctgttaaagccagatattaaagaggattgcaaaatgtaaattaatatcacccttctcacttgtttttgaaaaattttttaggaaaaaatatgttaatatgtaatgggtttattgctattttaaatattttaaaatttcttttaattttgaatatagtaaatattgataaatataacctatataaacaacagctcttcacaatctctaatactttttttttgagatggagtctcgctctgtagcccaggctggaatgcagtggtgtgatctcggctcactgcaacctcttcctcccaggtcccrgttcaaacagttctcctgcctcagcctcccgagtagctgggattacaggcacacgccactgtgcccagcttttttttttgtatttttagtagagacggggtttcaccatgttggccaggctggtcttgaactcctgaccttgtgatccgcctgccttggcctcccaaagtgctgggattacaggcgtgagccaccgtgactggtctgtaatactttttagagtgtgagtggatcttgagaccacagctttttagaactgctgataaacagtaatggttgagtagggctgctctgcctatggagtagccattcttttatttattttctaataaattgctttcgtttaaaaagaacacaatgttgggggagggggtaatggttgaatagttcctatcaggacagtttcctgcagataactataaacttgatacactttttttttttttccttttgagatggagtttcgctcttgttgcccaggttggagtgcagtagcgtgatctcagcttaccgcaacctctgcctcccaggttcaagcagttcacctgcctcagcctccagagtagctgggattacaggcatgtgccaccacacccgctaattttgtatttttagtagagatggggtttctccatgttggccaggctggtctcgaactcccgacctcaggtgatctgcccgcctctgcctcccaaagttctgggattacaggcatgagccactacgcccagctgataaaagttttaaaaattaatagatggcatttgagaattacaaaaactagattgaggtctgcaactggaagaggagaacagcaatgaataagcttctgtttttatggcttttagactggcataaggtcccagctggtgatatgaagaggtggctacaactgtaataacaacctgtaatctctcttgaagaaaagaggacagagctcacagtgatcatgcagctggaaagtgcaggagaaaatcctagaaagaatgttggagtggcagaaccccaaacactgtttataaactctgcttgaatttcttgcaaacccctcaactgtacatgtgtggagcagcctccaaacagcacacttaaggctaaaggagcagagatttcagctgctgtccaccataggggaggcagaacttggagtttaagtccagctaaggtaattgtctgcaaaaaacaaaaacacaaacactctttggaagaatattacagaatctagagtgaattgtattaatcacaatacctagactataatccagaaacaatcaccctaatcagtggagactgaccccataattagccaaaggttggatttagcagagaagatttaaagcagcagctattataactatgctcaaggatgtaaagcaaaatgttgtatatgtgaacaaataggaaatctcagcagagaattagaaactttaaaaaagaatgaaatgaaaattttacatctgaaaatacaatatctgaaacaatcttgaatagatttaacagatcagatatgacagataagtcatttaatttgaggatagattaatagaaattatctaatctgaagtagagaaataagttattgtatatgaaagttctctgtaaacttcagtgctctatgtaagtttcagagtttattactccaggttkctttcatatgtaaagggaagaggtatgtttgggtcttctgatctgcagcttccttaatgtcctgtcctgtcatgtctgtgtctaagctttataccctctggtttctttatttttatttttttatttttttttgagacagagtctcgctctgttgcccaggctggagtgcagtggatctcagctcactgcaacctctgcctcctgggttcaagtgattcttctgcctcaacctcccaagtagctgggattacaggcatgtgctaccacacctggctaatttttgtattttgagtagagacggggtctcaccatgttgttcaggttggtctcaaactcctggcctcaagtggtccactcaccttgtcctcccaaagggctgggattacaggcgtgggccactgcgcttggcctagcctctggtttctaatatcccctgcagtcagatatttggcccttgctgctttcctgtactattgtcagaggttaccaggaatcttttggtcagtacactcgacatgtttgtaatgggcctcacccccatgtttctcttcagtgttttgcaccattgccatctcctttctgcaaggtcattgcctttcctcaatgacgatgttttcttttttctcctcctctgtcttattttgtcttttctgttttccaaagattcattcttagcttttttccctcttatttcattctactttttagtctrctttattattttcatacttggttacttcagccttgtcgtttcagaggcctcttctccctctctggctctgctctctctagagccctgtcctgcttcttgtccccgctgatcactaaacatttctacttagatacctggtagacacttggagctcagagtgtctgaagtgaaacccctattcttcttcttcttttttttttttttgaggkggggtctcagaacctcttatcaagacggtttctgtacttcttctctaatgttctgggactctgcctttatatcaacacctagcacatggcagttactctgaaaatgtaatctgaaggaatggatgaattcttccaattacccaagctggaattctgagactcacctttgatttgatctctgtggtgacaagtcatgtcagttttgtgtctgatgtatctcttgtattccttccttcattcccactgcgattactttgataccatagtaggctcctagccagtctttctccatgccttttcccttgctaatattttttatatgttgctgttagagcagtctttactcacgcctaatgatggtgatgatgataatgcctagtatttattaggcactaactgtgggcccactgtttctaagtgcattatatcattaaattcaaataacctataagttagatactgtcattgtccatattttataagtgaaatggaggcccagagagttaagtgtcttgccaagaccacgcagctagtaaatggcagagctaaaattttaagctgtctgattttagttcaagctttaactaccacgctctgttctccctcccacagagtaagttaactgatcatgctgttcttactcaaacatcttacatagttcacttcaaacacgacactactttttagtcttatattctgtatsctttttgarctgaccacatttcattatttctgttactttttttttctatgccaagctgaatccttctgttatctaactattcatattcttcccagtaattttattcattttattttttctgcctggccttgtttcccatcaagttgcctgtgtttatctccctctgatagcatgttctctaactgctctgtgctactgaatgcatttatttcatattataattatggtttgatgttttatctttcctgtgagcctgtaatcttgagtgtagcatcttgtcatttttttctgtctccacgccttgtacaatgcaggcttttacacattttttctttattaaattgctcttcaaaaatatctgttgaataagtgaagaatttaactgttaccaacagaccattaaccataagattcctgtatgggtggcttattagtgtgctatgtctcatttccctatggttcagtagttcaatataatgggaagaactggtgaaaatgtttatgatccgagggtttggttttgttttttttttttgagacaayttatcaggctagtttaagatgcttcaatatgaaccatttcattgattctaagacacgtttttcacatgctgaaattgtcaatacagatttttagtttgttaggccgggcacggtggctcatgcctttaggaggctgaggtgggcagatcacctgaggtcaggagtttgagaccagcctggccaacatggtgaactcccgtctctactaaaaatacaaaaattagctgggcatggtggcgggcacctgtaatgccagctacttgggaggctgaggcaggagaatcgcttaaacccaggaggcggaggttgcagtaagccgagatggagccgttgcactccagcctggtcaacaagagcaaaactccgtctcaaataataataataataataataatwtaacttggggattattccacatcagtacattaaatatgtagttttaatagagtctgccttttttttttttttttttttttgagatagggtcttgctctgtcacccagggtgaagtgcagtggcatgatcatggcttactgtagcctcaatcttcctggctaaagctatcctcctgtcacatccacccaagtagctgggactaaagcatgcaccaccgtgcctggctaatttttgacacataggaagcactataaaatgttagctatatttattatattactgatcacttagctgtctgctgcccaagccactgccaatctttagacggctaaccctgcattacatcactgacctccttagaccttggtctggctggctggtgtggaaacctcattctctttttcagtgtctgctctttcaaaggatgttctcctggccacccaatgatgccctttatactacagctaccttctgcctaaagtaccagggctctctccacagtagggtagagaagatgatgtacagtctgccacctgcctgaaaccagggcacttctgaatgtttttgctgcttatactcggcttcttggccagaattctgcatgttcttcctcatataggcttccccgcagttgttccaccttgccttttacttcctttgggaacctacattataatatgcgtctgaatccagttgagatcagttctttcttttgtgtgtgtgtgtgtgtttttgagacagagtctcactgttgcccaggctggagtgcagtggtgtgatcacagctcactgcagccttgacctcccagkcttaagtgatcctcctgcctcagcccctcaagtagttgggagtacaggtgcatgccaccatacctagctaattgttttattttttgtggagatgacgtttcactatattgctcaggttggtctccaatacctgggctcaagcaaccctcctgcctcatcctcccaaggtgctgggattacaggcatgagccactgcgccagcttaagttctttctcaggaggctcttgggccacaagtaaattggggatgtggcttgacatctattttaagagttcctgagctactgtgatgataagtcccccaaacatttgatgagagttgggaagccagtatcccctgagcaccagwggatccctgaggaggagtgacatctctagctcagccaggataccgtgttatgttattaacatttatagctaacatcgaatagcagtttccattacaacatgattttcacataagttatttaactctgaggcaggaatcagtatctcattttcatttttctaatgaggaaacaagattagaaacattgtgttcacatagatggaaaaggacaggtctgtcttcatgtgtcactcataccaagctatcttcttaccagatgaaaaagggtcatattttatggttcagcagagtttatatcagttgtcataatggaggaatttagtgttagccgtgtttgcagtgaaagtaataggattgaaaacttgaataatttcatttaaatttagatctccttgttactctgtaggtttgtgtgaactgtagacaattttgtattaataaaaaataatgcgtatatacatacwcacctatctacatttatcttgtcctttttttcagaaccacaatggacactgccagccatagccttgttcttctccagcagctgaacatgcagcgagaatttggttttctgtgtgattgcacagttgcaattggagatgtttacttcaaagcccacagagcagtgcttgctgctttttctaactatttcaagatgatatttattcaccaaacaaggtaaggatgtgtttttgtaaataagaatttttaatattgtgatttatataagctttattatagtatcattttggaaattctttgttacggagtcacactaagaagtaaaattataattttttttttttttttttttttttttttttttttggcgacagagtcttgctctgtcacccaggctggagtgcaatggttcagtgtcggctcactgcaacctctgcctcccaggtacaagcgattctcctgcctcagcctcccgagtacctgggattacaggcgcctgccaccacgcccggttaatttttgtatttttagtagaggcagggtttcaccatgttggccaggctgatctcaaactcctgacctcaggtgatccgcctgcctcagcctcccaaagtgctgggattacaggcatgagccaccatgcctggccaaattataataattttttatacattagtaattaaactcagtgtgtaggatccataatggaaaataagaatgaaaataagaatagctaaaattggctgggcgccatggctcacgcctgtaatcccagcactttgggaggccaaggtgggcggatcacaaggtcaggagttcgagaccagcctggccaatatggtgaaaccccgtctctactaaaaatacaaaaattagccaggcatggtggtgggcgcctgtagtcccagctactcgggaggctgagggaggagaattgcgtgtacctatgaggtgaaggttgcagtgagccgagatcgcgccactgcattccagcctgggtgacagagcgagactctgtctcaaaaaaaaaaaaagaaaaaggaaagaatagctaaaatttattgaaggcttatcccatacccaagcactaagtatttgccctataatgtaaattctactgctgtccctatttcaggaaaaagaaaactgagactgagttaagtaacatgcccatgcaggattatacagctaataagttagatgcagatttgtctgaagctatgtctatgcttttagtcactaagctgttaatttttgtttcatataacacttttgttttttttattttttatttttattttttttgagacggagtctagctctgtcacccaggctggagtgcagtggtgcccaggctgaagtgcagtggcatgatctcagctcactgcaacctccgcctcccaggttcaagcaattctcttgcttcagtctccctagtagctaggaccacaggtgtgcgccaccacacccggctaattttttgtaattttagtagagacagggtttcaccatgttggttaggctcctcttgaactcctgacctcagatgatccacctgcctcggcctcccaaagtgctggaattacaggcgtgagccaccgcaccctgctgatttcaataggttctttcagaagttttaagatatctttattgtggctataaacatataaaatttgccattttaaccatttttaattatacaatgcagtggtgataatcacattcgcaatgttgtacaaccattaccactgtctatttccaaaacttttttatcaccccaaacagaaactttgtacccattaagcaataactccccatctcaccctctcaacccccagaaaccgctaatttactttctatctctatgaatttgcctattctagatattttatataatacttgtccttttgtgtctggcttattttacttagcatgatattttctgggttctccatgttgtagcatgtatcagaacttccttctttttatggttgaataatattccattgtgtgtgtaagccatcttgtgtttatccactcatcttttggtgaacactcagcttctttctaccttttggctactgtaagtaatgttgcagtgaacattggcatacaggtatctgtttgagtccctgtttttagttcttttgatcgtttacttgatagactgttaaattccttaagagcaggtacctattttattcatcagttttctaccgctggcatctagtatagtgcatatcacttaggagtcacttgattaatgttgaactattcagaatgtatgtctgtgtttcctaactttaggcagtagattgaatacatgaagactttttgctaggccataaagttggtataaaatgaaagtttaagcctttgttgccatgttttattaaggcagattgctaggttcgaacttcttaggaagaaattgctttagtctcagactatactgttaactgaaaggccagctaggttgtgtttcatttcttgtgggtctgtttttgtttttaacagtgaatgcataaaaatacaaccaactgacatccaacctgacatattcagctatttgttgcacattatgtacacggggaaagggccaaaacagaytgtggatcatagtcgtttggaggaagggattcgatttcttcacgccgactacctttctcacattgcaactgaaatgaatcaagtgttctcaccagagactgtgcagtcctcaaatttatatggcattcagatctcaacaacccaaaaaacagttgtcaaacaaggactggaggtcaaagaagctccttccagtaacagtggaaacagagctgctgtccagggtgaccwcccccagttgcagttgtctcttgctattggtctggatgatggcactgcagaccagcagagggcctgtcctgccacccaggccctggaggagcaccagaagcccccagtttccatcaagcaggagagatgtgacccagaatctgtgatctcccagagccacccctcaccctcatcagargtgacaggccccacttttactgaaaacagtgtcaaaatacacttatgccattactgtggggaacgttttgattcccgtagtaacctaagrcaacatctccatacacatgtgtctggatccctgccattcggtgtccctgcttccattctggaaagtaatgaccttggtgaagtgcatccccttaatgaaaacagcgaggcccttgaatgccgcaggctcagctccttcattgttaaggagaatgaacagcagccagaccacascaaccggggtaccacagagcctttgcagatcagtcaagtatctttgatctccaaagacacagagccagtagaattaaactgtaatttttctttttcaaggaaaagaaaaatgagctgtaccatctgtggtcataaattccctcgaaagagccaattgttggaacacatgtatacacacaaaggtaaatcttacagatataaccgatgccaaaggtttggtaatgcattggcccagagatttcagccatactgtgacagctggtctgatgtctccctgaaaagttctcgcttgtcacaagaacacttagacttgccttgtgccttagagtcagagctcacacaagaaaatgtggatactatcctagttgagtagcagcttctctttcagaatttttataccaattctgaaaaagaaaatttgcrtggcatttttwattcataaattattttcctcctcaagtttcattgactttttttcttcacagcttatccatggttttaaggttgtatatattagatcttctcataagacatattaatatgtggctattaaaatgtaacattcaattactactgtgaacttttcacaaacgaaataacaatttagaaatcagaaatcaatgtagaaatatggaaaccttaaatagttatttatagaattctaagtttttccagttatagaatcagtaaaatcaaattgaatataaagtaaatgaaatctgttttaaagcatattctaaactatcacttctgcytacatttcacatgaattcactcctaccaggattatttttaaatattttcttccatataggaaattaatagttactttaatgcataactgtatgttatacatatgttataatgtataaaaatttattttaagatataccaaatcatgagtagttttattttttaactactagctccacaacatcttacctacatggcttctctttactttttaacattgagtatacctctttttttttttgagacagagtctctctgtgtcgcccaggctggggcgcagtggcgcgatctcggctgactgcaagctccgcctcccgggttcacgccattctcctgcctcagcctcctgagcagctgggactacaggcgcccgccaccacgcccagctaatttttttgtatttttttagtagagacggggtttcaccgtgttagccaggatggtctcgatctcctgacctcgtcatctgcccgccttggcctcccaaagtgctgggattacagatgtggtatatctcatttttaataaaaaaaacagttaaagggagaagagtcagagagacattaaaaaatatttaagaaacagtaagatatacacacatagataaataagcatgcagagacagagactgagctagaactgcattgactaaaaaccccagggttgttaacttggtctagagtgttttcttagacaccttaaaaagtaatttgagattttatgaccagaggtttacatgagttgaaagagaatgatgataaaatataaatcatgtttctaccctcagcgtcaggatttttggggcttcctgggttgattttaattttctaaaaatcactgaaaaagtaatttttcagtggcacagttttcacttttttcctgatccataaaaccagcaaagtggatacattcagtgttctataactacatttaagatccatgatgttagcttttcctytataaatcaacttaactctcttttataatggtgacacttacaaagctaaaaccccaggaaaattaaagttgatgaaakaaataacagattccccggctctatatacctgggaaatagctggttaagcttcaccacaaaggatagatctaaattgtttctraaatgtttaaatttcaaaccccgcatagtcaaggataataraacagactcatctttttttgccctcttgttaaattmtaagcttcacrggcatttgaatacatctaaaaaatttggtttgtgagccttagaatttaaccacttacaaaactcttgagctccctccacttstgaggacgtttcctgacacattcaacagcatcagcgtccaatcagsagggagctcaaagagtaatccagctaattctaaggacacaaaggttttctctaggtaaacagtttaggtaaattacaaagtggtaagtttttcttgaggattgaatgaagaaagctactggatattgtgtaaggcagttgagtttctgccttaaacaagtgagtaaaggctcctatggttaagactgatgtgtgttgagagcacatctaacttgataagatcaattgtattgggagtaattaaaacaaatgtatgttctttggggtcagaactttgtctaatcttaaacttttttctaccaattcacttaagcaactattgaaatttgtactgccctcaaaaatatcatctcattggaagaacacaagtattaacattgattttttgtattttaggctagttaagatatatttcctagccttcttcaattcaaattctattgttcttattaagataatttttctcctctatattcttccctgtttgcctactcattattattatttttttaatttaatttttttttaagatggagtttcacccttgttgcccaggctggagtgcaatggcgtgatctcggctcactgcaatctctgctgcctgggttcaagcgattctcctgccttagcctcccaagtagcttgggattacaggcatgcaccaccatacccagctaattttgtgtttttagcagagacagggtttcacyatcttggtcaggctggtctggaactcctgacctcaggtcatgcaccagcctcggcctcccatagtgctgggattacaggtgtgagccaccgtgccaggcccactcattattctttgacacaggaaatccttgtatatagctaaagggtggaggtagagttgtacatggttggttggataagacagcaagtrcctcagggcagagtttggataaatggtaagagtttgctagcagctgattggccrtgatagacaacactsatttaaagcagaaatatatctgttcgttgagagttaagaaaatagtggttaactgtatttctattcttatagttccttttaatattagaaattcaaagcaaatgctctttccttgttccttaaaacattcattctgtttaggaagtgggaaaatatcaacttcattttatagaaaaaaaatcccaaaagctgaattccagagatgcagtgaatagtggtgtgggactgacccccagtttttgttattgttgttttcatttattctgcaggcttttttttttttttttttttttttttttgagacagtcgtgctgtgtcgccaggctggagtgcagtggtgcaatctcagctcactgcaacctccrcctctcgaattcaagtgattctcctgcctcagcctcctgagcatgtgccaccatgcccagctaatttttgtatttttagtagagacagggtttcaccatgttggccaggatggtctcgagctcctgacctcatgatctgcctgcctcagattacaggcatgagccaccgcgcccgggtctgcaggcattttttaaagtaactgtcatatgcctaacactgtgccctgagtattattttttaaagacatgattgctcactgagaaaatttgctttgtattttaaaagttcttccagctaggccaggcgtggtggctcatgcttgtaatcccagcactttgggaggccgaggcgggcgggtcacgaggtcagaagatccagaccatcctggctaacacagtgaaaccgcgtctctactaaaaatacaaaaaattagccgggtgtggtggcacacacctgtaatcccagctactcgagaggctgaggcagtggaatagcttgaacccgggaggcagaggttgcagtgagcggagatcgcaccactgcactccagcctgggtgacagagcgagactccatctcaaaaaaaaaaaagttcttccagctaaaacctttattttttgactacatctccacaaaatggagctatactgttagccagtatcctaatagtatagtgcagtttgcataatgattaccaagcttgaaactggaaatgtcatatgcactttcgtgtgtatcaggcagatactaaacattttccccttgagtcagcttaaaatttttccttcttttgaaatctcacgcagttgttttctggagaaaaatagagactgttttagtatttgttcttattagcgtatcatcagaactcagcacagtctgccttataagaaaacaaaaaatttttttatttataactcttgagattgttacttcttgctctttctgatttcccatccgtaaagtgggtgtaagcaatacttacctcacaggggtgttgtgaggatttatattaaacgtgttaagttctctcagtattattgattaaaatcaaccatataaacgacatttattctgtagctagacctattaactttagtatttcagcctataaattctaaaatgttcttaaaagcagtaatgtactatctaatattcaataactaattgacagaactcattgttattttttacaaataactagaaacaatactgttgctagaattcctgttctactgtaatttaatcatcactgtttctttttagccttcagtaaggaggatactagttctttggcattattgggaataaaactttgtcaatttcagctttaytgaaagttctcccaaatatattgtttttgtttacacaaaggaaaaggaacaaaaacaataaakaaatacctttgtttttttttcttttttgagacggagtctcgctctgttgcccaggctggagtgcagtggtgcgatctcggctcactgcaacctccgcctcccaggttcaagcgattcttcttcctcagcctcccgagtagctggaactataggcacgcaccaccacacccagctaatttttgtatttttagtagagatggggtttcatcatgttggcaaggctggtttcgaactcctgaccttgtgatctgcctayctcagcctcccaaagtgctgggattacaggtatgggccactgggcccagcctatttttatttctttgatgtaggtgatctaaatagtagatgaggacaggaaatggggtgaaggtaataatagtattattagaaaagtcttcactgaaaattgaaggaaatacatattaatcgtggaaaaagatagtgtgaaaaatgtgtaatttcgttaacatttatttgtacaggcacattcttgatgttgtgagtcagatacttgataaatgtccattttttgtagtaattgatgtaaaaatgggccatgtgaagaattttcataatgtaatttgtgtctttgtatattttgaactacatatagatttgtggcacttaaattattaatttttgatttcttaagagtgaagtctgtaaatgatttctctctgctgtacttctgtgtttgtatggttggwcattttgaaaactggtgagattgcacagtcccaaacctggatgtcttaaatacaaggaattacaaactgtgatttttgtcttgaagacctggaagaattcattgtgcttcagtatgtatttgtactgcacttgattaattagttaagtattggtctggtgcaattgacattaactgtcatcaactcctctattttgtgctaaataaagtcatttagtcagaatggatcaaatataaacttatactttaaaataaacttagattataaaaacttgttcaataaaaaagacccactgaaaaatcttcaaagtacatgtaacacatagctaatacaggagaccaaaatcaataatacattgtgtggctaaactcatccacctaatgtactgtgaatttgcttcagaaacattcttttagaaagttgtgtatctgccgggcatggtgcctcatgcctgtaatcccagcactttgggaggccaaggcccaggagtccgagaccagcctgggcaatatagtgagacctcatctctgccaaaaattttggcyaggggcagtggctcacgcctgtaatcccagcactttgggaggtcgaggtgggcggatcaccagaggtcaggagttcaagatcagcctggctaacatggcgaaaccctgtctctactaaaaatacaaaaataagccaggtgtggtggtgcgcgtctgtagtcccagctacttgggaggctgagacagaatcatttgaacccgggagatggaggttgcagtgagccgagattgcgccattgcactccagcctgggcgacagagtgagactccgtctcaaaaaaaaaaaggcagggtgtggtggctcacacctgtaatcccagcacyttgggaggccaaggcgggcggattatgaagttaggagatcgagaccatcctggacaacatggtgaaaccctgtctctagtaaaacacaaaaaattagctgggtgtggtggcacgtgcctgcagtcccagctactaggggggcagaggcagaggaattgcttgaacccgggaggcggaggttgcagtgagccgagattgcgccactgcactccagcctggcgacagagcaagaaacaatgaatttcatatattttatcaagacaaattaatgtgacttaatcaaaaacaagtttattagcttagcttatagaatgtgttcttattttacatcagtgtttgccaaatgttgtgttcctagtgttgaggcaagtagtctttgtactgggtaacattttggaggtgtgatgcaaaaatgcatttgtggacctaattcttaccaaccataatctgtgttaatcgaaaattgacgtcctaatcaaatgctttccaactgctgtctctggaaagaaaggtagtatttcgtcatttcccagaagtttcttgctttgcttcttcttttttttttttttttttttttttgagatggagtcttgctctgttgcccaggctggagtacagtggagtgatctcggctcactgcaaccttcacatcccaggttcaagctattctcctgcctcagcctcccgagtagctgagattacaggttcccaccactacactcggctaattttttgtatttctagtagagacggagtttcaccatgttggccaggctggtctcgaactcctgaccttgtgattcacctgcctcagcctcccaaagtgctgggattacaggcgtgagccaccgcgcccagctgcttctttcttctctatttacagtctactgtatcgccttttgcccccagtaacatgatccacaatagtagttctcaactgaggtatattagtcaggattctccagaaaaagaaagaaacaacaggtagaactgagagagagaaagagattgattgattataaggaataggttcatgtaattatggaggctgagaagtcccaagatctgcagttgggaggctgagaggctggggagtcagtgatgttccaatctgaatttgaagacctgagaaccaggagagcttatggcataagttccagtccaaaagctggcaggcttgaaactcaagaagagctgatgtttccatttgggtccaaagggaagaaaagaccgataattgcagctcaagcagtcaggccagagaaagtctctttttttattatattctggccttcaactgatggaatgagagccacccacatcagggagggtgatcttctttacgcagtctactgattcagattttgtctccctccagaacaccctcacggacacacccagaataatgtttgactaactattggggcascccatggcccagtcatttggacacataaaattaaacattacacagggctatccccccccatagagacatttgacgatgtggagatgtttttggttgtcacagttgggtgggcgatgagggaggctgctgctggcatctagtaggtggaggccagggatgctgctaaacatctcagtgcagaggacagcctcccgcaatacagaatatgtacctcaaaatgtcattagagctgaggttgaccaacccttctgagaccttaaagtaagttttgtgatggctgtcaggaataaaagaatacaaagaaacccaatttgggggatttctattctagtcatgtttagagcaagtattggagtatgagatgtgttcagaattaaattctatttgtattatccttgatcccagcttttaaaagataaaaatgtgattattagaaataaaaggaaaaaatgtgattattaaaaatcagagatgtattaatcagcaagacagttttgaatctattcatataatgtttgaactaaataattgtctccccaaagaggtctcttcatgaaattgagattgtaggttataatttctgtgaatttttaatctggccaaaaggtggcaccagtgtacctttaaaaaaatgttcattatacttgaattcagcattactattaatagtaaatattatttagggcttagctacttttggatcatgctttatagagtcaagactaatgagaattttcttaaaatttcataaggtactgcaatatcttgacatccctctttaatcaagatgcttctgatttacatgtacatatctcagcagataactttttaaaatatcacattattgtgctacattgagcatttctgaagatttttccaagccattaactgtgaggccttggaatttgggctcttttaatcaggcatcacactcagtttttggtgttctgcctggtcaagacatagattgaaggacatttgagtaaatacgctcccttgctcctttcttgccttttgttcattttttgtacatccacaatctatgaggtatgttacctactgaaatttactttcttttccaactgtggttcaacaactgayyttcttctctcatactttccaacccattccattctgaataagttaagagttttcttaccttcagctcttctcaccttccaatactaagtgaatacagcctgcctcccccttcatttctgattacaatattattctcatcatcctaggactttgtacctaatcaccagttgcttctcctaagtttattttacagctgataagccaacttggaaaatgagcccactctccctcagatacattctcttccgctgtttgaaacgtttttcattgaaacaatttggtgatattgtatcaaaataataaagtattaagctactggaacaccatggtgtcctttcatgtcaaacgtctgaaggaatgacagtcctccaagagagattctctgtacaaatggtgtgttcccactgtcctggaaacaggagaggcttgtgccagggggctggagaagatggctctcacccactgtggtcgtcatcccttgtctggtctgtgttattaacaagtttcaggaggttccgtgtcagatttatgtgcatccagcaggcctttgaggaatgggatcttgtgtatttagcactgccacattttttctatagtggaagccatgtgaaacttagtccaaaccatatgcaggtaattaaaaaaaaatttttttttgaactggcatttatggtaactaccatatagggaggaaaacctgaagaacctggagtggttctgtagaaagtgaagtcacacctgttactttttgaaggtgaaaacatatttgcaaaggcaagggaagaggttttaaaatgcagatcaaagattcgaggggagtgaatctcaacagtattcctagctaaccacttctcatttcccaacattgctcttttttcacatgtgtgctgtctggtggtgtgagctcagtggtttctgtcccctctatcacaatattttaacgtctatgaggaaagacatataaagggaagagtcctttttttaaaatcttaaatatctcctatttcactattaacataccagttttgctgctctctcaaactggtggctatgctcagagccaccatgatggccatgcagacaatgcacaacacagtgctagggggtgcctcgattgaatgaaggcttctcccagagttgtgctgtgccaatggcacagctgtgcgtgacagccttgcctttccttatcctggtttaaacactgggtttaagaagcccttattttgaatttctgcagcaagtagcagttttcactgattagtcaggattaaactaagatagacaagtggtatagaaatcagaataagatttaaaattaccccgaggtgacacaactaatggcttggtcaaaattggtagaacttgtattaaaagggtggattttgctgtatgtaaattataccttaatgagaaaaagattcataccactcagaaaaatataagtcttagagtttgatgaaccctagtgattatcattattcactgttaatccttcaggaaaaacacaacagccagatactgagggttttttaaagaattctaaacaaattcaccctgaaatcaggacaattactgataaggctatttagggaacatttggataaaagatcaaaaactgagtttgacttttttttttacctgaattgagtcgtgaccaattgttttggcattttctgcatctcagccatatagagtacgaggcagttctaacttagtcattctgtcaggaggatagaaatactctagttttgagctgggcgtggtggcttacgcctgtaatcccagcactttgggaggctgaggcaggtgaatcacaaggtcaggtgtttgacaccagtctggccaacatggtgaaaccccgtctttcctaaaaagagaaaaaaattagccgggcatagtggygggcgcctgtaatctcagcggcaggctgaggcaagagaatagcttgaacctgggatgtggaggttgcagtgagccgagatcactccactgcactccggcctaggcaacagaacgagacttcgtctcaaaaacaaaaacagaaatactctagttttggaagacctgtttaaacagaagtgatattctaaagttcttatgttgcaaatggccattccatatggaacctttgcgttgtaatttatatatatttgattagcagcacatgcatgcctgaagctgcattgtgatggtgattttatcacagatgtggtacagaaacccacttgtagtcatactgagcagacctgtgacctgtcagagtagggatttgggaataaaaggttcgggtacaagtgtagaaatgactgcatctgctttggtgtcaccttttgtttcctatctcccaggagtgcagaaatggaaggcctgggtcctaagaccacaagtatagctgtgaaaagtgtataatccttctcccatagtagcactgtcatatcaaggccaaaagttctttttgagtttcaccacaaagcaagtggtggggaaagtgcatctagttttgctaaagtcctgaaactgctggacactgctcccattgttatgataggctggagtttacggagacagttttaaggctgggagtttcccagacgcggcgccacaccatcctctcctcacctaggtttcccttcactgctcattgtgcccacacccagttttgcagaggattttctgtgaatgtgtagtgcacagacacgcatactctctttcctaagctcgggaacttaacccccagtaagcttaagctttcaggaaggaagaaagaaagaaaagtaggtattcacaaaagggttggggactccagacgtcagcattaaaggtaggtctaaaaagggattagcagaattgcctgtgaggacaacttttgtgaagtgtagtgtatctttttttttttttttaaaccaagaagagatttaataaaacttttttttgagacagagtctcgctttgtcgcccaggctggagtgcaatggcatgatgtcggctcactgcaagctctgcctcccgggttcacgccattctcctgcctcagcctccccagtagctgggactacaggcacccgccaccacgcctggctaattttttgtatttttagtagagacggggtttcaccatgttagccaggatggtttccatctcctgaccttgtgatccgcccgcctcggcctcccaacgtgctgggattacaggtgtgagccaccgcgcccggccataaaacttttaaaaatcctgcaaaatgtgaaatattagctaccctattacagtgtttgtacattaagaagacattttgctttgaagccagattcgttttaggacttttaaggtattatcaagttttaaattggttccaagatttggaaagtacagtccttcctagagcctgattgttatcatcgggctgtggttacgaaaagatagagtgttaacattaccaaaatgaaatcagtgtcttagtaaacacagaactttttaaacacccacctttagtatgtaccgtctgaataattctagcattttcacattgattagtcttttgaaaaatcataaagatgaacaattcataggttaatgcagaaaataatgagtatatcaagagatgaaaacagtgtgcttttgtcaaattcacaaatgtcatcaaattcagaactgcccttttggctgaattagttcagcattgtaggtgtttatatttgtcttgctgaaggactgttttaggagtgttgttgtaaaatctctgtccaattcccaattagcagagtagaacttttggtagtgcgaactcagtagttccatcaatgtgatctttacagttataggaaatgaacatagtttgcccacagttcttttaaaagatctgaataaacatgagtcaatataacatttattctgtattaataatcagtacataaattaattcaacttgaaaccttttttctacagagtactatttaatattatcatctgatccatagtaatttagtactaattttaatgagaaaaaatgaaacttttactttcataatagctcatccacttaacatttttacaaagaactactataaatatgtaacactatgcaggcttttttctacacctagtcacaaatcaaaataagcatactgtttatttaaaaacggaacactttcaaactgctgctgtattcagatcaccaccttccccacaccaaattaattgctctctctgtgtactcccctctgtgccactcatgttgcagcattatccatggctctttgccttaacccaacccggtttctgttgtcactgctccctaggttgagttcttggatggcagggagcctgtctcccttatcaaatagtgttaggtatgagttatgcctaatacgtgtgttgaatcaaattgaatttaattaggacacctgaattttatgtagcttccttctaatttttgtaactaaggagcattacaaattttcttttcaaaatgtaccataaaatataccatggattgaaattttgaattatgtataagagagttcatgttacccaataaaacatcataggaatttgaacctaaagaactctaaatcttaaatgaggatttttttttaaatgcacaaatggcaggcagaaaaatcaaatcctgctatattatcagatgaaattagaaagtagactacatatttcaataaagttgacattaaaaggatcttttcaaacagtgggattctaaagcctaacaattattttttaaattctgttgtaaacctcgaaaaacattcttaactataaaaaataaggtaacttgaagttagaaatttatggatgaagttagaaatgtatggatgaagttaatgctggattgcatacagaagccaaatttggtgcctccatgatccatatctttaatgcctttagcaagcctgttcacatatactggtgaaataacaatctctcagaagtaaataaaagagattctaagactccgctgagtagtagaccaagtaagatcatcacaaacttcatgctgtcaaatacattaccttgaaggaaaattatgcagacagcttttctgaacaactccatttatgccacatgcttattattctttgaggtggaggaggtggcagggaacataatttctgtttgaaagttcttttgttttctgctacctttacttaaatgttaccgggtactatttttatatcctataaagtgctttgaaaaaatgttaagtgaatagtgctacataaaatagaggagaattttcacattctctgggttgtaagaagcaaagtgaataatacttgagtcttaaaagaggaatgataatatgctgaaaaagttaacaagtagctaataatccccctccccaacccccagctttgcaaaattctgggttcaaagagaaactgaattttggctaataaataaataaacattcattaaaagcagaatttataccacagcaaatgtaaagaaaattcatgtggtgttcctaataattattttaatgttgttaaatggacatgaattgaaacagaacttatttatattcacttaacgtttgcatataaggtcaaattgcttaaatactattacaagaaaaatattttatgactctgaagccatctgatttctgcatatttctataacaataaaacaatttgaatcaccttagaattcactgtaataggatttggccatgtagcacatataatcagattgagaccagttaatttcggaattcctttttctaactgaaatcctacttaattcaacagatattctcaatagaaaaacagaaacctcttaagaatgaatgcaagtaaaatatacatcttatcataaaaacaatcagtacattctaaccaaaaatatatatcaaaccacagtgaaaaaagtaaaaacctagtattagataaaattttactttcttaaccaaaaaattcattgcacatatttaccatttatctgtttttttaaaaatcccccaaaatatttccaataactgctaagtactatactttttgcttgttcatgagattactaaacatttacaatgcaagtgtattggcttggaggcatccttgcagtaaatgagggcaggattcttcaatacactgtaaaatgcaccaaccttagtcaggtttttaaaatggttcacttttaaatatgatagctggtagctgtccaagtccattagcaccacatatagtgagttaaagagtgttttcagagaagatgactcgtcttttttgtttttaatgtttaaaagttgtacaattaaaagaaattgacttcttgggtcatgtgttttgaatgacacttttcatcttgctcaggatttccaccctcctccccggattataagcatgaaggtaggaaaatctgggggaaatatttttgcacttcagcaaagaatcttgctaataatatccatgatttggttcaatttccaagtcagattagtttcttttgttagaggtctcaatatgtatttacagaaagaaatgaagatgattctgtaggacaaagtagcaaatactttctatatgcaatccatacacaatgcaagaattcacccagatcatttaaaatcatctaatgtgcattatttcctccaagtggagctcttgaacaaataccttacatctcatacttcatctttattacttcatctgtttcaagtagtaacacaatcactcaatttacacaatgggggaatacacactttgaatcctaacctgtgaggtagggaagtgcactctggtattatggccatttcacacaaggaaagattgaaataggattactttttcaaaaaatatggcaatcattgatgagatcagatgcttccctttcaatatgtaaataaaaatgcaaataagcccttctcatttttgtaaagtatatctggattgaaaatagtgatgaaggccgggtgcggtggctcatgcctgtaatcccagcactttaggaggccgaggcgggaggatcatgaggtcaggagatcaagaccatcctggctaacacggtgaaaccccatctctactaaaaatacaaaaaattagccgagcgttgtagtgggcgcctgtagtcccagctacttgggaggctgaggcagaagaatggtgtgaacccaggaggtggagcttgcagtgagccaagatcgcgccactgcactccagcctgggcgacagagtgagactccatctcaaaaaaaaaaaaaaaagaaaagaaaatagtgatgaaaaagttaactttcaatattcatgtaaaatgctttttactggtctcaacacacagacatgaaggaatactgacatttaaattataatgtgctttagcaataacttttcacttttctattcacccacattcatggctcatttttggccgagaataaatatttgcactagattattaggattttccaggaccattactaccaggctggctttgaatctactctcccctctttggagagaagttgatgaatatggctcttaaagaagtaattctgcaagatgaatcctatattatctgtgataatttacttgggaattttcccttctcctggatgaagaataatattccccttgttttgtttttgctgtttcattttttaacttttcacagataaatccatgcagaaatggatatatacagatctgttgaggcagaaagaaaagcgggggaaaaacccactctccctgtttctacacttttgcacttagtaacaatttgcctgaytgaaggatttgtgaatggttctctttttttttttttttttttttgagaaggagtctcgctctgttgcccagactggagtgcagtggtgcaatcttggctccctgcaacctccacctctcgggttcaagcaattctcctgcctcagcctcccaagtagctgggattacaggcrtgcaccaccacgcccagcyaatttttgtattttcagtagagatggggtttcaccacattggccaggctggtctcgaactcctgaccttagctgatccacccgccttggcctcccaaagtgctgggattataggcgtgagccactgcscctggccaaatagcgcttataagagacttaagactaggaaaccactcacgtttaatatcaatatgcatattctgcacactatctgctgaaattgggaaaatgcaatgtattttttgagttaagcctgctgcttaggaatgtaacaattacaaatcacattcacaaaagtagctcaccttattcaccattttaaacatatatgtgcactgtaaaaaataagtttttaaaaacttaatgtgatgttagcctatacacagagctgaattatcaaaaggaaaccagactttgttatatcagaggtcattaaaaagcttatggcataccataagtgctcaataaatacaccttcctcccccaaagcactccaatctccatatgccrttttagcaactccctgtatgttatgtcattttacactgcaatctgtgctgacttcctccaatccagaagtgactgcatttcagtggtagagttttataaacttgacttaatctttagcacttctgcgctggaattgtaccttttaagttctagagatgataaatctctcatttgttactgagtaagaaatgccacaaatgtataaaagaattcttcattaagcttgttttttctgccgtgactctggagagtaagtcactgtagaagattgtttattttattatcatcagaggccatttcattaaccagctgttctattgacaactgaatagcattcttgactagagaagaggctgtttcaattaagagtgtttcatattgttctgaagttctatcctcaaaaccattatcattagcaaaaacccctacttgctcattttcagctgaaattaagaattgcttagggacatttttagattttgtaacatcaaattcactgatttcagtgtctgtaataataatagcaattggctccattcttttgctttcttctgatttggatttctcttcagtgatcccattttctttaaaatctgattyttggctcaattcagtatcttttggcttagtttcttcagctacaatctctgtactttcatagtcttttccatttggtgcactttctagggtactgttactggcttcttccacaatttgttgatctggaattgcaggtaaaggaggaacatcagaaagtactggctgctgatggtctgtttctgaagtttcaagtgggcttgcttgctggggttgaacatcttgtttttccttgatcgtttcaatttcttcaaggattagagttcccgtttgaatagsagaatgcccattatctaatccaagttctactgaaatcactttctctccaraagttrtgctattgctcacatttgattcacagacctcatcaccatctttcygtgagatgccttcacttagatcctgggttgacttagcctttgttgcctgatcattcaatggggtctgtgtttgtatatccaaaatttcagcttcttcctggactttgatgctgcagtctgagtcttctataattttggaatgattactcctttttggccctcttgggaattttatgcagggaatcttaagtctagattttgcctttttcttagaaagatcagcatcctcagcatttattgcaggttgcatttcaccctccaatrgcttttgctgctttgaagactctgaccttttcctgcgtgtkacaagacgtttgagtgaggcccaggccccccgtgtgggctctggctgatcagaagctcctgcttcttgtggacacttccttgccacatcagcagcttcagagccagctttgggcttcagtgctttggctgctttctttcttctcttgaagcaaagcatggatgccttttccttctgcctttcagccccaggactaccttctgctgatctcttctcatccttgttttctacatgaatttctgaaattgtggtttccatttttacactgcactcttattctctagaaaactgtattctctcttccttagcagccttttgtgacaaaaagatgagcaaaaatgtcacactaggtamaatttcttccaggcatattcatacctttcatcttactccatacagttgttttaggtggtttctctagtatagaaatgcccagtttctctatggcttgtaatttctctctttaatttcttgatgaaagcccttctttggataaatttttgctttatttaaagatcaacctgatgagagaaaagaaagtggtattttatttcactatgagcctattattttctgtggagactatttcagtgaatgtataagattctaccaggcatattttccatataataacttaatgaaatgactggagaataaacattggggtttactttggccctattaaagagttcagtgtgattctattttgttttatcctccttgttgaaacttcattttggattaccctgcaagtctgatattatcagttctttagttgtgttgtctgtgtgaattgcttatgactctaaagtgcaagttaagcaaacaacaagaaccaaaaatgaagtgcaggatgaaaagcaagctgatgtaatctttatcacactcaatagataattttaaagctgcaaaggactttagagattatttgagattactcaaatccagccagatgacaaaactgaactccagaggggagcagttgtcttgtcaaaagccatgcaactagataaggtcatagccagagttagaactagagactttgactctctagttttaccattataacataaggtttctgttctaaaaatgtatgttccatcaaggaagtgctatttttcatacatattcttaggaaaatttagcattactgtcatttcccactcttaaattagttgtacaattttgacattttcatttaagtactgtatctgctgtatcacatgtttccaccataatctgcacatagttggaagtcagtaagagtagtaatagctgacatttattgagcaattcttgggtattaggcagtgcatgcacttttacatacatctctaatcctcaccacaatattacaaagatggtggtatcaccacgtacagatgaagcaatttggctgagattacggcagagctgtaacagagctcagattaacacaagattgcttgttgcttaaagcttatgttctgaaactgggctttaagagtttcgtcagaaaatgaattgtttggggatactaatctgcagtgtttcattagtaaaaaaattaaaaaattgattaatggtcatttaaccataaggcacttatcaactcataattgaaccacgagtagactgagttcttgtcatttgaaaaccaagcttttgaaattctttatattttatttttttggttcaggaactaatttaaaagccaaaaataagttggcaaactatgcaattggcaaacttagataatataaaggtgtattgaaaatttaatccttagaatggtatgatggcaccaaagaatggaaatgggaggtgattatccaacaaagatcctatgaattttagtgggtggatgccctaaaataagcaaagggactcattctttatattgtttttatgtaaatccttcactgaagtttcatttgggtaacccataattttatgaactgtagaaggaactggaaccctgaaaatcagtttatgatctaagtaaatattatcttaggttgggtgtttcatactgtrtgcctctaacagaaagataaagtcattctagaacaatgacggaactaaaatatgaacatttgacagtgtttctcctcacaatgtttcagtgagcactagaacctaagctgataactgtttaaatcttctcacctcttgtgagttttcagcacctgagcatttttgttaagcagaggctgtattaccacataatagaaatattgaaatgagatgtttaggagtctgtcattggaaactaacctggattgcgcaaagacaatcgtttgagaagctcacttgaatgtatctcacatactagaaataaaacgaatacccaaacagaaacttaactaacgagggaaaataatgcagtctgtagacaataaaactttgcagaatgtcagactgcaaatgattcgctcttaaccagcaagggtagctttatcgcctcaggaaatcttaaagtccctgtgctcatttcctgatggaattgcaagtctcatgtcacagaaaacaccccctttcctttttcccttgagcagccagtacccgaggaaagcaatgcatctttcccagcaccagatacggaccacgaagcttcctcctggaggaaggaatctcgaattctggcttgacgccccttatggcaggagacagagcgcaggataaagtactcaaaaaggaaaatgccgggggcgtggaacagataacccagcttcaggctgtctgcagaattataatgtaatggccagaaacccaaaatcacatttctcaaagagggataaagaaggaaaaaagccaccggcaacccatgcttctaagacaagctgtaacgcgaaggggataggtgggcagacctgatgagggtcgccctggccgcggattccagcggacaagcgacctcccgcgttcttactcccagcacctcagagggctcggataccccgtatccagtgggcacctcttgcccactccgcggtccgcggaccggacattgcccccgaccctcctcccccgcaggctccccgccctgcctttacttacgtagggcgtcggggtccttggccaacactgctcccgaggtggcggcgcgctcgcggggcccgccgcccaggcctccagggagccgcggtcgcacccggagcaaggcgccctctgcagagcccgccgccgggtgcgccccctccccaccgcgcggggacagacagcaggcagcgccaatgcgagcggagcggagcgggcgggcaggggcggggcgaccgcsggaggcgcggggcggcgcgggcgccgggacccacctgcagcagcagcctgcctgcctgccgcggggaagcccatcgtgctccgcccgggcgccaatctccactgccagaccacatcagcgccgaggcggggaccgcaagagagccagccggaaggttcggggggcgggggaaggcgggggggaccagggcaatgaaccccgcgttttctgagacgctaaatagtgaggtccggtttcaaattatagacagtcgcattacacatctcctctcctccccctcagaatatttaaagacaaggcagacatcgcattttaaaagcaggattcaaaactgtgcatagaatagcgaggtcatgtttgtttgaagcgaaaattacatatataaatggaaacagaaagaaacccgactttctcaggagtggcttgagtgtcagatcatcgtggttcatcgccaaacaggctttcaaacctttgtctcccagtgggaagcaggtggaggtgattggtgcagaactttggcctgcaggagcagctgcatctctatgcggacaaggtgagaaaggcacaggaacccagctccatccatcttataccttacatagttccaaaaataagttgaggtagcttacaagttacccatgattcccttcaggacattccctatgagggcattcctgggagctccagctgtaaaatctagtaggatccatcacaatcccagcctcctcctctggcccccatagcatagcatccagatgaagaacctggtaaggtgaagtgaagaactactgaaaagcagccgcgttcatctcctttcttcaacaggatcacgaccttagggagtgtaaatgtcaggtgtccatttttgtattttttccggaaatgttttatatttgtaagattctgtagtttccacagaggcttatcaaggaaagaactcttgagacacaaaagcaaagccaaatataagctgtcaagatcttaaaattacagataaaagaggcaagagttgtaaaacaggaaaatccataagcatctagtttagttgtaattaagaattcagggatgggcgcagtagctcacacctgtaatcccagcactttgggaggccaaggcaggaggatggcttgagtccaagagtttgagaccagcctgggcaacatagggagacaaaaaaatctaaaaaattagctgggcatggtggtgcacgtatggtcccagttactcaggagctcaggaggctgagaagggaggatcacttgggcccagaaggtcaaggctgctgtgagccactactgcaccactgcacgccagcctgggcaacaaagtgagaccctgcctcaaaaaaaaaaaaaaattcagtcagccttgttcactcagcaaacacgtctatcgaaatggtctgcgtatctctctatgggttgctagcgctgcttgttgccagttttgaactttaagccaaaagaaatccattatgctyataagcaattgagaactattccttattgagatccaaggtttctcaaaactagcagacctgggagtttgcaagagtttcaggcaaaaaataagatgagcttatttaggtgaagacagggtaaaatagctgtcttatttttatttttatttgagacagggtcttgctcaggctggagtgcagtggtacaatccctggctcaagcaatcctcccacctcagcctcccatgcagctgggaccacaggtatgcgaccacatgcccaggttcttcttcttttttttttttttgtagagatggcgtctccctatgttgcccaggctggtcttgaactcctgagctcaagtgatcctcctgccttgacctcctacagtgctaggattacaggtgtgagcccccatgcctggccttcacttgcctttcttttaaacaaaattagtaaaagggaactgaaaggcagtttgaggtgagagatgaatttatttagtatttgaagggcaaattcggacagacttccttaaggtatattacaaacaagtcatccctgacctccaccaacacacatacacacagagtcactcacacagagtatagtactataaataacatagcgcaccatagtttttctttaggatatgactagaactcaatgccatatgtgtgtgtgtgtgtgtgtgtgtgtgtgtgtgtttaatgtatccagtacctcatgcatgaaagaaacctgtcattcctgaattcaggtaagtgacaacgaaggctgtttaagctattacccatatcattgtctactaccccattagtagcttttcattatataacaggaaataggctataaatgtatttctgcaatctgatgagaaattatcctacctatagcttatcatgttaatatcactagatacagtgtgccagtaaaatagcttacatatttatctgagcaatactctactgatcttaccatttatcccatcttgrtctctacccattgcctgggcctatagctaccaaaaatgacttataactccttgttaatagctcttacatttcagaggccttctgggaataagccctccaaccccgttccctgggacaccattgaatgaacctgaggctccaagtctctggtggtttcatctgttcctgggcaccatgagggttgcacagagccaacacaaactcaatagtaatactgttgcaatctgtttaatgtggcagcacataaatgctatctcttttgaattaagactgtgtgtacatcttcagtgcacagaaacagcctctgaagtgagatcagagaatgtacaatttgtttatcagtaatattactaataaggggaaggaaggcwttagcagcccagagaagagaaagggcacgggaaagccactaatctggagggactcttagcaccaaggtaaaggcactagaccttctctgccagcacatgctaatagttaccccaagcactaatgcttctataggtcttttttattttgacacagggtcttgctctgttgctcaggctggaatgcggtggctcagtcatagctcactgcggcctcgaactcctaggctcaagcaaacctctcacatcagactcccaaggagctaggactacaagcgtgcaccacacactcagctgagttttggggttttgttttttgtagagatggggtctgtcttgtccaggttagtcttgaactcctgggctcaagtgatcctcctgcctcagcagcctggacaagacagtgagaccccatctctacaaaaaacagaacttcaaaactcagctgagtgtggtgggattacaggtgtgagctaccatgcccagcccctaccagtattgaggatttaaacccatgtggctgttggcgatattaggaaacctaaatcctttaagatgatccttaagtcaccatatctgacaagactgcatccttcccttgtctacaaaatgaattcccagcaaatcccattccaggtgaagtttcacaggacattaagaaatgtaccagaaagcggtcgggcacagtggctcacgcctgtaatcccagcactttgggaggccgaggtgggaggatcacttgaggccaggagtttgagaccagcctggccaacatggcaaaaccccatctatactgaaaatacaaaaaattagccaggcatggtggtgcgaacctgtaatcccagctactcgggaggctgaggtsggagaatcgcttgaacccgggaggcagaggttgcagtgagctgagatcacgtcactacactgcagcctgggcaaaagagcacgactcttgtcccaacccccctaccccccctgccaaaaaaaaaaaaaaaaaaggaaaaaaaaagtaccagaagcaattaactctgcaaacagggcctggaggatgctgtgcaacaggaactgacaagtgcttacaatgtgccaggccctgtacaaagcatcttagatgatgtgtttgagtaattccagaaccgccctcacgaggtaggtaccaacagtgctcctatttccatggtgaggatgtggaggcagggaggtgggtgaggctctctgccatagagctggggctctgcactgtgacccctttgccatatgcctctcaaggcagcgctatcatttctgtggactgtaaaattgactgtattacaacattgacatggacctagggaattaaaaataataaaaccaaggtcactgggaaaaatactgctttgccaacatcagcagtgtttagcactggcgccagtgggatgcagcatcctctggaaggatccagtggagggagacaaggggaaaaagggaaggaaacaaatgggagaggaagaacagagatagaagataaagaacaagaagagaaggaaaaatatttgatttatttttttagacagagtctagctctgtctcccaggctggagtgcagcagcatgatcctggctcactgcaacctctgcctcctgggttcaagcaattctcgtacctcagcctcccaagtacctggggttataggtgcctgccaccacacccagctaatttttgtatttttggtagaaacagggttttaccatgttggccaagctggtcttgaaccccagacctcaagtgatccgcccacctcggcctcccaaagtgctgggattacaggcatgagccacctccacgcccagccagaagaggaggaaaaaaaatattaggttggtgcaaaagtaattgtggtttttaccaacctaatgttttaggaaaaagaaagtctgggccaggtatggtggctcatgcctataatcccagctacttgggaggctgaggcaggagaatcacttgaacccaggagacggaggttgcagtgagctgagatcgcgccactgcactccagcctgggcgacagagacactgtctcaaaaaaataaaaataaaaataaaaagtctgtagggaagggtggagcccaggcatttagaagaaactcaatgaatacttgctgcaccaacagaatagaggctcacctaaggctaatgctgcatgaccatccttcttgagcactctaaacatagacagtgctaaagctgtgacagaaatgggaattccaaggaagttcaggcaaaaacttgtataagcaatacttcctcagggtagaaaaacaaaattcaacaatatagaaaggtataagattaaaaggtaagtcatcaacttccaacccaaccctctcaggaggtcccctgaattatgtgtcctctcagaaatacacaagcatgcatacatttccctctaaacacaacagtatcataaagggcacactgcaacttgcatcttcagcccaagggtctgcctgacaaatgagctcacaaaggatggcagagacctgtggcacagtctgttaaggctgtaattcatattgcaacaccaagatggcaaacttgtttccttttattctgtggaacgtcactaaagtaaacagacatgcatgatttatgttaatttatacatgatgagaattaaggctgaaaatgacktctggggaaactcctactattagtttcagatcttctggrcaggggctgacttctcttggcttacttatacttcctaactcccagtgggcctgaatagacactggccagactttyaaagtagcttcttgaagatggatggtgatctggaaggaaaaacaagaaataaatgttttctctaagcactgaaatgtttcctgttccttccatactgcaccattacccactcacattgccaaagctgttaacatttacatcctttcctgccaccagctcttctagggcgtgtccataaatggacttgaaaatgatgcatggtatttccatagtactgtgtgaatactgttcaagaccagaccaagccgtgagccatgactgcatttcgagtatcacacataccctctcaaagaatagtgttctagcatcaaactacagtttgcttctacttggaccttaactttctcaaataatgcaagagcttttgttttatactatgaccctttgatatccttgtcttttctrgctttttctagtttttctcaggtgctcccccaacctgttccacacaggatttgtaacttcaggtcatttgcatggttatcagaatgccccttcgctaatgtccaaatgagggttcagtttcccaaaactcacgtcttccttttttcttggttaattcctcattttgctaagtacattgctaaataacttcttaggaagagatgtggggtggcaaacccttgcacgtctgaaaatatccagatagattcggctaggtgtgagcacatgttgaaagtcatcttccctgtgaccttacaggacactcctccattgtctaaaagcttcttattgccagtaagacgggcgttaagtctagttctcattcttttcataggcaagccacttttttcgtctctggagaaagatgttaggattttcatgtttgatatttttgcagtttcaacaggatgtgtctagggatataagtgcacactgcaacttgctgcttcagccccaagggtctgcctaaggagagacacgtcctgttgaaatttcaaaaatatcaaacaatgcaatgtcactcattgcagtcggtactcagggccctttcacctaaggccctaagaactgccagattggtcctgtttccttctcttttctattatacttcctaagacatttgctaattcttgccttctaactacctattcagagtatacagaccgtcagctgttcctgacctgcaatgtgtcatcaactctgaaccccaagcctcctggggcttcagcagagggagtctaacctctcctgtagtttcctctgtagtttattggacagcagttttctcccctacactgtcaacctgtgacaagccatgctgcgcttcttccaaaaatgtgttgaaatataaatatttcaattcattggttattgccaactctcattactatcccctctcccctcagggaagtctgaaaagaaatgttttgaaagcattagaatgtgaatttttatagcgtcagtttgagccctataattcataaataagctacatgaggaaaaaagccaaattattacccagtaacaacttacctgtttagaataatccattcacctgttctgtttcarggtccaaatcaatatcataaaaacagggccgggtggggagtccaggcattgtgctcatctaggatgtaaaaaagcattacaaataaactaatgctgggcacagtggctcacgcctataatcccaggctgagrtggagaggatcacttgaggccaggagttctaaaccaccctgggcaacatagtgagacccccatctctacaggaaataaamaattagctggatatgatggcatgtgcctgtagttccagctacttgggatgctaaggcaggaggattgcttgaggctaggaggttgaggccacagtgagccatgatcatccgattgcctgggcgacagagcaaggccatgtctaaaataaacgtaaagtcatctttactttcacttttccttcagaaagaaagcccaaggcataaagatagaacatcattttatagttgtcaataaagtgggtactcttgttacatattaaaaatcaagtcactgatcctgttaaaaaactcagaaactgatccctgccgggcgtggtggctcatgcctataatcctagcactctgggaggccaaggcagatggatcacctgaggtcaggaatttgagaccagcctgaccaacatggtgaaaccccatctctactaaaaatacaaaaattagctgggcatggtggcgtgtgcctgtaatcccagctacttgggaggctgaggcaggagaatcgcttgaacctgggaggcggaggttgcagtgagccgagatcttgccactgcactccagcctgggtgacagagcaagactccatctcaaaaaaaaaaaaaaggaaaagaaaagaaactgattcctcatgtccttctgcaaaccaaatgccagccttcactatcatcttccatgtggtcacaagcagtagcaggaggtgtttccaccttcaccttacaagaatgagtgctggggagtagaggagttgctcactcgcctcctcagctcacgctttgcaagaccaaaaggaggtacagggcttgyctgcttttaaattttgtttcgttcagtcttgctagctgagctgcccatgtgatttttgcttcagcaacacgatggtaggagttagtatcctttaacttgggccaagacacttttgtacataatctagatggttttataatcaccattcttactggcccaaaatggccttctaaaactaaacttgtaatgcttacaaattatatttgtactcactacttttctaaagactcggctttgacaaatttctacttagatgcaaatatgtacggcttgcaagtgaaaactccgtatatttttatctgtaacaatgtcctatataatgaatacacacaagttccaaatcaaatctagacaggaaaacagcttaggttacttctaaaacttaactataaaaaggttatttaaaaagagtcatcttctgtaacacaaaacatcatcaatactttagaaaacctcattctgactgacttctgagtaccaatcaatattccccaaaacacattatagggatctgacaactggtttatattcttatattgtgtaagaggtaaggaggtgctaggtgtgagacaagtaggagagaggaaaggatgggtccttagacacagcagaaaaaccggaagatgacattataaagataaaagacacatgcccattgttgtagacgggcatgtgcatgtcagcagaaaaccctaaagatggttccctaaacagtgatgagtaggatttttgatattttcactcattccccaagaggattttccctcctaaacactggtcactgataatcagaaaaaatacaaaaaaagacaatattatgtgtacgcacatgtatgaacctagatataaagttctgaaaataagccatcacactttgaattaatatagaaaatattcaaataatctgagtctcgttaaggccccaacggcaactggaaggtgttagaatagtgattaaaccatttgatcatgtgtggaaacgccttggtccaacttaaagttaaaagcctctgacacatactttgttctaaatgagaaagtcttgagttcggcaggctgtgtctctctccaccttacagcctgactctcactggcctgactgcttccagatttgctttcacctctactgttacccttttcttcatgtgaagatcaaaagtgacaagaaagagtacagctacccgtctttcagctggtagctgctgacaacttctccaaaaagaacaacacatatttctgcactattcaaggtgctgggtaaaaatggtggaaaattcctaccacaagggatttctacaaatcctggagactgatgtacatcatagcaagtctaagccttctgctctctatagagagctaaggaggcagtgagatgcaggcatttgtgctaagcaccactgtgatgtgatgatgttgcctacagtgtgagctgagggcagcagggctctcacctttcataatttgcccaaggccaagatctgaagaggtgaaaatgaattcagctctaatgtcctacgttttcaactctataatgccacctcctaccactttcttactatactgaaagaatgacataaatccaaaaggatgtatgttggtttcttttccatgtgtgttgatttagtttaatatttcagtcctgtattgcatggcagtacaatctgtagatacaggatacagggcagatttaggggataacctagattcaggatccaagttaaccttggaacaatgtcagcccaaactatgattatgtccttaagcatccctcccctctgcttcccaactggcaatattcttctttgaatatgcataaaatctgtaagataagaaagcaatggacaccttgttcaccttgaagcgtaaataagcaacctcacctttcatatctcaagggtccatttgcattttttaatggggaaattccttacttaaaaataatgaaccccctgaatttcagacgtaagttctaggcctgtcagtaaaacctctgtccctacctcctagggctgtggggggactgagttaatctatgtaaggctcccaataaacattaactgtgattatgttagcactaccccagcctatcaactgggctcatcctagattcagtgaagagcatactgtccctgggaaacagaattttttattcagtatgagtagtcctggcatcattcttgatttgacaccaagatggtccacagcaagagctatatagctcctgctttatagcttatgatccacagcaatcataataggcccgattccaattttcttctgggcagtgaactctgctcacttggcatttgcttgatggtttcggcaacacacttcagacgagaagtgcagatgcgcccactactcccttgcagcatgcacttaccgttcctactaaggggtacagaaaaccagccccaacgctggcgcggatgtcgcgaatgggcagaatgaagcctgtagggacacctttttgctctgggttgtgagacaaagacaagtgtgttttagccatgcagatggggagattcccaaagccctggggaaagaagggaagagagggaggacaaatgaaaagatgacaacccagcaatgaccatctgggccctgtgattacatggattcttcaatttattcgaaacatccaactccctttatatacatctctatcttgctgtcctccagcttatttattaagccaaaaaaaaaaaaaaagaactgttgggtgagggagttaggtactcacaactgtagtccacaagtgaatattttatttccatctatggaaataacataaaactaatttaaaataatagtttggagtagatatgagaataaaattggagagggtcaggtgcagtggttcatgcctataaattccagcactttgggagactgagatgggtggactgcttgagcccaggagttcaagaccagcctgggcaacagggcaaaaccccatctcaacaaaaaacacaaaaattagccaggtgtggtggtgcgtgcctgtaggcgcagctactcaggaggctgaggtgggaggatcgcttgagcctaggagtcagaggctgcagtgagctgaaattgtgccactgcactctagcctgggcaatggagccagaccctatctcaaaataacaaaaactggagacgttctcaatattttggtaagacattctgtatttcctcatggatttctacacattcatataacgcctatgggtaaataaagaaccagggactgtgccacctaatccaaactcagtatttcagaggagagaaggctgccacccagagaagtgaagcaacgggtayttggcagggctgggaggacccagagattgygactccaagtcctgctttgcaaagagttgaaaggacaaactaaccaaacatctacctgcttcgtgtagacttcagctttgtgttgagcttcgggaagtaattcaatgtcatctgctccatagatcttctgtgcaatgatcctgattttatcctcaactgggagctaatgcacaagaaagagatggggacaccatgactggacacatgtgaggacatttaaccaggacatagccacattctaggtcagagtccctaaaaggggcagaagatggtttttatatacatatacataagcaaatagtttgaggttgatgattgggttaagaacactttctttttgtttttttgagacggagtttcgctctgttgccaggctggagtgcaatggcgcgatctcagttcactgtaacccctgcctcccaggttcaagcgattctcctgcctcagcctcccgagtagctgggattataggcatgcgcaaccaagcccggctaattctgtatttttagtagagacggagtttctccatgttggtcaggctggtcttgaactcccaacytcaggtgatctgccagccttggcctcccaaagtgctgggattacaggtgtgagccactgcacccagccaggaacactttcttttaatatcaagcctcagattttataagtgaaaatgtcccacagaggtaaagtttttatatctatatatgcagatatacatatacacacatacatatatatatagatatagatacacatattaatatatattaaggttttaaatatatacttacataagtacatatttaaaatctctcgctaagtacatcataaacagtgttgctgactacccaagaataattatttcttcataaataaaaagtagatgttcaggctgggtatggtggctcatccctgtaatcccagcactttgggaggaggccaaggcaggaggatcacttgagcccaggagtttgaaaccagcctgggcaacatagcaacactctgtctctttaaaaaataaaaattttaaaataataataaaaattaaaaagtagatgttctattctaatactggagatcagtcctgtcaaaccagacctggggacactgtttatgaaataagacaaccaatgtccatctacataactcccagtctgtatatgagaggcagatgccacccttaacacaattgattaagtgcaagcaccaggaattaggaaatagtcataaaatcaaaatcacccaggtattagaaaaaacaacccagtgatttacatgatcaacacgcattgggcatgtccactttctgtggcacctgaagcaaacagtgcagtggacagagaccagtggtctaactggtgagggcctcagtcccatgggctgtttcctccggggcaaagccttcagagaagtggagctggcttcttaaatgctgtgtagactagttcagggcattaagattcaaagagaacagcatacggagaggttgcctaaaggaaatcagaagcaaagctactcatgggtaatttggatgagcaaattacaaaaattaggcaatatatctgtctttatagcaactaaagctaaaagaacatattaggcaggttcttatttatttgagacagagttttgcacttgttgcccaggctggagtgcaatggcgtcatctcagctcactgcaacctccgcctcccgggttcaagagattctcctgcctcagcctcccaagtagctgggatcacaggcatgggccaccatgcttggctaattttatatttttagtagagacggagtttcaccatcttggtcaggctggtctcgaactcctgaccttaggtgatccacccacctcagcttcccaaagtgctgggattacaggtgtgaccacagcgcccagccaagttttgtttttaaaaggagcaataatctatctataaaaacaaaaattcccttttgaactaaacaatgataatttatgaaggggctttatataatgggcatgaataaagtgaacattcaataaggactttataaagatgaaacacagattattttcatatgcatctcataactggagctctataaatgccaaggcacatttagaacttctgaagcaaaagcactttggttgaagggtgatttaagactagcagacgctgagtaagacaaaaagtggcagcctcctgtttgccagaatggataaaagttgcaagtagaaaygggttctaaagtccatatgtccctgctctttcaggtctcctgctggttttcaaggactgggcttccagccttgggtgctatgcattggagcctggagagggtgcctataaatgctttgcatttgtgtgcaaatttgtgtttatggcatttttctaaaaggatgattgctgaacagattttaaaacttgcctataaaatcaaagctcaacaggagaatgtcaatgtcaatgttaattaactgtaagtgtattatatctgcaaggggcaaagagaaataagagaacactaaaactcaagagtaataagtttattccttctgcttttttatggctgtttttgaaagtctatgattatctattaaaaaccaagccaggccaggcacattggctcatgcctataatcccagcactttgggaggctgaggcaggaggatcacttgaacccaggagttcgagaccagcctgagcaatatagggagacccagtcactacaagaaaaataaaataaaataaaacaaaattttttttttgagacgaagtttcgcacttgttgcccaggctagagtgcagtgatctcagctcattgcaacgtccgcctcccgggttcaagcgattctcctgcctcagccttccaagtagctgggattacaggtgcctgccaccacacccagctaattttttgtatttttagtagagatggggtttcaccatgttggccaggctggtctccaactcttgaccttaggtgatccacccacctcggcctcccaaagtgctggggttacaggggtgagccactgtgcctggccaataaaacaaattagccaggcttggtagtacatgtctgtggtcccacctactcagggggctgaggtgggaggaccacttgggtccaggaggttgaggctgcagtgtgccatgattgtaccactgcactccagcctgagcaacagagcaagaccctgtcttaaaacaaaaaacaaaacaaaaaaatcaagccagaaactagcctagagaataggaaaaattaactacagcatatatctcatattcctaacaaagtttccagttgttgtttccatactacttaatgtcaaatcacatcctgaaatacactggacagataaatgaaaacaaaacacaaccctataataagaaccttttcctgaactaactttattgtatcatagagtaagcagggctctacttagaccaggtgtaatttaatttgcttagtgatggaaaaaatgatgaagcttcctggagtactttggttttgcatgtgagggccctcaacttgaggcagcaccttaccaggaagtgaacgtgggggcacacttctttcccctattactgaaaagccatcagaaaaattttgtaagctcgatgcagccccttaccaatctgctacatggttggtgccttgttttaaaggctacagtgaattacatatttggtctatatgtaaccttctcttctgccacctgtactttgacccttttcgaagttaggatatgagcaacggttccccctccaccctggggtattcctgcttaaatcccctctgtaagtaagcagtggcatatgtttataagaaggctgtctgggcggacgcagtggctcacgcctgtaattccagcactttgggaggccaaggcaggtggatcacgaggtcaggagttcgagaccagcctggccaagatggtgaaaccccrtctctactaaaaaaataagaaaaattagctgggcacggtggcagacgcctgtaatcccagctacttgggaagctgaggcaggagaatcacttgaacccaggaggcagaggttgcagtgagctgagatcatgcctctgcactcgagcctgggcaaaagagcaagactccgtctcaaaaataaaaagaaggctgtctacagctgggagtccaggctgtggttgtgtaagtcacctacgtgggaatcaaaccgcaaggctgaagctgcgaagcatggggctctaatagaagtagccacacagaaacttcactgtgcccttttcgtcttttttctttttttgcagacagcaaatcacccaccttgaggtcataaaggagctggaagctgctgggtgcttgtgctgctctctggacggcctgagccagggctaaggcacmcttgcccccttctgcccagtgagtgcacttcacggcatcaaaagccccatgttctctggaaaggcggctgatgaggtccagctcagactctgtatccgtcctataaaggaagcatttcatatcaaagcatggaaaatggctggagagacagaattgtcttctttttgccattaaacctcatgtgaattacccactgataaacgaacactaaccaagaaatttggcctgggtttgaatctcagctccgaaacttactagctggtgacttttggccagttacctaatctttatgtgcctcaatttccaccctggtaatacgcgaataatcacagcacttatttcattgggacgttatgagactcagatggtaaatccatgtaaaatacttggaaaattcccagcactccagaaggaatcagtaaatactagcatttaagaattttgctggctgggcgcggtggctcacacttgtaatcccaacactttgggaggccgaggtgggagaatcacgaggtcaggagatcgagaccatcctggctaacacggtgaaaccccgtctctactaaaaatacaaaaaattagctgggcatggtggcaggcacctgtagtcccagctactagggaggctgaggcaggagaatggcatgaacccgggaggcagagcttgcagcgagtggagatcgtgccactgcactccagcctgggcaacagagacagacttcgtcccccaaaaaaaaaaaaaagattttttgcttcccattctactacggtgaggccattataacaaaaccctgaccaccaatgcaatacctaaacaacccacacaagttcttgcatgaccccttccagagtaatatgcccaattctttgtcaagacaacatcccaccagatctagtaaaataatggaacactataggcctatgaccttctgttagcataaaaggcctctaaagatgaaaaaggaacattgaacttcaggcttgtgtgttacttcccccagtggaaaggaaaagggcccataggagctgaatctgactttgggaccctcagtgggtgaggtggtgagcccgcagtgacgtatgcaatgcctgtcacagtgcaggctaaaaccacaggctataaccaatagcagtaactgaaaaacaaaataaagctaaaagcagtgctgtacaatcagctccaggagattttccacattcatccttttcgcttacactctacacttacttgaatgcattcacggccactactactggaattccaaacattctggcattttcaatttgtttcttcaagttactgaagcctttttcaaccagctccaggttctgtaaaaacaacagtgaaaggcctatgagatcagagagttgaaaaccactgcaggttcttcttcaaaggcaaacaacctccttgagccagcagccactcactatcaggacaaggaggccaagaaagaagagagaaggtcccttggtgcattttttccagtgcggtgagtggatgctatggagaactgcagctttcactccagcctatgacactagagtagagctctgcttgtttcccagccttcaagaaaaaaagagctggtatgtttcctgtcattatgccacatcattatagcttatttgctgtttgaaaggaattagttacccttacccaaattatatttaccaattgtgtttatagattttatgtattcatagggttatgataatacaaattaactctactctgcacagcacagacccttccatcagaagacagagcctaacaacatagtggctggcacagaagaggtattcgttatatggctgccgtaaatactgccaggaaatatgaagtaagcagtgatgttttcaaaggttttaatgaactcgaccgtgaacgagggcaagaaataagataaatactatctttaggaatcaggccagtggctgggcccagtggctcacacttgtaatcccaggactttgggaggctgaggcaggagaatccacttgagcccaggagtttgagacaagcctaggaaacataacaagaccccatctctacaactgagaagttaattaaaaaaaaaaaaaaaaaaagggccggacctggtggcttatgcctgtcatcccagcactttggggggccgaggcaggtggatcacaaggtcaagagattaagactatactggccaacatggtgaaaccccgtatctattaaaaatataaaaattaactaggtgtggtggcaggaacctgtagtcccagctgcttgggaggctgagggaggagaatcacttgaaccccagaggcggaggttgcagtgagttgaaattgcaccactgcactccagcctggtgacagagcaagactctgtctcaaaaaaaaaaaaaaaaaaaaaaaaagaactgagctggatgtggtagctcacacctgtaatcccagtactttgcgaggctgagatcggaggatcacttgcacctaggagttcgacagcagcctgcctgggcaacatagggagaccccgtctctacaaaaaattaaaaaattagcctggtgtggtggcgtgttcctgttcttccagctagttgggaggttgaagcggggagactgcttaagcccaagagttagaggctgcagctatgatcacgcctctgcagtccagcctaggtgacagagtgagaccctgtctgtaaaaaaaaccccaaaaaccggctgggcgtggtggctcatgcctgtaatcccagcactttgggaggccgaggcgggtggaacacgaggtcaggagatcgagaccatcctggctaacacggtgaaaccccgtctcaactaaaaatacaaaaaaattagccggacatgatggtgggtgcttgtagtcgcagcttcttgggaggctgaggcaggagaatggtgtgaacccaggaggcggagcttgcagtgagccgagatcacaccactgcactccagcctgggtaatagagccagactccatctcaaaacaaaacaaaacaaaaaaacccaccaaaaaccaagtactacaaactaaagggaagcaattaaggaaatgtatctttaagtatgtttactgcagccctgcttgtagcattggaaaattataaacataaacctcctccaagggggactgggccaatgaattatgacatatacactcaataaatatttatcatgcagatgttatgaaagtgagacccatctgtgttaacatggaacctgtccaagatgtactaaaggtgcaaaaccatggagagcttaattattccattttaggacaaacacaaaaatacatgtatataattcatgaaaaatttttaaatgtcgagaaatatgcaccgaactgttaaggggactcaactcacatatattacattcttataatgtttaattattattttttacaaagggtatattactattgtaggcttaacaatacattaaatattttaaaaataaaagagtcttctataaaaatacatatactgaatcatcgagcaaaacccagcactaatgtttgttgatcccaaaaaagcagaaataggtaggataaaaggtggaaaacaactaggttcattataaatgtgatttatgcttttttcctttaataattgaaaactgagattatgatttatttgagcttctaaagaacactgctaattctttacctctagtcacatgaaaaccaattaatatgtaacgctgatcaagaacagttttaaataagtagaatttcttaaatgaagacaccagctgggccagctaggggcagtcactgtaattagacacaggaaaggctgtggggtggcaggagggccagaactgtgaattcccctcctacgcgtgaatcagacaaatgaccataaaaggcaaaccataactcagaagacaggcagactgaaggtaccagcaattttttctagccagttttgaaatacttcatttggggcctgaacagtgaccctgtattgcttgataatttaaaagccttccaaaaaggcagaaaaattgaattagcagtgacagcaggtgaccttgccaccttatctgatggcctgtctttcctgtaaccaccccaaactggctttagagatgtttctttgatggtaaatgacataaatatgaaaagatttgagctcacagttgttctctagcctcctgtttgatgctataaatatccaggaagctttgtctagaaaaacaaccagaatcctgaccatatatcttggcccgttaatatggatttaaatcggcagaggagaagccatttcaaaaaaggtctctacttgcttctgatctgaatggcatttggaacttacccagccaatgcagggaagacaatggaagggaactgctattagtctaggacagggtttctcagcctcacactccgacatttgagctggataatgttgtaggggctgtcctgtgcattaaaggatgtttagccagcatccccagtttctacccactagattccagtagcactccccacctccagttgtaataataaaaaaagtctctagacattgccaaatgtccccggggtcaaaatcagctgttgagaatcaaccactggtctagggcagtggcttattgacaccctatgtgggacaattctattttgtgaggtgcatcttccctatctactcatttaatataactcctcagcacactgcaggccttttggcaccctgcaccctgggtcacagcaataacccattcatttccacatgggccaggtggagaaatgctgattcaaggtgtggtgctttctaggacacgtgatgagaaataactcaggttacctcctgtatgtaagccttgggaagaggcagtccagcagtgacctggaaggaaaagaaacagagtcagaggcatttcctatttaaatctcctagcttaaaatggtgcttttcatgtgttaaaggcaagacgctgcaatgcttgcaggctgtacagtagtataagattatttcctgccctaaggacttagggtatgtgaccaatcacacagcacagaacaaaatcgactgctttgggcagcgtggaagacctctatgacctgaattaaggaggtgagaaggaccggatcgatggcaggagaggtggaaaggggtgtaccaagcaggtgcagtgactcgagtgaaggccatagcagtggggttggaagtcaaggggagtgtggggaaagaggaagcggtcgggcctgcggaagtcaccctgggatgtctgtcgatagagcccgtgatgagccctgccatggtttcatgaactggtccacagtgccaacctagcattggtggagctgaaccgtggtgcagggtcaatacaaacaagagggaaaacaatacagaaggattttctttctcttttgtagagtatatctaaaggatggaggtgtctggtgcctccccgccccgccccccagcccccagtcttgatctatgccgtggctcagccctgttgcatccacagaaatgagcaaatgggtgaaggtgtccatttcatgggccccaccatgggcagtggatagtgattaagaagctctgccctcttccattgcagtgagactatgtgctccaactccagaaggggctgtgtggaggcagagcaagaagcaaggaccttacaggtagcttcccgtcagcaagctaatgagagcaggaggcctactctcttgacagagccatatgtgcaaatgttcccctccatgcacagcattatgggacattatcctgactgtgaggtcaggaggaagcaaggaaaggaggtgtgatggtgtgagggtgagtgaggggtgtaagagagaggaatgttagttgtgactgggaaaaaaaagggagtctatcctgtgctactagcagaaaggagtgtgctgggttgggagtgcctttggcactcagggataactaagactggataggggtgctggggttgttatggcagcattcccagtgtgctccggggacccaatcctttgaaggggtccatgaagtcaaaactatttccataagattctgtaacatcttatggcccttttactctcattatcattctctcattgagcatataatggacttttccaaaggttatgagacatgtgatgtcacaacagatcaagtgctgtcttcaattaagccagacccagagaagatctgaaaaatgtacaatgcctaaattttgctgggaaaagataatgcattttcatgtttacaaagttctttatgtttacatgtaactcagtttt

SEQ ID NO: 17805 - DNA, 83712 bp, Homo sapiens
ctgacggatctcctgaggtcaggagtttgagaccagcctgaccaacatggtgaaaccctgctgtactaaaaatgcaaaaattagctgggcatggtggcacatgcctgtaatcccagctacttgggaggctgaggcaggaggattgattgaacccaggaggcagaggttgcagtgagctgagatcgcaccactgcactccagtctgggcaacagagcaagactccatctcaaaacaaacaaacaaacaaacaaacaaaaaaagcttaaaaattaaattctggtgtaaaagacaggtagcaaacaaaaatataaagaaataaagtcattttagatggtagtaagtgctatgaataaaacaggttaatgagatagtaatggggatgtagatggagaggtaacttttgatagtgtaatcaaagaaggcctttttttggatatagcaacataatattatacattttattaacctgtctttatcatttaaaaatgtataaaagctggtcacgcgtggtgggtgatgcctgtaatcccaacacttttggaggtgggtggatcacctgaggtcaggagtttgagacaagcctcgccaatatggcgaaaccctgtctctactaaacatacaaaaattacctgggcgtggtggcgggcgcctgtattcccagcttactcaggaggctgaggcaggagaatcacttgaacctgagaagcggagcctagatctcaccattgcattccagcctgggtgacaagaacgaaattccatctcaaaaaaaaaagtatgaaagctatcttacatgtctatacatatgtatctgctgttcctttaacaactgcatccatcctgacagaaattttgttttttgctattgaaatcagtgttgtgattaacagttttacacatggtttttttgttttgtttagttttagtttttgtttttttgagatggagtttcgcttttgttgctcaggctggagtgcaatggtgtaatcttggctcactgcaaccttcgtctcctgggtttaagctatcctcctgcctcagcctcccgagtagctgggattacaggggctggccaccacgcccagctaatttttgtatttttagtagagatggggtttcgccatgttagccaggttggtcttgaactcctgacctcagttgatccaccagcctcggccttccaaagtgctgggattacaggcgtgaaccactgcacccagcctatacatctttctttatatgtaaatattactttaagataaattcctaaactgggagaggtggctcacgcctgtaatcccaacgttttggaaggtcaaggtgggaggatggtttgaggccaggagttggagaccagtctgggcaacatagcaagactatctctacaggaaaattttttaattaatcaggggtggtggcatgtgcctatagtcccaactactcagaaggatcactttagcccaggagttcagggttgcagtgagctgattgtgttactgcactccagcctgggtgacagagtaaaatcctgtccaaaaaaaaaaaatcctggaagtggaattacaatgtcaaagaaaatacaaatttaaaattttcgggccaggtatggtggttcacacctgtaccaatcccagcactttgggaggccaaggaaggcagatcacgaggtcaagattgagaccatcctggccaacatggtgaaaccccgtctctactaaaaatacaaaaattagctgggtgtggtggcgcccacctgtagtcccagctacttgggaggctgaggcagaagaattgcttgaacctgggaggcggaggtttcagtgagccgagatcatgccactgcactccagcctggtgacagagcgactcaaaaaaaaaaacatttttttcccgtagatattatcatatcaaattacccctgaaaaaggttgtaaaaacggggcctctgcaaaaagtaaacattttttctagcaactgcctttataagcatttaaataaaaatattttttccttctatttgctgtgaaaggttgattttcattctttatttgaccaatttgcaacacttgacagaattaattacctctttttccatgaaacacattcttcacttgtcttgttttttttttttgtttgtttacttgtttgtttttgagacagagtctcactctgttgctcaggctggagtgcagtggcactatctcggctcactgcaaactctgccccctgagttcaagcagttctcctgcctcagcctccctagtagctgggattacaggcacgcgctaccacacctggctaatttttgtatttttatagagacggaggtttcgccatgtttgtcaggctggtctagaactcctgacctcaagtgatccacccaccttggcctcccaaagtgctgggattacaggcatgagacaccatgccaggcctcctcacttgtcttctaaggtgggatgctcttggggttttccttagaacacactggactctcctttccttttaagagacagggtcttgctctgttgcctaggttggagtgcagtgtgatgattatagcttactgaagtttccaactcctaggctcacaggatcctcccacctcagccttctgagtaactgggactacaggtacatgccaccacgcccagctaactttttaaatttttatttatttatttattttgagatggagtctcgctctgtctcccaggctggagtgcagtggcgtgatctcggctcactgcaacctctgcctcctaggttcaagggattctcctgcctcggcctcccgagtagctgggattacaggtgccagccatcacgcccagctaatttttgtatttttagtagagacggggtttcactgtgttggccaagttggtctcaaactcctgacctcagctgatccacccacctcggcctccaaaatgctcggattacaggcaaattttttaatttttatttttgtagagacagggtcttgctatgttgctaaggctgttctacaaactcctggattcaagtgatcttcctgtatttggtctcccaaagtgctgggattagtaaaggtgtagccacagctcccagctggactctccttttcaatcttccctcttggttcctcctgtctccttgcattctgaacactgaaaggttctaggtgtcagtctttggtcctctctctacctacaatacccttggttggatctcattcaatcccatggatttaaatatcttctctccatttggatgtctaagagaaatctaaaaatgtctaaagccgaattcataatcttaaccccaaaacctagtcctacattttactttatttcaactcagcgaatggcaattccatctttccagttgctcagagcaaatccctgctttctttcttttacattccaagttcctctcttcattaaggtttctgctgaagtcagatgcccaaagaaatctcttaccacatttctgagacaaaactttcccacctcccagcatcactgcctatcctcttagcttgcctatttttaaaatatagcatgtcataatctctaaaattagcctatgtatttctttaacttgatcgttgtctcctccaccagaatatgagctgagagcagaaactttgctggttcactagggtatctctagcatctatagcagtgctgttggcatagtggccactcaataattatttgctccatgaatgaacgatttatgcaactcatacatagataactgtcaaaaaccaggctgttgagatggcaaaggcagtagatttagagaagaaacatcaggtttggggcctataccagccacagctatgcagctttgggtattatccttcaaagtctatccctctgtaaaatgggatttctgccatcttcctcaacaaataagaaagctggaatagtcaatacctatttgatagtataagacaaaagattcactatctgcaatttaccagaaacatttccttcaattttcttcttaatttcacttgtttaggtacaacacaatatgagacaatgtgttttagggttattattataatgacattatattactaagtctgtgcctttaacatatcacttgtgcaaactttaagaatagtaactttaaggccacgcacggtggctcatgcccattatcccagcattttgggaggccaagggagactaatcccttgagatctagaccagtctggtcaacatagtgaaaccccaactctaccaaaaatagaaaaattagccggcgtggtggcatgcacctgtggtccaagctactcggggggctgaggtgggaggatcatttgaacccgggaggcagaggctacaaagagcggagatcatgccactgcactccaccctgagcgacatagcgagactccgtctcaaaaacaaaaaaacatatattagaaataattaccagaaatagaaaatcacaagagattatctaatcccgtatatggggctactataaataacctcagaatttagaaataagaaaaaaatattaaaagccccaaaattaataaaaaatcagttttaggccaggtgcggtggctcacgcctgtaatcccagcactctgggaggccgaggcgggtggatcacgaggtcaggagttcaagaccatcctagccaagatggtgaaaccccgtctctactaaaaatacaaaaattagccgggcgtggtggcgggctaattaggtggtgcctgtaatcccagctactcgggaggctgaggcagagaactgcttgaacccgggaagcggaggttgcagtgagccaaaatcgtgccactgcactccagcctgggcgacagaatgagactccgtctcaaacaaacaaacaaaaaaagttttagatgagctctgccagtagtaaacggcttgtaaaagaaacccggtatctggtcaagtcctaagtgacctgaaccacgcatcttcaggactctactgggatgactgtaacctgaacgcggttcctagagcagagcaagcatattccttggactcagtaacacaaggggccagtcctctccagcatcccagctgccaccgccctgtcaggctccccaggcaattgtccatcttactccttctccagcgtggacgcttaaggggagggagcatccctcctcgagggtcaactggcatgtagcttacgaagaccgcgtgagttctccaaccccagacttgctgcggggcggggacgtgggggtgacaaaatccagactacgaccctccatgagccctggcaaccccggggtgaccccaacaccgatgaggccacgcgcgctccagctctgacactccttccagatcggcggggcctgaaacagcgggctaagcttcacctacggctgagcgtcagattcagctgaggagattctaaaagcgctatgctgggcccagacccaggccctccagagcagaacgcggaggggcccgaccccagtctggtggcgtaggtgtgtgacaaagtatgagggcgcgccaagctctccagttccacatctgctgtcgagtccagcgcctgccacgctcccgtgcggggacccgcccaaaactccctggaagccaggcgattcagaccccgccaccgcgtccccagagactgggcggaaaccggagactcgcctcccgaacccgcgaaactatctcccgcgagactgccccgccccaaccccgccccgcaactctactccctgattggctggaattacggccggattccggagtcctttccagctccctcttcggccgggtttcccgccgaatacaaaggcgcactgtgaactggctctttctttccgccaatcatttccgccagccattcatcaccgattttcttcatcttcccctccctcttccgtcccgcagtccccgacctgttagctctcggttagttaagggactcgggtccttccgaactgcgcatgcgccaccgcgtctgcagggggagaagcgggcaggggcgcaggcgcagtagtgtgatccccyggccagtccctaagcacgtgggttgggttgtcctgcttggctgcggagggagtggaacctcgatattggtggtgtccatcgtgggcagcggactaataaaggccatggcgccagcagaaatcctgaacgggaaggagatctccgcgtaagcacctgacattgttgttgagtgtggggctgtggacgagggctctgagggtgtgcaggtcccccggacccattttttgcgggagggacacttgtagcggaagagttaggcccataacacctgaagacctgcagccaaagaaagagaacccgggcacaacctgcgtttgcaagtggactgcctagtggctgtagccgctggctcctgtgcttcggggaaaagtcctgtgccgactrtgctcccaaacgcgcagctgctggtgactttctgccgggagagtgggtagttgcggcttcctggagcccccctagtcagaactcagaaatccaatctacttaattcccgttaatttggaggtgagtagatggagactagtgaggtgacaaggcttgacaagactacaaggctgataatgacagagggtccttccagctcatagcttttcccactataccatagtcttatcatacgctaagtgaaatctaatacatttttcctttctcttcaatctcgtgcttctctctaacagccrtctctctgccctggtcctagagttacttgaaacgtaatttggctcctgagtcctgagaatattctgcattccwcttgacctctgcctgttctacccttgcgggacatctgaatgcttaattagtgggtatcgttgccagctttactcccaggaagtaacactggctgctttttgtctgggaggtgactggtgaggaaaaatgagagtagaaggaagagggaaaaatatattccctctagtagatgaaggagggaaagatatattctgtgtgaccttactgagtttgctcttgggacctttcacatcacccgttatgtaagtaactgttgccagccacagcagttactaaattgtaattgtcctgtaactcctaactttgtaataggtttttgagtgaattacaaagtcatcggtggtgaaaagtccgggcccagtggctcatgcctgtaatcccagcactttgggaggccgaggtgggtggatcacctgaggtctggagttcaagaccagcctatccaaaatggtgaaaccccatctctactaaaaatacaaaaaattagccgagtgtggtggcaggcatctgtaatcccagctacttgggaggctgaggcaggagaatcacttgaacctggggggcagaggttgcagtgagctgagatgcgccattgcactccagcctgggcaacaagagcgaaactccgtctaagaaaaaaaaaaaaagaaatcacaatacttactgcttagtgcttttcaacatgtggcttgctaaactgtatttctgctttactttctgtttttgtttgcttgtattcaaacttacttccttttccagtggctttttgttttaatataaaaatcttccttttagaaagactgattgtgaagagataatttagtgcataataatagtgcagataatttagtacaataataatgcatctgggccagtactgagaataggtgctcactgaatatactttcgttaattggagagcaaattaaatatgtttatcaactccataagggcaaatacatgtattgtcttatttttgtctatatcctaaacacctggaaaccctgtttcctgccttactacttgtgtggttttaagcaaattaattaacctttctgtgccaaagtttcctcaaatgttaagtaaaagtaatgtctaggtcattgggatgttagtagaattaaatgggttcctaacagatgatcatttataattcttcctggcacataataagtattcgatatatgttgtattaataatcagtaattagttaatgtatatatgaatgattcattatctttttttttttttacatggtagctgctgccttgagatctatttttttttttgagatgaagtctkgctgtgtccaatcttggctcactgcaacctctgcctcctgcatacaagcaattctctcatatcagcctcctgagtacctgggattacaggtgcccgccatcacgcctagctaatttttttttttgagatggagtttcactcgtcgcccagactggagtacaatggcrtgatctcggctcactgcaacctctgcctcctgggttcaagcgattctcctgcctcagcctcccaagtagctgggattacaggcgtccgccaccatgtccagctagtttgtttgtttgtttgagacagagtttcactcttgttgcccaggctggagtgcaatggcatgatcttggctcactgcaacctccacctcccaggttcaagcgattctcctgcctcagcctcccgagtagctgagactacaggtgtgtgccaccccgtccggctaatttttgtatttttagtagagacgggctttcaccatgttggtcaggctggtctgtaactcctgaccccatgtgatccacccacctcggcctcccaaagtgctgggattacaggcatgagccactgcaccggtcctagaatttcttaaaaatccagcccacttcccacattccatcctgcggattaggaaatcatttgaggccagaaaagtgatgtgatttgtccaagggtgaatggcaatggctcaactaaaactaaggtcttcacccagtatatgatgtttttcattctaaccagcacttactacttgctaaaaggaatttcgtaagcttttctttttcttttctttctttctttctttttatttttcagacaaggtcttgctctgttgctcaggctggagtgcaatggcacgatgttgtctcactgtaacctccacttcctgggttcaaacgattctcctgcctcagcctcccaggtagctgggactacgggcatgcactactatgcccggctaatttttgaatttttagtagagatggggtttcgccatgttggtcaagctggtcttgaactcctgacctcaagtgatctgtccacctccacctcctaaagtgctaggattacaggtgtgagccactgcgcccccgctggcgctttgctttttctttacagtcttcctctcattagcatgtttcccaccctgctgagaatgctatccctgactcgtcctcttctattattattctccttttatgccttcctgggagctcggacatcaacaaagttcagcattccagattccttctctacctgctctactctgtgggaaactgggtacttacatgatggatttagttgccaaattatctttctttggaagtaacagccccttttctccctcacggggaattctaagtttgcagcctgaatttgacaaccgggggaaggtctgagagttagagacaagtatctgttctttgtgggtatttattcacttactcaacaagtagctgtatgtgtcccctaagccaggcaatcttcaaagctctgagagtctaatagtgaacaaaacagcccaaatccctaccctcatgaaacttgcatactgatgggtagagacagacatttaaataggtgaaacacattgtgagctggtgggaagcacaaagagaacaccagagcagaaaagagggacaggagtttctgtggtatggtggctgcaattttaaatatgggagtcatagtctttgtaaaagtgacttacgggcaaagacttgaaggaggtggagccttaagcctgccaatgttgtgagggaaatagctcctgaccaaaaacacagcctgtgccatagacctttgtcctcaccagttactaacttactgctttggggggtcaatggcaatggccctgtgagaagctgaccgagtggaggctcctgagtagaggaacctgaccctgccctgggcagaagggtggtgtcttttaaaagattatgcaaagtgggagaaggatgtgcattagtgttggaagacccaccttgctttgtaggcaagaaagcatagttgttctataagtgggcctttcaaaggggggcttactacatttatatgatttgtttggtttttccttcccttagtttgctataattaagcctgytctctccattggtggcatttttcttgattaagtctcctttctaaagagactggttgtgaagaggcagatggtttgagtaggtgctgcgagtgtttgctggcsaagtgcagggcaagttgggtatatttgtaagctcgctgtggatggtagctccagagcctaagcacggtgctgcctcctctgtgcatcactgggtcatgcaatttacctctgtgccttagcttctgtatattggggtagtaatgtcacctaactcataaggttgttagaattaaatgagtttaatacctataaagcatttagagaagttgttggtacatggtaagttttaataaataggtacttagaaagtactcattgaataaaaaagtgatgtttgtgtttatccaggctgtacctttgggagctggcttataatcttgagacttaaaattagaatttatcctagtgatcaaagataaaagtttggaaccttggctgtacatttagctacagggctagaagaactgtttttgtgaaaataatttgcttaccatagtgaagggcaggtcttcttggttactaagttaacatggataagacttttactttgtcctgtagattaaatacatgtaggcccttttgtgcttaaaaagatttgtctgggcagggcgtggtggctcatgcctgtaatcctaggactttgggaggccsaggcaggaggatcacctgagatcaggagttggagaccagcctgactaacatggtgaaaccccatctctactaaaaatacaaaattagctgggcatggtggcccatgcctgtaatcccagctactccagaggctgagacaggagaatggcttgaacctgggaggaggaggttgcagtgagccagtgagccaagatggcgccattgcactccagcctgggcaacaagagcaaaacttcatctcagaaagaaaaaaaaaaaaaatttgcctgtaatgaactccaaagtgcaggttgctcaaaagttacatggaaacttgactgtcatagctggattgattctggaagcctgtgcaggagaggtcggagttccagagaggctgggaccttcagctaggaccccagccaggctgttgggcaggttgcagcgatagtgcagcagagcccagagctggcagccaactactatggtcatggcacctgattggggatgtggtttgcaaataagtgtctgtccttgtccatcaggggagttgggatcaggcagtttgggatttgggtagtggggttttgagcagaggtctgtggttccctgttacatcccctatttgcatgaagaatcttctagaaggaaagctggcctagtacagaggagggtccttggagtggaagcaaatggctcccttctcctctaattgactcagtagaggttggtagaatagaggttaaggggcagggatgcttgtgtggccttggaaaagttagcttcactttcctttctgtgcagtagggatgatgagaactgtctacttcctgacgttgccccaaggattaaaagaatgtaagactctcaaaacaagcttctttgacgtcccatccacagtgcagaaggcccccattacccctgcactgtgcggttggctctcctttgcaccccttaattgaccaaaaagcagcttctgtcaccctgtaaatccttgaccttgaagaagtgggtggctaaaggtgccacagtcaagattcctcagccactcggctactacccttaccctcaattttgcagtttatgacactttagccagaagctaagtgacttgcccaggtgttccaaggtaggtggcagaggctcgatggtgcatttctttccctaccatgggcttgtcattggcttgctagaaggaattgcaaacttctaccctccagcaggagacaccctgggtttggttctccctgaggcctttccattgtgaggaaatcattccacccatcagtctggttgggaagcacccaaacagattctcttcaaaaagtcatttttgaagttatagtccaattttgactggttagagacaggtcagacctacttactttgctggctaagctttttttttttctttgcccctcaccacaagcctggacgggagacgtactgcttggtatctggtgcttgagaggtcccaggagataagggagcatttctgtgaaaggttttgccagagcctgtcargaacttaatcttgactgcaatgaatgacttaacattataagtgatctttgggtttaggtgcccaaataccagtccctccttartaagcagccttttagacctaaccttttctacctaaggttttgttcagtctttttgaaaagcaggaaggccaggtccttgtgaggcttttctcattacaagctcttggcaggttcttccctccaagtggagaacccttaccttccccattctttctaccttcccctctgatgatccagagggctgcaagggacctagagctgttcattggagccctagtcagctctagcggccagatctatggttaggtaatcctccaatagtgagactaattctcagtgttagaattaggggtctgcctgttctcaccagcagacccactggcatcaactctcctttgttgacatatagttaagcaccgcttcttacagatcctcatactcagagccaaccttgtcttgtctcataactcttgctactggcagaaggtgataaaattgtggcctagaggccaaatgttttttgtttggcttacagaattagattacttctcaacacatttattactttacaacattagattacttcttaacacacttatgcctgtagttacacataaaaatctggatgcttgactttttgaaagatgtgaacagtttagcaatactgtactgtctatcttcatgccatcaatttgttggatctgagtagatgctgcctaccccctcatccttgagtgggtgggggtgggggaggtgggacctcattgttcaggaatcctaccacacttggttgcctgtaccaggactccgaaggttctttcctctttgagacctttttctgaatgaacttatggtccacttttaaaatcctaaattttataaagccttaaccagtccaacctagtccgtttattgcattagatcagaggttgtcaaatggggcagttttttcctccctctacctcagggcattgggcatgcctggagtcttttgggttgtcatatggggaaggggtatgctattggcatctagcagtagaggccaggactggtgccgagcatcctgcagtgcacaggatagtccccataacaaaggatgatctggtccaaatgtcagtggtgctgagatcgaaaaaccctgatcragaagcttaatgtgagttattgtgtcattgtgtgtgtggattaatgatggactttaccctcactaagaattataggattcattaaaattttacactattctgacttattttcatgtcataaatatcaagcagtttacctttgctttcttagggctttgagttagagacaattggatggaagaactttacattataaactttcaatgaagcataaaatagcttcctcacattaagctttcaaatacgtatttgaggtaactgtcaaatttggtaaatgtctgggttaaattataataatttttttagtaaatattcttatgtaataatagtactattatcagttgactgtcttgtatactgatatagcttttgctatattagtgataggtgaaaatcagttttctttcaacaagaaggtaatttagtgttttaatttgacttaaatgactagcaatttgaaatatatgtatttcttggaacactaggtggccttacaatcacaattatttttacaaggaactacatattaagtttttaaaaattttttgaaggttttttttttttttttttgagatggagtttcactcttgttgcctaggctggagtgcaatggcgcgatctcggttcaccgcaacctctgcctcccgggttcaagcgattcccgtgcctcagcctcccgagtagctgggattacaggcatgcgccaccgctcccagttaatttttttttttttttttttgtatttttagtagagacggggtttcaccgctcaggctgtgtcaaaccccccagctcaggtgatccacccacctcagcctcccaaagtgctgggattataggcgtgagccaccgtgcccagccgaagtattttttagtagtataaaaattgttaatgaacaaatgaaataaatcaacaaatgaacaaaatgggaataaaacatattaaataaaacatttgtgttctgcattttaaaaatcttataatagctgggcgccgtggctcactcctgtaatcccagcactttgggaggccgaggagggcagatcacgaggtcaggagatcgagaccatcttggctaacacggtgaaaccccgtctctactaaaaaatacaaaaaattagctgggcgtggtggcgggcgcctgtagtcccagctacttgggaggctgaggcaggagaatggcttgaacccgggaggcggagcttgcagtgagccgagatcgcgccactgcactccagcctgggagacggagggagactgcgtctcaaaaaaaaaaaaaaaaaaaaaaaaaaaaaaaaaaatatatatatatatatatatatatatatatatatatatatatatatatatataaaacagtaatctattggggcaggggataaattgtgtccttgtttagaagaagactttttttttttttaaaaaaagccctgttgtttttgttgttgttatttgtttgtttgtttgttttgagacggagtctcagtgggtcgcccaggctggagtgcagtggcgcgatctctgctcaccgcaacctccgcctcccgggttcaagcgattctcctgcctcagcctcctgagtagctgagactacaggcgcgtgccaccacgcctggctgatttttcgtattttttagtggagacggggtttcaccatattggccaggctggtctcgaactcctgacctcgtgatctgcctgccttggcctcccaaagtgctgggattgcaggcgtgagccatcatgcccggcccgaagccctgtattttgaaggtgaatgtttttgcttcttctctgatcagttactaaaagtgttttccctgtgccatttgagaattatttgagaactactctaagcttatggcacatttcagcatttttgttgtctaaaggcagctttattttaatcatgtaaatttcatgctgcctcctttgcctaccatatagcttctgttgaaatgtccatgttatattttattttatttactcatttttctatatccataataagagttaaaggttatattttagcaatgtgtttttttctctgtcataacatgttaaatattttaaattcagccatgatgttaaacagagtgaattggaatttctaacggatttcggcaggaatgattatataagacttagggccaaagagagcctgggtgactgtgtaggggtattaggctatgcccagcaccacatctggttgtcattcaggggagcagctagggctggaactgctggggagtgcaaactgcagtattccctgttcccttgtctcagagcagaattgtggcctctatccaggtccaatcccagttaaaaaaaaaattccaatggtctattcttcttttgagctatattattgtagagaatactgacttgaaaaaacaaagtcactaactagaaataaaatttgagctgggtgcagtggcttataactgtaatcccagcacttttgggaggccaaggtgggaggatcacttgagctcaggagttcaagatcagcctgggcaacatggcaaaatcccatctctacaaaaaatacaaaaattagctgaagtgtggtggtgtgcacctgtagttccagctacttgggaggctgaagtgggaggatggcttgagcccaggaggtggaggttgcagtgagctgtgattgcatcactgcactccagcctgggtgatagagccagaccctgtctcaaaaaataaaataaataaataaaaatcaaaataaataaaatttgaaaatcttgggtatgacttctttcttgtaccattcaacattcttgatgtttactaggccagtccaaataatctatttcttgtgtgcctgtttatgtcagttttttgtgacgtgtggagaagtggaactgggagtaaccaaatcagaatgaaggaagagctgtttgtgaatgtccatatgacaaatgacaaaactggttttccaagagggacagagcatgttcaagttgaacattgtatcatatatcataactgggcaaggttgagctattcagatatgtatttatggatgtaatttcatttacttgacatcctagtgtattgttgagaagttgtatgttggtaaattgatcatcttagttttgcaagaggttatactttctttcactctaataaggagactgcaggaggttatacttttagccttgtgttaaattctttgtaaagaaaattcttttgtgaattagaatataatttgtaagtttatactgaatttggagtgggattcattgatttatcattcaaccttatgtggatacgctgtggtcatcttactagtgcaggttgagcaaaaggtgtgtgcttgagtttgttcctgtaaaatttttcatgacagcacctggagagtggaaatgtgaaaaaagatgagcatcagcactttctagaagtgttggtctaagttttcatttatttactatatgattttgaatgccatcaactaatacattttcaattatccctgaaccctgtggctcagttagtgtcagtgggagtaagaaaagatccacgtgtccgggaacagtggctcacgcctgtaatcccagcactttgggaggttgagatgggtggatcacgaagtcaggagttcgagaccagcctgaccaacatggtgaaaccccatctctactaaaaatacaaaaattagccgggcgtggtggcacgtgcctgtaatctcagctactcaggagactgaggcagcagaatcgcttgaacccaggaggtggaggttgcagtgagcagatatcgcaccattgcactccagcctgggcaaaagcgagtccccatctcaaaaaaaaaaaaaaaaaaagaaaaaagaaaaagattcacatctacttgaggcctggaaaattgttgggaagttcctgtacatattaaaccagataatgtccattcagtggtgtttttattttattttattttattttggagacagtcttgctctatcgtccaggctggagtgcaatggcaccatcatagctcactgcagcctcaacctcctgggctccagccatcctcctgccgcagcctcctgagtagctgggactacaggggcctgccaccactcccaactaattttttattctttgtagagatggggtctcactatgttgcccaggatagtcttaaactcctgttctaaagcaatcctcttgccttaggttcccaaagtactgagattacaggcatgaaccattgcctgctcctggccagtgtttttgatttaaaagagaaatacaggccgggtgcagtggctcacgcctgtaatcccagcactttgggaagctgaggtggggggatcacctgaggtcgggagttcgagaccagcctgaccaacatagagaatctccacgtttactagaaatacaaaattagccaggcttggtggcgcatgcctgtaatcctagctactcgggaggctgaggcaggagaatcgattgaacctgggaggtggaggttgtggtaagctgagatcgcaccattgcactccagcctgggcaatgagagcaaaacttggtctcaaaaaaaaagagaaatacaggccgggtgcagtggctcacgcctgtaatcccagcactttgggaggccgaggtcctagatcgcttgagcccaggaattcaagaccagcttgggcaatggtgaaacccatctctaccaaaagtacaaaaattagccaggtgtggtggcacagacctgtaaagtcccagctactcaggaggctggggcgaaaggatcgcttgagcccaggaggtcgaggctgcagtgagctttgattgtgccactgtactcccagcctgggtgacagagcgagaccctgtgttaataaacaaacaaacaaataaaagagaaatacatctaataatctgcatcacttatttgtgcttgaaacattcagtgttaaccccaccctttcctttttctctaggcaaataagggcgagactgaaaaatcaagtcactcagttgaaggagcaagtacctggtttcacaccacgcctggcaatattacaggtattatgatagtgtattttcattaatgttgtctttgcttgatttctcagtatcatttcagacctctccctctactttcctcctttttttttggctgttgtgtaatctcatgccttttcagtctctcttggcaggctcccccctttggctcagcttctaaatgttggcatatcctggccctctgctcttctctgtggataccctttctctaggccagtgtctcttaacctttggtcttagtagggcccctttacaatcttttttttctttaatttaatgtatttatttatttatttacttttgagagacaaggtcttactctgttgccaggctggaatgtagtagtgcaatcatagctcactgtagcgttgaactcctggcttcaagcagtcctcctgcctctgcctgccaaagcatgggtatyacaggcgtgagccactgtacctggccccgtttacactcttaaagatgtaagacctcaagaagctattgtttatacagatttatccattaatgtttactatattagaaattaggaagttttggccggacacggtggctcctgcctgtaatccagcactttgggaggccgaggtgggcagatcacctgaggtcaggagtttgagaccagcctggccaacatggtgaaaccccatctttattaaaaacacaaaaattagctgggcgtggtggtgggcgcctgtaatcccagctactctggaggctgaggcaggagaatcacttgaacccgggaggtggaggttgcagtgagccaagattgtgccactgcactccagcctgggcgacagagagattccgtctcaaaaaaaaaaaaaagagaaattaggaagttttaaaaatgtttattcatttaaaaatgccaatagtgagctcatttattatatgttaacataaataacattttatggaacaaaaacttttttaaaaagaaaatttagtgaaaagaggggcattattttatatttgtgcacacctctttcctgtatggcttagtagaagagagctggagtcctatctgcctctgcattcagtcttttgctgtgtgctggtttgattgaaatatatggagaaaatttggcttcatacagatgtgtagctataaaagggaagaatttttttaacagtccttccaggtaattgtgggtatttttctttgatgttgtaccaggactcagtaagtaaattttaaaagattagttgcaatgtagaatctgaaactctatcagtgaactttgatactttgttacatcttctcagacttgcacactttgttacatcaaaatgttacatttggaatgaatatttaccccatgcatggttttgtaacatcctttgttcctcatttggaaaataatagttcccggaattatgcagatcttccaaatgttaacatttcattatgcaatatgaaagaattggaatcattaacatcaccaacaagctcatcagagaagttttcaagtattgagaagctgtcaagctcacaggggtggataaaaaattttaattttcacccaaaaactcayattttatcattrgcaacaaatacaattaattgtttcccttgaaataccagtttcactttattcatttttgagaaaatatttgtcaaatactcaagcctgaataatcattgcttgtcagttgttatttcaagtaggtgtttcatataaaaatgcatctgtttcagctaacaaggcaaaaaagcacaagtgcagcctggacaacaaagtgagatcccatctccacaaaaaaattaaaaaatgagccaggagtggtcgtatagaggtgtggtcccaactacatgagagggagacaggagatcacttgagcccaggaagtcgaggctgcagggagttgtgttcatgccactgtactccagcttaggtgacagtgagatcctgtctcaaaaaaaaaataaaaataaaaataaaaaagcactaatgctttagtaacaaccacaaccactgtacttctgtatatagcagaagtgcattatgagtgcttcccaattccttacatagactattaaaaacacatgcactcaagagttgaggtttatttatatatatatattttttacttttttgggacagagttttactgttactcagtgcagtggcacaatcttggttcactgcaaccttcatctcccaggctcaagtgatcctcccactcagcctccagagtagctgggattacaggcatgcgccaccatgcctaatttttttttttgagacggagtcttgctctgtcgcccaggctggagtgcagtggtgcaatcttggcttactgcagcctccgctcccagattcatgcaattctcctgccttggcctcctgagtagctgggattacaggcacctgccattgcaccctgctaattttttttttttgaaacagaatctcgctctatcccccaggctggaatgtaatgacataatctcagctcactgcaacctttgcctcctgggttcaagtgattctcatgcctcagcctctggagtagctgggattacaggtgccacgcccagctaatttttgtaattttagtagagatagggtttcaccattttggccaggctggtctcgaactcttgacctcaggtgatccacctgcctcagcttcccaaagtgctgagattacaggtgtaagccactgcgcccagccttaattttttgtatttttttgtagagttttttttttgccttgttgccctagctggtcttgaactctgggacccaaagtgatcctcccattttagcctcccaaagtgctgggattacaggcatgagctactgcgcttggccttaattttttgtatttttttgtagagacggttttttgccttgttgcccaggctagtctccaactcctgggctcaaagtgatcctcccgccttggcctcccaaagtcctgagattacaggcatgagccactgtgctcggccaagttgaagtttaagaaaattaataatgtatatttcttcatcaagggtggtcctagtgaaactggcatttagttttactgggagtgtgtggtagtgaaggataccttgactactartccaaagccattgtcttgatttgtgctggttcactagtagtcttacacaccattgcttttgcaccatcggtacagacgttaacacaatgaaaaaggcaaacaacattgtagtggtattattatgaagctagtctggccctcataaatctttgaaaaggtcttggggtccctcaagagtgtgtgggccacattatcagaaccattattttaggcagtttcatctatcaggccagtgacttctaaatctagatttcttctgagctccaggctcttggtctgggacaccactggtttccttcccaccttcaagtctcctttgcttgttgttgytcatcaccctaatacctaaaccatttgaatgccttgggctcacccttgagatctcttccccatcttattctttccctaagtaacctcacccagtcccatagcttcatgagggaatgcttccaaatttaggtctctatccagtatttcttccctgagctccagattcacccagtagggagatattcaatacatatttttacggacaaatgtatgaaggaatgtttgcaatcttgatttggatgacaggaaactcacggctttcatttgaaactcccatcagagtttcacccaagttggacatagtctccttctcaatctctttatttgtatgtctccaatagatcatttaatcccttgctaaatttctatcccttgttcatcaagaatgtcaaggtgggcatggtgcggtggctcatgcctataatcccagcactttgggaggctaaggcgggtagatcacttaaggtcaggagtttgagactagcctggccaacatggtgagaactcatctctactcaaaatacaaaaattagccaggtgtggtggtgcacacctgtgatcacagctactcaggaggctgaggcaggagaatcgcttgaacctgggggacagaggttgcagtgagctgagattgtgccactgcactccagcctaagactccgtctcaatttaaaaaaaaaaaagtcaaagtgaatagtacttaaatattcccctctcctcctctgctgtttgtctaagagggcttagctgagaagaaaagcacagaaggcctgtcactctctgcctggcatgttctctgctgtggtggattttcccttttttgcaaattactaagaatcaaaagtatatattgtgggtgtatactggtacatttggtggctggttatttcttggcttatttttgcaaattgtttgttgtagaaagagtaaatgtcataggcaagaagtataccctttttaaagcaacattgggggtgttttttttcctccattttaaaaactgacttccaaccttgttttttaaatttattgattacaaatgtttttattacataaacactgttctacagctcgtctcctacgtccttgctgataaaacagtggtagaatcttttaattttgtactttagcaccagagtcaacagctttctgtgatacaaggtttatataatatgttgtaatcacatctccctgcctcagacctctagtctttttcgctstggtgctggcaccaccatcttcccacattccctgagctagaagcctgaggccgtctccttaggagctctcttcctcactccctgcatccagttaggggctattgtcctattgattgtgcctctcatcaactcttggaatctgttgcctccccttgattcctatttctcccaaccctggggccactatagttacctgcttaatgatttggggttctatctatatacctcctgtctgtcctcctgactgcaattgcaatccttgttaaaatgcaagtctgatcacaatctatccagccacactcactctccatcctttaccagaatgatagtacaagttgagtatcccttatccgaaatgcttgggacaagagtgttttagatgttggaatctgtatatacatagggatgagatccaattctaaagcaaaatttatttgtgtttcattatataccttatacttgtagactgaaggtaattttatatatatrtgtgtgtgtgtatatatatatataataataattattattattattwttttttttgagactgagttttgctcttgtcacccaggctggagtgcaatggcacgatctcggcgcactgcaacctccacctcctgggttcaagtgattctcctgcctcagcctcctgagtagctgggattacaggtgtgttccaccacgcctggctaatttttgtatttttagttgagatgagatttcaccatgttggtcaggctggtcttgaactcctgacctcaggtgatccgcctgcctcggcctctcaaagtgctaggattacggacatgagccactgctcccggccaattttatatatttttaataatattttgcatgaaatgcacttttaactgtgttttgactgtaagccatcacatgaggccaggtgtggaattttctacttttggcgttgtcagtgctcaaagtttctgattttggagcattttttatttgtggttttttttttttttttttttgagacagggtctcactctgttgtccaggctggagtgcaggggtgtgatcacagttcattgcagcctggatctcccaggctcaagctatcctcccatctcagcctcctgagtagctgggactacaggcatccagctaattttagtatttgagacagaatttctccatattgcccaggctagtctcagactgagctcaagtgatccacctgccttggcctcccaaagtgccgagtcaccgcacctgactgattttggatttttgagttagggatcttcaacctgtactacttatatagagtgtctacaataattcaaattgtttgtttatatttctaatcgttctatgttttatactaccctacgatgtaggagatgtccccttatagccatagtaactcatgctcaaagatcttgggtagcttgcccaaagccagtcaggaagggactgagtctgggaaatgaacccagatctgtctctaaaacccatttgttcttcccctttgttttcctaattccttagcaatgcattcaagaacattcatgatctggcccaagtatatatttaaaagttgagttttcatytttttttaataaagtggatgagtaacttcccaaataactgaatatttataggaaattaagacttgacttttcattataagagatactaatgggctaggcatggtggctcacgcctgtaatcccaccactttaggaggccaaggcgagtggattgcttgagcccaggagttcaagaccagcctgggcaatatagagagactttgtctccaaaaaaatacaaaaattagctggttgtggtggtgcttgcctgtagtccccactactgaggaggctgagctgggaggattgctcacgcctgggaggttgaggctgcagtgagctgtaatcgtgtcattgcactccagcctgggtgacagagcaagactttgtctcaaaaaaaaaaaaaagtttctggtaaggtgatagaaatacagcctcagccccatagcctcattagtatctctcactctctctcttttttttttttttttgagtcagaatcttgttctgtcatgcaggctggagtgcagtgatgtgatctctgctcactgaaacctctgccctcccctgtcccccaggggatcctcccaccttagcctcccaaatgagctgggactacaggcacaccaccatgcccagataatttttgtattttttgtagagatggggtttcgatatgttgcccaggctggtctttaactcctgggctcaagcaatccacacaccttgacctcccaaagtgctgggagtataggcatgagccactgcacctggccaaaaaactgatttttaacagtattcgggaactattcagagtgctttatgtatagtaactcattcagtcctcacaaaatacatggacagaatacagttaataaactcaactagcctgtatcttcataaggttttctgaaacagaaagaaaaatgaaccagtagaccaatacccaagatatcttacggtgtagaacacagattagtaaactgtggcccgtatccaaatgctgcccagtttataaagagttaaaaaagcaatagcagcagctgctgtgacacggtatgtgtcccacaaagcctaaaatatacaccgtctgcccctctacagaaagtttgcagactcctggtataaaaaaaaagtgtccctaacctgttctggaataggatcttttttggatgatgtagtactcagccaccttcaaggagaaatcagcattcttttttttttttttttttttgagatggagtttcactcttgtcgcccaggctggagtgcaatggcacgatcttggctcactgcaacttctgcccccggggttcaagggattctcctgcctcagcttcccaagtagctgggattacaggtgcacaccatcatgactggctaatatttgtatttttagtatagatggggtttcaccatcttggccaggctagtctcgaactcctgaccttaggtgatctgcccgccttagcctcccaaagtgctgggattacaggcgtgagccaccatgcccggccagaatacacgttctttaaacattctttttgcatctagtctatcaatggttctataaccactttcccctataaaatgcctatactggccaagtgtggtggctcacacctacctagcactttggcaggctgaggcaggaggattgcttaagcccaggtgtttgagaccagcctgggcaatagagaaactccatttctacaaaaaatacaaaaattggctgtttgtggcagcgtgtactggtagtcctagcttcttgggaagctgaggtgggaggattgcttgagcctaggagttgcaggctgcagtgagccatgatcatgctactgtactctaggctgggtggcagagtaagaccctgtctcaaaaataataaataaataaataaaacctatactaagagtgactctttgaattggcttttagatgtcttttccaataaaactttgacatacgctcataactataactattaagttttctttctggaactggttgtagttttagtgttttagacaaactccttcagaaatattcaggccgaaaatagttacatgtaaaggaacaacaacagcgagagacttcagacttctcctgtgtgacattagatgccaaagacaacatctccgaaggaaaatgctgtcactccaaatcaggcaaggccagtcaagtgcaagggacagcagaaaaatattttcagttatacagacttagaaacatgtccacctacctttcctggaaaactgacttataagttacatttcacttacttgaaacatgaatgaagataaattctagaacagagaagttgtggcttccttactggcagcaagtgataaaacaatttaatctcagagttaagactaaataactagtggtaggtataaatatgaatgaaattgtaaaaaaataatacttttgtatttagaaccacctcctttcctactttgatctaaaaattccggaatgtatcaaatctggtaactgaaccagtgagggttgggtggtggggcaaagaacatacatagaaagtgacatgagaggcacgaaaagtctagggaagcccctacgagaagcatctaatgtacttagatacaaataacccattaaaaaaaaaggtagaattcccctcaaaggactcttctggctcttgcaattcaaattagcaccacaaaactgagaactgtctgtataagggacaactgaagctaagattcaggccatgtcctgakatctgaggagagcgtccagtaatagcaccaatatgacaagctcagaaaatcctgtgttacaaaagccggcttctttctctgccatggtcctgttaaaaggagctgtgcttcagttgtctttgatatgaagggaccaccacctttccctctgtgataccctctgcaattctgggagaaacacaacttatggtagcatgtatcaaccttgagaaggagaaataccaaccactggagcatgaaacaatattagtacaataaaattttacaaataaatggttataatgataaactataaatatgttcatggtcaaagaaacagagggaacatagtgagacactgcatggtggttcaaaggatttagcctctgcactacaagtttctccctgtctctctcttttttttttaagagacaaggtctctctctgttgcccaggctgcccaggcatagtaccatgactcactgtgcactggtgcaatcatggaaaaactcttgacctcaagtaatcctcccaccttggcctcctgagtgctgggactacaggcaggcaccactatgcctggctaattttttgtaaagatgggggggtgtctcactatgttgcccaggctggtctcgaactcctgggctcaaacgatcctcctcccttggcctcccaaagtgcagggattatagacctgagttgctgcacccggcctcctctctgtgttggggccagcagattgccctttgtcttgcctggctgtttattctgtgtaaactagagggaggtccttccaccctcctttctattgtctgtgtggcggggccagggagctttccattgcccctgcgggtgggggagagggtgtggaatgtgccctctgggtgctcctgcctctcaggcatttttcttgcctgatgacagtttctcagccctccatactctgtttttctggtatggcagcagaaatcccacatgtttctagtaggcctgcagcatccttgcttagtttccagtgcagatgcagatatcctctactttctgtttggggtttggcagtgggaaccaggtgggccttgtttaggggaggggctgtaacaccatctgtgttcacataatccctcctgcccccacagcctccctatactcctgtaaaagttctctgcaacaagagtcgcatgattaaacatttcttttattaaaactaaaattgtagaagcttttctgtgcactttgcctttccctaatcatctgatttgcatgcatttattattctaggttggcaacagagatgattccaatctttatataaatgtgaagctgaaggctgctgaagaggtaacgccagaagagctgtgccatcaccctccccaacctccacctgggtcctatcgattaccccttgccctttttggtcctccctgtgaaaacttttatcacccacaggagacattagtttatctattttgtaagtcagaaatgggtgggttagatctgtggcctctggtttgcccgtgagtttttgttttctcattaatgattttcttcccaaagagcaggatgtcaattgaggaaagtgacaagtctcgatcattttaggagatttatttgccaaaattaaggacacacctgggagacaggtctatacctttctccgaagatgatttcgagttctccaaatttaaagaggaaagggtgggttattgaaaagtacacgttttcatgtaagaggtggrtagggaaaaatagtcattcatgaccttctctggctcagtgaatctgcattttttacataagatgacagatggccggacgcggtggctcacgccagtaatcccagcactttgggaggccgaggcgggcggatcacctgaggtcgggagttttagaccagcctaagaaacatggagaaaccccatctctactaaaaatacaaaaaattagccgggtgtggtggcgcatgcctgtaatcccagctactcgggaggctgaggcaggagaatcgcttgaacctgggaggcggaggttgtggtgagccaagatagtgccattgcactccagcctgggcaataagagtgaagctccaaccagaaaaaaaaaagacgatatagacaagtggggcagaggaaaaatgcaggcaatctgcattttacataagataacatagacagaattgggcaggggaaaaatcagatatacatttgtgtctggtgggctggggggatttacatygccatggtgaaattttaacagaaacatcataaagatgttgcagctcactacgaatttctttgtgggcaaaatatgggggaggcatgtagcttttcatcttgtaacatcttatttaggaaccaaaaagggggaggcagatttgcatgacccagttcccagcttggcttttccctttgacttaatgaatttggggtcccaagatttaatttcctttctcaagaaatagcaagcatgacattgctgaagtgcagtggtggcaattaacaagtgaatgatgaatgggttgaagtgagggactcattcttcagaacatataagggtgaaatgatgaccaacacctccttgcttgttagtcatgtctgtaaaagaaatggttcaatatctcaagttgtcttgccatttacctgcttttaatgtctgttttgcagattgggatcaaagccactcacattaagttaccaagaacaaccacagaatctgaggtgagcttttatgagttgattgtgaagagggaaggtgaagtggtttcctctctggttttggtttacgggggctttggggactgacacatttagccaagacctccaggtatttttttttttttttttttttgagacacagttttgctcatgtcacccaggctggagagcaatgatgcgatctcgactcyctgcaacctccgcctcccaggttcaagcaattctcctgcctcagcctcccgagtagctgggattacaggygcccaccgcctcacctggctaatttttatatttttaatagagacgcggtttcaccacgttggccaggctggtcttgaactcctgacctgaggtgatttacccgccttggcctcccaaagtgctgggattacaggcgtgagccaccacgcctggcacctccaggtattctttcttcacagactcccacagaggagatggtgcagggatgaacatttggtactcaaagtgtgactgcagtactgtttgcttccaaatcatctgttgtgtttgttaaaactgatccttggagccaggcacggtggctcatgcctgtaatcccagcattttgggaggccgaggtgggcagatcacctgaggtcgggagttcgagaccagcctggccaacatggagaaaccctgtctctactaaaaaatacaaaatttgccaggcgtggtggcgcatgcctgtaatcccagctacttggaaggttgaggcaggagaatcacttgaacccgggaggcggaggttgcagtgagccaagatcgtaccattgcactccaacctgggaaaaaagagcaaaactccgtctcaaaaaaataggtaaaaccgatccttggcctgtaattatctgcattctaaaaaccaaatatgtattccttttatatgaggttcaggactaggcagaacaaatcagcggtgattaaagtcagaactgtggttgcctgtaggtgggagattaatgctaaactgtaggaggataaagcaactttcttgaggttatggcaatgttccatatatgcgctgtccagtatgggagccactagccccatgaggctatttgaatttagttaaaatgaaataaaattaaaaattcacttccttggttgtactagccactttgcaaggattaagtagctgctattgtattgtaaggtgcaaattatagaaaatttctgccatcgcagaaaagatgattggacattgctgctctacatcttgatttggatgattgtaacatgggtattattgctgtaataagttattagagttcttagctctttttattttattgtattgtatttttagagacagggtctcactcttttgcctcagctgcagcacagtggtgtgatcatagctcattgtagcctcaacctcctaagctcaagtgatcctcccacctcagcctcttgagcagctgggactataggcatgagccaccatgcccagctaattttattttatttttgaggcagagttttactcttgtcgcccaggctagagtgcagtggtgcaatattggctyactgcaacctccacctcccaggttcaagcgattctcatgcctcagcctcctgagtagctgtgactacaggcatgcgccaccacgcccagctaatttttgtatttttarttgcccatattgcccaggctggtctcaaactactgacctcaagtgatctgcccactcaagcctcccaaagtgctgggattacaggcgtgagccaccgcacctgtccccgctttttttttttttttttttgagacagagtcttgctctgttgcccaggctggatgcagtggcatgatctcagctcactgcagcctcygcttcctgggttcaagcgattctcatgcctcagcctcctgagaggctgagattacaggcatgcgccactatgcccggcttattttttatatttttgtagagacagggtttcaccatgttggccaggctggtttcaaactcctggcttcaagtgatccagtagctgctattgtattgtaaggtgcaaattatagaaaataattttctatattttgggaggcctgccttggcttcccaaagtgctgggatgacaggtgtgagccaccacacccagccctaattttttttttttttttttgaggtggagtttcactattgttgcccaggctggagtgcaatggcacaatctcaactcacygctggagtgcagtggcactatctcagcgsactgcaacctccacctcccaggttcaagcaattctcctgcctcagcctcccgagtagctaggattacaggcatgtgccaccacacctggctaattttgtatttttagtagagacagggtttcactatgttggcccagctggtctcaaactcccaacctcaggtgatccacccacctcagcctcccaaagtgctggaattacagtcgtgaaccaccgcacccagcccctggccctaatttttaaaaagtttttgtagatatcacatttcactgtgttgtccaggctggtcttgaactcctgggttcaagtaatcctcctgacttggcctcccaaagtgctgggattacaggcatgagacacctcgcccagcctcttagctcttttatttgatggacttcttaccagacacctaggggatgcattctatgttaaagtacaggtgctctcaggattcaaggggaaggtacattctgaaaggactataattaaagtgttggggggaaatagggcaacctaatttttgccttagaaagtgtttcttcctaccttttgatttctgtgtgatatacaaattatatatggtattacttttaggtgatgaagtacattacatctttgaatgaagactctactgtacatgggttcttagtgcagctacctttagattcagagaattccattaacactgaagaagtgatcaatgctattgcacccgagaaggatgtggatgggtaagtgtggcttggcttcctatgtctcattgcatgctttcatttataatatgtttctatttggggaatacagcataaatgtttctaaagagtaaagacatctaattgcctttatttccttcttatttccatcacttttttaagattgactagcatcaatgctgggaracttgctagaggtgacctcaatgactgtttcattccttgtacgcctaagggatgcttggaactcatcaaagagacaggtaaaaacaacaaaccaaacaacaagaaagcaccatttcctgaatcctggtcttgacatgtggtggcatagaggaggtacattgtgggccataaataaatggacttgattggcagaagggcctgtctactaaggatgttacctaaattttctctcaattttctcagcaactctgtgaagtaggtactgttattgttcaactgctaagaaaataggctcaggccaggcacagcggctcatgcctgttatcccagcactttgggaggctgaagcgggctgagatcacctgaggtcaggaattcgagaccagcctggtcaacatggtgaaaccctgtctctactaaaaatacaaaaaaattatccaggcagggtggcatgcacctgtattcccagctattcgggaggcagaggtgggaggattgattgaacctgggaggcggaggttgcagtgagccgagatcacctgactgcactccagcctgggcaacagagcgagactctgtctctaaaacaaacaaacaaacaaacaaacaaacaaaaccagctcagagagagcaagtaacttgtctgggagacaacggaaccaagatttgaattcagagttatctgagttcaaagcaatttattttaacctatacagtaataaaaatttggatagtttaaaaggatatgaagtgaaaagccccacctccccccacccccaaaatgggcactgaatctccacagtagttccaggactcgacagatggctggaaatgggtctcctgcacagttggccatattgtcccgttactagttagcaccttgctattttaatttcattatgaatacttttagcagaggttattttttacaaggaaatgggtcctggtaaaaagaagtaggtcagaagtttcaagtggaaagttttggccagcataaatgaaaattttctgtggttggcaagaaaaggtcaaaggtcaagctttgacagttcatttctacagttaaatgtatattcttcagcatatttagcaaacattgtagtgccttgcttaaaagaaaaaaatcccacgaggacagcacctgaaggcctcccactgcctcttattgagtgatgctaccatttgccctgatgcagctttaactcttctgctgaatcctaaaaagtatagaaagttaccttttaaaactttgaggtctttacttctagatgttcatgatgttcacattattataagagtttatctttttctgaaaaaaaatgattttatgcgagaagcacaatttaaacccttgctgctttgagcaagggtccactgccctcagccttgactgccctgaggactctgatgaagtcgtcaacttctctctgctttcttctttgtggacagctcattttcgggctccactttgtggccacaaacacctacagcctggttccatcctcatgcctaacagtcatgggattggatcttatcagctgagggaagaaatatggtcccctgtccactactgggtactcactcaggctgtctttagtagagtatgagtcagccctgaaaaggacattggtatattgccagaaaaatggatgctgtgatagcaaaaagaaagctttgctgccacagttcaatttcccctttatcacttccctgcaagtaaccctatggctcaggccctaagccaaaagagaaatttgggtgaggaactgtataaacaaacttaccaaagttagaaggaattaccgatactaatctaatttcttacacatctctccagcctgttacatacaccctatttgttttaactttttttccccatgtaatttaatctgatgtcttcttccgtatggctgattagctgtatgtcagggtttcttttttctttgagtgtaggttttcttcccactcccctatgactcaatgaatgatcttggcttaagctgctcccaaaaacccacggccagaaggacacaagtacaagtcccaatttatagctgaaaccctagagttgagaatattattgccaaagaaggaatgcttttaggaaggtttctgtttgatgttaagaacctgtttttgtgcacttattctaatttctccacgtggcatgcgaaggagggcagcttctatcctccaactctgatgcaggctggcttttctttcaggggtgcygattgccggaaggcatgctgtggtggttgggcgcagtaaaatagttggggccccgatgcatgacttgcttctgtggaacaatgccacagtgaccacctgccactccaagactgcccatctggatgaggaggtagggtgtccagaggagaggtaaaggtgttacggtggggagggtgggtgtgccagaggctgccatgtcctttacactcatgacctcatttaaccccatcatctcatttttacaagatgaaaaaacaaattcaaattaaaggctgagtggggtggctgacacctgtagtcccaacactttgggagtctgaggcaggaggattgtttgagcccaagagtttttgagaccagcctgggcaacatagtgagacgctttctctgcaaaaaaaattaaaaattagccagatggggtgggcacatgcctgtagtcccagctactcgggaggttgaggcaagaggattgcttgagcccaggaggtcgaggctgcagtaagctacgatcacaccactgcactccagcctgggctacagagcaagaccctgtctcaaaaaaaaaaaaaaattaattaattaaaaaaaacataaaattaaaagcatgctgaagtttatacagagtttgttctgtgtactttctctcttcctttttcttttttctttatttattttttttgagatggagtttcactcttgttgcccaggctggagtgcaatggcgcaatctcagctcaccacaacctctgcctcctgggttcaagtgattctcctgcctcagcctcctgagtagctgggattacaggcatgtgccaccacgcctggctaattttgtatttttagtagagacaaggtttctccatgttggtcaggccggtcttgaactcctgacctcaggtgatccacctgccttggcctcccaaagtactgggattacaggcatgagccaccatgcccgacctttgtcttttttcttttgagacagggtcttgctctgttatttaggctagagtgcagtggcagtccatgagagcccactgcagctttgaactcctgggctcgagtgatcctcctgcatcaaccttctgagtagctgggactacaggcatgtgccaccatgcctggctaatttttaagctttttgtagcgacaggggtctyactgtgttgcccaggctggactcaaactcctggactcaagcgatcctcctggttcaccttcctaaagtgctgagattacaggcgtgacccaacatgcctggcctctcaccaagtactttctaccctaatctgcctcgtggtggacagggattagcagtacaggcactcagattgacctctggcagccagatcccatgtgtgtaaaagtggtggcctcagagtgaaggtgctccagaggcagtcgtgggcagtagtctgctaatagctatggcagcttgttctagatccctgcatcagattcctgagcccaagaatgcgcacacacacacgtgcctgttgacagtgcagtctcttaaatgtggggagagagcaggagagaggcctagtactttctcttttaatcctcccaaagtagtgctctacattctgtaggagaaggagcagtgtctggacataacacgcagggccccaagcctgtttgcccctctgccttgcaggttgacactgatttccctattgggtaaaatggctggtgaaagggagctctttggcatgtgtagaaatgagcacggcatgtgaagggctgtcagaaacagtgtgtggcttacatttgaggccttaacccaatatcttatgaaatagcttaygacasttaagaatttaatacaaagctcagggatatccttttcatttctgggtttttttttggtgtgtatttcattatttcatttctgatgtccaaatcccctacccctaggtaaataaaggtgacatcctggtggttgcaactggtcagcctgaaatggttaaaggggagtggatcaaacctggggcaatagtcatcgactgtggaatcaattatgtcccaggtgagtgttgttggaggagtaaggtggctgctggtattgaggatggtatctaggtcatcaaaagaagcctgagagagaagcttgtctcattttatgcttgtagtactaaggtttaggagactgactagcccaagrgtgcacagagttagtagatagaagagttgccacttgcaggcaggtctgcctggtgccagagcctttgattttcatcatgtgctgtacagcttccaagatgactttgtccagggagaaagtgagagggagggcaggagggatatatcactttatcttcatgtagagatcaccctttattttagcaaagttgatggatggatttaaaatacagtataattattgcaaagtgctatgagagtccagaagaggractcattctgccaagaggagggctttacaaagaagatatttgacctgggtttttttctaggctgagaggataaatctagccttttaatcatgtccaaaactgtactcggcatcctcatccccaagttacccctwactcccgtcttttggttagtatcaccattcttccttcccgcaagtctgaagccttttagtttccctcccaagcattccctatattggaccagtctctaaatattaggaattgttttctctctcctctgttctgagtgtcaccactgagtgttaccttctcagctgatgggctgtgataacttccttgcaggtgtccctccctccagctgcttcccactcagatctatccccgtgctctcgccttgccacgttcaccttctggcatggaactctgagcctcttccttcttacttgccagactccttagcctcacactaatttcagtgacctctgcagcctgtgatctcacttgcgcatggtgaatacctgtcttcaacttgtaaagtggaccactttcccttccctgcgcatgcctcgtttgccctttgtagttccctcacctgcattcttagtggagtgggctactctttcaaacagaaaacttcacagaacaatagggcaaaacttgcgtacgtcctcatagatccaagaaaggaacaatctttaacggagcaactactgtgtatccagcacaatgccaggccttgggctacacaactgaataaggttcaacttcaccttcaccttcagctgcttcctccccatstcctctctgtcatgtctgttattccttccaaaccttgtttgatttccccttatcaagggatgatctttccttctctccctccctcctctcccatagaacatgtgtattgtatcttttgttgcatgtgtctcatgtacggcgtcctgtgctctcctgcctagatagctcctcaagggcagtggtcactgtggcgccacatccagcttcctgccatctgaccactggcactcatatctattgaattgtygaagggagttatagctggaagtcttttttctcccttcccatctcaagtttcagatgtagacgctgagctgccaggaacattagtcactgtcaagccttcaccgtttttaacctccctcccactctccctaccgtgcttttaagacagtrgctcataattgatcactcattttcttgtagtgtaattatctaacaggcgataaagaaattgctctcctacaactcctcactttgaatacttgcgatatgacattcaagctcagtctttttatttatttatttttttaattttttttttttttcttgagacggagtctcgctctgttgcccaggctggagtgctgtggcgcgatctcggctcactgcaagctccgccttgcgggttcatgccattctcccgcctccgcctcccgagtagctgggactacaggcgcccgccaccacgcccggctaattttttttgtatttttagtagagatggggtttcaccatgtyagccaggatggtctcgatctcctgacctcgtgatccgcccacctttgcctcccaaagtgctgggattacaggcgtgagccaccgcacccagcaagctcagtctttttaaaacctcgcatcttctgtatcatatttctgcttttggcattttttttttggattacatgtgagaaatggagaagaaaaacctgagtggggatcttgagtgttgcagataggtaggaaatgttgacttaaacatgaaacttgccatccttttcacattgattccttatgtagacaataaaatatgaataaaatcaaagcagtatcttcccttctggtcaacagtgtttttactgatcttgggcatataggcaaattaatgctgatacagctggatgttattgtgttccccaaaggatggcagaatcactcagttacagaccagcaaatgggctgcaggacctaaagactgatatttgcaaatgttcactttagaagcaaacttttctaccaccgagctacttcttggttcatattttgattatttaaatagtttgcatggtccactcagggataacattgtaagtcacttgccaaattaagaatgaatcaaggtgtgtataccttttacaaagaagtaatatttttaaagattcaagtgcagggcagaaagtattggccagagaaacacataaaagtgctcttcctgcttggcttactaaagataaattgagaagggccagatcaatagtgttttatttggaagggttaaaaagtgggaacagattccccaccctaatgcaatccagtctcaacctatccagtgtagctgcttctggactggcctctattattagggtccccaaattaaatgtagaagagtcagggctcagctggatctttagttgatttttgtacatgtgatttcccaaagaaagagaaattctagggctgggggtagataaccaaaaggtttgctcattactgaggtcatatgcttaggctgagtagtggtcactttttccactgaccacatcatcctatccacgaagcactgcatgtttagcagtgtctcgtcaaccctgacagtatttggtttaggagcaaaactgaactcaccagtgctgcgtttagtcatgtagtcaaagatatgtgtctcttacctgtgggaaaacgaaaatgactaacattaacacgtagaaatagatgcagcgggtatttcaagctaactacagtgtgaagacgattgaaacttgtacagagggcaaacctctatctatatttccttggcattttgaaatgactctaggggctgtaagaggaaatgttctgccagtttgctgctttataatcttctagaaacttgaaaccatcccaatgagttgtgttgaccagctccttttactccatataaaaaatatcttacgtatctgtggtggaaagagaaactcttgcgtttggaggctgctttttcaatttcagtaatgtacacattttctcattttgccctcagcaaatttgtgataggtagtgttaagccttctttgcattttggacttcagattaatatggagcccacaggagctgcagaactaacttttttttttgagacggagtttcgctcttgttgcccaggctggagtggaatgctcactgcagcctccgcctcccgggttcaagtgagtctcctgcytcagcctctgagcagctgggattacaggtgcccgctaccaagcccagctgattttttaatatttttagtagagacggggtttcaccatgctggccaggctggtctcggactcctgacctcaggtgatccacccgccttggcctcccaaagtgctggcattacaggtgtgagccaccacacctggccctaatttttaataaaagagctgatgctacagctaatctcttttttttttgagacagagtctcgctctgttgcccaggctggagtgcagtgacgcaatctccgctcactgcaagctccgccccccgggttcatgccattctcctgcctcagcctcccaagtagctgggactacaggtgcccgccaccatgcccagctaatttttttgtatttttagcagagacggggtttcactgtgttagccaggatggtcttgatctcctgatctggtgatccgcccgcctcggcctcccaaagtgcctgctaatctcttaattctggcttcttgcctccaccttggagcttcttctcagttgtggcgatctgatcagagagaagtggtgatgtcgctaaaactaccagatgcagcgcgggagccttattgcttcgaggtctaggcccgcccccagcccctcctggaagtgcactgaagccaagtgtaggatgttctttgtgtgagtgagcaatgatgcatcattgggttttgttctcttgaatagctattctttgctggtaagatttgtagttgttcttgtgtccttttaagggaagtgtaattatattctttgcctttagcatacatttaagtagctgtgtctttggaattggatgttgaattgttcctccagctcacacatggagctcacaaaatgctgacagttgctgtagaaacgatatctggcagctgtgacagagttggatctttgtgcacccaaaaaatttcctttgtaggctttagcaaattaacattttaaaatgggtgctcattatatactgggtagttggttttaagaataaaaaacagttggtattttatttgccacctgagagactacaaaaggattctccaggttctgtaaaaccacttatgcatcttgtgaatttttgcaggtaaaataattttctccctaagaaatagcaaacatctgtcattccatagcttttaagttaagtaggcactggagcctgatgggactaacacaccctacaattctgctgagtttttgtcgtaactgatcwccaggactgtgattctgagacttagttttgatttctcccccacttgaccagatgataaaaaaccaaatgggagaaaagttgtgggtgatgtggcatacgacgaggccaaagagagggcgagcttcatcactcctgttcctggcggcgtagggcccatgacagttgcaatgctcatgcaggtaattgtgaataaaagtttctataagagttctgaaaagctgatcgagttttggctgcttttctccccaagtagaaatgtcaaaaacctactcagaagtaaagrtgtgaatttattgagaaaaagggaagggaagaatagagaaataagatcaggcacattaatagaggaaagtagggatggcataattccagtctgttttggaatataataactttgaaagaagaaaagtgcgatcacactggcttggccaggtctgttttggtttgccttccctttctttttttttttttttttttgagacggagttttgctcttgctgcccaggctggagtgcaatggtgtgatcttggcttaccgcaacctccatctccctgattcaagtgattctcctgcctcagcctcctgagtagctgggattacaggtgtgcaccaccacgcccggcgaattttgtatttttagtagagacaggtttctccacgttggttaggctggtctggaactcccgacctcaggtgatccgcccaccttggccttccaaagtgctgggattagaggtgtgagccaccgtgcccggcctgttttccctttctaacatgcaccagctgacaggggccaggcgagcagccccaaagcatgttaggtgcctcttgactcttagctaggattgaagcatggtaataagtrggtctgaagcagttcattttgtgattgaactggagtgacctggagcttgaaactgaggtgaggattaaaataaccacctcttctaagtttcatttatttcattttgcttagagcacagtagagagtgccaagcrtttcctggagaaatttaagccaggaaagtggatgattcagtataacaaccttaacctcaagacacctgttccaaggtaaaaataaagttttactgatttaaaactttgtgaattgttggtttttagttgacagatactgtgggttcacatatgctccctctgaaggtgccttcagtggttggggttgggttgggggcttgttactactgtgggattaattaaactcagtggataaacattaatacctattttctatgtttccaaagtgacattgatatatcacgatcttgtaaaccgaagcccattggtaagctggctcgagaaattggtctgctgtctgaagaggtagaattatatggtgaaacaaaggccaaagttctgctgtcagcactagaacgcctgaagcaccggcctgatgggaaatacgtggtggtgactgggtatgctttttattcatgttgccatccaaatcttagtatcagtcctgatactaaggcgttgcatttgcacttggcacatgtatgtagaggtgcctttaatttgattttagcattttcacccgtatttgatctcatttgatccttacagcaatcctgagaggtaggtaagaatagattataatcatagatgagaaaattggtcaaggttatccatctagtaagtggaagagtttggtcttaaaacccggtcttaagatagaatcaccttttgctgttgttgttgttgttgttgttttgagacagagtctcgctctgttgcccaggctggagtgcagtggcacgatctcggctcaccacaacctctgtctcccaagttcaagcggttctcctgcctcagcctcccgagtagctgggactacaggtgcaaggcaccacacccagctaatttttgtatttttagtagagagtgtgtttcactatgttggccaggctggtctcgaactcctgaccttgtgatccacccacctcagcctcccaaagtgctgggattacaggcgtgagccaccacacccggccagaatcacctttttgaacccaaaattcattaattcgatggatttactaagcattcatttttattgctgggctgaggttatattaaaaagctagtttttgagaatataaaatgagaaattaaaattatagccgtgtctctacaagataaagtatatttgcttcttacagcaagaagagctaaaatacaggaatcattttttttcttaaagttttttggaaattacaactaagacttttgaaaaagatatctttcagggcttttgtctttctttttctttgtcttttctttctttttttttctttaagagatgggggtttgctctgttgcccaggctggagtacagtggtgcagtcatagcttactgtagcctggaactcctgggctcaagtgatcctcttgcctcagcctcctatatagctgggactacaggcatacactgctatgcctgactttgtctttcttaatctttagattacgagtcattctctaggatctgctaggtatgacttagtgattcagatacacttaattctttaaacctttttctcttttgctttcgtcttgaagaataactccaacacccctgggagaagggaaaagcacaactacaatcgggctagtgcaagcccttggtgcccatctctaccagaatgtctttgcgtgtgtgcgacagccttctcagggccccacctttggaataaaaggtactagtgagactggaccatgggtggtgacaggggacctgcttctccttcagtcctcccaggcccacgcaacctatgatacttatggggtcttcaactcatttcaacaccaggaatgtcattctcacaaacctctgtagtcatgcttttgatgaaggctgtcattggatytccccagctcctgctgtcactgttggccactgcacagggattctctgggatgggtgatatgtagctggaggtgcttttatttgaccctcatagtccactgctacagtaaccataaaggtaatcatagctactgatcatcttacagacactctagagacaatgacaaaccccacagatgtttcaccttgttgggaataagaaaagcctacctttattgaatatatgctttgtgccagatattgtgctgagcagtttttgcatattattctatcatccagtacgagatagtattgtcaccattttaaaatagcagcaactgggacttcagaggtggcttggtcaaaggcacctgtattaagtaccagagtgattcttccatgtctatttcaagctctaaattactaccatactcgcactttaccttcagatttttattgctgcggtactaagaacatgtgtttttttttttttttttttttttttgagacagggtctcactcactctgtcgcccaggctggaatgcagtggtgtgatctcggctcattgcaacctctccaccttctgggttcaagagactctcctgccacagcctcccgagtagctgggattacaggcacgcatgaccatgcctggctaatttttgtatttttggtagagacggggtttcaccattttggccaggctggtcttgaacttctgacctcaagtgatctgcctgtctcagccttccaaactggtaggactataggcatgagccaccgtgccaagctgctgtcttaattaaaataatttttattaattatgataggttcttagagttagctttctctgcttggtgagggtatcacattttgcttgttctagcaattactacaaatgttgacaccgggaacaccttcacccttccacctttttttttttttttggagacacagtctcgctctgttgcctgggctggagtacagtggcacgatcttggctcactgcaacctccgcctcctggtttcaagcaattctcctgcctcagcctcccaagtagctgggactacaggtgcgtgccaccatgcctggctaatttttgtgtttttagtagagatggggtttcactatattggccaggctggtcttgaactcctgaccttgtgatctgcccaccttggcctcccaatgtgctgggataataggcatgagccaccgtgcccagcccacccttccacctattttataaatgtaatcactttgttctgctcttgagcttgtcttaaccccctttcaacttcagcacgagctattccttgttctgcttattgaacccattattttccttttactcttactgcaaattgcctcactgcacggtctctgcctcacaaaaacaaaatacatattaatatatctctgggctgggtgcagtggctcatgcctaaaatcccagcactttgggagggtgaggtggtagattacttgaggccaggagttcgagaccagccaggccaacatggcaaaccccgtctctattaaaaacacaaaaattagctgggcatggtggtatgtgcctgtaatcccagaccattaccctccagcctgtgagacagtatgagactctgtctaaaaaaatatatatctgatttacatttattgcactgataatgtggtaacctggactttttttgtttgtttgtttgttttttttgagacagagtcttgctctgtctggagtcccagctcaggctggagtgcagtggcatgatcataactcactgcagccttgatctcccaggctaggactataggcatgagcagccatgcttggtgtcctgaacattttcaactggcttttggctaatacagattgagcatcagaaatctagaaacctgaaatctgaaaggctccaaaattctaaactttttgagtgctgacacgatgctcaaaggacatgctcattggatcatttcagattttaaatcctggatttgggatgctggatcagtatgatgaaaatattccaaaatctggaaaacaaaaacccaaatccaaaacccaaatccaagcattttaaataagggatactcaacctgtaatccaagtagcccaaaaaaatctagcaattaggctgctttctaacagcctaatctatttatctctatttaggaaaaattatagtctttttgttaggtgtatgtattttaaatatttctgttttaaaagccaaagtagctttatgagagtaggaaattgaacaggttgcctttatgtaactgtcagctgggtgttttaacaaatgccagtaattacaaggaacatatttctaaagataatgagtaggtatatatttgttcatggttttgtcatttaaactcagatttcaattgagagactagtattagaaaacacttgatcaaaactgtccaaatgattstaaaaaataaataaataaatgtgcttagtagttacaataatgcatttgcatttatttgatttctaagtcattggagaagcatgcttaactgagcttccacccttgacctgtcccctaggtggcgctgcaggaggcggctactcccaggtcattcctatggaagaggtaaagtattctgggatttggctgaattagatccccctttttttgtcgggggggagggtgctgaattagctccctttttttccccatgacggagtcttgctctgttgcccagagctggagtgcaatggcgcaatctcggctcactgcaacctctgcctcccaggttcaagcaactctcctgcgtcagcctcccgagtagctgggattacaggcatgcaccaccacgctcagctaattttgtatttttagtagagacggggtttcaccgtgttggccaagctggtcttgaactcctgacctcgtgatccgcccacctcggcctcccaaagtgctggtattataggcgtgagccaccgcacccagcctagattctttattatagctttttctctctggagattagccttttttgtagagctcttagcggacaaatgacttgtttctcagcaaaagcaacacctagggggaaaacaacttaatttgcagacttgtgatacagcttggtttcaaactttggctttcagtgggaatgattattataagcaaatgaccaaatgaagcatggtatcgggaagcaccaacacacagcgatttcagaattcatttatgtaactgcagaaattggaacattacatagacatagagtcggtgctgctcccgtgcactcctcctcrctgttttgaggtgtgtcctcagtaacccagtgtggctgttgatcccagtggtgtggtatttgtggtctctggacatctcattttggaaaaactgcaagttctgtatttgggaggagattcttctgtggacagataattagtcttttatgttttctttttctttttctttttcttttttttttttttttaagacagagtctcactctgtcacccaggctggagtgtagtggtgtgatcttgggtcactgcaacctccacctcccaagttctcctgcctcagccttccaagtagctgggattacaggtgcgcactaccacacttggctactttttatgtttttagtagagatggggtttcgccatgttgcccagggtggtcttgaactcctggcctgaagtgatccgcccgcctcggcctcccaaagtgctggtattatagttgtgagctaccacacccagccagtcatttatgttttcaagaactccctatattgggtgtttgtccactaactgggctgccttcagtattccattggctttaaaatagggattgagctttgcaatagaatgaaagttggaaagatacagagcagctgggagactaatgtggcttctgttcttttgtagtttaatctccacctcacaggtgacatccatgccatcactgcagctaataacctcgttgctgcggccattgatgctcggatatttcatgaactgacccagacagacaaggtaggatgccaaagccccatgaaccccattgaacagttttgaaagtattgaaccatctgaattagtgttggtgtcttgggtgctgaggatgcaggtagcaargcartggggctcctctcattttaaagcccctttcttttctttaaggctctctttaatcgtttggtgccatcagtaaatggagtgagaaggttctctgacatccaaatccgaaggttaaaggtaagctttttttcttccacattttttatattgtatggaatctggaatctgatcattgattaggacataaaagtcttcttggagtagcctattttagatgaagttacrtcagyaatcatagtcttaaagtcatgatatacatagcaaagatggatggtagaggttatttctcatttatctatagattagaagtggctagtgtggaataaatagaacactgacaacctgccctcagctaagaaagaaacgacacttcctttataacatgaacaagagtcaggatgtcactgtggcggcatagcagcctttggagtttgcatcattgggaccttaagcaaatttgttaaatgacttgtttctccgcttacttgtctgtaaaataatacttgccttgccctgaatagataagggtctgtgttaaacagttaaaaccatagttatatctatattttatttgaatttctgtaacaaatacatagttagtaagcatacaccataccacctgacccagaaatctcacccaaaataaatgaaaactctgttcacataaaaatctgtacattaatgtttttagcagctctattaataatttccaaaaactgggaactaatctaaatgtctttcattggatgaataaataaacaaactggtacatccatccaataaaaataaatgagctattgatacaagcaacaacttggatgaatttcagtggcattatgctgggtgaaagaagccagtctcaaaagcttgcatattgcatgcctccatttatatgatattctcaataagagaaaactatagtgctagggaacagatcaatagatgttaagggtatggatgaagggagggtatgaccataaaggaacagcaaaggagaggtgttttgttttgttttttgttttcttttttgagacagcgtctctctctgtaacccggctggagtgcagaggcacaatcacagctcactatagcttccaccttccaggttcaagcaatcctctcatcttagcctcctgagcacctgggactataggtacacacaccaccacacctggctaattttttattttatttttttgtagagaccgtgtctcaccatattgtccaggctggtctcaaactcctggtctaaagcgatggtcctgcctcagcctcccaaagtgttgggattactggcgtgagccaccacgtctggccacaagggattttttgtttttgtttttctgttttttaatttttcaaaaatttattggttggttgtttgtttgtttgtttaagacagagtctcactctatctcccaggctggagtgcaatggtgtgatctcagctcactgcaacctccacctctcaggttcaagcagttctcctgcctcagcctgaatagctggggttacaggtgcctgccaccatgcccagctaattttggtatttttagtagagagaaggtttcatcatgttggccaggctggtctcgaactcctgacctcaggtgacccacccgccttggcctctcaaagtgctgggattacaggcgtgagccactgtacccggcctgtttgtttatgtttttgagaaaagcttttactctgtcacccaggctggagtgccgtggtgcaatcacatcttactacagcctcaacctccaggactcaagtgattctcccacctcacccaactaggtagctgagactacagccaggtaccaccatgcccagatttttatatattgtgtagagaccgggttttgccgtgttgcccaggctgatctcaagcttctgggctcaagcaatctgcctaccttggcataccaaagtgctgggattacttgcatgaaccactgagctcagcattttttttttttttttttttttaagagatgaggaggccaggcgtggtggctcatacctgtaatcccagaacgttgggaagctgaggcaggtggatcacctgaggttgggagtttgagaccagcctgaccaacatggagaaaccccatctctactaaaaatacaaaattagctgggcatggtggtgcacgcctgtagccccagctactcgagaggctgacacaagagaatcgcttgaacctgggaggcggaggttgcagtgagctgaggatgccccactgcactccagcctgggtgacagacagagactgtctcaaaaaaaattgggtttgtgttttacaacacttcttggtcactatgatactatgattatttaggtctaggcttagggaaatcttctggtgctcagttatagggacaaacatgttaataatacctttgtacatgtgtgagtaatgtgaatttgcagatatcgggataaaatcacttttgtcagacccagaaaaaacagggctgggaaaacatgaagaagaggaggcttacacttacgtgtctgtgataagaactgtttgcaaggcctgtaatcccagcactttgggaggccaaggcaggaggatgacttgagcccagcagttcgagaccagcctgagcaatgaagcaaaacctcgtctctacaaaaaaatttaaaaacgagccaggtgtggtggcatgcacctgtagttatacccagctactcgggaggctaaggcaggagcatcccttgaacccagaagttcaaggttgcagtgagctatcattgggccactataatctagcctaagtgacagaatgagacctcatctcaaaaaaacaaaagcaaaaattgtttccaacaactttataaaaccccaaaagaaatcccttcacgtccttcacacatctcctgctttgcacagcttgcacatttcaaatgtatacttatgtttccatgacaagacttatcactagacattcttcaggatgggagtaattcagataagatgctcttgaaagtacacttatccagcaacggcaactgcaccaatgaattgacaactctggctttgagcttctgggagcgatgaattctgttttttttttttttttgagacagggtcttgctctgtcacccaggctgtagtgcagtggcacaatcatggctcactgcagccttgacctgaactctctaagcagactacgtgaagctctccctcttttcttttttttttttttttttttttttttgagatggagtctcacccaggctggagtgcagtggcgtgatcttggcttactgcaacctctacctcctgggttcaagcagttctgctgtctcagcctcccaagtagctgggattatagtcacccaccaccatgcccagctaatttttgtattttttagtagagacagggtttcaccgtgttggccaggctggtctcaaactcctgacctcaggtgatctgcccatctcagcttcccatagtgctgggattacaggctcagccacaggctgagcttcacgcctagctgaagctctccttctttgctagtaaaatcttcccttccctcactaggcatatttrtggcatcccaggttataatcctcgttgctcattcctgaataaactcaacctayttggagataattttttgtaatgtctttcttyaggctgacagtagraaataacccccagctttcagtttttccttctgaatttaagatggtttgcatttcctagaggggatcccatttagaggtaggggtcaaaatttttgtcttacgtttattgtgcttctgtttgtcttattttatgttttcattttcctacactttcagagactaggcattgaaaagactgaccctaccacactgacagatgaagagataaacagatttgcaagattggacattgatccagaaaccataacttggcaaagaggtaccagagcagtatacaagccccgtttgttttggctatattgcacaccctacaccctccagaagagttgttaaaatgtgaggctcagaagcttccatgttggyattttaccagctaaggcatgaccaagatggtgacattatttctttttcttgccacctctctcagtatctctccttattagctatcatcaaatctctttgttggattggtcgaacattttgctggctattcagtgttgactgaaattagggtagttaaaccaaaaatcacattttacaaatttaattttatgcaaaaagttttagtgtcatgaagtagagaaattatgtttaatcacttcttgaatcatgtgtgacctttattcttagaactcttgtgtggcataaatgacttgatttttttctgtagttctctagcttacctaatctttttttttttgagatggagtctcgctctgtcgcccaggctagagtgcagtggcacagtatcggctcactgcaagctctgcctcccaggttcacgccattctcctgcctcagcctcccgagtaactgggactacaggcacccgccatcatgcccggctaattttttgtatttttagtagagacagggtttcaccatgttagctaggatggtctcaatctcctgacctcatgatccgcccacctcaggctcccaaagtgctgggattacaggcatgagccaccgcacccggcctacctaatcatttttttacctcattttattaaattctcttatagcatattaggtagccttcaaggtttaaatacttaccagttcagtaagtaggtttcctggcttcactgccatatgctacttttctcaatgcacaactagtgtagcttagatttcactttgcatcaacaatgcaaccttctattctgtatcactattgagaaagaatcttcatccactcatgcagaatagagctgaaggccagtttattgactgtttttgtgattttccttgactcaataaccgttgctagctaatggccttatttagatgacactctcaatgtctaaaaccacattggaatttctcttcctttgcttcaatagctttagacaaatggtataatattttataaggaataagctaaaagtccattttgaagatttagtatccgatttacttttcttttgcttcgtgtctcattcatgttttctaagcaactagaggcagtcatacctattgactagctattttttacagaaatattagttacatgaaacctgatacttttttcttttgaaaaataagggttggctttaacaacacattacagcaagagtggggggtgtgtgtgtctgattgctatataagacactgcttttggtatgaaattatgacagtctttatggaaaataatttggcatattatcaagtgccttaaaaatgcttctcctccttgactcatttagagtatgaactgggtttttttgttcattttgtgtgtgtgtgtgtttttactttgaaattattttaattttgaaatagaaaacatcttgaaaaaaaaacccacaaaatatataggcaaatttgtactctgtgagcttctcacatccttacactgcttcaccaatctctaagatgaaaaactctgttctaaaacatattcagccatcagcaatgatgttattagtaggaatatggatcaatttaattttgtgtttctttgatattgtttggcatttgatactgaaatggcaactcctgtttcctctctatactcatagtactctcagcacctcacttctgacaccagatgggtagtttttctcttccacaacaattcagctttcacttctccagtggatattgactgagtatcctatgatttaactcaattctgacactaactgtctggagcagatcctacaggtaaagggctcagtcctaaaagactgccccacttcagacaygaatcgcaagtccaggttgtcacctgtgcttctgaccaactggttataaactggagggtccccacaaccccctgctcaggttcatttgctagaatggctcacagaactcagagaagcatttcayttgtgtttatggtttattataaaggatacagctcagaaacaaccagatggaagagaagcgtagggggcatcactctcccagcacctggatgtgttcaccagcccagaggctcatcaaatcatgttgttcaagagttttttttttgagacggagttttgttcttgttgcctaggctagagtgcaatggagtgatctcagctcactgcaacctctgcttcccgggttcaagcgattctcctgcctcagcctcctgagaagctgggattacaggcatgcaccaccacacccggctaattttgtatttttagtagcgacagggtttttccatgttggtcaggctggcctcgaacttttgacctcaggtgatctgcccaccttggccccccaaagtgctgggatttacaggcgtgagccactgtgcccggcctgttcaagagttttatacacccctaacaccttacccagaggttggtgggtgggactgaaagttccagccctctaatcatttggtctttttggtgaccattcctttcctgaggctgtctaggagacctaccataagtaacttattaccataaactcaggtgtgatcaaaaggagtttgtaatgaataacaagacactcctatcacccttggaattccaagagctctgtgagccttttgtcaggaacccatgacaaaggtcaaatatatttcctattacactacacataccaaaagccagaactgagggtacactaaaatgttaacagtagttagtcctgggaggtcgttagttggttagttgcttggtctttgccatgttttttgtggttatataattggatagatattctgtcatcagaataaaaattctctctgctaagtgtgctatgtttcctaaatttccagaccaggcctggcacccagcgtgtttcaaaagatatttgcacttgccctgatttgatggctcctgcatttcttacggtggtggaaagtcaatgagtcatcatcccacagaacaacaacacaaacctcagtcttttgaaaaaatgtagactgctctgtttttcttatatgtggaatatgctttaaaatagattccagatttctagttaactgtttgaattctctagatgggataaaaccaagccattccacattcctttgctgtaaaaataactcctgtgtatttatggtatatgaacatcatttcttaactttaacacatattctagctttgccatccattttgaaatattgatagacaatcatgaaattagacttattgctttaaaactctgctgcttcctttaactttgtggtccttttactcaaaatcgttctatatcttgcctgtctgctgtagtgttggataccaatgatagattcctgaggaagatcacgattggacaggctccaacggagaagggtcacacacggacggtaacaatttgtccctttccaaggaaattagttcagaggcactagatcttgctgcttctctcctcctccatcctctctcatacgaytgatactgccaggtgttgttctgccttctcccttttaaaatggaagtgagtaggtgtgtggcattgagcactcctgacagcttttgcaataaatcccatgtgtcacctgtgtgtttttcccccggcattttttcctggaggtggagagccccaagtgaatatccttgcatagaaattgattaaaattgcttcttttttgtggccatttcactgtatatctccttggtttaagaggtaccatattattcccttgtatatgaaagaaacaataagcgcatgattataagcggccttcatagggataaaatcatagctttttggtcctactataacatttattttaaaaaactgacaactcagggctgggcgtggtggctcacgcctgtaatcccagcactttgggaggccgaggcgggcggatcacttgaggtcaggagttcgagatcagcccggccaaaccccatctctactaaaaaaatacaaaaactagctgggcatggtggcacgygcctgtaatcccagctacttgggaggctgaggcgcgaaaattgcctgaacccaggaggtggatgttgcattgagccaagattgtgccactgcactccagcctgggcaacagaccgagactctgtctccaaaaaaaaaaaaaaaaaaaaaaaatgacaactcagggtcttggaataattaattaatatatttttttgctattagaggattattttcattaagtattttgggtagtattctgttattctatccttttaagctatttgtttaagcctcagatgtaaaagaggatcacttttgcaattcacacttctggtttaacacaaagtttttgctagtacctcttttccctgcccacaggcccagtttgatatctctgtggccagtgaaattatggctgtcctggctctcaccacttctctagaagacatgagagagagactgggcaaaatggtggtggcatccagtaagaaaggagagcccgtcagtgccgaagatctggtgggtacccagacacgccaggcttggcgacatatctgtgtctgttgtcctagggtctttcagcagttattaataacaaaatgtaatgctgtacttaagacattgcaattaattcatcaatttaatcctattttgctaattacaagataattatgaaatgtttaaaaagtacatcagagtgaataatagctggtatgctttagtaatagatcacaagttccagatgatttgagtaacatcttcatcctgtgggcatctctaaaagtgggtgtatgacttcaatttgcagagaacatcaagagtaccattgctttatctttgttgctaggtagttcagctacactttgatggcttaatagagtgacctgatgttaaaagttggtattgaactcttgcgtaatattgcagtttcagctttggaagacacatattgagtttggtatttatagaaatttctgcccagataccagagttacaaataactgagtactctgggaacgagcattgtcgtgctctaaaatagtctagaatggatttctcacatcagtcagcagctgagcttgattaagatgcttgtttctagagttacatgtttttccagatattacatgtgaatgtcatttgtattctatctggcaactttggccaggcgtggtggctcatgcctgtaatcccagcactttgggaggctgaggcgggtggatcacaaggtcaggagattgagaccatcctggctaacacaatgaaaccctgtctctactaaaaatacaaaaaaattagcygggcatagtggcgggtgcctgtagtcccagctactcgggaggctgaggcaggagaatggcgtgaacctgggaggtggagcttgcagtgagccgagattgcaccactgcactccagcctgggcaacacagccagactccgtctcaaaaaataaataatttaataattggcaacttcatagcatatccagaaaaaaaccatgaatggtccaattcaggtgaaagtatcarttggtccaagatggctaacatgggtaagcctagaatgtcaaatattggtttcagaaggttgggtttttttgctggtgggagttgatgctgcacacatttgttttgtagggggtgagtggtgcactgacagtgcttatgaaggacgcaatcaagcccaatctcatgcagacactggaggtgagcagagtgactcctgccttcttgaaytggttttggacagtcagagcagastggttataaagcacacttgcaaggcgcggtggctcacacctgtaatcccagcactttgggaggccaaggtgggyrgatcacaaggtcaggagatcgagaccatcctggctaacatggtgaaaccccgtctctactaaaaatacaaaaaattagccgggcatggtggcgggcgcctgtagtcccagctgctcggaaggttgaggcagaatggcgtgaacctgggaggcagagcttgcagtgagccgagatcacgccactgcactccagactgggcgacagagcgagactccgtgtcaaaaaaaaaaaaaaaaaattaagcacacttaacctgggtagtcaagaccttctccacttgctcatctctttcttctcattcttcctcacacctgtgactgggacgttactgaaataaaagagatgactttatattttccctctgggaagtattcttccttccgattccaaatcaattccataccgttgaatgtgtgatcccactttgaagcaggattggcagctcagctcacggtgtcctggtttccacagggcactccagtgtttgtccatgctggcccgtttgccaacatcgcacatggcaattcctccatcattgcagaccrgatcgcactcaagcttgttggcccagaagggtttgtaggttagtgttttttgcaaaaccagtgaatagactgtatgtttcttttaacatcaggggarttgggatggcatttttactgttgctttcctctttacagtgacggaagcaggatttggagcagacattggaatggaaaagttttttaacatcaaatgccggtattccggcctctgcccccacgtggtggtgcttgttgccactgtcagggctctcaagatgcacgggggcggccccacggtgagtggtgggttgaagtatctgattatcrgcagtgtgctgacggccaaaaggaagttggatgacttctgcctgtttcttcattgagttgctcttatcctcgtgattaacaggcagcaaaagcaagggacgggcagacagcccttgtgttggctgccttatcactcacaggcaccgtcagcgctcagcattttaagagggccaaaatcggctgcctggcctacctttcggaggacatctgacaatatctaaacccctccaaggacgtgtactcggctagccccacaaaaaactgttttacgttcagactgttctttttaaatctgcatccctctgtatagtgacactggcaaccagccaaccaaaccagttagctgagacagaggtcagccccttcttgagtatactgttcatgctggacagggcctccacaccctagggagggagtgggggagaggagaatggcagatctgcccagggctgccctgggtaacagagaaacaggtggagactggctcatcctcacctccagcctgaattttgtatttctctgaattcctactgcttagaaattcctactactttttatcctagtattttaacaccttttctttagggcctacatgaaaagacatggtgctaggttttctgaaatcatttgaaaaactattaaattcctgtccaccaggagcttgtattataacttaggaaataaggactccctggcctacaggataaaaatcaaatttgttttggtcagggtttgtcctaatgtagcagttctctgttttggcctcagaacctctttacactcttgacagttattgagagcctaaaagagtttttgttcatatgggttatagctattgatatttaccatattagaaattaaaactgagttacatgtaaacataaagaactttgtaaacatgaaaatgcattatcttttcccagcaaaatttaggcattgtacatttttcagatcttctctgggtctggcttaattgaagacagcacttgatctgttgtgacatcacatgtctcataacctttggaaaagtccattatatgctcaatgagagaatgataatgagagtaaaagggccataagatgttacagaatcttatggaaatagttttgacttcatggaccccttcaaaggattgggtccccggagcacactgggaatgctgccataacaaccccagcacccctatccagtcttagttatccctgagtgccaaaggcactcccaacccagcacactcctttctgctagtagcacaggatagactcccttttttttcccagtcacaactaacattcctctctcttacacccctcactcaccctcacaccatcacacctcctttccttgcttcctcctgacctcacagtcaggataatgtcccataatgctgtgcatggaggggaacatttgcacatatggctctgtcaagagagtaggcctcctgctctcattagcttgctgacgggaagctacctgtaaggtccttgcttcttgctctgcctccacacagccccttctggagttggagcacatagtctcactgcaatggaagagggcagagcttcttaatcactatccactgcccatggtggggcccatgaaatggacaccttcacccatttgctcatttctgtggatgcarcagggctgagccacggcatagatcaagactgggggctggggggcggggcggggaggcaccagacacctccatcctttagatatactctacaaaagagaaagaaaatccttctgtattgttttccctcttgtttgtattgaccctgcaccacggttcagctccaccaatgctaggttggcactgtggaccagttcatgaaaccatggcagggctcatcacgggctctatcgacagacatcccagggtgacttccgcaggcccgaccgcttcctctttccccacactccccttgacttccaaccccactgctatggccttcactcgagtcactgcacctgcttggtacacccctttccacctctcctgccatcgatccggtccttctcacctccttaattcaggtcatagaggtcttccacgctgcccaaagcagtcgattttgttctgtgctgtgtgattggtcacataccctaagtccttagggcaggaaataatcttatactactgtacagcctgcaarcattgcagcgtcttgcctttaacacatraaaagcaccattttaagctaggagatttaaataggaaatgcctctgactctgtttcttttccttccaggtcactgctggactgcctcttcccaaggcttacatacaggaggtaacctgagttatttctcatcacrtgtcctagaaagcaccacaccttgaatcagcatttctccacctggcccatgtggaaatgaatgggttattgctgtgacccagggygcagggtgccaaaaggcctgcagtgtgctgaggagttatattaaatgagtagatagggaagatgyacctcacaaaatagaattgtcccacatagggtgtcaataagccactgccctagaccagtggttgattctcaacagctgattttgaccccggggacatttggcaatgtctagagactttttttattattacaactggaggtggggagtgctactggaatctagtgggtagaaactggggatgctggctaaacatcctttaatgcacaggacagcccctacaacattatccagctcaaatgtcggagtgtgaggctgagaaaccctgtcctagactaatagcagttcccttccattgtcttccctgcattggctgggtaagttccaaatgccattcagatcagaagcaagtagagaccttttttgaaatggcttctcctctgccgatttaaatccatattaacgggccaagatatatggtcaggattctggttgtttttctagacaaagcttcctggatatttatagcatcaaacaggaggctagagaacaactgtgagctcaaatcttttcatatttatgtcatttaccatcaaagaaacatctctaaagccagtttggggtggttacaggaaagacaggccatcagataaggtggcaaggtcacctgctgtcactgctaattcaatttttctgcctttttggaaggcttttaaattatcaagcaatacagggtcactgttcaggccccaaatgaagtatttcaaaactggctagaaaaaattgctggtaccttcagtctgcctgtcttctgagttatggtttgccttttatggtcatttgtctgattcacgcgtaggaggggaattcacagttctggccctcctgccaccccacagcctttcctgtgtctaattacagtgactgcccctagctggcccagctggtgtcttcatttaagaaattctacttatttaaaactgttcttgatcagcgttacatattaattggttttcatgtgactagaggtaaagaattagcagtgttctttagaagctcaaataaatcataatctcagttttcaattattaaaggaaaaaagcataaatcacatttataatgaacctagttgttttccaccttttatcctacctatttctgcttttttgggatcaacaaacattagtgctgggttttgctcgatgattcagtatatgtatttttatagaagactcttttatttttaaaatatttaatgtattgttaagcctacaatagtaatataccctttgtaaaaaataataattaaacattataagaatgtaatatatgtgagttgagtccccttaacagttcggtgcatatttctcgacatttaaaaatttttcatgaattatatacatgtatttttgtgtttgtcctaaaatggaataattaagctctccatggttttgcacctttagtacatcttggacaggttccatgttaacacagatgggtctcactttcataacatctgcatgataaatatttattgagtgtatatrtcataattcattggcccagtcccccttggaggaggtttatgtttataattttccaatgctacaagcagggctgcagtaaacatacttaaagatacatttccttaattgcttccctttagtttgtagtacttggtttttggtgggtttttttgttttgttttgttttgagatggagtctggctctattacccaggctggagtgcagtggtgtgatctcggctcactgcaagctccgcctcctgggttcacaccattctcctgcctcagcctcccaagaagctgcgactacaagcacccaccatcatgtccggctaatttttttgtatttttagttgagacggggtttcaccgtgttagccaggatggtctcgatctcctgacctcgtgttccacccgcctcggcctcccaaagtgctgggattacaggcatgagccaccacgcccagccggtttttggggttttttttacagacagggtctcactctgtcacctaggctggactgcagaggcgtgatcatagctgcagcctctaactcttgggcttaagcagtctcccygcttcaacctcccaactagctggaagaacaggaacacgccaccacaccaggctaattttttaattttttgtagagacggggtctccctatgttgcccaggcaggctgctgtcgaactcctaggtgcaagtgatcctccgatctcagcctcgcaaagtactgggattacaggtgtgagctaccacatccagctcagttctttttttttttttttttttttttttgagacagagtcttgctctgtcaccaggctggagtgcagtggtgcaatttcaactcactgcaacctccgcctctggggttcaagtgattctcctccctcagcctcccaagcagctgggactacaggttcctgccaccacacctagttaatttttatatttttaatagatacggggtttcaccatgttggccagtatagtcttaatctcttgaccttgtgatccacctgcctcggccccccaaagtgctgggatgacaggcataagccaccaggtccggccctttttttttttttttttttaattaacttctcagttgtagagatggggtcttgttatgtttcctaggcttgtctcaaactcctgggctcaagtggattctcctgcctcagcctcccaaagtcctgggattacaagtgtgagccactgggcccagccactggcctgattcctaaagatagtatttatcttatttcttgccctcgttcacggtcgagttcattaaaacctttgaaaacatcactgcttacttcatatttcctggcagtatttacggcagccatataacgaatacctcttctgtgccagccactatgttgttaggctctgtcttctgatggaagggtctgtgctgtgcagagtagagtyaatttgtattatcataaccctatgaatacataaaatctataaacacaattggtaaatataatttgggtaagggtaactaattcctttcaaacrgcaaataagctataatgatgtggcataatgacaggaaacataccagctctttttttcttgaaggctgggaaacaagcagagctctactctagtgtcataggctggagtgaaagctgcagttctccatagcatccactcaccgcactggaaaaaatgcaccaagggaccttctctcttctttcttggcctccttgtcctgatagtgagtggctgctggctcaaggaggttgtttgcctttgaagaagaacctgcagtggttttcaactctctgatctcataggcctttcactgttgtttttacagaacctggagctggttgaaaaaggcttcagtaacttgaagaaacaaattgaaaatgccagaatgtttggaattccagtagtagtggccgtgaatgcattcaagtaagtgtagagtgtaagcgaaaaggatgaatgtggaaaatctcctggagctgattgtacagcactgcttttagctttattttgtttttcagttactgctattggttatagcctgtggttttagcctgcactgtgacaggcattgcrtacgtcactgcgggctcaccacctcacccactgagggtcccaaagtcagattcagctcctatgggcccttttcctttccactgggggaagtaacacacaagcctgaagttcaatgttcctttttcatctttagaggccttttatgctaacagaaggtcataggcctatagtgttccattattttactagatctggtgggatgttgtcttgacaaagaattgggcatattactctggaaggggtcatgcaagaacttgtgtgggttgtttaggtattgcattggtggtcagggttttgttataatggcctcaccgtagtagaatgggaagcaaaaaatcttttttttttttttgggggacgaagtctgtctctgttgcccaggctggagtgcagtggcacgatctccactcgctgcaagctctgcctcccgggttcatgccattctcctgcctcagcctccctagtagctgggactacaggtgcctgccaccatgcccrgctaattttttgtatttttagtagagacggggtttcaccgtgttagccaggatggtctcgatctcctgacctcgtgattctcccacctcggcctcccaaagtgttgggattacaagtgtgagccaccgcgcccagccagcaaaattcttaaatgctagtatttactgattccttctggagtgctgggaattttccaagtattttacatggatttaccatctgagtctcataacgtcccaatgaaataagtgctgtgattattcgcgtattaccagggtggaaattgaggcacataaagattaggtaactggccaaaagtcaccagctagtaagtttcggagctgagattcaaacccaggccaaatttcttggttagtgttcgtttatcagtgggtaattcacatgaggtttaatggcaaaaagaagacaattctgtctctccagccattttccatgctttgatatgaaatgcttcctttataggacggatacagagtctgagctggacctcatcagccgcctttccagagaacatggggcttttgatgccgtgaagtgcactcactgggcagaagggggcaagkgtgccttagccctggctcaggccgtccagagagcagcacaagcacccagcagcttccagctcctttatgacctcaaggtgggtgatttgctgtctgcaaaaaaagaaaaaagacgaaaagggcacagtgaagtttctgtgtggctacttctattagagccccatgcttcgcagcttcagccttgcggtttgattcccacgtaggtgacttacacaaccacagcctggactcccagctgtagacagccttctttttatttttgagacggagtcttgctcttttgcccaggctcgagtgcagaggcatgatctcagctcactgcaacctctgcctcctgggttcaagtgattctcctgcctcagcttcccaagtagctgggattacaggcgtctgccaccgtgcccagctaatttttcttatttttttagtagagayggggtttcaccatcttggccaggctggtctcgaactcctgacctcgtgatccacctgccttggcctcccaaagtgctggaattacaggcgtgagccactgcgtccgcccagacagccttcttataaacatatgccactgcttacttacagaggggatttaagcaggaataccccagggtggagggggaaccgttgctcatatcctaacttcgaaaagggtcaaagtacaggtggcagaagagaaggttacatatagaccaaatatgtaattcactgtagcctttaaaacaaggcaccaaccatgtagcagattggtaaggggctgcatcgagcttacaaaatttttctgatggcttttcagtaataggggaaagaagtgtgcccccacgttcacttcctggtaaggtgctgcctcaagttgagggccctcacatgcaaaaccaaagtactccaggaagcttcatcattttttccatcactaagcaaattaaattacacctggtctaagtagagccctgcttactctatgatacaataaagttagttcaggaaaaggttcttattatagggttgtgttttgttttcatttatctgtccagtgtatttcaggatgtgatttgacattaagtagtatggaaacaacaactggaaactttgttaggaatatgagatatatgctgtagttaatttttcctattctctaggctagtttctggcttgatttttttgttttgttttttgttttaagacagggtcttgctctgttgctcaggctggagtgcagtggtacaatcatggcacactgcagcctcaacctcctggacccaagtggtcctcccacctcagccccctgagtaggtgggaccacagacatgtactaccaagcctggctaatttgttttattggccaggcacagtggctcacccctgtaaccccagcactttgggaggccgaggtgggtggatcacctaaggtcaagagttggagaccagcctggccaacatggtgaaaccccatctctactaaaaatacaaaaaattagctgggtgtggtggcaggcacctgtaatcccagctacttggaaggctgaggcaggagaatcgcttgaacccgggaggcggacgttgcaatgagctgagatcactgcactctagcctgggcaacaagtgcgaaacttcgtctcaaaaaaaaaattttgttttattttattttatttttcttgtagtgactgggtctccctatattgctcaggctggtctcgaactcctgggttcaagtgatcctcctgcctcagcctcccaaagtgctgggattataggcatgagccaatgtgcctggcctggcttggtttttaatagataatcatagactttcaaaaacagccataaaaaagcagaaggaataaacttattactcttgagttttagtgttctcttatttctctttgccccttgcagatataatacacttacagttaattaacattgacattgacattctcctgttgagctttgattttataggcaagttttaaaatctgttcagcaatcatccttttagaaaaatgccataaacacaaatttgcacacaaatgcaaagcatttataggcaccctctccaggctccaatgcatagcacccaaggctggaagcccagtccttgaaaaccagcaggagacctgaaagagcagggacatatggactttagaacccrtttctacttgcaacttttatccattctggcaaacaggaggctgccactttttgtcttactcagcgtctgctagtcttaaatcacccttcaaccaaagtgcttttgcttcagaagttctaaatgtgccttggcatttatagagctccagttatgagatgcatatgaaaataatctgtgtttcatctttataaagtccttattgaatgttcactttattcatgcccattatataaagccccttcataaattatcattgtttagttcaaaagggaatttttgtttttatagatagattattgctccttttaaaaacaaaacttggctgggcgctgtggtcacacctgtaatcccagcactttgggaagctgaggtgggtggatcacctaaggtcaggagttcgagaccagcctgaccaagatggtgaaactccgtctctactaaaaatataaaattagccaagcatggtggcccatgcctgtgatcccagctacttgggaggctgaggcaggagaatctcttgaacccgggaggcggaggttgcagtgagctgagatgacgccattgcactccagcctgggcaacaagtgcaaaactctgtctcaaataaataagaacctgcctaatatgttcttttagctttagttgctataaagacagatatattgcctaatttttgtaatttgctcatccaaattacccatgagtagctttgcttctgatttcctttaggcaacctctccgtatgctgttctctttgaatcttaatgccctgaactagtctacacagcatttaagaagccagctccacttctctgaaggctttgccccggaggaaacagcccatgggactgaggccctcaccagttagaccactggtctctgtccactgcactgtttgcttcaggtgccacagaaagtggacatgcccaatgcgtgttgatcatgtaaatcactgggttgttttttctaatacctgggtgattttgattttatgactatttcctaattcctggtgcttgcacttaatcaattgtgttaagggtggcatctgcctctcatatacagactgggagttatgtagatggacattggttgtcttatttcataaacagtgtccccaggtctggtttgacaggactgatctccagtattagaatagaacatctactttttaatttttattattattttaaaatttttattttttaaagagacagagtgttgctatgttgcccaggctggtttcaaactcctgggctcaagtgatcctcctgccttggcctcctcccaaagtgctgggattacagggatgagccaccatacccagcctgaacatctactttttatttatgaagaaataattattcttgggtagtcagcaacactgtttatgatgtacttagcgagagattttaaatatgtacttatgtaagtatatatttaaaaccttaatatatattaatatgtgtatctatatctatatatatatgtatgtgtgtatatgtatatctgcatatatagatataaaaactttacctctgtgggacattttcacttataaaatctgaggcttgatattaaaagaaagtgttcctggctgggtgcagtggctcacacctgtaatcccagcactttgggaggccaaggctggcagatcacctgargttgggagttcaagaccagcctgaccaacatggagaaactccgtctctactaaaaatacagaattagccgggcttggttgcgcatgcctataatcccagctactcgggaggctgaggcaggagaatcgcttgaacctgggaggcaggggttacagtgaactgagatcgcgccattgcactccagcctggcaacagagcgaaactccgtctcaaaaaaacaaaaagaaagtgttcttaacccaatcatcaacctcaaactatttgcttatgtatatgtatataaaaaccatcttctgccccttttagggactctgacctagaatgtggctatgtcctggttaaatgtcctcacatgtgtccagtcatggtgtccccatctctttcttgtgcattagctcccagttgaggataaaatcaggatcattgcacagaagatctatggagcagatgacattgaattacttcccgaagctcaacacaaagctgaagtctacacgaagcaggtagatgtttggttagtttgtcctttcaactctttgcaaagcaggacttggagtcrcaatctctgggtcctcccagccctgccaartacccgttgcttcacttctctgggtggcagccttctctcctctgaaatactgagtttggattaggtggcacagtccctggttctttatttacccataggcgttatatgaatgtgtagaaatccatgaggaaatacagaatgtcttaccaaaatattgagaacgtctccagtttttgttattttgagatagggtctggctccattgcccaggctagagtgcagtggcacaatttcagctcactgcagcctctgactcctaggctcaagcgatcctcccacctcagcctcctgagtagctgcgcctacaggcacgcaccaccacacctggctaatttttgtgttttttgttgagatggggttttgccctgttgcccaggctggtcttgaactcctgggctcaagcagtccacccatctcagtctcccaaagtgctggaatttataggcatgaaccactgcacctgaccctctccaattttattctcatatctactccaaactattattttaaattagttttatgttatttccatagatggaaataaaatattcacttgtggactacagttgtgagtacctaactccctcacccaacagttctttttttttttttttggcttaataaataagctggaggacagcaagatagagatgtatataaagggagttggatgtttcgaataaattgaagaatccatgtaatcacagggcccagatggtcattgctgggttgtcatcttttcatttgtcctccctctcttcccttctttccccagggctttgggaatctccccatctgcatggctaaaacacacttgtctttgtctcacaacccagagcaaaaaggtgtccctacaggcttcattctgcccattcgcgacatccgcgccagcgttggggctggttttctgtaccccttagtaggaacggtaagtgcatgctgcaagggagtagtgggcgcatctgcacttctcgtctgaagtgtgttgccgaaaccatcaagcaaatgccaagtgagcagagttcactgcccagaagaaaattggaatcgggcctattatgattgctgtggatcataagctataaagcaggagctatatagctcttgctgtggaccatcttggtgtcaaatcaagaatgatgccaggactactcatactgaataaaaaattctgtttcccagggacagtatgctcttcactgaatctaggatgagcccagttgataggctggggtagtgctaacataatcacagttaatgtttattgggagccttacatagattaactcagtccccccacagccctaggaggtagggacagaggttttactgacaggcctagaacttacgtctgaaattcagggggttcattatttttaagtaaggaatttccccattaaaaaatgcaaatggacccttgagatatgaaaggtgaggttgcttatttacgcttcaaggtgaacaaggtgtccattgctttcttatcttacagattttatgcatattcaaagaagaatattgccagttgggaagcagaggggagggatgcttaaggacataatcatagtttgggctgacattgttccaaggttaacttggatcctgaatctaggttatcccctaaatctgccctgtatcctgtatctacagattgtactgccatgcaatacaggactgaaatattaaactaaatcaacacacatggaaaagaaaccaacatacatccttttggatttatgtcattctttcagtatagtaagaaagtggtaggaggtggcattatagagttgaaaacgtaggacattagagctgaattcattttcacctcttcagatcttggccttgggcaaattatgaaaggtgagagccctgctgccctcagctcacactgtaggcaacatcatcacatcacagtggtgcttagcacaaatgcctgcatctcactgcctccttagctctctatagagagcagaaggcttagacttgctatgatgtacatcagtctccaggatttgtagaaatcccttgtggtaggaattttccaccatttttacccagcaccttgaatagtgcagaaatatgtgttgttctttttggagaagttgtcagcagctaccagctgaaagacgggtagctgtactctttcttgtcacttttgatcttcacatgaagaaaagggtaacagtagaggtgaaagcaaatctggaagcagtcaggccagtgagagtcaggctgtaaggtggagagagacacagcctgccgaactcaagactttctcatttagaacaaagtatgtgtcagaggcttttaactttaagttggaccaaggcgtttccacacatgatcaaatggtttaatcactattctaacaccttccagttgccgttggggccttaacgagactcagattatttgaatattttctatattaattcaaagtgtgatggcttattttcagaactttatatctaggttcatacatgtgcgtacacataatattgtctttttttgtattttttctgattatcagtgaccagtgtttaggagggaaaatcctcttggggaatgagtgaaaatatcaaaaatcctactcatcactgtttagggaaccatctttagggttttctgctgacatgcacatgcccgtctacaacaatgggcatgtgtcttttatctttataatgtcatcttccggtttttctgctgtgtctaaggacccatcctttcctctctcctacttgtctcacacctagcacctccttacctcttacacaatataagaatataaaccagttgtcagatccctataatgtgttttggggaatattgattggtactcagaagtcagtcagaatgaggttttctaaagtattgatgatgttttgtgttacagaagatgactctttttaaataacctttttatagttaagttttagaagtaacctaagctgttttcctgtctagatttgatttggaacttgtgtgtattcattatataggacattgttacagataaaaatatacggagttttcacttgcaagccgtacatatttgcatctaagtagaaatttgtcaaagccgagtctttagaaaagtagtgagtacaaatataatttgtaagcattacaagtttagttttagaaggccattttgggccagtaagaatggtgattataaaaccatctagattatgtacaaaagtgtcttggcccaagttaaaggatactaactcctaccatcgtgttgctgaagcaaaaatcacatgggcagctcagctagcaagactgaacgaaacaaaatttaaaagcagrcaagccctgtacctccttttggtcttgcaaagcgtgagctgaggaggcgagtgagcaactcctctactccccagcactcattcttgtaaggtgaaggtggaaacacctcctgctactgcttgtgaccacatggaagatgatagtgaaggctggcatttggtttgcagaaggacatgaggaatcagtttcttttcttttccttttttttttttttgagatggagtcttgctctgtcacccaggctggagtgcagtggcaagatctcggctcactgcaacctccgcctcccaggttcaagcgattctcctgcctcagcctcccaagtagctgggattacaggcacacgccaccatgcccagctaatttttgtatttttagtagagatggggtttcaccatgttggtcaggctggtctcaaattcctgacctcaggtgatccatctgccttggcctcccagagtgctaggattataggcatgagccaccacgcccggcagggatcagtttctgagttttttaacaggatcagtgacttgatttttaatatgtaacaagagtacccactttattgacaactataaaatgatgttctatctttatgccttgggctttctttctgaaggaaaagtgaaagtaaagatgactttacgtttattttagacatggccttgctctgtcgcccaggcaatcggatgatcatggctcactgtggcctcaacctcctagcctcaagcaatcctcctgccttagcatcccaagtagctggaactacaggcacatgccatcatatccagctaattktttatttcctgtagagatgggggtctcactatgttgcccagggtggtttagaactcctggcctcaagtgatcctctccayctcagcctgggattataggcgtgagccactgtgcccagcattagtttatttgtaatgcttttttacatcctagatgagcacaatgcctggactccccacccggccctgtttttatgatattgatttggaccytgaaacagaacaggtgaatggattattctaaacaggtaagttgttactgggtaataatttggcttttttcctcatgtagcttatttatgaattatagggctcaaactgacgctataaaaattcacattctaatgctttcaaaacatttcttttcagacttccctgaggggagaggggatagtaatgagagttggcaataaccaatgaattgaaatatttatatttcaacacatttttggaagaagcgcagcatggcttgtcacaggttgacagtgtaggggagaaaactgctgtccaataaactacagaggaaactacaggagaggttagactccctctgctgaagccccaggaggcttggggttcagagttgatgacacattgcaggtcaggaacagctgacggtctgtatactctgaataggtagttagaaggcaagaattagcaaatgtcttaggaagtataatagaaaagagaaggaaacaggaccaatctggcagttcttagggccttaggtgaaagggccctgagtaccgactgcaatgagtgacattgcattgtttgatatttttgaaatttcaacaggacgtgtctctccttaggcagacccttggggctgaagcagcaagttgcagtgtgcacttatatccctagacacatcctgttgaaactgcaaaaatatcaaacatgaaaatcctaacatctttctccagagacgaaaaaagtggcttgcctatgaaaagaatgagaactagacttaacgcccgtcttactggcaataagaagcttttagacaatggaggagtgtcctgtaaggtcacagggaagatgactttcaacatgtgctcacacctagccgaatctatctggatattttcagacgtgcaagggtttgccaccccacatctcttcctaagaagttatttagcaatgtacttagcaaaatgaggaattaaccaagaaaaaaggaagacgtgagttttgggaaactgaaccctcatttggacattagcgaaggggcattctgataaccatgcaaatgacctgaagttacaaatcctgtgtggaacaggttgggggagcacctgagaaaaactagaaaaagcyagaaaagacaaggatatcaaagggtcatagtataaaacaaaagctcttgcattatttgagaaagttaaggtccaagtagaagcaaactgtagtttgatgctagaacactattctttgagagggtatgtgtgatactcgaaatgcagtcatggctcacggcttggtctggtcttgaacagtattcacacagtactatggaaataccatgcatcattttcaagtccatttatggacacgccctagaagagctggtggcaggaaaggatgtaaatgttaacagctttggcaatgtgagtgggtaatggtgcagtatggaaggaacaggaaacatttcagtgcttagagaaaacatttatttcttgtttttccttccagatcaccatccatcttcaagaagctactttraaagtctggccagtgtctattcaggcccactgggagttaggaagtataagtaagccaagagaagtcagcccctgyccagaagatctgaaactaatagtaggagtttccccagamgtcattttcagccttaattctcatcatgtataaattaacataaatcatgcatgtctgtttactttagtgacgttccacagaataaaaggaaacaagtttgccatcttggtgttgcaatatgaattacagccttaacagactgtgccacaggtctctgccatcctttgtgagctcatttgtcaggcagacccttgggctgaagatgcaagttgcagtgtgccctttatgatactgttgtgtttagagggaaatgtatgcatgcttgtgtatttctgagaggacacataattcaggggacctcctgagagggttgggttggaagttgatgacttaccttttaatcttatacctttctatattgttgaattttgtttttctaccctgaggaagtattgcttatacaagtttttgcctgaacttccttggaattcccatttctgtcacagctttagcactgtctatgtttagagtgctcaagaaggatggtcatgcagcattagccttaggtgagcctctattctgttggtgcagcaagtattcattgagtttcttctaaatgcctgggctccacccttccctacagactttttatttttatttttatttttttgagacagtgtctctgtcgcccaggctggagtgcagtggcgcgatctcagctcactgcaacctccgtctcctgggttcaagtgattctcctgcctcagcctcccaagtagctgggattataggcatgagccaccatacctggcccagactttctttttcctaaaacattaggttggtaaaaaccacaattacttttgcaccaacctaatattttttttcctcctcttctggctgggcgtggaggtggctcatgcctgtaatcccagcactttgggaggccgaggtgggcggatcacttgaggtctggggttcaagaccagcttggccaacatggtaaaaccctgtttctaccaaaaatacaaaaattagctgggtgtggtggcaggcacctataaccccaggtacttgggaggctgaggtacgagaattgcttgaacccaggaggcagaggttgcagtgagccaggatcatgctgctgcactccagcctgggagacagagctagactctgtctaaaaaaataaatcaaatatttttccttctcttcttgttctttatcttctatctctgttcttcctctcccatttgtttccttccctttttccccttgtctccctccactggatccttccagaggatgctgcatcccactggcgccagtgctaaacactgctgatgttggcaaagcagtatttttcccagtgaccttggttttattatttttaattccctaggtccatgtcaatgttgtaatacagtcaattttacagtccacagaaatgatagcgctgccttgagaggcatatggcaaaggggtcacagtgcagagccccagctctatggcagagagcctcacccacctccctgcctccacatcctcaccatggaaataggagcactgttggtacctacctcgtgagggcggttctggaattactcaaacacatcatctaagatgctttgtacagggcctggcacattgtaagcacttgtcagttcctgttgcacagcatcctccaggccctgtttgcagagttaattgcttctggtactttttttttccttttttttttttttttttggcagggggggtaggggggttgggacaagagtcgtgctcttttgcccaggctgcagtgtagtgacgtgatctcagctcactgcaacctctgcctcccgggttcaagcgattctcccacctcagcctcccgagtagctgggattacaggttcgcaccaccatgcctggctaattttttgtattttcagtatagatggggttttgccatgttggccaggctggtctcaaactcctggcctcaagtgatcctcccacctcggcctcccaaagtgctgggattacaggcgtgagccactgtgcccgaccgctttctggtacatttcttaatgtcctgtgaaacttcacctggaatgggatttgctgggaattcattttgtagacaagggaaggatgcagtcttgtcagatatggtgacttaaggatcatcttaaaggatttaggtttcctaatatcgccaacagccacatgggtttaaatcctcaatactggtaggggctgggcatggtagctcacacctgtaatcccaccacactcagctgagttttgaagttctgttttttgtagagatggggtctcactgtcttgtccaggctgctgaggcaggaggatcacttgagcccaggagttcaagactaacctggacaagacagaccccatctctacaaaaaacaaaaccccaaaactcagctgagtgtgtggtgcacgcttgtagtcctagctccttgggagtctgatgtgagaggtttgcttgagcctaggagttcgaggccgcagtgagctatgactgagccaccgcattccagcctgagcaacagagcaagaccctgtgtcaaaataaaaaagacctatagaagcattagtgcttggggtaactattagcatgtgctggcagagaaggtctagtgcctttaccttggtgctaagagtccctccagattagtggctttcccgtgccctttctcttctctgggctgctaatgccttccttccccttattagtaatattactgataaacaaattgtacattctctgatctcacttcagaggctgtttctgtgcactgaagatgtacacacagtcttaattcaaaagagatagcatttatgtgctgccacattaaacagattgcaacagtattactattgagtttgtgttggctctgtgcaaccctcatggtgcccaggaacagatgaaaccaccagagacttggagcctcaggttcattcaatggtgtcccagggaacggggttggagggcttattcccagaaggcctctgaaatgtaagagctattaacaaggagttataagtcatttttggtagctataggcccaggcaatgggtagagatcaagatgggataaatggtaagatcagtagagtattgctcagataaatatgtaagctattttactggcacactgtatctagtgatattaacatgataagctataggtaggataatttctcatcagattgcagaaatacatttatagcctatttcctgttatataatgaaaagctactaatggggtagtagacaatgatatgggtaatagcttaaacagccttcgttgtcacttacctgaattcaggaatgacaggtttctttcatgcatgaggtactggatacattaaacacacacacacacacacacacacacacacacatatggcattgagttctagtcatatcctaaagaaaaactatggtgcgctatgttatttatagtactatactctgtgtgagtgactctgtgtgtatgtgtgttggtggaggtcagggatgacttgtttgtaatataccttaaggaagtctgtccgaatttgcccttcaaatactaaataaattcatctctcacctcaaactgcctttcagttcccttttactaattttgtttaaaagaaaggcaagtgaaggccaggcatgggggctcacacctgtaatcctagcactgtaggaggtcaaggcaggaggatcacttgagctcaggagttcaagaccagcctgggcaacatagggagacgccatctctacaaaaaaaaaaaaaagaagaagaacctgggcatgtggtcgcatacctgtggtcccagctgcatgggaggctgaggtgggaggattgcttgagccagggattgtaccactgcactccagcctgagcaagaccctgtctcaaataaaaataaaaataagacagctattttaccctgtcttcacctaaataagctcatcttattttttgcctgaaactcttgcaaactcccaggtctgctagttttgagaaaccttggatctcaataaggaatagttctcaattgcttataagcataatggatttcttttggcttaaagttcaaaactggcaacaagcagcgctagcaacccatagagagatacgcagaccatttcgatagacgtgtttgctgagtgaacaaggctgactgaatttttttttttttttgaggcagggtctcactttgttgcccaggctggcgtgcagtggtgcagtagtggctcacagcagccttgaccttctgggcccaagtgatcctcccttctcagcctcctgagctcctgagtaactgggaccatacgtgcaccaccatgcccagctaattttttagatttttttgtctccctatgttgcccaggctggtctcaaactcttggactcaagccatcctcctgccttggcctcccaaagtgctgggattacaggtgtgagctactgcgcccatccctgaattcttaattacaactaaactagatgcttatggattttcctgttttacaactcttgcctcttttatctgtaattttaagatcttgacagcttatatttggctttgcttttgtgtctcaagagttctttccttgataagcctctgtggaaactacagaatcttacaaatataaaacatttccggaaaaaatacaaaaatggacacctgacatttacactccctaaggtcgtgatcctgttgaagaaaggagatgaacgcggctgcttttcagtagttcttcacttcaccttaccaggttcttcatctggatgctatgctatgggggccagaggaggaggctgggattgtgatggatcctactagattttacagctggagctcccaggaatgccctcatagggaatgtcctgaagggaatcatgggtaacttgtaagctacctcaacttatttttggaactatgtaaggtataagatggatggagctgggttcctgtgcctttctcaccttgtccgcatagagatgcagctgctcctgcaggccaaagttctgcaccaatcacctccacctgcttcccactgggagacaaaggtttgaaagcctgtttggcgatgaaccacgatgatctgacactcaagccactcctgagaaagtcgggtttctttctgtttccatttatatatgtaattttcgcttcaaacaaacatgacctcgctattctatgcacagttttgaatcctgcttttaaaatgcgatgtctgccttgtctttaaatattctgagggggaggagaggagatgtgtaatgcgactgtctataatttgaaaccggacctcactatttagcgtctcagaaaacgcggggttcattgccctggtcccccccgccttcccccgccccccgaaccttccggctggctctcttgcggtccccgcctcggcgctgatgtggtctggcagtggagattggcgcccgggcggagcacgatgggcttccccgcggcaggcaggcaggctgctgctgcaggtgggtcccggcgcccgcgccgccccgcgcctccsgcggtcgccccgcccctgcccgcccgctccgctccgctcgcattggcgctgcctgctgtctgtccccgcgcggtggggagggggcgcacccggcggcgggctctgcagagggcgccttgctccgggtgcgaccgcggctccctggaggcctgggcggcgggccccgcgagcgcgccgccacctcgggagcagtgttggccaaggaccccgacgccctacgtaagtaaaggcagggcggggagcctgcgggggaggagggtcgggggcaatgtccggtccgcggaccgcggagtgggcaagaggtgcccactggatacggggtatccgagccctctgaggtgctgggagtaagaacgcgggaggtcgcttgtccgctggaatccgcggccagggcgaccctcatcaggtctgcccacctatccccttcgcgttacagcttgtcttagaagcatgggttgccggtggcttttttccttctttatccctctttgagaaatgtgattttgggtttctggccattacattataattctgcagacagcctgaagctgggttatctgttccacgcccccggcattttcctttttgagtactttatcctgcgctctgtctcctgccataaggggcgtcaagccagaattcgagattccttc

SEQ ID NO: 17806 - DNA, 14036 bp, Homo sapiens
  misc_feature (1)...(14036): n = A,T,C or G, or insertion/deletion polymorphism (see Tables 1-2)
gtgagctatgatggtgccattgcactccaacctgggcagaaaagtgagactccatctcttagaaaaaaaaaaccaggccgggtgcagtggcacatgtctgtaattccagcacttcgggaggctgaggcaggcggatcacttgaagtcaggagttcaagaccagcctggccaacatggtgtactttctatactaaaagtacaaaaattagccaggcatggtgacatgcacctataatcccagctacttgggagactgacataggtggattgcttaaacctgggaggcagaggttgcagtgagccgagattgtgccactgcactccagcctgggtgacagagcgattctgtcttaaaagaaaaaaaaaaaaaaaaaaggctgggtgcggtgtctcacgcctgtaatcccagcactttgggaggccgacgcaagtggatcacctgaggtcaggagttcgagaccagcctggccaagatggtgtactttctctactaaaagtacaaaaattagccaggcatggtggcatgcacctataatcccagctactcaggaggctaagacaggagaatcgtttgaacccgggcagcagaggttgcagtgagctgagattacgccattgcactccagcctgggcaacagagtgagactccgtctccaaaaaaaagaaagaaaaaaaatccagggccagtgtggtgactcatgcctgtaatcccaaaactttgggaggctggcccagcatggtggctcacacctgtaatcccaaaactttgggaggctgaggcaggcggatcacctgaggtcaggagtttgagatcagcctgactaacatggtgaaaccccatctctactaaatacaaaaaattagccgggaatggtggcatgcacctgtaatcccagctacttgggaggctgaagcaggagaatcgcttgaacccaggaggcagaggttgcagtgagatgagatcagtcattgcactccagcctgggcaacgagcgaaaccgcctctcaaacaaacaaaaaaaaactttgggaggccaagatgggcagatcacttgaaaccaggagttcgagaccagcctgagcagcatagaccctgtctcaacaaaaattttaaaatattttttaaaattagccaggcacagtggcacacacctgtagtcctagatacttgggaagctgaggtggaaggatgacttgagcccatggttttgaggttgcagtgggctatgatggtgccactgcactccagcctaggccacagagcaagacaccatgtcaaaagaaaaaaaaatccaatcacctctgctcacctccctctttctctctctctctctctctccctccccctctctcccctgcaacacacacacacacacacacacacacacgcacrcaygcacgcaccacacactctgacgacctttaaaggcttcctgtggctggatgaaatctagaggctttacccttcttgcatggccctgcatgacctggcccctgccctcctctctgacctcatctcccacccgcctcccagtctctctctctgctccagccacactggccttctgtttgtcgtcaacacccccagcttggttccgccttccagcctttgcagtagctgctccctttacctgaaatgctttgctcccaaacttttacctggtcactattttttgtcatttgggtctcagctccagtgccacccaaacactcaaagaggattttgctgactactgtatttaaaagtagctccctgccactcttacaacatcagcctgtcttattttctcatagtaccaatttcttcttcagtttctttcttttccgtctggcctcactggaatacaagctccacaggtgctggtaccttctctgatccctttgcctccatgtccctcctgccttaggacaatgcccagcatgtgttaggcacgcagatactcactaaatggaggaatggatgaataattcataaagcaggataaagttcaactttaggcttgtggctcagattggacttacatttagagtcagatttaagtttagtgttaggagtggtggtaaactggtttcaagattagccctagaaacagggttgggttggggtagaggagaagttttatttagggggttattaattgggatgtgtttagatttaaggttagggttacagttggggttgagtttgagttgtgatttgggttgaggttaaatttgggttagggttgatgttggtattaaatcccaattcaggttttgaggctaagttcaagtttgaagctaatgtcatttcagtctcatttggaggcttcagagatttcactagtttctccacaaagaccactataaagactgtatttccctgagtctggggcacaagactccagtcatcagctctcccacccagggaaagtcccaaaccaactgctggcctgcccaagaaagaaaccaaattcatacaacctccgaaactgagattgaaaccaagattggcccatctcaaggagcatccttcgcatatctcacatgcacgtgacactgagcctcagcccagtcttacccttccttcctctgtgtctctcatgtctccccatcacccttcttgccttcccttttttgtctttcaatgtcccattcttcctctttaatttaaatttctctctgtgtctcactgttaattgcaatacctttttttgtttgcttgttttgttttgttttgttttttggtttgtttgtttgaaatggagtctcactttgttgcccaggctggagggcagtggcacgatctcggctcactgcaacctccgcctcctgggttcaagcagttctcctgcctcagcttccctagtagctaggattacaggcgcgtgccaccatgctcggctaattttttgtatttttagcagtgatggagtttcaccgtattagccaggattgtctctatctcctgaccttgtgatctgctcgcctcagcctcccaaagtgctgggatgacaggcatgtgccactgctcctggccttgtaataacattttatattttaatatagctcagctggggtcccagtccatcagctcataccattagagaagcagaaagagacaacaggaagcaaaaaggaccctgagagaaagggcaacacagagaaaaagaaaggagcaggggctaaaagggaaacccacactgacacaagagataataaggttaaaagaatgagaagaaggttgggcgcagtggctcacgcccataatcccagcactttgggaggccaaggctggtgggtcacctgtggtcaggaattcaagaccaacctggccaacatggtgagaccccgtctctactaaaaatacaaaaaaaaatttggcgggcttggtggcgtgtgcctgtaatcccagctactcgggaggctgaggcaggagaatagcttgaacctgggaggcagaggttgcagtgagccaagatcgtgccactgcactccagcctgtgcgacagtgagaaactgtctcaaaaaaaaaaaaaaaggaaaagaaattttctgacctatctcatctgatagtaggttataagaccctcattccagaagaggttctgccctatacctgggaggaaggaatgctgtacagagagaccaagaagaatatggccaggccttgctgggatccccccagtcccagtctgtgaccattagatgatactccttttgttcaattacatttctgcacagctgttcattcttcatcaaatctaagcataaaaatagttttcccctgggtccttgggtcttcatttctgaaggctcccatgtcacctaaaactttgattaaataaatgtattatgcttttctcttgttaatctgtcttttattataggagtattggccataacccttatgatgggtcaggaagggatcacccctttctgcccctacagaaataatagctaagactagtaaagcataaaaggcaaaggggcaggtcctcaagtagagaagaacaggagaaatagctcatacacacccagaatgttacttacatgtccctccatgttacaccaagacccctcagggaccttgtgcctggggagagaagtggtctgccccatgcaacagtgggctttaccccgggtcaccaccagccccagctccaacccctctaacactctccaagtaaaatcacatcagtagcagtaataatatttgaggtgacaagttggtattatctcaaacttaggaaaagtgaataaagtcatctttagaaactgctttttttaaaccttgtaacttgcaagctaagtgaaaatgggctcatgtatgagaatgttcgtgttagacattttttgtgttagacaaaaactagaaacaaaccaaatccccatcaacagaatatattagaatatattgatacaatagaatattacatcataatttttttaaaaaacattactgatacatacaaccacgtatatgaatctcacaaacataatgctgactgaaagaagtcaaacagaaatgagtacattctgtgtgatttcatttatatgatgccccaaaccaggaggaaataatctatggtgataaaagtgagagagtggttggttatctttggagggtatcagcagggagggggcatgagggaacctgctggggacctgaaaatacgtggagctgggtggtggctacatacagatggaaaaattcatcagctgtacacttaagaggtgtccacctcatacctaagttacatatcaataaaaaggaaaaaaattttggaaactttttttttttttttttgagacagagtcttgctctgtcccccaggctggaatacagtggtgcgatcttgactcactgcagcctccgcctcccaggttcaaataattctccagcctcagcctcccgagtagctgggactgcagatgcgcaccagcacgcctggctaatttttgtatttattatagagatggggtttcaccatgttggccagctggtctcaaactcctgacctcaagtaatccgcccacctcagactcccaaagtgccaggattacaggtgtgagccactgcaccaggcctggaacaattttaaaataatgtattggctctgcaaatgcagcttcagaacaagtcccttagctgtccccaccccaccctaagtcaccacccttaagcctcacccatgtggaattctgaaacttcctttgtagaaaactttggaaggtgtctgccacattgatcctggaatgtgtgtttatttggggttatataaatctgttctgtggaagccacctgaagtcaggaagagatggagggcatccttcaggagtgagatgagacctcatcatacttgactgtccagcatcatctctgagtaaggggaccaaaaaatttatcttccaaactaggacactttcaagagtggaagggggatccattaatattttcacctggacaagaggcaaacaccagaatgtccccgatgaaggggatatataatggaccttcttgatgtgaaacctgccagatgggctggaaagtccgtatactgggacaagtatgatttgagttgtttgggacaaggacaggggtacaagagaaggaaatgggcaaagagagaagcctgtactcagccaagggtgcagagatgttatatatgattgctcttcagggaaccgggcctccagctcacaccccagctgctcaacyrcctcctctctgaattgactgtcccttctttggaactctaggcctgaccccactccctggccctcccagcccacgattcccctgacccgactccctttcccagaactcagtcgcctgaacccccagcctgtggttctctcctaggcctcagcctttcctgcctttgactgaaacagcagtatcttctaagccctgggggcttccccgggccccagccccgacctagaacccgcccgctgcctgccacgctgccactgccgcttcctctataaagggacctgagcgtccgggcccaggggctccrcacagcaggtgaggctctcctgccccatctccttgggctgcccgtgcttcgtgctttggactaccgcccmgcagtgtcctgccctctgcctgggcctcggtccctcctgcacctgctgcctggatccccggcctgcctgggcctgggccttggtgggtttggttttggtttccttctctgtctctgactctccatctgtcagtctcattgtctctgtcacacattctctgtttctgccatgrttcctctctgttcccttcctgtctctctctgtctccctctgctcaccttggggtttctctgactgcatcttgtccccttctctgtcgatctctctctcgggggtcggggggtgctstctcccagggcgggaggtctgtcttccgccgcgtgccccgccccgctcactgtctctctctctctctctctttctctgcaggttctccccatgacaccacctgaacgtctcttcctcccaagggtgngtggcaccaccctacacctcctccttctggggctgctgctggttctgctgcctggggcccaggtgaggcagcaggagaatgggggctgctggggtggctcagccaaaccttgagccctagagcccccctcaactctsttctcccctaggggctccctggtgttggcctcacaccttcagctgcccagactgcccgtcagcmcccyaagatgcatcttgcccacagcamcctcaaacctgctgctcacctcattggtaaacatccacctgacctcccagacatgtccccaccagctctcctcctacccctgcctcaggaacccaagcatccacccctctcccccaacttcccccacgctaaaaaaaacagagggagcccactcctatgcctccccctgccatcccccaggaactcagttgttcagtgcccacttcctcagggattgagacctctgatccagacccctgatctcccacccccatcccctatggctcttcctaggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaatgctgtctgcttgtgtgtgtgtgtctgggagtgagaacttcccagtctatctaaggaatggagggagggacagagggctcaaagggagcaagagctgtggggagaacaaaaggataagggctcagagagcttcagggatatgtgatggactcaccaggtgaggccgccagactgctgcaggggaagcaaaggagaagctgagaagatgaaggaaaagtcagggtctggaggggcgggggtcagggagctcctgggagatatggccacatgtagcggctctgaggaatgggttacaggagacctctggggagatgtgaccacagcaatgggtaggagaatgtccagggctatggaagtcgagtatggggacccccmcttaacgaagacagggccatgtagagggccccagggagtgaaagagcctccaggacctccaggtatggaatacaggggacgtttaagaagatatggccacacactggggccctgagaagtgagagcttcatgaaaaaaatcagggaccccagagttccttggaagccaagactgaaaccagcattatgagtctccgggtcagaatgaaagaagaaggcctgccccagtggggtctgtgaattcccgggggtgatttcactccccggggctgtcccaggcttgtccctgctacccccacccagcctttcctgaggcctcaagcctgccaccaagcccccagctccttctccccgcagggacccaaacacaggcctcaggactcaacacagcttttccctccaaccccgttttctctccctcaaggactcagctttctgaagcccctcccagttctagttctatctttttcctgcatcctgtctggaagttagaaggaaacagaccacagacctggtccccaaaagaaatggaggcaataggttttgaggggcatggggacggggttcagcctccagggtcctacacacaaatcagtcagtggcccagaagacccccctcggaatcggagcagggaggatggggagtgtgaggggtatccttgatgcttgtgtgtccccaactttccaaatccccgcccccgcgatggagaagaaaccgagacagaaggtgcagggcccactaccgcttcctccagatgagctcatgggtttctccaccaaggaagttttccgctggttgaatgattctttccccgccctcctctcgccccagggacatataaaggcagttgttggcacacccagccagcagacgctccctcagcaaggacagcagaggaccagctaagagggagagaagcaactacagaccccccctgaaaacaaccctcagacgccacatcccctgacaagctgccaggcaggttctcttcctctcacatactgacccacggctycaccctctctcccctggaaaggacaccatgagcactgaaagcatgatccgggacgtggagctggccgaggaggcgctccccaagaagacaggggggccccagggctccaggcgktgcttgttcctcagcctcttctccttcctgatcgtggcaggcgccaccacgctcttctgcctgctgmactttggagtgatcggcccccagagggaagaggtgagtgcctggccagccttcatccactctcccacccaaggggaaatggagacgcaagagagggagagagatgggatgggtgaaagatgtgcgctgatagggagggatggagagaaaaaaacgtggagaaagacggggatgcagaaagagatgtggcaagagatggggaagagagagagagaaagatggagagacaggatgtctggcacatggaaggtgctcactaagtgtgtatggagtgaatgaatgaatgaatgaatgaacaagcagatatataaataagatatggagacagatgtggggtgtgagaagagagatgggggaagaaacaagtgatatgaataaagatggtgagacagaaagagcgggaaatatgacagctaaggagagagatgggggagataaggagagaagaagatagggtgtctggcacacagaagacactcagggaaagagctgttgaatgcctggaaggtgaatacacagatgaatggagagagaaaaccagacacctcagggctaagagcgcaggccagacaggcagccagctgttcctcctttaagggtgactccctcgatgttaaccattctccttctccccaacagttccccagggacctctctctaatcagccctctggcccaggcagtcagtaagtgtctccaaacctctttcctaattctgggtttgggtttgggggtagggttagtaccggtatggaagcagtgggggaaatttaaagttttggtcttgggggaggatggatggaggtgaaagtaggggggtattttctaggaagtttaagggtctcagctttttcttttctctctcctcttcaggatcatcttctcgaaccccgagtgacaagcctgtagcccatgttgtargtaagagctctgaggatgtgtcttggaacttggagggctaggatttggggrttgaagcccggctgatggtaggcagaacttggagacaatgtgagaaggactcgctgagctcaagggaagggtggaggaacagcacaggccttagtgggatactcagaacgtcatggccaggtgggatgtgggatgacagacagagaggacaggaaccggatgtggggtgggcagagctcgagggccaggatgtggagagtgaaccgacatggccacactgactctcctctccctctctccctccctccagcaaaccctcaagctgaggggcagctycagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaaacatggtctccttcttggaattaattctgcatctgcctcttcttgtgggtgggaagaagctccctaagtcctctctccacaggctttaagatccctcggacccagtcccatccttagactcctagggccctggagaccctacataaacaaagcccaacagaatattccccatcccccaggaaacaagagcctgaacctaattacctctccctcagggcatgggaatttccaactctgggaattccaatccttgctgggaaaatcctgcagctcaggtgagatttccggctgttgcagctggccagcagtccggagagagctggagaggagccgcattctcaggtacctgaatcacacagccaagggacttccagagattcgggtgtctaggcttcaaatcaccctgtcctaactctgcaacctgaaccagccacttaacctatctatccaatggggataggaatgtccaccacacatagggcatgtgagagaaggcctgacctccatcagaggacctcactcagcccttggcacagtgggcacttagtgaattctggcttccttcaaccagtttccagctgttctatccccttccattctctcagtgggtgaaatcgaagagactgaggacaataaagaacaaggaaccgaactgccggacgtggtggcatgcacctgtaatcctaccactttgcaaggccaaggtgagaggatcgcttgaacccaggagttccagagcaacctgggcaacatagtgagatcctgtctctattttttaaaaaagaatgaaacataggaataagatgtgggtgaaggactcacatgccggcttggtcccactggtctttgtggtgaaggaggggagaggtgagaggtgggtaatccggaaagagaaaagcaccccctccctggatgaaggctcttctggagagagtcaaagacaaataagggtggggcgcagtggctcatgcctgttatcccaacactttgggaggctgaggtgggaggaccacttgagcccactagttcaagaccagcctgtgcaacatagcaagaccttgtttctagaaaaaaaattaaagattagtcaggtgtagtggtgcatgcctgtaatcctagctcctcaggaggctgaggcaggaggatcactcaagcccaggagtttgaggttacagtaagctatgatcatgccactgtacccccgtctgggtgacagaacgagaccctgtctcaaaaaaataataattccaaaaacaaatatggagacggaaattgagcccccctagactgggagcccccactgagttcggaaattaggctttacctccagccctggggtgccaggcaggagaaaaccatgtggtaggctgagggggtagggtgacccattggggtgacctakatagggccttgggtcaccctctgcctcctccagcctgtggctgaaagtcagccatgaagtaatgggggacactgttactcatcccagaagcacccacacttactcacttttgggaagggggacctaaagtgtgaaaaaaaggtgaggattttccgtctcaccctaaatgggacaccctaagtggggcatcggtttttcctcctccccagaacttcctggtgttttcaggcaccacaggctccttcctgccatccccatctctctctaatattctccccttctttctccttcagcctcctcccttcagaccccatgagccttgaattaagctccttggaggagaagagttgactgtcgggtaggagacagagaggccttcaggcagctctagggggagaagtgcggggcccctccaggcttcattcctctgtcatgataggggcttactctgctgctgggcctttctgagtggtgcttgctgggctctgtaatgacccctctcactgttggggggtacccaagagaaaagagtatggtgcagagtctggttgggaccatgtggccctgaaaatcaggatgcctagagaa

SEQ ID NO: 17807 - DNA, 18303 bp, Homo sapiens
acctataatctcaatgctctggaaggccgaggcaggcagacagacagattgaggccaggagtttgagaccaacctgggcaacatagtgagaccctgtctctaccaaaaaaaaaagaaaaaacccagaatttgtttttactgtcagtggactgaggaggggagacttagtgggagagtctgaggtcttttaattccattgagcttttttgtgtcattggcacaggtgcatttcttcaatagtttcttctatgataaactccgtaccaagggttatgatggggtgaaaaggtggaccaaaaacgtgagttttgaattcacatccacttgtgtaatgccttgcctctaaagaatgagagtcttgttttctctgagccctttccctgaccgtgttcattcagtctttcaaagattaaacgtctcttgtgtgtgtaggcactaaggatacagtgttaaataaggaaaacttgcccttaaagttaaattgcagctagtgataagtgctgtgggcagatcaacacagagtaacgtgaggctgggcgcagtggctcacgcctgtaatccccagcactttgggaggccaacacgggcggatcacctgaggtcaggagttcgagactagcctggccaacattgagaaaccccatctctattaaaaatacaaaaattagccctgtgtgatggcaggtggcctgtaagcccagctattcctggaggcggaggcaggagaatcccatgaacctgggaggcagaggttgcagtgagccgagaccccgccattgcactccagcctgggcaacaagagcaaaactccgtctcaaaaaaaaaaaaaaatcacagtaatgtcatagcgtgggaagtgggtactttagattgggtgatctaggaaggcctctcatagctgagacgtgaatgatgagcagccagccatgcgcagacctgggaatagcaagtacacaagacccatagtgaaaaaccatggctgaggaacagagggcttgtgggggtgacctgtgtagttggcgcagagtgagcaaagggagatggatacaaaattcggtcagagagtagatcatgtaagacatgtacggtaggctgaggaggggggattttattgcgtgtatactgagaagccattgagttttaagcaggctgagaagtgccttctgttttaaactcctgtttcaatgacagattgaaaggggggcaagaatggaagcaggaacagagcacagtagtccaggtgagaaacttgaactggagtgctaaaggaagagagagagagtagttttatgtaggataaattttacgagtaaaaccagtaggactgacaggctctgtgatactgagagatacatatttggtctcctgaccaggctcctggcattcaacttctaaaatccttggaatctccagtgatgtgtgtttttgtgtgctgatgagttgattcatggctagcccctctaggtggcttcatgattagagggttggaactttcagcctcacccccaccaacttcctgggaggggaatggggccaaaggttaaggcaatcactgaggatcagtgatttaatcagtcatgcctagtagtgaagcctctaaaaaccggaaaggggccgggtgcggcggctcacgcctgtactcccggcactttgggaggctgaggcagatggatcgcaaggtcaagagattgagaccagcctggccgacctggcgaaaccctgtctctactaaaaatatgaaaattagctgggcgtggtggcgtgcgcctgtagtccccgggaggctgaggcaggagaatcgcttgaacccgggaggcagaggttgcagtgagccgagattgtgccactgcactccaccctgggtgacagagtgaaactctgtctcaaaaaagaaaaaaaaacccgagaggaggagtttggagacattctagatagctgaaggcatggaggctcccacaggatggtctccaggcctcttcccggtacctttccctgtgcatcttttcatctgtactctttgtactaccctttgttaataaactggtaaatgtgtttccatgagttctgtgagctgctctagcaaattaatcaaattcaaggagggggtcatgggaacgctgatctaaccagttggtgagaaacacagataaaacaacctggggcttaggactggcatcagaattgggggcagccttgtgagactgagccctaaacctgtgacacattatctccaggtagatagtgttggaattgaattgggggatacccagctgtgtccaccgcaaaattgcttgcttggttgttggtggagagaaagccccacaaacacttcttggtgaccacaggttacagaagtattttgtgttgtgagagtatagtaggaaagaagatttgtttttttgccgggcgcggtggctcacgcctgtaatcccagccctttgggaggctgaggcgggcggatcaccaggtcaggagatcaagaccatcctggctaacacagtgaaaccctgtctctactaaaaatacaaaaaattagccgggcgaggtggcacgtgtctgtagtccaagctacttgggaggctgaggcaggagaatggcatgaacccaggaggtggagcttgcagtgaggcaagatcacgccactgcactccagtctgggcaacagagcaagactccgtctcaaaaaaaaaaaaaaaaaaaaagatttgttttttcctctgcaggttggatgtgggaaatgaagaaaaagaaatggaggatgatgcctaggtttttggcctatgtaacgggaaaagtgggagaggaacaggttgggggaggaaaatgaagagttcttttctcttctggtttccctgccctcccattcaaaagccaggaaatttctacagctaggcaggatgattggctccggcattccttaatttcagtcctcaaaatcaagagcttacaccctcagggatcttcttgcagtagagggaagggtggtgacgtacagtgaaaaacatgttggccttcttcatactgagtttgagtcccacttctgccatttctttctttcatgaccttgtgcaagtcacgactttccaagctgcaatttcctcatctgttaggttgaatgttgagaacttcccggtaggattgttatgagcattaactgcgtgtttactttgtgctgtgtcttgttctaagtgtattatggatagtcactagtttaatcctcatatcaaatggatgaggtgtaggtactactatttacactctctgacagataaggaaactgaggtatagaaggttattaagtaggttgcccactgtcataagccagtaaatggaggagctgtatttgaattctggcaggctccagaatcctgggcctgggttcttagctgctaagtgcttctccctttaaagtgtgaaaagcgcctgcccatcatgggttctcaagtgttcgttctgatgtctcctccattgtctgaccttcctcccttaccccgaagaaccgaaacatgcagatcctgagcttgcccacaatctaggccttgggtcttctgttctttcacttggttcccttacctgtgtctctgttcctctctagaaccttcatggcaaaaggcaagacttctgtttgttgtacctgacctgtggcactatctctttaggtggacatcttcaataaggagctactgctaatccccatccacctggaggtgcattggtccctcatctctgttgatgtgaggcgacgcaccatcacctattttgactcgcagcgtaccctaaaccgccgctgccctaaggtttgagggggtaggagagagatgggcaaaatgtggggcggtgcagtggcaaggcattgcaggaagaagggtgggctttgggtctttgaggggcgacctgggcatggtgtctgccagcactgtacccaccatactgtgttcaattgagaaacttagggcatcactttcttttcccccatccacatagcatattgccaagtatctacaggcagaggcggtaaagaaagaccgactggatttccaccagggctggaaaggttacttcaaaatggtgagtttcctgagggaggggtatagggtgttggtggggacagtggtagaaggcagaaattgaagtcctacccctgggagtctccatgtgaagggcctgctttctttctcttctctagaatgtggccaggcagaataatgacagtgactgtggtgcttttgtgttgcaggtaagcagatgatggggccacctcctctagctctgaagtcagttgggttaaagggtcgggaggctgttatgcatcccctcatttggctcatagtcagttgtggagcaggaagtaatctgttttagaacaccaaaacactggcttcactggttctcttctggacttctccatcccacattgggactgggtctctagtcttgggcctctggccttcatagagctccctgctaacctccaactcagtgtattttctccatctaaaacattctatcaagtaagaacactagctttagagtcaggctgtttttgaaccccaggctgtgggaccctggctccctttggggatgttctctgaaggatggagacacatctcatatgaaatgtgtagcacaggtcctgacacggggggtttctcatggcttgctttgttaacacccagtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttcgtgtatttttttttctttgagagaatacttgttgatttctgatgtgcaggggatggctacagaaaagcccctttcttcctctgtttgcaggggagtgtggccctgtggccctgggtggagcagtcatcctcccccttccccgtgcagggagcaggaaatcaggatggggggaggggggcggacaataggatcacagcccgccagatatcatatatatatatatatatatatatatatatatatatatatatatatatatatatatatatatatatatatatatataaaaatgccacggtcctgctctggtcaataaaggatcctttgttgatacgtaagtggtggtcttccttaaggggcttcaaattagtggatatgcttagctcagaccttccagccagtctcttgagactaaagggttcagctttccatccctggctcaggcactgccaacaccttgtcttcacccaaacaaatcccccagatgggagcagagagcaggaaggagggaaagtagataagcctcaagaataagggcatccgagagggaagcgtggggaactggacacaagggactggggaggggaccaaccaggattcatgatagtaccccaaagccctttacagttttcttccatccctccaccatccagccaggggaatcctcccatccctacgatatcgctgttgattccttcatccctggcacacgtccaggcagtgtcgaatccatctctgctacaggggaaaacaaataacatttgagtccagtggagaccgggagcagaagtaaagggaagtgataacccccagagcccggaagcctctggaggctgagacctcgccccccttgcgtgatagggcctacggagccacatgaccaaggcactgtcgcctccgcacgtgtgagagtgcagggccccaagatggctgccaggcctcgaggcctgactcttctatgtcacttccgtaccggcgagaaaggcgggccctccagccaatgaggctgcggggcgggccttcaccttgataggcactcgagttatccaatggtgcctgcgggccggagcgactaggaactaacgtcatgccgagttgctgagcgccggcaggcggggccggggcggccaaaccaatgcgatggccggggcggagtcgggcgctctataagttgtcgataggcgggcactccgccctagtttctaaggatcatgtctgcgagccaggattcccggtaagaaaggcatttgcaagagattgtggctgcttattttgccgcccccttccgacgggcccgccgggggtagctgagaggcccaccagggttgcgggagaaaccgaaccgggtggggggagggtccgacttggaggggcgagggggaagacccacggccgacgcggccaccaggtcgaggcggagggtagggacagcccggctagggtcaggcgtgcgaggtctgttacgaggcctcgacccgaggcggtgccatgcgcgaagccccggcgctgagtggcgagacggggtcgcgacctggcgtgggaaagaaaggtggaggcggccgccactatgtgtggcccagagccggcaggtccggttgcctccctgtgccgggggagggacggcgcgcggggttccggagcattctgacggtaccactcgcgagaggcgggggtgcctggtccttagatccagtcacttcgtcgcggctaaaacacgggtcggggagaagaaaccggccgttcagtgtgctggttttcttgacggccaggactgagcctaaccccgaggagcggccgcgtgaggcaccaggagcccacccggcgccgggcgggcgggtccattttgccgcacaagccgggctattggcaaactgcggatgggcaggtccaccttccttcgggggtgagcggcctgaggtatgggagggcgacgctacttcgcgacgggggcgggcgggatgtggattgttccatggaggggtgggagacgccgccgggtggtcgagggagcgagcacatggtggcctgaggcgttcccctcccccagtctgcttcgcttctaagtgttgtgcaatctccccctttgctagctcggcttgggctcattgtgcgcgaggccgccaccgcccgcggcctcccacatccgggcaacgcgaggggggggcttcggctggagggagtgggggagggcgcgggcgggatgacgtggggggaaggggatgtcctaccctccgatctgggaggtgaagggcgggacttccagcgcgctggtgctgcggtgggaggtgcacgcgcttgggctttaagcggctgggtcgggcccacgtggacccggcggcaagcaccacctctgggcaccgtgagcgcggcggcacgcctgccggcctgtcttcagaaagggtcacccccttatgtcgggggtggcctggcytgagccgctgcctgcatggggcaaatgcctcagttttatagaaactcctcctttgggtattttttgggagctggtgggagttggatctgggacagcagrttgatggcatcatgcaggccactcctgacagagcccggctgtcaggatttctgagtrcttcggtcgggcaggggacaaaacttatgctttaaaccaacagatccagagacaatggccccgatgggatggagcccgaaggcgtcatcgaggtgagactggagaaatggaattctgtcctcccccattacaactttcagccgtatagagttagagtggcctcttgattgatttcccagatcatctagaagcagctggtttccctaaagggaggagggttgtaagctctgaggcttttgttagtaggcaccagattctgtttgctcggagactacagctcagctccmccttttccatgactcaagctttaatttctttgcatcccctagagtaactggaatgagattgttgacagctttgatgacatgaacctctcggagtcccttctccgtggcatctacgcstatggttttgagaagcccyctgccatccagcagcgagccattctaccttgtatcaagggtgagacctctcagtcccagaagacattgtggactgtccctgacctgggtagagtggcatctggttggtgatgcccatctcatatcagccagggacaaagcaactccttgttcatcccagcttggcttttgatccgtgcccatgcctggttcatgccttggacacataggtttcctttaaagaggtggtattgtagccagcttatatttgcatctacagccatgtttctagtccagcttggtgtgcaatactagatgagttaataactggtccttgtttctgayctggttcccattgtgtaactgtgttgattgggaaggtagtttgtgagccatgaaatgcttggttcattggttgcttattgacctcattaacctaggacttgaatatcccaaagggtatgctctttaccacattcaactcctaatttatttgtttaggttatgatgtgattgctcaagcccaatctgggactgggaaaacggccacatttgccatatcrattctgcagcagattgaattagatctaaaagccacccaggccttggtcctagcacccactcgagaattggctcagcaggtaagagtggcttctattccctccttcagggctgatttagggatgatgagtataatccaaggaccagagaagtcttctctgatcaccaccttgggaggaagacatgggtgccctaacactctcgagacctgctgggttaattaaaagctatttcttacccaaacgtaaccattgcttcctccacccatttcctgagtcaaatgggaaagctgttgggtgaagcctggctggctgggcaagtttgactgtgttctgaataagcaccttcactatgggctaagagatcccttggtgtgggggtgatcttacagtagtcagagcagatggacagtccttttcacccttgcttaatagccagagctgtttcatgcctggggcacacacaattctaatgctggactttttcctgggtcatgctgcaacactgatgtcagagcatgtttttaaatgttctgtggcaggggcagtgattattctgggtgtggataatgtaagaagttacagcagagctccattctaaggcacttggctctcagttttctcagagtgaacatgcctcgtagcttgggtcctatggcaggagtgcaataggacatggatatgcatcacctgttctataaaactggttgctggctgggygcggtggctcaactcgtataatcccaacactttgggaggccaaggcaggcagatctcttgagatcaggagttggagaccagcctggccaacatagtgaaaccccgcttctactaaaaatacaaaaattagccaggcatggtggcgtgtgccttttatcccagctactcgggaagctcaggcaggagaatttaacccaggaggtggaggttgcagtgagctgagattgtgccattgcactccagcctgggcaacgagcaaagctctgtctcaaaaaaagaaaaaaaaaatggttgctgcgtgatgaggcagttggtcaaattagttttcagaaggttaagggttctaaatatctagagtaaagaaactgaattaattatctgagcggcctcattgtgaatcactgtacactcaggaaccagactgagttgaaatcctgtctttgccacctattgacagcacgatcttaagtggattttagcctctgcctgtttctcagctgaatgtgagtttaataatagtgcatgccccaaagttgttggttaggaatcaatacatgaaaaacatttaagaatggtgccgggcacagtggtaaytgacatatgagcacctgcctctctctgctcagatacagaaggtggtcatggcactaggagactacatgggcgcctcctgtcaygcctgtatcgggggcaccaacgtgcgtgctgaggtgcagaaactgcagatggaagctccccacatcatcgtgggtacccctggccgtgtgtttgatatgcttaaccgsagatacctgtgtgagtaattcggttctccaatcccctgggtcactttgctcttgtgcacgctttccagtctttcagcgtaagccagagtcattcccaaggatgctggtttctctctgggggaagagctgctctgtgatggagcccatgcgtgtcatctgagcctctggcttccctgccagtgcagccctggcagtgtcctacttcccagggctgttgtctgcctggcgggaaggtcctgggcaaaggatcagtcyttgtactctgagagcagactacttggctcctctctgttttttatcagygaagttggatatmtctctcccacatttccctaatcatatgctatatattggctttttttttcttctctagcccccaaatacatcaagatgtttgtactggatgaagctgacgaaatgttaagccgtggattcaaggaccagatctatgacatattccaaaagctcaacagcaacacccaggtgagggcagtcttgcttgaatagctaatgattcttgaaaaatagtaagtgccaggggaaccawatactggattcttgagcctttttatgcatctgcttcagttttaggtgtggctagggaagggagcaggcctcaggaaggaaccagcactctaagactggcctttttttccactaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggtggggcccagtgcaggaggcgggcctggtagtgagttgttgggtatagcccctgactgatttttgtcccccaacctccaggagtggaagctggacacactatgtgacttgtatgaaaccctgaccatcacccaggcagtcatcttcatcaacacccggaggaaggtggactggctcaccgagaagatgcatgctcgagatttcactgtatccgccatggtgtgtttgcccgctgccagcctgttgtgggtctgcccgtcagaagtgtcctacttgaagccagggttcctggaacccaggtgcctacctggtctgctgcatatttgttttctcttccagcatggagatatggaccaaaaggaacgagacgtgattatgagggagtttcgttctggctctagcagagttttgattaccactgacctgctggtgagtagagggaactgatagcaaaggcagaagggaggatccaaggtgattccctctccaaggggacatcagtgcctctcaggaaagtagcagcttggaatagaatctggcatgcctaaggcctttggggaactgggatgcttatttcctctgccttccttggctgcccacatggatgcctaagtgtcttccctccgggatagagtgtcctccgtgcacatgctgaagagttgtctttcttgacgtaggccagaggcattgatgtgcagcaggtttctttastcatcaactatgaccttcccaccaacagggaaaactatatccacaggtaagcgtagatctggaacactcccctaccccttcacacctggccctccctgggcttaaagctcctgatattcctcatccccttccttgttttccagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatgtcactttttgaggcaaaagaaggaaccgtgaacattttagacacccttttctttggggtaggctcttgccccaggcgccggctcttctcccaaaaaaaaaaaaaaaacactaatccatttccctaacctagtaacctccagatcccagaggctctcctcacctcagctgagctcctttgaaagtgattcaagggactrtgtcactcagcctcatttgctggaccaaatctggagggagaacccctaaaacycctaagtgaggttgcccagggggttgtccccaggtggggggaagcaggggagagaaaatggtagccatttttacattgttttgtatagtatttattgattcaggaaacaaacacaaaattctgaataaaatgacttggaaactgcctgtttgggcttctcatttcttacctccccttccctctcccacctgctactgggtgcatctctgctccccccttccccagcagatggttacctttgggctgttgctttcttgtcaccatctgagttctcagacgctggaaagccatgttctcggctctgtgaatgacaatgctgactggagtgctgcccctctgtaaagggctgggtgtggatggtcacaagcccctcacatgcctcagccaagaggaagtagtacaggggtcagcccagaggtccaggggaaaggagtggaaaccgatttccccaccaagggaggggcctgtacctcagctgttcccatagctacttgccacaactgccaagcaagtttcgctgagtttgacacatggatccctgtggatcaactgccctaggactccgtttgcacccatgtgacactgttgactttgccctgacgaagcagggccaacagtcccctaacttaattacaaaaactaatgactaagagagaggtggctagagctgaggcccctgagtcaggctgtgggtgggatcatctccagtacaggaagtgagactttcatttcctcctttccaagagagggctgagggagcagggttgagcaactggtgcagacagcctagctggactttgggtgaggcggttcagccatgaggctggctgtgcttttctcgggggccctgctggggctactggcaggtaaggaggaaggaggctgaggggagggggcccctgggagggagcctgccctgggttgctaaccatctcctctctgccaaaagcccaggggacagggaatgactgtcctcacaaaaaatcagctactttgctgccatccttcacggtgacacccacggttacagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggtaaagctaaaactgggggatgagaggggagggaggcaggactggatataggctcagagggaagaaggaagaggggacagggaaccttggccggcatcgcatgcagtcttgtgaccttccagtctttaacttccgcaggcctggggcatctctgtactgaaccccaacaaaaccaaggtccagggaagctgtgagggtgcccatccccacctgcttctctcattcccctatggacacctcagctttggattcatgcaggtatagccatgacctcagtctcacccctcactcagcctcccggcgcccctcccctcccaatcccacacgctactccttcctctgtggagagggataccacctgcgccttcctcttcgccccacaggacctccagcagaaggttgtctacctgagctacatggcggtggagtacaatgtgtccttcccccacgcagcacgtaagtaacctccttccctttctcattgctaccactagacgccagggttcctgaaaggactaagctggggccagggaggtggataggatctgacccttcctcactcctccagagtggacattctcggctcagaatgcatcccttcgagatctccaagcacccctggggcagagcttcagttgcagcaactcgagcatcattctttcaccagctgtccacctcgacctgctctccctgaggctccaggctgctcagctgccccacacaggggtctttgggcaaagtaagacctacctactccttccctcctagaatcctcccactgcactgaaaaccccttccccaggcccataagccactcatctctcttcttaaccccccaaatctcgctctcccagcttgtcatggctacagggcagctttctttccatcctctacaagactctgccagtttcccccttttatcactgctgagtcactgcggtgagctcctcaccaatctcctactccccagcatccccccattccctcctcccacctttatcccaaccagcacgtcactgcaaatacctacctgccctatccttccgccaggtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggttggggtgtggtgggggggtacccttatttcctcgacacgcaactggctcaaagacaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtgaaaccctgtctctactaaaaatacaattagccaggtgtggcggcgtaatcccagctggcctgtaatcccagctacttgggaggctgaggcagaactgcttgaacccaggaggtggaggttgcagtgagccgtcatcgcgccactgagccaagatcgcgccactgcactccagcctgggcgacagagccagactgtctcaaataaataaatatgagataatgcagtcgggagaagggagggagagaattttattaaatgtgacgaactgccccccccccccccccagcaggagagcagcaaaatttatgcaaatctttgacggggttttccttgtcctgccaggattaaaagccatgagtttcttgtcacatgcctttctatgccttccatggctgggtctcagggagccggaagcagctgctgaggagggatgaaaatgtcagtgtgtgacgatgcctcatgggttcaccccccaaagcctggcacagctggtgttgggtctgccgtgcctcccttccttcctcctcttggggccactggctgctccagttccccatccgtggcaagccggtagagccattcatccccgcagccttcttcctgaccctcgtacagtttcaaatgcagcagacagccaaagcaatgagtggggggctgtggaacttcattcccaaaggcagcgccagtggctcctgagcaatgagaatgtcctgtcctgtccaccatattcaaggccagcagaagagcccgattaaaccctcgcagcacctggcatgctcctatcccacctgcaaggggttgaatcaagaaggagcagtgggtactctgacctccactgggggctcctgggaacagcatgccccccacacggggccacctgccaagcctaacttcatgcccccagtacttgagatgaggagtgtcactctcaggacagccaaggtccagattctagaaaggacctcccagatggccacagcctgcaccagcagtgagcgccagtcccacccattacagctggctacggcgcaatccctgggagccaggatgagcagcaccccccagccgtaggagccccaggaggcttccggcctccaaggcccagagactgccccacaagggcagccctcacctggcagggccccagcagccccacctctgcctgcagacatccgtgtgaccttgtagactttggaggggggccgccaaagggctgatccacagcggaatgacgcacgggtgggcaccgtgggttggcgtcccggcggtcggtaacgaagcacaacgcccccaccaggtagtccaaggtgccctttcccaagcagcgctgcagggtccactcggcctcgccgaagtctctgcccagcacgtggtgcgccctcgggccagcggggagggggcgaatcccgggactgcctcgccaggcctcggctccccggagactcttgggggtctgggccccaagggtgattcaggtgctgcccttccccgacctgggctcgcctcccccacctcctcctctgcttcactgtcccgggcccagcagttgccggcgcactcatgctccgaggcctgagccaaccggaggcgagacaagcacagggccctgcgcgcaacccggcacctaaggaggcctgcccggtgcagactctcctgctcccaccggcgcccttccctctagagacgctgagagaacgggagctagtagcgcccccacccaacgccacctcggagactccggctccttctctctcaacttcgaacaatacaaagtgtgctaggagaagacaagatggcgcccagcaggaggagcggagaaaggcaggggtgtaaatctggcttccaaactggaagcgtcaacaaaggcgtgggaggtctaaccgcgcaggcgtgcagcttcggcaagctttacaattccaacagcgcgtccaaaacgtggtccctgactgagacttattttacgccactagagtgagggtgggtagcgtcagaaagagcggggcacggggcgggccagcttcgccgcgggaaaagaacgggaggcggagtgtccgcagcgcgcacgcgcaacgaaagtcaatggcggtctggagagactggcggaagctagctttgcaatatggcggccgaggcggacggaccgcttaaacggctgctcgtgccgattcttttacctgagaaatgctacgaccaacttttcgttcagtgggacttgcttcacggtgagttttattcagcatccgatccaagtcctactcgagtgaccgtgggcccttagtccaagccttgatcggcgactaagtgacggcagtgactgccgccatgccgagctggacggaagtcacttctgagaagggcggaagtgtctcgggctccttagagggaggacaccatattagtgccagtggggaagtcaccgggtggaattacttctttgtggagtttgtgctgtagcgacaatgaaaaacgaagagtcaacttttataaaacaaaataaaaattaagtcaaatcatgccaacctttattagatcgctagcagggttaaacttaattcaaagcccctgatgaatcgggccttcattgcacccccaaaggctccgccaccctgattgctttctttccagcctccaggtttgctcatagtctgatttcggaataatttgcctcccttcctttttctgattgcgagacagctccacaagggtcaccgtcagaccgtttggggagcgtcagtctgcccctgtcagttcatggtacctctcttgagctcgtggggcactttgttttagccgcattcatgacccgtgagagtcagactcccactagaccaagttccttgaggggaaggcttcaaggctagagaagttgtggatggccagggcataaaagcaagccttgaaagggtaaggtttagtccctgagtaggggccagggacagtcagagtgttcaagaaagagtggtatggggcgggcacggtggctcacgcctgtaatcccagcactttgggaggccgaagcgggtggatcacctgaggtcaggcgttcgagaccagcctggccaatagggcgaaaccccgcctctactaaaaatacaaaaaattagccgggcgttgtggcaggcgcctgtaatcccagctactcgggaggctgaggcaggagaatcgcttaaacccgggagacagaggttacagtgagccgagatcgtgccattgcactccagcctgggcaacaagagtgaaactccgtctcaaaattaaaataa

SEQ ID NO: 17808 - DNA, 28724 bp, Homo sapiens
aacatagtgagaccccgtctctacaaaacaattaaaaattagctgggtgtggtggtgcatgcctgtagtttcagctactcaggaggctgaggagggaggattacttgagcccaggaggtcaaggctgcagtgagccatgactgtattgctgcattccagcctgacaacaaagttgagacggagtcttgctctgtcgcccaggctggggctggagtgcagtggtgcgatctcagctcactgcaagctccgcctcccgggttcacgtcattctcctgcctcggcctcccaaagtgctgggattacaggcgtgagccaccgcgcccggcctaaaaaaaaaaacaacttttttaaagaacagttttaggatgggcacagtggctcacgcctgtaatcccagcactttgggaggctgaggcagggagatcacttgaggccaggagttcaagaccagcctggccaacatggcgaaaccctgtctctactaaaaatagaaaaattagctgggcatggtggcacatgactataatcccagctactcaggaggctgaggcaggaggatcacttgaacctggaaggtggaggttgcagtgagccactgcactccagcctgggtgacagagcgagactctgtctccaaaacaaaacaagcagacaaaaaaacaaaaccaagccaataaccccaagttcctcaacttttaggtacctagggaggtttctggactaggactctggagacaaaattttaagaaggggagcaatcatgctcttgggaaaatacatatatatgtatttttagacagagtctccctctgtcgcccaggctggagtacagcggcacagtctcggctcactgcaacctccacctggcgggttcaaggggttctcctgcctcagcctcccaagtagctgggattacaggtgcatgccaccacacctgtctaattttttatatttttggtagagaaggggtttcaccatgttggccagtctggtctcaaactcctgaccgcaagtcatctgtctgcttcagcttcccaaagtgctgggattacaggcatgagccaccgcacgctgccatgggaaactaatattaatagatgtgtggctatggtgatgagaagggaggagctggagaaggagctacacggccctgccagggatgcccttgaaactatgccctcttccagggcatccctacgttgttcctcggtaaggagaccaaggacacaatgagagctgctcccttgggatcagaagcatcaagataatttcctgaccaggtgcgtggcatgtgcctgtagtcccagctacctgggaggctgaggcaggagaattgcttgagcctcggcatttgagtccagcctgagcaacatagcaagactttgtcgtaagaaaaacaaaaggtgatttttttgtcttggccacagtctccctgtccactaaatgattgagggtgggaatggaagtagaaccaaaataataggaaactcaaagttgtctgagatccgtgaaaaaataagccactttttaaaaaaacatgcctttttttttctgtaacaccttttttaaatcagatgttttctcatttatatggactctaaataaaatgaagatctctttttaaaaggataattttttagaagttttatggaaaaaaattttttttttagacaggtctggctctgtcactcaggatgcagtgcagtggcatgatctggctcactgcgacctccacctctctggctcaagctagcctcccaactcagcctcccaagtggctgggactacaggcatgagccaccatgcccagctgattttggtatttttcacagagtcggggtcttgccatgttgcccaggctggtttcaaactcctgagctcaagtgatccgcaaaccttggcctcccaaagtgctgggattacgagtgtgggccactgtgctggcttattatgtaaattctcaaaaatatattaaagtagggaggatagtataatgaaccttcttttactcattgctcaacttcagcagttgtcaaaccaccagtataccctccccatctaccctcaaaccagattatttagaagcaaatcctagtcattttatcatgctaaacagaaatgcttagcatgtacctctacaagaaaataacaaaaaggacttctgattatttacaaatcttaatcttgcttccccttcattcctcatctatcccagggcatggattaggaagcgtgagttctaaccctggtttgccccttgctaaccgtgtgagcagaggcaaatcatttaacctttctggacttgcatttttctcacctgagtgagggaactagatgatttctaagatcccttctagttctagaaatcaaaaattcatgcaagggccgtccttcaagcctctagagacatacagatttggtgcagtatctatttactggtttttgtttgtttgtttgtttgttttgtttttttggtgcagtgcccagttcagagtcaagaccctctcaatgaagagccaagcaaaagtcctagaggctgctggtggcggaatctttaacctggagctttaggaaagaaataggccttggagcttcccctttgtgcagtttcatgctgccctctgtatctcttctcataacctcaatttatcattttttttttctttttttgagatggagtcttgctctgtcacccaagctggagtgcaatggcatgatctctgctcactgcaacctctgcctcccaggttcaagcaattctcctgcctcagcctcctgagtagctggtattagaggtgcccgccatcatgtccagataatttttttgtatttttagtagagacagggtttcaccatgttatccaggctagtctcaaactcctgaccttaggtgagtgatccgcccaccttggcctcccaaagtgctggtgtgagccaccctgccctgccggcgacccgtcactttattaaacaacaggaactgatttctgtcatgttccaggtgactgttaaggaataagaatactcattttatgggcaaataaactgaatgtgaagtaaagtaggtgcatctcaggttgcctggtgaaagaaggattaagtctggtatagggtttgtcttttaaaattgtggaaaacatgcatatcgtagattgacttttagggaaagatgtgggtcctattgggttaatggcggaatcttttggtaagatcatgcccagccctgaggaccgttgccaatgcctccctcaccacgtgtgccatgtgctcttgaggacatcctgtcattggcttcccacaccatcattacatctggaacaagggacgcataaaaagtgagtggcccagcgtggctcagctggtaagtgaagggcatgggcttggacccaggacttccagctgctgcagcatgtgtcctgctcccctacagcttgaagagggctaaatgagactggaggacttcttagaaaaagagacttgattatcagcgtagtgggagaagagcaaatgcttatgaatactgcacctgtgctttaaaagtcaccatgagctgggcgttgtggcttacgtctgtaatcccagcactttgggaggccgagacaggtggatcacttgaggtcaggagttcgagggcagcttggccaacatgacaaaaaccccatctgtactaaaaaaaagaaaagaaaagaaaagaaaagaaagaaagaaaaaaaattagtcaaatgcgtttgcttgaacccaggaggtggaggtacaccctgggcgacagagagagagaggtaaaaaacaacaacaacaccatgacccagagaaagaaagaaaaaaaatgaagttcccaaatggaaaaagcccctaaaattaccattttaaaacacagccctaatcagctctggggatttgcaggaaactcatcgaagctattgataggaactattgttttggtgccagggttttcaattgggagttagatttaaaaggaccaaagatgacatctgatatttcaaacagaaaccgacatttctcagtggaaaactttccgggccagtgcattttggggttggttactgtgcttggagacgcccctgagttggaggacacacttctggctgatgtgaggggcttctgaggagggccaaaatgtacactctttgtgttcttgcaccacggctattagactgtgagactctgtccttagcaggaaatggtaaaggaatcagcaggaagcctaaaacaagggaagggaaactcctccctcctatcaaaggccaggcaagggcgaggatgagaatggaaagtggggcacgtgcattaagccgtctgggggagcggtagggatagacatgttgaaatggagagtggttgaatcttgaaaggaagtaaggaaaatgtatatgccacaagggcaaggatgtatgataggcttgtatttattgtataactttattttattttattttattatttttagttttttgaaatagagtctctctctgtcacccaggctggagtgcaatggcacgatcttggctcactgcaacctctgcctcccgggttcaagcgattctcctaccccagcctcccgagtagctgggactacaggcactcgccaccacgcccggctaattttttgtatttttagtggagacggggtttcacggtgttagccaggatggtctcgatctcctgaccttgtgatccacccacctcagcctcccaaagtgctgggattacaggtgtggaccacagcacctggcctttattgtataactttaatatggagccttagtcctccagaaatctgcaccatgcccagggaaaatgctgttcctttatttacatgaggcagaggtttgtgttgtttgctgaggtccagcagctcactgtgaggacaacctctccctcgttcctgatttctggcttattcaaggccagaggacccaaaactcgagttgaaaattttgactaggagaacagataaaaatagaaatggaatccatcttaagaaatgctcaatgtgaaggagaggggaatgcaaaatagtttttctgttttaccacagtctttgtaactgaaaatcctatgttcttgagatagagagagagccaatgatccaatgcaagaaactgagtttaagaagaaactgtttgctgggcacggtggctcacgcctgtaatcccagcactttgggaggctgaggcaggcggatggcctgaggttgggagtttgaggccagcctggccaacatggtgacacgtcgtctctactaaaaatacaaaattagtccagcgcagtggtgtacgcctgtaatcccagctactcaggaggctgaggcaggagaattgcttgaaccctggagatggaggttgcagtgagctgagatcgcgccactgctctccagcctgggtgacagagtgagactccatctcaaaaaaaaaaaaaaaaaaaaaaaaaagaagaaagaagaagaagaagaaactgttcatctgaaatccgacaactcattcttgaaggttagagctcagctttgaagtttcacttcacgagcttggctcagtgaggtatgttactccccggtgaaaaagaaaatgaagagaatgttttatgttgaaagtgcttggtgacgaaaaggcagcacctagatcccttatctcataaaaaatgcagcagattcttaatattagcaatctagtgtttagattgttacctgaagaaaggaaaaacaaactgtcccaaatgctgattctactgtttcggtgggaaaaaaaaatgtcttgcaggcaagtggcaaacaacaaaacttttgaaaaagcaggcctggggggagtccagtacagtttcataatgggtatgaatagttattttactgtgttccccccaccccctttctttctgggttttgatgtggatgtctttctatttgttcaggaaattgtgacgtgtgttctgggcagggtttgaggttttggaacattttctaaaagggacagagagcaccctgctacatttcctaatcaagaagttggcgtgcagctgggagagctagactaagttggtcatgatgcagaagctactcaaatgcagtcggcttgtcctggctcttgccctcatcctggttctggaatcctcagttcaaggtaagactcaggagtcttgttccccagccatcttctctgtaagccctgtggtccatgcaagtcattatattcattttaaggcatagaatgtataatattgtgagaaaggaggcaaagaagaaggatttggggtcgctgaaccctttaatatgagttctgttaagtttggtaccaagaaaaattaaactctgtggcgtgtgcagtcttgtaaactcttacaatgattgaaatgtgctattttgggatgaaaatgtgaggtttataaattttaaaagctcaaaaaaggaatctagaaaatgactcctgtgcctgttgcatggaggagatggcacctttgactgttggggggtgtctgcctacccctaagtgtctacatcagccccaagttttagtgcgctgtgacggtgtcattgttattttaacactgggagacgttatattccaattggggtgaatctgactgtgtgtattttcttttcttttttttttttttaaagataaacttggttcttactgaaaactcaattatggttagacatagttcatgtaaaacctctcagattttaaagagaaggccaaataatttggtatttgtgctcttgctcagagaagcatcatattcggaaatatcttcctaggtttatctaccatttagtgttgtttagtcagactgaaacaacttaaaacctgtaatgactaagacaatgaaaatgataggcttgtaagaaaaatacaatttgttattctttggcaaataaggaatcatgtctaaataagayggaggtcatggcttgatagagagatggctgaacctatagtagaaaaacactaggttccgccaaatggtaagggaaatgttgagtcacaatgacacacatgtcctagatttgtttcgtcaaagcgacttttrgttgtcatgatcttacttccggtggagatgaaatcttacagatgatcgcagagacattcattttatgttggaaatttataaaatcattttcttctagttatgctaatgctgaaaaaagagcaagtaatgtttctggaacgttattaatttatgtatttttaaaatataaaacattgtcaattgtagggaacaggcttcactgggatcttttagggaatatcttcagcttgatgaaataattcccgaatagccaagtggtctgacaagatcgagagtaatgaggcccatactttagtacagtcttgaatggccagatggtgctgggcataccccaaccagagatatgtaagtctttatgttgtcaaaatttcccagaaacatgaatttcccactaagattcattaaggaaaactagaatgaaaacaaaaacgttccttgtataatattcattagaaagaaatgaagaaggccgggcatggtggctcacgcctgtaatcccagcactttgagaggccaaggtaggcagatcatgaggtcaggagtttgagaccagcctggccaacatagtgaaatcccgtctctaccaaaaatacaaaaaaattagccgggcatggtggcacacacctgtcatcccagctactcaggaggctgaggcaggagaattgcttgaacctgggaggtggaggttgcagtgagctgagattgcaccactgtactacagcctaggtgacagtgcaagactctgtcagaaagaaagaaagagagagagagagaaagaaaggaaagaaagaaagagaaggaaagaaaataattcatcatgaaattgtatagaatactagcatttatgtcatgacctcgtaggtttagctctttgttagaaaaggaaaccatagaaagagacaagggagaaactgacaaactagggtgtttccgaaaaaaggctctcagtatcgggctcaagggcttgtgcccacatctgagcatgcagggaaatagatgtcccccactggctgcacatgtgagtgactgcggcacaaggctgtgatgtgaagagtcatgacaccatttcctcacacctccacgcaatgccagatatgattcgacaacattcttcctgtcttataaaaagtgtttatctagcccgttggtttggcagatgaaatcaactaggcttttggcttgcttttactgagcatattcaaaaccatttcaggtcactatagtggtttgctcgggttgccataacaaagtaccacggactgagtggcttaaataacagaaatgtatttcctcacagttctggagatgggagtccaagatcaaggtgctggcagggtcgatcgcattctgaggcctctctccttggcttatagatggcgccttctcccttgtctgcacatggcctttcctccatgcatccgtgtcttaataccatcttcttagagggtcaccaggcattggatcagggccaccctaatggcctcatcttaactacctatatctgcaatgaccctatttctgaacaatttcacattgtgagattctgtgggttagaactggaacatatgaatttggtggtggtatatttttattataagtcaaacccaagtaaagatgtggggtaagattgtgtttaccaagcacaaagaaatggaaatttggggatgtgtaactctggagagcacagatgactaatctatttaatgtagggctccaggggatttgatgaggcctgtgaatcttccacttttattgcctctcttttccaatgacacccataaagaaaaaaaatggaatatccatgaacaggtgcagccaaggaggccaggcccgccatgtgtccactgtatactgtctcctagctcacaggaatgatactgatccactccttgtgctgctctttgtaaagtgatttcacatccattctctggtaatcatcatcacattccctgtgatgaggaattagcaccaattatagaggagaaaactggatctgacatttctcatctcatttgctctatacattaacctcttgcaaaaaatttgtgagtcttgcccaagacccattacaactaattaacggctgaactggtcgtctgatttcaaggccagaattaactttctactgcagctcatggatcagaggttttctttatttaaacaaacaaacaaaaaatcctttgaccgtagcccttgctataacgtttcccactgagttgagggagaaattgaaagtaaacttaggagctttttatagcttgtcaaaccatgcaagagtgggggaagcttatccatcttgtggaattgatagaccaggaggaagtaactccggcttagataatgctaccattttgaataaatcaaatggtcttcttttccccttcatggtagttgctgcttaagtttctctaacatgcctgcagtaagtttccattaagaataggaaattaggctcggtacagtggctcacgtctgtagtcttagcactttgggagaccgaggagtgtggatcacttgaggtcaggagttcaagaccagcctggccaacatggtgaaacccccatctctactaaaaatacaaaaattagccaggcatagtggcatgcacctgtaatcccagctactcgagaggctgaggcaggagaatcacttgaaccagggagatggaggttgcagtgagccaagatcatgccactgcactccagcctgggcgatagactgagactctgtctcaaaaaaaaaaaaaaaaaaaaaaaaaaaaagaaaaagaaaagaaaagaaaaaaaaaagaaattagtatattgtgattatgttgagggaaaagttagtaccataatataaaaaggtatggactattggagaaagttgtttgctttggtaacatttactcatagaaagtattttggtaaagcaggactcagggtggtgggggaggtgggcagtgagggataggattcaaataaaaaccattctttcccttggaatccactacacaattaaccaacaaatcccataagtggaccttttaggaagataacatttctatccatgagcatagccactataatcacaagacatttatctcaagcaagatagagtcaagatactctcacaacctcaggggctggaactgtaaattttcacatcctgccaacacccttgaatagctatgtcaagaatttagtgtctgtaacttgttctttattttaaagtacatttaacatcatcggccccaaattagataggcttttggagtgggatcccttctacttttgatttctttataaaattttaaaatagctttgttgagatagtgttcacataccatacagttcacccattaaaagtgttcaattcagtgattaggccaggtgtggtggctcatgcctgtaatcccagcattttgggaggccaaggcaagtggatcacttgaggtcaagagtttgagactagcctggccaacatggtgagaacttgtctctactaaaaatacaaaaattaactgggcatggtgrtgtgcacctgtaattccagctacttgggaggctgaggcaggagaatcacttgaacctgggaggtggaggttgcagtgagctgagattgcaccactgcactccagcctggatgacggagcaagactctgtctccaaaaaaaaaaaaaaaaaaagtgttcaatgttttttagtatattcacagagtcatgcaaccatcactataattgcttctagaacattttcatcatcccccaaaagaaagccttcgttacgaattttaattagctgagattctgaactctgggggaattttgtattctagaaatattttttactaatatgctacagttgtatttgtcatgctggtgaaaagatgtggtctttcacctggatgctttctcattaagcattatttttctgtttagcttcctgtgtragcaaacattttctcagcttgatactcagtgcatcagcggcttgcagaagagactgcctaggcctgctctgtccagtacggtagccacaagtcacttgtggctactgaacacttgaaatgtggcaaggccaaattgggacaggctgtgaatgcaaaatatacaagatttggaacccttagtatgaagaaaagaatgcaaaatatcccagtaataacttttacattgatgatatgttaaaggacaatatttgaatatgttaggttaaataaaattaatttcacctgtttctttttacttttaaaaatatggccgctggaacatttaaaactccctatgtggtttgctttgtgtttctattggacaaagttggtctagacagtacaaggtgtgaagacaccgccctctgctggagaagatgctggatttttatttcacctacaggaagagacgtctaagtagcaattagatgctaaactaatgctgcctcaggaaagaatcaaaagagaaagagtgaaaccaggccgggcgcggtggctcacgcctataatctcagcactttgggaggccaaggcgaggggatcacgaggtcaggagatcgagaccttcctggctaaccccgtctctattaaaactacaaaaaattagccgggcatggtggcacgtgcctgtaattccagctagtcgggaggctgaggcaggagaatagcttaaacccaggtggcggagggtgcagtgagctgagatgtgccacagcactccagcctgggcaacagagccagactctatctcaaaataaggaaaaataaaaaagaaaagaaagaaagtccataaattgagactcctagagatactaaatggtagaatgggaatttgaatttaaatttataagatgttcactctcggagatcataggtcattgttgtcctcctccttttcatgacaggaactagcaatgaagagctctgactatgtgctaggtactactctgagaacctaacatttgtatctccttattaactctattactgccccatcctacagatgagaaaattgaggcacaggaagtttaagttggccaagatcacacagccagtaaggggcagacattgaaaggtcattttgcctgccttatccccagcctccaggcagtggcagagttagctcattttggacaaacagctctcccagaccagacattgtaagctatactcaggaatcataggaaagattatgatagaataatatatagttacaaagaaaagaaagaaaatccaatgggagaatatttactgttttctatattaaagtgtttaatgtttatgtttttagaggaatattgtttattatagcaatttagaaaacaaaatgagaaaaaaaatcaccaaagattctacctccagttatttttgtgtatttccttccatttttccccccatgtctgtttatataattgaaactattattcatgcaaagaggtattctgattttctcagttatttttatttatttttaattttgtaaataaacttttttcttctgagacagtctcgctgtgtcacccaggctgaagtgcagccgtgcaatcttggctcactgtgacctcccagtctcaagcaatcttcctgcctcagcctcctaagtagctgggactgcagatgtgtgctaccacatccagctaatttttaaaatcttttttctcttttttggtagaaatgggagtctctctatgttgcccagcctgtattgaactcctgggctcaagtgatcctcccacctcagtctcccaaagtgctgggatttcaggcatgagctaccacacccaacctaatttttatttttattttattaaaaaaaaaagtttttgcctacccgcctctcaccctctcactcatttttaagtataggtttttctacaatgccacattgtcttttccataaaaagtactttcggccgggtgtggtggctcacacctgtaatcccagcactttgggagactgaggcgggtggatcacctgaggtcaggagttcgagaccagcctggccaacatggtgaaaccccatccctactaaaaatacaaaaattagctggatatgattgtgggcacctgtcatcccagctactcgggaggctgaggcaggagaatcgcttgaacctgggaggcagaggttgcagtgagccgagattgtgccactgcatcccagccagggcaacagagcgagacttcatctcaaaaaaaaaaaaaaaaaagtacttttcttcatttggttagtattctcttatgagttgatgccttgtaatttatctgaatgttttccattattttgtggtgagctttaaaactacccttcctgactttcaagaatcctagacatgctccttcttgctaggtaattattagttgcactcattagaataaagtatatgcttggagtggggaggagatgaactttttgaagggcggtgaagtatttctcaccaccaggcctttgtctttgctaaactgaggaaggaagattttatttcattagctaacaaagaacctcctatataggccgggcatggtggctcamgcctgtaatcctcacattttcagaggccaaggtgggtggattgcctgagctcaggagtttgagaccagcttgggcaacatggcaaaaccccatctctactaaaaatactaaaaattagctgggcgtggtggtgagtgcctgtaatcccagttactccagagggtgaggcagaaaaattgcttgaacccgggaggtggaggttgccatgagccgagatcgtgacagtgcactccagcctgggcgacacagcaagactctctctcaataaaataaaataaaataaatacataaataaatctcctatataacctcataatatcagatttggagccttttccatagaaatgaaattcagaagaagctgagactcagatattccaagctgcctggtgctctgtgaatagaggagacttgttcttgtgaaatctgagtgcaaagacacaggacaaattgttatctacttttcattcctaaggatactgtatggccctaaaacacaagaactagaattctgtgataccacgggtactccacagtgtgttccttcccctttctgaacctgatttgactcatctctatgaaaagatgtgggctttggggtcagatgtgggttggaatcctagcgcctgtgtggctgcaattttcttttgtgtaaaattgagataatagtacaaaagtaacaacagttaatattatcaagtgcttactgtgtgcctggcactgtgttaaattctctaagtgtattttctcatttaatttttgtgataggcttatgacactattagtatcttcatattacagtgagggttcagagaagttaaggttccataactagtcagcagacctgggacttcactccaggcagctgattccaaagcctattctaactttaaactgctactttttggagtgttgtaagaaggacaatttatataaaatgttggcacatagtgggtgctgctgttatatgaatgggcacaaaatctgtctacattttgccttttaccaaatttagaatctatttagttaaaaccttcttagggcgggtggrgtgcagttgctcattcctgtaatctcagcacactgggaggccaaggcaggaggattgcttgagcccaggtgtttgagaccagcctgggcacatagtgagacccccatctctccaaaaaacaaacaaacaaacaaaaacaaaacaaaactagctgggcgttgtggtgcccctgtattcccagctactcaagaggctggggtgggagaatggcttgagcccaggagttcaaggttgcagtgagctatgatcacagtactgcactccagcttgggcagccgactgagaccctgtctcgaaaaaaaaataaaaataaaaacttcttaggacagagtgattagaagctgtgtagtagatacttagtaacaatgtgggttcctcgggcaggttatcctacgcrgagagccaggtaccaatgggtgcgctgcaatccagacagtaattctgcaaactgccttgaagaaaaaggaccaatgttcgaactacttccaggtgaatccaacaagatcccccgtctgaggactgacctttttccgtaagtggacttttctctaattaattaattaattacttatttatttgagacggagtttcacttttcttgcccaggctggagtgcaatggcgcaatcttagctcactgcaacctccgcctcctgggttcaagcgattctcctgcttcagcctctggagcagctgggatttcaggcgcctgccaccatgcccagctaattttttttttttttttttttttgagacggagtctcactctgttgctcaggctggagtgcagtggcgcaatctcggctcactgcaagctccacctcctggattcacgccattctcccgcctcagcctcccgagtagctgggactacaggcacccgccaccacgcccggctaatttttttgtatttttagtagagacggggtttcaccttattagccaggatggtctcgatctcctgacctagtgatccgcccgccttgacctcccaaaatgctgggattacaggcgtgagccactgcgcctggcctaattttttgtattattagtagagacgggctttcatcatcttggccaggctggtctcaaactcctgacctcaggtgatccacccaccttggcctcccaaagtgttgggattacaagcatgagccactgtacccggccttttctctaattttaaagtgtctgtaatttcacaacctcttggcacagatgtgggagtgtttttcttcaagctgtccagagtgttttgcttcgagctcttgctttggtagtttggctcttactctgcagtacatggtaaaagtgtactgtatatactggcatatgacatgtgcgagtatacatgattcacctatgtttttgaaattttttttgtggatggtagagaggagcattgaggacttttcatcaacaggtattgaaaatgattgaacattgttttatttgtgtaaacagaacacactatatataaaaatccaataattaactgaatggataagcaaaatgtggtataagcatacaaaggaatattattgggtcataaaaagaatgaagtactgatacatgctacaacatagataaaccttggaaacattatgcagagcgaaggaaggccagacaccaaaagccacatattgtatgattccatttagatgaaatgtccagaataggcaaatccctagaggcagaaagtagattagtgggttacaggggctggggaaagggaggaataaggagtgactgctaatgggtatgagggttttttttggaggaggtgattaaaatgttcttctgccaggtgtggtggctcatgcctgtaatcccagcactttgggaggccgaggcgggaggattgtttgagcccaggagtttgaggccagcctgggcaacatagtgagaccctatctctatttcaaatacattttttatattaaaaaaatgttcttcaagtagttggtaattatttttaaaaatggccaggtgcagaggctcatgcctgtaatcccagcaccttgggaggctgaggtgggaggatcccttgagcccaggaggtttgggaccagcctgggccatacagcaagaccctgtctctacaaaaaatacaaaaattagctaggcatagtgatgtgcacctgtggtcccagctactcgggaggctgaggtaggagaatctcttgagcctatgttgagcctgcagtgaaccctatttatgccattgcactccagcctaggcaacagagtaagactctgtctcaaaaaaagaaaaaaaaaattagggaaaggaagaataattagccaagacttgtaaaacaaaaatcaaatctcttcttttgatcacataaaacttgctttaaacttgcaaaaaagacctgatataaattcataagtaacaaaaaattgaattatattagaaaccattaattcaatgaatactaaagctatgtaggatgtagcaaaatatacatattaagaaaaggattatcataaaagttttaatctccaggctcaaacctagaaaatcactctcctcaaagccagggttaatcatcatgctccaaaccaggtacatttcacatcactttgggatcctggcaactttctcttttgttttttttttttttttgagacagggtctcctctgtcacccaggatggagtgcagtggtgtgatcatagctcactgcagcctcgaactcctcaagtgatcttcctgcctcagcctcccaagtagcgggaccacaggcacamagcaccatgcccatctaattaaaaaaatttttttttgtagagacaggggtctctgtacatttcccaggctggtcatgtactcctaagctcaagcagtcctcccacctcagcctcccaaagtgccggaattacagtcatgagccaccattcccagcgctggtgactttctccatcactggtgactttctccatcactggtattcactgcattagtgatgacatcattacaatcttcaatatgcaactttgtagtcctactcttgcattcttactttaaagcctcagcattaagtttgaatgtaatattacagcatccttcattactttaaatcattggtttcaatagtaattcatttaaatctaaaatgttaggctgcagtggctcatgcctgtaatccccccagtttgggagactgaggtgggagaatcacttgaggccaagaatttgagaccagcctgggcaacacggcaagaccccatctctaaaaattagtggcccggcgctgtgcctcacgcctgtaatcccaacactttgggaggccgaggcggatagcttgaggtcaggagttcaagatcagcctggccaacatggcggaaacccatttctactaaaaatacaaaaattagctgggcatggtggcacgcctgtaatcccagctattgagaggccgaggcaggcagactgggaggccaaggcaggcagattgctttgagacctgcctgggtaacatggagaaatcctgtctctacagaaaaatacaaaaattagccaagcatggagaaacctcgtctctatagaaagacacaaaaactagccatgcatgcctgtggtccagctactcgaaaggctgagrtgggaggattgcttgatcctgagaggtcaaggctgaagtgagccatggtgtggcactgcactccagccagggtgacagactaaaaccttgtctcaaaataaataaacacatttaaaataaataaatacaattaaaactaaaattaaaaaataaaataaaatgttaagagaatagctcaaattctccaaaagaactcttgcacaccattcctcctcttctcaaatctctattttccttccccaaagccagtaactgcttctcaccctgaccctgtgctttctttcccgtcattgcgaaagaatggtccttgcttctgtgctgatcccaaacccttttgccctcagatcctcctgtccttccctggccctgctctgtattggctgtggggtgggggtggcggtggaactgacccctggsgtctgcatttctcaggctcccagggctgtggctgactttggccaatgggaggcaaggacgggagactgagagcttgggaggaagggagagaggtatgtttcttctccttactccctgcctgggrtggcaccttgggcaggactctgttttgcccatggcctcagctcccaccagatgcctctagtccctgggctcaggaaatagacaacctccttccactatcgctgtagcccaaggagggaagtattttttttctttctttctttctttyyttttttttttttacagagtctcactcttgttgcccaggctggagtgcagtggtgcgatctcagctcactgccacctctgcctcccgggttcaagtgattctyctgcctcagcctccagggtgtgccactatgcccagctaatttttgtatttttggtagagacggggttttgccatgttgaccaggctggtcttgaacttctgaccccaaatgatctgcctgcctcgtcctcccaaagtgctgggattacaggcatgagccactgtgcctggccgaaggaaatattttcttgctattgctaatctctgggttacctcgctatcccccatttagcttcacttctcctccatcacctgtatgaggaattccctctgtgttaaatatctggagaagtttcctgattggaccctggctgttgcagcttccaaggccacctctctttgtggctggtatccttttcccatgcatcttctccaggacttccattctgcagttatctctctgaactcagtgtcttcttcccatcagtataggggtggactttagtatctcctatgtttaggcaacatctctcctttgactctgcgtcttctccagtggttgcccttctctgctcctcttcacaataacacctcctgaaagggccacccatgcctgccccctcctttcctcaccccctctgtggctggacttctgttcctacactccaccctggttgacaaagtcactgattacttctctattttcagcttacttgatccttaattgccttcaaaaacagctaactgggccatgcatgtaatcccagcacttcgggaggccaaggcaggaggatcacttgagcccaggagttcaggaccagcctgcctgggcaacatagtgagaccctatctacaaaaaatagaaaaattagccgggcgttgtgactcatgcttgtggtcccagctacaaaggaagctgaggtgggaggatggcttgagtccgggagggtgaggctgcagtgagccatgatcacgccactgcactccagcctgcacaacagaaggaggccctttctgtaaaaaaaaaaatggttgaccactccttccttgaaatgcttttttcttgaggctyccatgccctgccttatcctgtttcttcctacttctctggttgtgctttttcctctgctcagtatttaacatgttggtgtgaccctggctctggcctgggcccccttctctatctacrtgctttctctcgacgacctccatcggttgcatgggtttaactaccaaatctgtgattctagctccgacaccccaggctaaagtagccacctggtcactccctattacattggtcaatttcatttctctgtgccacctatgattttcctgatttatttattcacttttcattgtctgtcttccccactaaaataaaaacttcttgagaaggggcttcatcgatctgcctctgttctatcccaggccctcaaaacaaggaccagatattcaacaaatatttattgaatgcgtacatgaattaaaactctaattggttgtatgctggtggtttattattttcatggaggaaatgacttgtaggctgtgacactcagcttttgtctctgatgctttgttgccctgttctgtcaccgagggctgtcgtcattgctctggccattttgtgctctttgaatttctaatcatcacactcaacccagaaggcagccttacctttcagcactcttcagctgaatgagtgcaagttggaggcagggtcattttttgataggaaattgaatgtttatatgctggtaaatataaagcttagctttttacaaagaatttctcaaaagtgagctttgttgaagccctgtaaattgttagaacttttatggaaattttaatttaggaaaaaatgtcatctgtttgggctgacttagttgttagttgtttgtcctttcttttttttggtggagggtatggagttttgctcttgtaacccaggctggagtgcagtggcgcgatctcggctcactgcaacctccgcctcctgggttcaagcgattctctcacctcagccttccgagtagctgggattacaggcatgcaccaccacacttggctaatttttgtattttaagtagagaccgggtttcactatgttggtcaggctggtttcgaactcctgacctcaagtgatcacccaccttggcctcccaaagtgcttggattacagacatgagccaccacacccggccaagaggacttcttttaaaaatgatttcttgggccgggtgcagtggctcacacctgtaatcccagcactttgggaggctgaggtgggtggttcacaaggtcaggagtttgagatcagcctggccaatatggtgaaactccatctctactaaaaatacaaaaattagccaggcatggtggcgcacccctgttgtcccagctactcgggaggctgaggcaggagaatcacttgaacctgggaggtggaggttgcagtgagccgagatggcaccactgcactccagcctgggcaacagagcaagactctgcctccaaaaataaaaattaaaatgatttcttaagtaaatttcaaatatagaatgtatatgctagtgataacaaaattaacactgtttatgcaagtctgcaataggtagatgtgaagttgataggtgcaataagtataggcaaacacataggaacatttgacctgtttttttgttgattttaaaacattgaataattgggaagcttttaaatctcttaatttgagcaactagatggctgtatttatctccttatattaaaaaaactattataattatctttcccacatatcaaactccactggtttttttcccatttttctttcatacttcagaaagacgagaatccaggacttgaatcgtatcttcccactttctgaggactactctggatcaggcttcggctcyggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaattcttaaaggattatgctttaatgctgttatctatyttattgttcttgaaaatacctgcattttttggtatcatgttcaaccaacatcattatgaaattaattagattcccatggccataaaatggctttaaagaatatatatatatttttaaagtagcttgagaagcaaattggcaggtaatatttcatacctaaattaagactytgacttggattgtgaattataatgatatgccccttttcttataaaaacaaaaaaaaaaataatgaaacacagtgaatttgtagagtgggggtatttgacatattttacagggtggagtgtactatatactattacctttgaatgtgtttgcagagctagtgkatgtgtttgtctacaagtawgattgctgttamataacaccccaaattaactcccaaattaaaacacagttgtgctgtcaatacctcatactgctttacctttttttcctggatatctgtgtattttcaaatgttactatatattaaagcagaaatataaccaaaggttaagctgtctcggatctgttgttctaaacccaggaaacagttatttttggccagacgtttctccagaagtcttatcaacaaaacaactttaaacgtattctacagtaaacacaagttttgtaaccagaatcaaatcatactaactagcaaatgaagaaagcaatgatgccttagcaagagggttatatatctcaaagcacttcctcacctgaaagatagttccatctctgttccccttagttctgaaaagcccccttacatcaccatcctggattctgttctgtactgtccagatcccagctccagaactgagtacttactcaaattaatctcctcaggagagagccaccttgcccaaggtcatgctgctttgcagggcagcctgcatccagtgactggctgatgtgggcatatcaaggcctgaactcagaatagtcatacagattcaaaactccccacaggatcagctccagttttgctgggactactttgtagctcagtttcttctttactcaattttacttccttccattccgctcataggtttctatcctgagagtgctcccttagaaattttctgctagtttccatctcagaatttgcttctaggagaacacaacttgtgacaggttgtgccaggagggataagaaatggatgctaagatgggattttggagctagattgcctgctgtctggctggcaatgaggactccatccttggccatagatgagcacaggcacaagatagcagtgcaattgttaaaactttcactggtgatgaaccaagatggtataccagtggaagggagtgcactagggtgtgatgtactaggcatctgagaaatgttggcaagtagtaataataaagacaatggtattggttggctattgctggacttaattaatgcttttgaaaaagacaatgaaaggctaaggacaattaattaaaagctaaatgtgaaaaccattgggcctccttggcagcatattaagaaactctcttctgtaatagaaggaattaaaaagctgaggaccaggcccaggacttatgagaatagcagatggctgggtgtggtggctcacgcctgcaatcccaacgctttggggggctgaggcaggtggatcacctgaggtcaggagtttgagatcagcctggccaacatggcgaaacactgtctctactaaaaatacaaaaattagccaggtgtggtgacaggcatctataatcccagctactccggaggctgaagcaggagaattgcttgaacctaggaggttcaaacctgggaggttgcagtgagctgagatcatgtcactgcaatccagcctgggtgacagagggagactctatctcaaaaaaaaaaaaaaaaaaatagcagagttccaagaatattaaattgtcagcttagcccagtctgttatgcaagctcagagtccttactggggaaaaataggaccctgagagatggaaacatctgggctgatacattcaagttttaaatcctcagattcctttgaacctctgaatctacagaagagtcccatgctttaaggaccgatgctggccaggtgtggtggctcatgcttgtaatcccagtactttgggaggctgaggcgggcagatcacttgaggtcaggagttcaagaccagcctggccaacacagtgaaaccctgtctctactaaaaatacaaaaattagctggttgtggtggcgagcacctgtaatcctactcggcaggctgaggtatgagaatcacttgaacctgggaggtggagtttgcaatgagccgagatcacgccactgcactccagcctgggtgacagagcgagactctgtctcaaaaaaaaaaaaaaaaaaaaaaaaaaaaaaaacagcaatcaaaaaacaaaaaaactagtgctttcctgttgaagacaatcaagaggcctctacccttaaagacaacactcactctccttcaagatctgtccccacctcccttcctagacagcagataaatatcaaagttaagtcagtataaaccaacaggggagttttgggcttgctcaggaggaaaggtaaaatactctgaaagttctgtagaacttagctaacgtggaccttaaaagctaagagggtgtctgtaagacttaactctggaagtccttgatccagggacggagatagaacacaaacttggataagggagtgtttagcaatgtgagtgtaccctcctgggatacaggttttaatgccctggcaagaaccctgggagaaggtgttgagactctgctaaaatgactcttagacacttggagaaagtgacagcccacacttaagtgaagtggaaatactagaattgtcatgccaggcagtggaaaaaggggtcaataggattaaggaaatgcacatgatagaatgaatggactatataagccttgcaaacccaccagatgactgtcttgcaggaaggccaaagcaataaagaatagcctggtgagagcaatcagcacctctgagccatctgcagtggctctcctctgaaaggcagggctgatgttgttacataactgggcttattaatagcagtgggaataaagggtaccaaaataatagagaccaggtggtagtgctcaaccatcagaagccaagaggtgcagttaccttttttttttttttttggaaatggagtctcactctgttgcccaggctggagtgcaatggcgagatctcagctcactgcaacctccgcctcctgggttcaagcaattctcctgcctcagcctcctgagtagctgggactacaggcacacgctgccacacctggctaatttttttttttttttttgtattttagtagagatcaccgtgttgcccaggctggtctcgaactcccgagctcaggcaatttgcctgccttggactcccaaagtgctaggattacaggcatgagccaccgcgtccagccaagaagccaagaggtgcagttatcttaatgagcagcaaggtcagagatgtatccaggggagcctcatgggcactgagataggagatggcatctctagaggcaatgtagttgcacagccagcaaaagtattgctcaatctattgtattaagcagggtttgccagagagacagaaccactaggacatatacttagatatatgagaggaggtttattagggcaattggctcatgtgatggtggaggccatctgcaagctggagaaccaaggaagctggtagcatagctcagtccaagtccaaaggccttggaccagggatccagggatatggcagatcttccgcacctggtctaccaactcacactctaatctcctgacgaaataacttcacagatacacccagaaataatgctttacctcctatctaggtatcccttaatccagtgaagttgacatctaaaattaaccaccacattattcaaccagaaagatcaagatggtcaggaggcatagggcaattgcctcaataaaaaaacactatggtggctgggcgtggtggctcatgcctatagtcccagcactttgggaggccaagatgggcggatcacgagatcaggagttggagaccagcctgaccaacatggtgaaaccccatgtttactaaaaatacaaaaattagccgggtatggtggtacgcgccgggtgtggtggctcacacctgtaatctcagcactttgggagactgaggcaggtggattacaaggtcaggagttcaagaccagcctggccaagatggtgaaaccccgtctctactaaaaatacacaaattagctgggcgtggcggcagggtcctgtaatcccagctactcaggacgctgaggcaagagaatcgcttgaacccgggggacggaggttgcagtgagccgagatcgagccactgcactccagcctgggcgacagagtgagactctgtctcaaaaaaacaaaaacaaaaacaaaacaaaacaaaaaacaaagaacgcaggaatgctggtccccaatgcacctccatttaattcaccagtctgggcctcacaaaaagcaaatggagagtgctagtggactattacaaattcaaccgagtacagagggtccccaacttacaatgatttgacttaatgattctttgactttatgatagtgtgaaagtgacacacattcagtagaaactaaatttcaatttttgaattttgacattttcccaggttagtgatatgtgatgtgatgctctctggcggtgttgggcagcactagcgagcatggtttttcgctttcagtattcaatacattacatgagacattaaaactctttattacaaaataggctttctattagattattttccccaactgtaagctaatgtaagtgttctgagcatacttaaagtaggctaggctaaataaactatgatgtttgatacgttaggtgtatttaatgtgtttttgacttaagatatttttggctgggtgtggtggctcacgcctgtaatctcagcactttgggaggccgaggtaggcggatcacctgaggtcaggagttcgagaccagcctggccaatatgaaaccttgtctctactaaaaatagaaaaactagctgggtgcggtggtgcacacctgtaatcccagctactccggaggctgagataggagaattgcttgaacctgggaggcggaggttgcagtgagcgaagactgcgccactgcactctagcctgggagacagagtgagactcagactcaaaaataaataaataaataaataaataaatattttcaatttatgatgggtttattgggatgtaaccccactgtaagttgaggtgcatctgtagtagctctattgaagcagcatccccaggtggaacacttttgctagagcagagttacatagctttagatacctaatagtcatttatttgacaaatgctttcttttatatccctatcaaaaaaagaggataaggctgggcacagtggctcatgcctataatcccagcactttaggaggctgaggtgggagaatcacttgaacccaggagttcgagaccagcctgggaaatatagcgagacctcatctctccattttttaaaagaggatcagaggccaggcgcagtggctcatgcctgtaatcctagcattgggaggccaaggtggatggatggcttgagctcaagagttcaagaccaacctgggcaacatggtgaaactctgtctctacaaaaaatacaaaaattagccagttgtagtggcatgcgcctgtagtcccagctactcaggcagatgaggtggaaggttggcttgagcctgggaggtagaggttgcagtgacctgagattgcgccactgcactccagcctgggcaacagagccagaccctgtcaaaaaaaaaaagaaaagaaaagaaaaaagaggatcagaaagagtttacgtactcttggaacagacggcagtatatttacagtctattcccaggactattttaactctcccactctttgtcatagtaccatctaaagagacctgaactggctggacatctcacagaaaatcacagtggtcactgaccagacccccatgtcattgccactgatgcaccagcatttcttcctgggctcacatctatgactgtatgagggcttcctaatgaccaactgccaggataggaataaactccagcttggttcacacatggattggtctggtatatgggagcaagccaaaagtggatgtcagctacactacaatgccattcaggagtggacttgaaaagcagctttgaggggaaatcctcccagtgagcaggagcactgggtggtgctcctggccatccactctgtgtagagagagaagtagcctgaggttggaagatactcatttgcatggactgtggtgactgttttgcccagttgataaggggtctaaaacagaaagattggaagattgggcacgaagcagctcagggtaaaggcatgtggatggaccaatgagagaagacaaagtgtgaagatgtacgtatc

SEQ ID NO: 17809 - DNA, 109730 bp, Homo sapiens
atttttaaaatatataacaatgctatcatcacacataattttttttttttttaatggagacagagtctctctctgtcccccaggctggagtgcagtggcgcaatctcggctcactgcaacctccgcctcctggggttcaagcaattctcctacctcagcctcccacacacatataattttttataaaataatatcaaaattaaaaccagtgatcacattttcccaattattttatgtatatttttcgggttacttgaatcagcatccaaataacatctttacattgcacattacaattgcttgatattgtaatgtccttaatatatcttaggtttcttttaatttataggctccatctctttttttattttcttacaaattttcgttgaagaaaccaagatatttgttccatacagtttcctaggttctggaattttattttatttattatttatttatttatttatttatatttttttgagatggagtcttgctgtgtcacccaggctggagtgcaatggtaccatctgggctcactgcaacctccaccttctgggttcaagcgatcctcctgtctcagcctcctgagtagctgggattacaggcggccgccaccatgcccagcttatttttgtatttttagtagagacagggtttcactatgttggccaggctggtcttgaactcctgacctcaagtgatccgcccccctcagcctcccaaagtgctgggattacaggtgtgagccactgcacctggcctttggaattttaaaattatgtccctgtgttgtcccatattccactatcccatgtatttcctataaattggtagttggatctgggatcttcaggtgtgcgccaccaggccctggaatcttaatcagattcaaatatcatttgtttgtataagaatacttgtaggtgaaaatgtgtcaaacttatttatttatttttaattattattttttagagacaagatcttgctctgttgctcaagctgaagtgcagtgacacaatcgcagctcactgcagcctcaagtttctgggttcaaacaatcctcctgactcagcctcctgaatagctgggactacaggtgtgagccacatacccggctaattttaattttttttttctagaagtggggtctcattttattgcccagggtggtctgtaacttctaggctcagtgatcctcttatctcagcctcccgaagtgctgggattataggtgtgagccactgtgactggcctcaaacttctttaattttcctttttttttttgagttggagtcttgctctgtcgcccaggctagagtgcaatggcaccatctcggctcactgcaacctccgcctcctgggttcaagtgattctcctgcctcagcctccctcccaagtagctgggattacaggtgcgtgccactgtgcccggctaatttttgtacttttagtagagacggggtttcaccatgttggccaggctggtctcaaactcctgacctgtgatccgcccgcctcggcctcccaaaatactgtgattacaggcatgagccaccgcacccggcctttaattttcttttgttgtgaaatacatcatattcacagcagtgtgtaaaaataattacatagtttaaagaataacaataaaatgaacatccagcacccaccacagaggttaaaaaaaaaatagggtgtggttggacatggtggtccacacctgtagtcccagctacccagaggcttgagcccaggagttcaaggctgcagtgagctatggtcgtgcctgtgaatagccattacactccagcttgggcagtgtagcaagaccctatcgcaaaacaacaatagggtatgttagcacctcagaaatccccagtttgtcttctctaattaaacctcctcttcccaccccataccagacgtaaccacaatcctgacttttgtggtaattattcctttactttccttatacccctatgaatgtattcctaaggagaatattgtttgcttccgcctttatgtctattattccatgacttgcttttccccctcaacattatgtttttgagattcattcatggtgtgtcaggtaactgtagctcattcatttacactgttatttaatatataggtattttattatgactgtactgcaatttatccttttgttggtgggcatttagattgttcccaattttttgatattataaacaataatgctatgaacattcttatacttgtctcttggcacatatgtgtttctttgaggtttatatctgggggtgaaactgctggctggaggatatgttcaactttagtaagatatgccaaattatttttcaaagtgctcacacccattgggatgtccaccaacagtgtgtgggtgttctccattgctctgaattcttgtcaacactttgtattgtcagattttgccaattggtgagttcaaagcccctattaataaaagatgtgtaaaattatactataaagttgatatctcaactgaactcacatgaaccctattcaaatattccttttgtttgtccctgattttcaggaaaacataaggctttgtaagttaaaaatgacatgaaagtatttcacctgtgagctgctacgaaactatgtcacaatttttggagagagagaggaaagggagaggagatatttgtgtgacttaaggggtggaaacatggtatcaagatgctggtaagatagatgaccacttactcatggctaagcatcatggtgctaagaatctagataaaatacatcctttcgtagagttagcactagacactccattcaacccagaaacaaacttactcttctcttttccgatttcccgtttcagctcatttcttctagttgcttttgaccctttaagagtttctttattacagaattcctatcatgaactctgacaccaaaatttcatacttgggcatgcatacctgggcgtgtaatccaggactctagacaatttcaggctactttccttaagtgttgctgtgaggaagaaattagttctcatattagatatgactcttggcacatcacagaaaaacatgggcattacttcaccttctgttagcctatacctcatactccaaaatatttcagtctataagatttgctccttctagaattattttttccaccaatttccacggaaaatcaagtgttcctagaaaccattcctggctggccgcggtgactcacacctgtaatcccagcactttgggagtccaaggagggtggatcacgaggtcaggagtttgagaccagcctggccaagatggtgaaacccttctctactaaaaatacaaaattagctgggcgcagtggcgggtgcctgtaatcccagctactcaggtggctgaggctggagaatcgcttgaacccgggaggcggaggttgtagtgagcctagatcgtgccactgcactctagcctgggcgacagagcaagactctgtctcaaaaaaagaaaccattcctaacttctcctctctcaccaaccccctttttcatgaagatctctgccttgtgtccaagattcttggacaaagcagcagtatctttatgattttgtatcctgaatactgctgcactcaagctgatgttctgcaaatttgtaataatcagtttcattttttttttagtttttcattttatttatttatttttttgagacggaatctccctctgtcgcccaggctggagtgtagtggcgcgatcttggctcactgcaacctccgctccccaagtttaagcaattctctgcctcagcctcctgagtagctgggattacaggcgtatgccaccacgcctggctaattttttgtatttttagtagagacaggtttcaccatctttgccaggctggtcttgaactcctgacctcgtgatccacctgccttagcttcccaaagtgctgggattacaggcatgagccactacgcccggcgaagaccaagtcttgctctgttgcccaggctggagtgcagtggcatgatctcagttcactgcaacatctgcttcctgggttcaagcaattcccctgcctcagcctcccaagtagctacgactacagtgccaccatgcccagctaatttttgtatttttgttagagatggggtttcaccatgttggtcaggctggtctccaactcctgacctcaaatgatccacccgctttggcctcccaaagcgctgggattgcaggcatgagccacagcgcccagccaatcagtttcctttaagacagtaattgagytttaaatagaaggtagtgtgttaggtcttggccattggaagctcgcttttctccccataaccagcctgtttcattgctttatctcctcatgtttcacttatttcaggccatcttccttcacttctgtttctgacctaaggtagacacaacactctttaaaaaaatttttaaacccccagcagctacacaaaaacttaaaaaatttaaaattgaggtaaaatacacatacataaaatttaccatcttaactttttgtttttgtttttgtttttgagacagagtctcactctgtcacccaggctggagtgcagtggtgtgatctcagctcactgcagcctctgcctcccgggttccagtgattctcctgcctcaacctcccaggtagctgggattacaggcatgcgccactacgcctggctaattgttgcatttttgtagagatggggtttcaccatgttggctaggctggtctcgaactgctgacctcaggtgatctgcccacctcggcctcccaaagtgctaggattacaggcatgagccaccgcacccagccttagccatttttaagtgtacagtttagtagcgttaagtacattcacattgttgtgcaaccagtctccagaactctgctcatcttgcaaaactgaaactctgtatccattaaacactggctccccatttccccctgcccccagcccatggtaaccaccatttaactttctgtctttatgaatttgtaatgggatacagtattgtattttttgggactagcttatttcacttagcataatgtcaagattcatccatattttagctgtatcagaatttccctcctctttaaagctgaaaaatactcagtcgtatgtatatactgcatttttgtttatcattcatctgttgtggacatgggttacttctgccttttgactactgtgaataatgctgctttcaacacgggtgtacagacatctcttcaagaccctgctttcaattcttttggctacatggccagaaatggaattgttggaccgtattttttttaattttttgagaaacctctatagtgttttccatagtggctgcaccatggtagacacttctaaagtttctgccataccctaggggaaagaattattgtactgtagacaacatctaaggaaaagaactgtatggccaagagtaaacagtcaattttcatgctttattagaaaataattaaaataattaagagcgtggaattcctagaattgggagagacattatgaaccatttggtccatccctttcctttacgatgagtaaacagaggtttgtggaggtcaaacggctagttaagtaagggaagaaccagaactggcatccagagctttccaatcctcaacttattgcaaagaaaataataataattttcaactcgaaaaattatgcgatgaagaacaagaactattgagcggatgattcgcaacatcctctgggatgtattttctgtgtgttttgttttgaaggctgtttgttaacctccctaattgccttggttgacattgaaaccctgcctgtttttcttgatcccgccgctgactgggtcctgagcatcctaggagatggaggcagagacaaaggaaatcagtccacaattaagaatggaatggttcttaatggaatgctcgcctgtgcgctggcgggagttgccagcgtgccgagcggattcagcgcctttctcagggcctcaaagatcccagcgcactaggagggtggtttgtggctccctgcagtccccacgccccggatccaaacgacagagttcggggactcacaggggcagcaaggcggcagagccgcggagccagtgcaacttctccggcgggaccgcgcccaatcttccccgccgcagtcggggagccccgggggccgccgagcacaggctgcggaccgcggcgggcacgtgggctcggctgcagcgctgcgccaggcaccggctgctcggctctgcccaacctctccgctcccgcctcggtccctgcctctggggagagggttcctccccccttccactttgcaccagtccgagggaatttgcggtcggtgacgcgcatccttaagagagccacctgcagcgcgaggcgcgccgctccaggcggcatcgcagggctgggccggcgcggcctggggaccccgggctccggaggccatgccggcgttggcgcgcgrcggcggccagctgccgctgctcggtaaggccccgctcgctcgctcgcagcccctcgcggtccctcagcccccaccccgcagtgtggacccgggcgcgcgcctcctccggcccagccgcctcgctcctccccgcgctcgctccttccattgcctcccgcgcccctcccctctttcgcgccctccggactcgcccactacttgcctgcggccccggcgtttcccaccccgcgtcctcttccctcttctccgaagtctctcctctggctcgggccgcggtcccgagtggcggcccggacttcgcagacggcctcgccgaggcgctgcgccgggtctggggcagctcggcccgcgcgctcgggtgctgggccgtccgtgggagtctgcggccgcgaactcggcgccaggtggccaaggacctctcctggcccggcccttggatactgtagacacctgggtgtcgtctttaactcttcttttgaggttttgatttatggagggaactctgatgggaaaatgcgtccgcgttctcccctagagcgagtcatcctcaataacgataccccccagccccgccgaattttggttggatcaacgaatagtttacctaggaaatattatgcaaacagatttacatattaaaatactagctgtccctttcttctagtctcttcttatcctggcataaaccccaaaggggttttcaaggactccgaggactgtccccaaagaatctgctgggtagcatagttgttattgaaaaaaaaaatcttcccatcggttcgcgtcagctttctatttggaaagatgagaggactgaatcgaatttgggttgaaggcgacagagttctgggtgcccggcagctccggtccctgtcctaggtctgcaaccttgggactgacactcacctcccccggcctccgcgtcctcatctgtgcagtgagggagtccgtccgagtccccttcagctctgaaatgctaggacttgaagtctctgtggtaaatagagaaaatgcttgcaatatagaagtgcaggaattatatccaatagcttttgttacaaataattctgaaatataaaaagtaaaaaatggaaatcgggggaaaagagttgaaaaacaaagacattttagttcttaaatagttatctttactagttagtaaatctgtaatttcaaatgtgtagtacaatatgttttccagattccgttaatacaaaatgttagctttctattatgtatgatattaagtagtaagtgcatttttcagaagcataatgggctttctaaaggtataagcatcaatacttgcaacgatatttaagctgcatggaattcttttctatttaggaaagaattcagaaatttctatgtctctctctccagatatttctaaatgaagtataattggcacacagtaaatatgcacacatcttaagagtacaatttcattagttttcacatatgtacgtgcccaaataaccacgatcagactgagatatagagcaattctagctccaccctctctgtcagtaccccctccccaggtagccactattctgacttctgatgccatggattgcttttgcctatgtttgaacttcatgtaaaccaaaccatcatcgtgtgctcttttatgtccaccttcttttactcaacattataataataagattcaaccttgttctctgtagcagtgtttttttttttaattkctggtaccattccgtggtatgaatagatcttataatttattttatccattatgttcacgaagcacatggaagttgttccaattttgtgtaattatgcatagcactgctgtgaacattgttttatatatggtggacataaacaccagtataaaggattatgcccacaagtagaattcctggatcatagggaagggatatgttcaggtttggtagataccgtcaaacggttttccacagtggttacaccaatttccactcccactagcagtgtatggcagttccagttcctcacatctttgccaatactttgtattatggattttcttgaataaagaaggataaagtgagaagcttaaacatgagaactttaaaatggttaatagccttaaattctttgaattagaacatgggatcccaatttcccttatattgtaaacactacttttttttttttttttttttttgagacggagtctygctctgtcacccaggctggagtgtagtggcgcgatctcagctcactgcaacctccgcctcccaggttcaagcgattctcctgcctcagcctcctgagtagctgggattacaggtgcgtgccaccgcacccagctaatttttgtatttttagtagagacgaggtttcaccatgttggccaggctggtctcgaactcctgaccttaggcgatccacccacctcagcctcccaaagcgctgggattacaggtatgagccaccacacccggccatgcccagacttctattcatcatttatgaataatgatgaagctttctaagtggcatttgaaggagaggaacatgttcccaatgggcttttctgcattatctgctgatactggacagagagaagtatttcaatattttaagagctatgatactacctttttcattagtgttaaaaaaaattcgtattcaaagccttgaactgcacatttgagttgccattctttgctcttgttgcttatcttagtttatttgccttcttggaaactcctagcccaagggggaatgattcaggagaaagtggagggaagggacactcagcaaagcttggtttggattggatgtgagcccagacctgccgacctgacattaatgtcccctctgactctgaaactctagttctaatttttgccattatataggtgtagattggatattcatttctttttaggtacttcacgtctatctatagtaaattatcctcttaggtttaattgtgaacttcttgccttacattaaaaatggattaactttttataactaagaaggcactttcagtaactcttagctattggtaaatatttgttattggattctcctgttgtttaaactgaaaaacaatcaggcaatgagatattaaatgggaaggaggaagacttacttatattccaagggaagacttcagataagaaaaatgaagagaaaacatgcattaggaagaaaaaatctgtttttatttaacaaactttaattgaatacccatttttttccttccttccttctttccttccttcctttctttctttctttttctttctttctttcgacagtctccctttgtcattgaggctggagtgcagtggtgtgatcacagctcactgcagcttcaacctcctgggctcaagcaagcctcctacctcagcctcctgastacctgggaccacaggcacgtgccaccacacctcattaattttttgaaaaattttttggtagagatgagatctcactgtattgctcaggctaatcttgaactcctgggctcaagtgatcctcccaaagtgctaggattacaggtgtgagctaccrtgcctgacagaatacctatttcttgctaggcacaagcagtacaaagattaaagagatggaggtaggggaacttgtgtataaataaccaattttatttttttaagaaatgtgtggtcattgcctttccccaggaaaagtatttcagtatgctttcttttattaaaccttccaacacagttattatgattactaaatatacattaaaaattgcatgagtctggctgggtgcgatggctcatgcctgtaatcccagcactttgggaggctgaggcaggcagatcacttgaggagtttgagaccagcctggccaacatggtgaaaccctgtttctactaaaaatacaaaagttagccaggcrtggtggcagacgcttgtaatcccagctacttgggaggctgaagcaggagaatcacttgagcctgggagrcagaggttgcagtgagccaagattgcgccattgcactatacccttggtgacagagtgcgactccatctcaaaaaaaaaaaaattgcatgcgtcaatgaaggaagctttagcctggtcagaaaagggatcccagttttttgccccctaaaactactttttaaattttttttgagacaagacctggccctatcacccaggctggagtgcagtggtacagtctcggctcactgcaacctctgccttacggactcaagcaagcctcctacctcaacctcctgagttgtgggactacaggcatgcaccatgacacccgactaatttttgtattttttgtagagatggggtttcactgtattgtctaggctggtcttgaactcctgagctcaagcaatcctcctgcctcagcctcccaaagtgctgggattacacatgtgagccagtgcgcccagcctaaaactacttaaaaatggagatatagtactgtatttaatgcttatgggaaagaaaatgctcttccatttaaagtaaaaggaacaaactgttccaaagctaaatatggtcatcttttaggtcttgggaagaagcacttttccaaatcattctttaagcaaaggtattgacyacattttactctgggagggtattcctgctcatttgagaagcccacaaaatgcctcggcttcaacaacatatccacggttctttgtgttcctctcatctcatccttgcatgacactcggcaagcagggtgacagtaactaacccctatcattcaagttcaagattacagtcttgctgcctccccacatacctaccagacattgccttaatctttgggcaaagattttgatttgacaaaaagcaaataatctcaagagtattgtattttatcatttttcttaactttgaaagggatcttgtagataacaggagtaagaatttggagagggggccgggcaaggtggctcatgcctgtaatcccagcactttgggaggccaaggtgggcagatcacgaggtcaagagatcaagaccatcctggccaacgtgataaaaccctgtctctactaaaaatacaaaaattagctgggtgtggtggcgcacgcctgtagttccagctactcaggaggctgaggcaggagaatcacttgaacctgggaggtggaggttgcagtgagccgagatcatgccactgcattccagcctggagacagagcgagactccttctcaaaaaaaaaagagaggggaaactgaagggctggaaattggcttagcttggtcttgacactgtgctgtatcctttattccctctgaaatagcaaattcttgtgaacttcacagtaggtggtttgtctgagtagagctttttggttttttgttttttcttatatacccagactgctcacctgcaagctttttggtttttatcaggagactttgtgatcttaagatgtttttctatgacttccagaaaagctgtatccacttctcaggtagtcacagttatagggtcgaagatttttctgtctttggggaatctgcgagttttatacctaagtgatttagttattcttggttgatactttctatggctgcattatcagtggttttgaagtaatgaaagcttttgtagaagtcactactggtcactaatttgactcacgcaattctgttctatgagtaccaacacatgtgaaggaaattttaaaataatataaaagtaggcagagtgcagtggttcacacctgtatccccagcactttgggaggcctaggtgggaggatcactggagcccaggagttcaagaccagcctgggcaatacagcgagacccagtctctacaaaaaaatttaaaaattaactgagcgtagaggcacatgcctgtagcctcagctactcaggaggctgagataagaggatagcttgagcccaggaatttgaggctgcagtgagctacgaccatgccactgtactctaacgtgggtgacagagcaagatgctatctctaaaaaaagaaaaaagaaaggaaaaaaatatataaagtgcacacagtgttcttttgtggccacagaaattgcataagatcctaaaagaggaaccatttttttttaggttaaacagtaaaaaaatatacatttttttactgctgtcattataaggtcaattggtagccaagaatcttccatacaattatttacagtctatgctaaagcaggctttagtgtataagacagtgtataagatagtcactgaattcggtcttggaatattttgttatttgagttatgcttttcctaatgtttgatattatgttcttggaggtaatgcccatagatatattaggactaaaaacacatttaagaaacgtgctgttttctgtggcagagaatgtctctgcacttaagttcctcatttgtaaaaaggagataagcagtatcttactccttcatcagataatacttgtaaagcacagctgcactccttgttaggcacgtgttttgcagaaagaaaaatatatgaagtctgaagacattaggatttggagtcacaagatttgcctgcctctctccttccctcccttcttttttaattccctccctccttcccacccttcctccttccacagatgtttttgagcgccgtctatgtctaggacctgtgttaaatgctacacagtactgtttcctgccctcaaagtataatgttaggggtgttggtgggagaaggtcagacatatagaaagaaaattgcagtggagttttagaaatatgcacagtggctgaacctctaacccagactgagaaggtaaagcaaagcttccaagagaaggtgatgccagagtcatactggaagagaagtaagacttgtcagagaaagaagagggtgaggatgttccaggtaaataggacagcaaatggagtyttccacagatggaaaactatgatttcattccgagttgttgtgacacaatgtataaggtcgccaggattagagtaactatcatttataaagttgtaattcagcaaattatttgaagatttctaatgaataggttttaaaaaaagaaaattcagggttgcctgagcataacatgtaatgtgtaagggatactttggtgatgtgttatgttaagtggttggactttatcatgtagaccaagagtctctggatggttggtctgacgtggggatccatgcctgtagtcccagctacatgggaggctcgcttgagcccaagagttcaagtccagcctggccaacatagcaagatcccatctctaattaaaaaaaaaaaaagaggccaggtgtggtggctaacacctgtaatcccagcagtttgggaggccaaggtgagtggatcacttgagcccaggagtttgaggccagcctgggcaacatggcaaaaccccatttctataaaaaaatacaaaaaaagttagccagatgtgctggcacatgtctgtagtcccagctactagggaggctgaggcaagagaattgcttgagtctgggatgtggaggttgcagcgagccgagatcacaccactgtactccagcctgggtgacagagcgagaccctgtctcaaaaaaaaaaaaaaaaaaaaaaaagtagtctctggatggatttcaggggggttgttatatcttccctctgtgtgtgtatgtgtgtgtgagcatgctttttttttttttggaaagtgagttaattgcgaccttcagattttcaaagggatttgtgactcaagaaagggtaatcattgctgttggttctggagggctttaagcagaggtgtgacatgctctgatttgtattttagaaagacacttctggtgtctgtgtagaggatgaatatggggccaacagaactatggcagggaagttgttggcagtagtccaggccagagatgataacgagggcttgaattagggtaatggtgatagagatgtggagctgagaattgctttgagaattatcaagtagtcaaaatgttagctgagcatggtggtgtgcacctgtaagcccagccactctggaggctgaggcaggaggatcacttgagcccaggagattgaggctgcagtgagctatgatcctgccactgcactccagcctgggtggtagagcgagaccctatctaaaaaaaacagtcaaaatataagggttggcaattgcctgggtaatgggaaatgagggagagggaggagtcaaaaatggcttctgggtttctggatcctgtgacactggaggtttgccactgaggaggatttggggagagggaggagagagggagataggaagaggtggggcttagggaggagaaaggtgagttaaatttccatttgagtttaaggttcctggcgggggttacccagatatatagttaaagacacagaaggtatgaattaggaacttgtgagcagatatattcttttttattttatttttattttttgagacggagtctcgctccatcacccaggctggagtgcaatggcgcgatcttggctcactgcaacctctgcctcctgggttcaagtgattctcctgcctcagcctcccgagtagctgggactgcaggtgctgtccaccacgcctggctaatttttgtatttttagtaaagacggggtttcaccatgttggccaggctggtttcgaactcctgacgtcaagcgatccacctgccttggcctcccaaagtgctgggattacaggcgtaatcctggccacgcctggcctattttttatttttatagagatgaggtcttgctgtgttacccaggctggtcttgaatgcctgagttcaagcgaccctcccaccttggcttcccagagtgctgagattacaggcgtgagccactgcacccagcctcaccagcagatagacagtagttaaaattatgagaatttatagagaaagaacattgaatgaatgagttcagagaatgaaaccttggagttacccagtctactgccctcatttaccacaggaagaaaatggggggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaaagaaaatggggcccaaagaggataaatgagttgctcaaattcagttttcaaagctgataactttcagaagagggacttggaactctggtctccaactctttgcctcacagaagagagcttgaaaatgaagtgtcttgacatcctctggtttgtttcatratgtgtaaaataaagccacaactctttaaagttttagattaatgtcaacttttgttttacttacccccacccccatcccagtactgtcccttcaaagtgtaccactttgagagctctttttcaattccaaagttgtcctcaccgctcagaatgtgtttggaactggattctgggaatttccattaaggttttagaatgaatttttggaaagaaccttaatattgatggtggcaaatttcctttggctttgttcttttgttgagggggcaggggcggacaggtctcactctgtcacccaggctggagtgcagtggcatgatcttggctcactgcaggcttcactttgcgggcttcagtgatcctcccacctcagcctcctgagtagttgagaccacaggtgtgcaccaccacactagggtagtttttgtatttttggtagagatggggctttgccatgttggccaggctggtctcgaactcctgagctcaagtgatcctcctgcctcggcctcccaaagtactgggattataagtgtgagccaccgcatctggccagctttttaaaaagtcaggtttattgaggtacaattttcatacagtaaatttcatcctctttagtatgcagttctatgagtttaagaaacaaatacagtcatggaactgccaccactaccaagatatagacatttccattccccttaaaagttccctcatggtggtgcacagtggctcgaacctgtaatcccagcactttgggaggctgaggcaggcggatcaagaggtcaggagttcaagaccagcttggccatcatggtgaaaccctgtctctactaaaaatacaaaaaattgggcatggtgatgcacgcctgtaatcccagctactcgggaggctgaggcaggataatcatttgaacctgggaggcggaggttgcagtgagctgagattgtgccaccacacttcaccctgggtgacagagacagactccatctaaaaaaaaatttccctcatggcggggcgcagtagctcacgtctgtaatctcagcatttggggaggccgaggcgggcggatcatttgaagtcaggagtttgagaccagcctggccaacatggtgaaaccttatctctactaaaaaaatatatataaaacttagccgggcatggtggcaggcacctttaatcctagttactcgggaggctgaggcaggagaattgcttgaacccaggaggtggaggttgcagtgagccaagatcactccactgcactccagcctgggcaacacagcaagactccatctcaaaaaaaaaaaaaagttccctcatgcccttctgtagtcaaccctgatccctaccccaagcccctcacaaccagtactctctttcctgttttcattccctttatagaatgtcatgtaagtggaatcttatgatatgtagcctttgagtgtgtttatttcacatagcagaattatcagatttatctgatcaggtgattgttacgtatatcagtaattttttctttctggtgctgagtagtatcctattgtatggataggcctcagtttgtttatccattaaccagcgactggtcatttgtttgcttccagtttttggcaatgatgaataaaacagctataaatatttgaatacaggtttttgtgtaagcataggttttcatttcttttgggtaaatacctcagagtggtattgtattgctgcactggatgctaagtgaatgtttaacctcatgagaaactgccaaactgtttttcaaagtgattgtaccatttgtcattttccccaacaatgtgtgagaattgcatttgctcaaggtcatcgtcagcatgtggtattgtcagttttttggtttgggtttttaaccattctaatagcagtgtagcaatgtgtactgtggcttaaatttgcatttccctaatgactaatgatgttaagcatcttttcatgtgtttaattgtcatcctatattttgtttggtgaagtgtctcccaaaatcttttgcccatttttaaaactggagtgtttgttttattattattgggttttaagggttctttgcgtattatggatacaagtcctttttcacatgtatatcatcaaactattttctccagtctgtggcttgtcttcattttttaagaatgttttctgggctgggtgggcagctcacgcttgtaatcccagcactttgggaggccgaggcaggcggatcaccaggtcaggagttcaagaccagcctggccaacatagtgaaaccccgtctctacgaaaaaacaaaaaaattagctgggcgtggtggtgggcgcctgtaatcccagctactcgggaggctgaggcaggagaatcgcttgaacccgggggtggaggttgcagtgagccaagatcgcaccattgcactccagcccaggtgacagtgtgagactctgtctcaaaaaaaaaaaaaaaaaaaggttttggatggctcacacctgtaatcccagcactttgggaggccaaggcaggtggatcacctgaggtcagcagttcaagaccagcctggccaacatggcaaaaccctgtctctagtaaaaatacaaaaattagccaggcatggtggtgtgcacctgtaattccagctacttgggaggctgaggtgtgagaatcacctgaacctgggaggtggaggttgcagtgagctgagattgtgccactgcactccagcctgggcaacagagtgagactccgtcttaaaaaaaaaaaaagaatgttttctgaggagcaaaagtttttcattttggtgaagtccactagtaaaagaaaattaactctaaactgaacactgctttgatcccacctaacccagcttaaatgcaagacatgaaagaacaaagtgctcaccataaatttaattgcatcccagaaaaaagttcaagaatatttaacagaagacaaaaacatccagcaccaggtaaaattcacaatgtctgacacccagttataaatttactagacaaacaaggaacaagaaatatttracttaaggagaaaaatcagtcacycaaaagggacccagaaatgacatcaaatgtggaattagtgggcaagaaaattaaaacgrttattataacaatattccaaatctttctgaatgaggaaagattgtacatgttaagaagagacatagyaaatataacaaattactcaaattgaactactaaggatgaaaactcaattacactggagagaattagtaccagattaaacattgtaggagaaaagatkagtggacttggcggcatagcaacagaaactatccaaaatgaacagagcaaaaaagaccaaataacgtaaacagagaattagggaggtacagaacttcaggtcgtcagatatacatgtaattagagtccctaaaggagagaatggaggaaaggaagatgacagtaaagatatstcaaaaataagggaggaaaattgtcaaaatcggataaaartgataaacctatgggttcaagaagcccagtgaaactcaaacacatgactwatgacaactacaaaaggctaattatcatcaaattsgttaaagccagagactaagagaaaatcttaaaagcatccagagaaaaaaagatacattcatttggcagacttcttgtcatgaactatgtaagtcaaaagacagtgaagaaacattgcaacatctttaaagaactgaaggacgctttgggaggctgaggcaggaggattgcttgaagcaaggagttcaagaccagcctgggcaacatagcaatccactgtctctacgaaaaataaaagaattggccaggcatgatggtgtgtccttgtagtcaaagctacttcagaggctgaggtaggaggattgctagagcccaggagttcaaggctgtagtgagctatgatcatgccactgtacttcatcctggacaacagagcaaaactaataatataaatgtgtagttctatatccaaaaataaaacactttcaaaaatgaagagaaacaaatagtttttcagatgtacaaaaactgaaagaaacaatcactaccagactggcacaataggaactgttaaagaaagttcttcagacaggtgggcatggtggttcatgcctgcaatcctagcactttgggaggccaaggtgggcagatcccttgaggtcaggagttcaagaccagcctggccagcatggtggaaccccatctgtactaaaaatacaaaaattagctgggtttgattgtgcaagtttgtaattccagctactcgggaggctgaggcagaagtattgcttgaacctgggaggcggaggttgaagtgagcagagatttcaccactgcactccagtgtgagtgacagagcaaactccatctcaaacacacacacacacacacacacacacacacacacacacacacacgagttcttcagacagaaggaaaaataatacaaaatgaaaatctggatttacacaaaggaatacaaaatagtgggaatggaaactatttgagtaagtatagcctttttttcttattgtttaaatctctttaaaagacaattcactgtttaaagcaataataataataatgtcttgtggggtttatagcttacgtagaagtacagtgtatgtcagcaataccacaaagcctgaaagaaatgaaacggaaatatgccagtgtaaggtcctagtattagatacgaagtaatgtaacatcacctaaaggtagactgtgttatggtaaacatgtaatactatgaaccttaaatcgactactaaaacaaaacaaagcattatagctaataatccacaaaaggaaataaagtggaatcatttttttaaaagctcagttattcccaaaggaggcagaaaaaagagaagaaagaataaaaaacagaagggacaaatggaaaacaaagaacaatatagtagatttaaatctgatcatgtcaatactttctgtaagttaaaatgatctaaatatcataattaaaaagcagaagtttcagatttggctatagaaaagtaagacccaactatatgcatcataaatgaaaccagtcctggatatttttttaatgtaattttttatttaaagaaggggtcttgtcatgttacccagactggtctcaaactcctgggctcaaatgatctgcccacattggcctcccgaggtgctgggattgcaggtgtgagccaccatgcccagccctagtcctgcatatgaagacacaaataggttaaaagtaaatggatggggaaaaaaatcccattctaacactaatcaaaagagagccagaggtaatgatgttagacaaagtacatttcagagaaaagaatattgctagaaacaaagagagccatttcataatgttataaggcttgattcatcaaaaggacataacaatcctaaacgtatgcacctaataacagaacttgaaaatacatggggcaaaatctgactgaactgcaaggagaaataaacaaatacacaattatattcaaagtgtatgacactccttctccttcaataattgatagaacaaggacaaataaataagtaggatatagaagacttgaacagcattgtcaagcaacttgaccacatcacatttatggaacattccacctaacaatagtcacagtagtcaaatgcacctcttttttcttttctttttttttttttttttttttttttgagatggwgtctggctctgttgcccaggctggagtgcagtggcacartcttggctcactacaacctctgcctccccggctcaagtagttctcctgcctcagcctcccgagtagctggaactataggcgtgcgccaccaggcccagctaattttttgtatttttagtagaaacagggtttcaccacgttggccaggctggtcttgaactcctttctcaggtgatccgctcgtgtcggcctcccaaagtgaggtgtcacaggcgtgagccaccgccccggcttgcacatcttttcaggtgcacacttaccaaggtaaagcatattctgaaccataaaacaagtgtcagtgaattttttttttttttttttagaggaaggctcgctctgtcgcccaggctggagtgcagtggtgcgatctcggctcactgcaagctccgcctcccgggttcacgccattctcctgcctcagcctcccgagtagctgggactacaggcgcccgccaccacgcccggctaattttttgtatttttagtatagacggggtttcaccgtgttagccaggatggtctcaatctcctgacctcgtgatccgccctcctcggcctcccaaagtgctgggattacaggcatgagccactgcgcccggctgtaaattttaaaagattcaatacatacaaagtatatcttctgactacaatagcattaaattaaaatttcagcctgggcaagatggcaaaaccccatctctacaaaaattagaaaaaaataattagccaggttggtggcaaatccccatctctacaaaaattagaaaaaaataattagccaggttggtggcatttgcctgtactcccagctacacaggaggctgaggtgggagaatcacctgagcccagggaagttaaggctgcagtacaccgtgatcacaccactgcagtccaccctgggtgacgagtgagactcaaaacaaaaaacaaacaaaattaatacctgcaggacatttttgtaaaaaaataaaaaattaattaattaaaattaataacagaaagaggccagtacagtagcttgcgcatgtaatcccagcatttttggaggctgaggtggcaagatcacttgaggccaggagttcaagaccagcctgggtaacatagcaagacctcgtctcccaaaaaataaaaaaaaattagggagacgtggtggcctatgtctgtagtcctcactagttgggaggctgatgtgggatgatcatttgagcctaagagttcaagtccagccaaggcaacacagcaaaacaccatttcttttaaaaaaaagaaaaaaagtaagcaaaagaaaggaaacacagtaataatcatcagggtgaaaaatcaaagaaaaagaaaacaaaaaaattagaaattaaaacaataaaactaagaacagtaaaagatcaataaaatcagtaaacctctagccaaactgattagaaaaaaagagtgaagacgtgaattgccaatatcaggaatgagagaagtagtatcactacataatctacagatattaaacggttaatatggaaatattactaacaactttatacctatactttgacaactttgattaacagaaaaaaaataaaagacacatactatcaatgctttttcaagaaaaattgataagctaaataatgctctactaaagcaatttaatctgtagttaaaaatattcccacaaggaaaattattagagcagatggctctcactgggaaatccaccaaacatttaaagaggaaataaaaccaattctatacagactcctccagaaaactgaagagaaggcgacacttctcaactcattctatgaagccagcattactctaataccaaaaccagacaaaggttaaaagaagggtatagatcaataacttccatgagtgtaaatgtaacaatccttagtaatattttaacaaattgaattcaatgatatataaaaaagataacaggtgatgtcccgctgatgtttattccaggaatgcaaggttggttaacatttgaaaatcaatcactatatttacagactaaaaagaaaattattactaaaaaaaaagaacaaaaccaagtctatctgattatctcaatagatacagacaaagcatttgacaaagttcaatatccattactgacaaaaacctcttagcaaactaggcatagaagtgattcggctgggcacgtggtggatcatgcctgtaatcccagcactttgggaggacaaggtgtaaggattgcctgagctcaagagaccaacaccagactgggcaacatggtgaaacttcatctctacaaaaaatacaaaaattggccaggcgcggtggctcatgcctgtaatcccagcactttgggaggccaaagtgggcagatcatgaagtcaggagatcgagaccatcctggctaacacagtgaaaccccgtctctactaaaaatacaaaaaaaaagtagctgggcatggtggtgggtgcctgtagtcccagctactcgggaggctgaggcaggagactggcgtgaacccaggaggcaaagcttgcagtgagctgagatcgcgccactgcactccagcctgggcgacagagcaagactccgtctcaaaaaacaaaacaaaacaaaacaaaacaaaacaaaacaaaacaaaaattagctgggcgtcgtggctcctgactgtagtcccagctacttggaagcgtcccttccaaggttggaggatcccttgagcatgggaggtggaggttgcagtgagctgagatcgcaccactggactccatcctaggtracacagtgagatcatgtctcaaaaaaaaaaattcctcctggagtgagcagcagaaaaaacaaaaaataaaagactaggcacagtggctcatgcctgtaatcccagtgatttggcaggacgaggcaaggggggttgcttgaggctaggagtttgagaccagccttggcaacatagcaagaccccatctctacaaaaagttaaacaattttttaaaaattagctgagtgtggtgctatgtgcatgtagtcctaggtacttgggcagctgaggtgggaaaactgtttgagcccaggagttcagtgttggagtgagctatgataatgcctctacactccagcctgggcgacagagcaagatcctgcctataagaatcaaagtaggccggtgcagtggctcacgcctataatcccagcactttgggagggtgaggcaggcagatcacctgacgtcaggaattcgagaccaacctgggcaacatggcgaaaccctgtctttactaaaaatataaaaattagccgggcatgatggygggcacctgtaatcccagctactcagaagctaagggacaaaaattgcttgaacccgggagatggaggttgcagtgagccaagatcgcaccattgtactccagcctgggcgacagagcaagactgtgtctcacaaaaaaaaaaaaaaaaaaaaaaaaaaaagaatcaaagtaaaaaaatcaaagtaaatcaaagtaaaaattataataaaaaaattacagaagagaaaagaacttatcttcctcaagctaattaagggtatctatgaaaaaccaatagctaatattatacttcatagtaaattaataaatcttttccctaagatcagaaacaaggcgaggatatccactcttcacttcttttattcaactttatactgcagattttagccaacgtattaagacgtgaaaaagaaatgaaaagcatccagattgaaaaggaagatgtaaaactctttatttacagacaacatgataacctatgtagaaaattctatagaacctacaaaaagtgactgtaactaataagtgagttctgtaagtttgcaggatgtactatcagtgtggaaaaaaattaattatctttctatgtcctagcaactaacaatcagaaattgaagggaagaataccaaaatagtatccaaaaatatgaaacagggagaaagatgggcaagacccataatgaaaactataaaacattgataagagaaattaagtaagatctaattaaaaggagtgatatgccatatttatgtattagaaaactcaatattgttataatgtcagttttgcccaaattgatctagtgattcagtgaaattccttttaaaatycctgtagatctttttgcagaaattgacaagctgattctaaaattcatatggaaatgcaagagaactagaatatccaaaacaactctaaagaacaaagttagagaatttgtagtagattccaaggcttattataaagcagtagtaaccaagacaatgtggaattggcatccagatagacaaacagattaatggaacagtatagtgatttgcgacctagaaactgaccaaaaatatatggtcaatttatttttgataaaggtgtaaaggtaattcagtggagaaatcagtctttcaacaaatggtactggaacaatggcatattcatgtgcaaaactttgatccatatgtcataatgtatgaaaagttaattgaaaatggatcatagacctaaatataaaattaaatgtaaatatgacttctaggagaaaacctttctgatttaagattaggtgaagattttttagatacaaagccaaaagcatgatccataaaagaaaaattgataaattggacatcttcaagattaaaaatttctgatcctctaaaaacaagccacagactggcagaaaatatttgccaattacataagtgataaaggacttgtatccagaatatatataattttaacctctcaaaactcaataatacaaagtttcagttaggagggtaagttctggatatctattgtacagcatgatgactatagctgacaataatgttgatatagtttggatattttttgctctaaatctcatgttgaaatttgatccctaatgttttatttatttatttatttttgagatggagtctctctctgtcaccaaggctggagagcagtggtgcgatctccaccaactgcaatctccacctcctgggttcaagcaattctggtgcctcagcctcctgagtagctgggattacaggaatgcgccatggcgcccagctaatttttgtatttttagtagagacggggtttcaccattttggccaggctggtctcgaactcctgacctcaggtgatccacccaccttggcctcccaaagtgctgggattacaggcatgagccaccgtgcccggccagatccccagtgttttagatggagcctagtgggaggtgtttgggtcctgggggtggatacctcgtgagtggcttgatgtcatcctgtgggaatgagtgagttctcattttactagttcctacaagacatgattgtgaaaaagagcctggcatccccctcctctctcttccttcctttctcactatgtgatggctgctccctttccccttctgtcatgagtggaagtgatatggtttggctgtgtctccacccaaatctcaacttgaattgtatctcccagaattcccacatgttgtgggagggacctagggtgaggtaattgaatcgtgggggctggtctttcccgtgctatccttgtgctagtgaataagtctcacaagatctgatgggtttatcaggtgtttttgcttttgcttcttcctcatttttctcttgctgccaccatgtaagaagtgcctttcacctcccaccatgattttgaagcctcccagccatgtggaactgtaagcccaattaaacccctttttcttcccagtctcaggtatgtttttatcagcagcatgaaaacagactaatacagtaaattggtaccagtagagtggggtgctgctgaaaagatacctgaaaatgtggaagtgtctttggaactgggtaacaggcagaagttggaacagtttggagggctcagaagaagtcaggaaaatgtgggaaagcttggaacctcctaaagacttgttgaatggctttgacaaaaatcctgatagtgatacgaacaataaggtccaagccgaggtggtctatctgatggagatgaggaacttgttgggaactggagcaaaggtgatgactcttgttatgttttagcaaaaagactggaggcattttgcccttgtcctagagatttgtggaactttgaacttgagaaagatgatttagggtatctggctgaagaaatttctaagcagcaacacattcaagagatgacttgagtacttgtaaaggcattcagttttgtaagggaagcagagcataaaagttgggaaaatttgcagcaggattatgcaatagaaaagaaaaacccaggccgggcatggtggctcacgcctgtaaccccagcactttgggaggccaaggcggggggatcacgaggtcgggagttcaagaccagcctagcaaacacagtaaaaccctgtctctactaaaaatacaaaaattatctgggcatgatggcrtgcacctttagtcccagctacttgggaggctgaggcaggagaatcgcttgaacctgggaggcggaggttgtggtgagccaaagtggtgccactgtactccagcctgggtgacagagtgagactgcatctcaaaaaaaaaaaaraaagaaaagaaaaacccattttctggggagaaattctagctgctgcagaaatttgcataagttgcaaggagcctaatgttaatccccaagaccatggggaaaatgtctccaggccatgttggagaccttcacagcagcccatcccatcacaggcccagaggcccaggagaaaaaagtggtttcatgggctgagcccaggatccccatgctgtatgcagccaaggacttggtgccctgtgtcccagcagctccatccatggctgaaagggaccaatgtacagctcaggctgtggcttcagagggtggaagctacaagccttggcagcttccacgtggtgttcagcatgcgggtgcacagaagtcaagaattgagatttgggaacctctgcctagatttcagaagatatatggaaaagcctggttgccctgagaaaagtttgctgcaggggcagggtcctcatggagaacctctgctagggcagtgtggaagggaaatgtggggtcggagcccccacacagagtccctgctgaagcactgcctactggagctgtgagaagagggccactgccctccagaccctagaatggtagatccattgacagcttgcaccatgtacctggaaaagctgcagacacaatgccagcccatgaaagcagccaggagggaggctgtaccctgcaaagccacaggggcggagcttcccaagaccataggaatccacctcttgcatcagcatgccctggatgtgagacctggagtcaaaagagatcattttggagctttaaaatttgactgccttgctggatttcagacttgcataggccctgtaacccctttgttttggccaatttctcccatttggaacagctgtatttacccaatgcctgtacccccattgtatctaggaagtaactagcttgcttttgattttacaggctcataggtggaagggacttgccttgcctcagatgagactttggactgtggacatttgggttaaggctgaaatgagttaagactacgggggactgttgggaaggcatgattgattttggaatgtcaggacatgagatttggaggggccggggcagaatgatatggtttgactgtgtcaccacccaaatctcaacttgaattgtatctcgcagaattcccacgtgttgtgggaaggacccagggggaggtaattgaatcatgggtgccagactttcccatgctattctcatgatagtgaataagtctcacgagatttgatgggaataagtctcacgagatctgatgggtttatcagggggttctgcttttgcttcttcctcatttttctcttgctgccaccatgtgagaagtgcctttcgcctcctgccatgattctgaaacctccccagccatgtggagctgtaaatccaattaaacctctttttcttcccagtcttgggtatatttttatcagcagtgtgaaaacggactaatatatgaagcttcctgagttcctcaccagaagcagatgctagcatcatgcttctcacacacactatgtaactgtgagccaaataaaactctcttttcttttgttttctttttctttctttcttttctctttctttctctctctctttctttttctctttttctttctttctttcttttctttcttctttcccttccttccttcctctctctctctctctttcttttccttccttccttccttcctttctgtctgtctcttccctcccttcctccctcccttccttctttccttccttccttccctctcgctctgtcacccagagacagggtctcactctgtcatccaagctgaagtgcagtggcatgatcacagctcactgcagccttgacctccctgggttgaggtgatcttcctgcctcagtttcctgagtagctgggactacagatacatgctaccacacctggctaattttgtattttttgtagagacagagtttcactgtgttgcccaggctggtctcgaattcctgggctcaagcaatcctcccaccttggcctcccaaagtgctgagattacagtcctcactcatgctacaaacactgccttctctctgccttctggagtagaacaccttttctcctcctgcctttggacatcagactccaggttctttggctcttggactctgacacttgcaccagcagccttctgggggctctcaggcctttggcctcagactggggttgcattgttggcttccttggttttgaggcttttggtcttggactgggacacgttactggcttttctttctcattttctggcttgcagacagcttgtcctggaacttcgcctttgtaatcacatgagccaattctctctaaaaaattccctttcatatacaaatatatgaaatatatgtatatatatcctattggttttgtccctctggagaaggctactacaaatgtattgtgtaaaatgaaataaaataaatgtcagcatttgattatgttttgtaatatattttctctttttggggccattgtaggtacttaatatttgttaattgcatggatggatgaataaataaatgtcaaaatgctcatattttaaaaatgcattgtatatgagaaaattgctatgaarggccaygtgcagtggctcacgcctataatcccagcactttgggaggccgaggcggacagatcacttgargtcaggagttccagaccagcctggccaacatgggggaccctcacttctactaaaaatacaaaaaattagccgggtgtggtggtgcatgcctgtaatcacagctacttgggaggctgaggcaggaggatcactggaacctgggaggtggagtttgcagtgagccgagatggtgccactgtactccagcttgggtgacagagtcagactctgtctcaaaaaaaaaaaattgctaagagagtaggttttagatgtctcaacatgaaaaaataaatacatgaagtgatgcatccatttttttttttttagacagagcctcactctgttgcccaggctagagtgcaatggcgtgatccctgctcactgcaacctctacctcccaggttgaagtgattcttctgcctcagcctcctgagtagctgggactacaggcatgcgccacttcacccggctaatttttgtatttttagtagagacagggtttcaccatgttggccaggctggtcttgaactcccgacctcaagtgatctgcccacctcggcctcccaaagtgctgggattacagatgtgagccaccatgcccggccttgtgatgcatctattttttattgatacataatattttacatatttatggggtacatacgatattttgtgacctccacagaatgtgtaatgaccaactcagagtatttgaggtaatcatcactttgaatatttatcatttctatgtgttgggaacatttcaagtccaagaaatatatgaaatatatgaaaaaatgttcaacatcactaatcatcagggaaatgcaaatcaaaaccacaatgatgtatatgttaattagcttgatttaatcattccacaatgtatgcatatattaaaacatcacattatactccgtgagtatatatttttgtcaattatacaatactcaatactttttaaaatgagcaatctcattaaaacaggttagatgtgggcaaaagatgtgaacagatacaccaccagagaagttatggaatgtgatagcatcatctaaatggatgttcagtgttcattagtcaggaggaaaatgcaaattaaaaccacaatgaggggtgagcgcagtggctcacacctgtaatcccagcacttgaggagcccaaggtgggcagacaacttgagcctaggagtttgagaccagcctggacaaaaaatacaaaaattacaaaaatacagaaattagccaggtatggtggtgcgcaccagttgtcccagctactcaggaagctaaggtggggggatggcttgagcccaggaggtcaaggccgcagtgagctgtgatcacgccactatactccaacctgagtgacagggtgagaccctgtctcaaaaaataaaaaataaaaataaataagaacacaatgagatacaacacacttattagaaaggccaaaattttaaagtctcatcataccaaatgttagcgaggatgtgacacaactggaattccatacgctgcgagtgggaacataaaagctctaacctctttggaagacaattgggcactttcttaaaaagttacaaatacactgaccatataacctaggcattcaattccttagtatttacccaagagaaatgaaagtrtatatccatattaagacttttatataaatagcagctttattagtaacagcaaaagtggaaacagcccaaatgtgtgtccacaggtgratagattaaaacaaattgtgttatatatctatacaacagattactacttggtaattaaaaggaatgaactactgatatctactacagtatggacaaatatcaaaaaaatgcacaatgaaagaggccagaccacccaccctataaaaaaacagttcatactgtgtgattccatttgtatgaaattttagaaaattcaaaccagtctataattacagaaaatagatcagaggtggcttgggtgtgggggaatggggttggtagcagggcgtgatatcaaagcttcataaggaaacttttgcgagtgataggtaactttactatcttttaaaaaaaattgttttcttttttttcttttctttttttttttttttttagaggcagtatctggctcttttgcccaggctggagtgcagaggcgtgatcatagctcattgcagcttcaaactcctggcctcaagctatcctcccacttcagcctcccaagtagctgagacttcaggctcgtgccaccacacttggctaatgttttaaaaacaaatttttgtagagatggggtttcactctatctctcagcctggtctctaactcctggtctcaagtgatcctcccaccttggcctcccaaagcgctgggattacaggtgtgagcatcatgcccagccttaaattcaccattttgattgtggtgatggttttgcagatatgtatgattttactaaattgtatacttttaatgtgcacgatttattataagttaattatacttataaaatattttttaaattactatttttttaaagactagagagaaaacattacagagtggagcaggaaaagttcttactttctgagactgtctcagattatgagattacaaagatggctggacacatatattacctcctgtcgctatctacagaccactcaagtgacagtaaaaaatgcttttttttttttttttccagagatgaggtctcactgtgtcacccaggggctggagtgcaatggtgcaatcacatctcactgcagcctcaacatcccatgcctgagcgatcctttcccacctcagccttctgagtagctgggctgggactataggcgcacaccactatgcccagttaatttaaaaaaaatttttagagatatgcttttactgggttgcccaggctggtctcaaactcctggcctcaagcaatccacccacctcagcctcccaaagtgctgggattacagacatgagccaccaggctcggccaaaaaatgcttttaaagagataagcatatttgttgttgttgttttttttttttagagacggagtctcgctctgtcgcccaggctggagtgcagtggcacgatcttggctcactgcaagctccgcctcccgggtttacgctattctcctgcctcagcctcccgagtagctgggactgcaggcgcctgccaccacgcccggctaatttttgtatttttttaggtagagacggggtttcaccacgttagccaggatggtctcgagctcctgacctcgtgatccacccgcctcggcctcccaaagtgctgggattacaggtgtgagccaccacgcccggccgcatatttgttaagagaatagatcttggccaggcacagtggttcatgcctgtaatcccagcactttgggaggccaaggcagctgaatcacttgaggccaggagtttgagactagcctggccagcaaggtgaatgctgtctctactaaaaacacgaaaattagctgggcatgatggcgcacacccgtgatcccagctacttgggaggctgaggcaggagaatcactcaaaccccggagacagaggttgcagtgagcagtgatcgtgccactgcactccagcctcggcaacagatcaagactctgtctcaatttaaaaaaaagagagagagagagcgagagagagtagatcttaaatgttctcatcaccaaaaaagaaaaagaaaaagataagtatacaagctgatggataggttagttagcttgtttggggtattcgtttcacaatgtgtgtatgtatatgtgtatatacttatatgtacatatatacttaaatacataaagagaagcccatatatatgtatatatacttaatatatacatatacatacacacattatatataaatacacatatatttatatatatatgaaaattacatgatgtacactgtgaatatatgatgtacactgcaatttttatttgccaattatacctaatacccccaaagaaacaaagatataaacatagaaagacaaagaggatggagaaggagaaagtaaaactttgagagctttaaagcagataaagctgggtgtagtggctcacacctatcatccaacaacttgggaggccaaggcagggggatcacttgagtccaggagtttgaagtcactgtgtgcaacatagcgagatcctgtctcttaaaaaaaaaattaaaaagaagaagcagatgatgaaagctgaattatagttgggggttgagaaagctgagaagcagcctgcttttcattgcaggaccccacaatagtataacttgccaagaccagctcgcaggacacaggcagcaagcaagagagagaatcttctctggggagtcggaccagccggtgagaaaagacctaaatatacacctacagagattgagccacaagccacatcayagagcttaggatagacgctcagcacttcattcttatatgtgaagagactgtcaaagattgtcagtcatttggggaaaatatctaaatcatgggcaaacagaaagtaaagaggagagaaggaatcaaagaaataattcaagaaaatgccaaacagagggatatgaatttctagattgaaaaggcccactgagtacccagcacaatggatgaaaatagactctcaggaaggcacataattttgaaaattttagtgctgtggtttcaaagaaaagattctataagcacccatagagaaaaaaagaatataccaggccgggcacagtggcttacacctgtaatcccagcactttgggaggcagaggcgggtggatcacctgaggtcaggagtccaagaccagcctggctaacgtggcgataccccgtctctactaaaaatacaaaaaaaaaaagaaagaaaattagccaggcacggtgacgggcacctgtaatcccagccactcgggaggctgagacaggagaatcacttgagcctgggaggcggagcttgcagtgagccaagaacgcgccactgcactccagcctgggcgacagagygagactccatctcaaaaaaaaaaaaaaaaaaaaaaggtagaaatctatatacaacaaaaagtgcacacacacacacacacaaatcatgtatacaaataatcatttcctcagtcaaactagcctcatttcaaaagcttaagagccacatgtagctagtcactaccatattagacagcacaggcatagaacatgtccatcactgcagactgttttattggacagccctgctctaagtatctctgctcctgatttaaactagactaaacttgcataaaatcraatttcctacatactttcatagtggccaatttcctctgattacactttgttttgytgtttggttgcaagataaatgcatgttttctttttaaggtgtgcatgtatcaacattatcatttttattttgttttacagttsttttttctgcaatgatatttgggactattacaaatcaagatctgcctgtgatcaagtgtgttttaatcaatcataagaacaatgattcatcagtggggaagtcatcatcatatcccatggtaaagtaacattaaaattatacctttagctgtttttctctagagaacgtaatttgtaagttattgaagcctaccatggctaaatgggcttctctttatgtatttaagtatattmtgtcctcacatctggtaccaacagagcatctatactcctagctccctggcactccattccttcaagaaccgtattcttcatatgaggatttaggaaggacactgattgataactagcatgaagtaatgagtagagtcgtcccttggtatacagcggggatggttccaagactctcactaataccaaaatccatggatactcaagtacctgatataaaatggcttggtatttgcatgtaacctatgcagattctgtatatttttgagacagtctcattctgttgaccaggctggagtatagtggcatgatcatagctcactgcagcctcgccctcccgggctcaagcaatcctcccacttcaacctcccaactagctgggactaaaggcacatgccaccacacctggctaattttttttattttttgcaaagatggggtcccactctgttgcccaggctgatcttgaactcctgggctcaactgatcctaccacctaagcctcccaaagtgctgggattacagtcctcagccaccatgcttgaccctcctgtatacttttaaaattatctctagattacttataatacctaatacgatgcaaatgctttataatacctaaacaactatgtgamtagttattataccctattgtttagggaataatgatgacaagggaaaaaagtcggtacatgttcagtacagatgcaaccccatttttttcggaatattttcaatctgtggttggttgtatccatggatgcggaacccatggttacagagggccgactgtatttccttttctccttaaagagaatcctggcttttcttccaagcctgaatccctcacttccagctgcccccagtatataggtagattttccatttgcacatcaaaatccacctaygtcatttattttatttcatttctatttccccaagcctgctcttattcttgtatttattgatttctgtttatacccctgtttagttcccaggcttgaaagctcagcatcattttggactactttctttctattactttcacatttggtcagttaccaagtgttgtcgatcccytttaggagttctcatataatcatctcatattctctagtctcactgccacttccctaagtcaagccctcgttaactccctcataatcacagtgatatcctaagtggcctcttcctgctacaattcatctcagaggtagctgctgggctagcctccctgaagcaggcacatccttcattgcctggctctgaaccctccatgatttcccattacttagactgataccaagattgctcagtaatctggctctggctccttcaagttccgactttgtttttcatgactcctctcttttacgctgttcgtcttgtttttcattaccccctctcttgtgctattcctacccctctattttaaaaacatatatttagtaaatttactcaagggaagcttaagtgatggagaactgaaaatagtagaaatcagccaggtacagtagctcacacctgtaatcccagcactttgggaggccaaggtgggtggatcgcttgagctsaggagtttgagaccagcctgaggaacatggtgaaaccccgtgtctatcaaaaatacaacaacaacaaaaaaattaaccagccatggtggtgtgcgcctgtggtcccagctacttgtgaggctgaggccggaggatcatctgarccagggaggtggaggttgcagtgagccaagattgtgccactgccctccagcctgccttggcctcccaaagtgttgggattacaggcatgagccactgctactggctgatatatatctcatatatatatatgatatatatcatagattttttttttgtagagacgggttttgccatgttagccagatgggtctcgaactcctgacctcaggttatccgcccaccttggcctcccaaagtgctgggattacaggcatgagccactcactgcacctggctgggaatcgcgtttcaacatgagctttggaggggacacacatccaaaccatatcaccaactattccatattcttcaaatttgcttttaagagatgactatactaaggcaccaagtattcacagcagctgagtgagatgtactgttttttttttcctgtcagtgattagagagcataggcaggcaatccaccataactctaaaattatctctccttaccaaataggttcatttatacctcccttcctccagaaagtcaaagctgcatttaatgtcacattcctcctgaacagatcttgtgccattgcggcacagtctaaacaaaacaaaacaaaacaaaacaaaacataataaaaacaaaaataataaaaacaaaaagtctccactatggtttaatgactggttttctctttgtgaagaactgaagttactggagttgaccaaatgtgtttgacaatcatgacctcatatttcaggcaggtggcctgcacaagccagctcattttctttatttgccatgtcccaccctgtacttctagagaatgagttgttgatttgtttgtttgttggttggttttctgtaacaaggatttgggaaagaatggtggactttgtgtgatggatcattttacgtgctttctctggacttttcacagcttgtgcagctgttttacttacgtaagcagacaacaactgtgttagtgatttcatgtcctcattagttagctatacttgttataagaagatcaacagactgaatttcagtgttattacaaaagttgtatttttttttaacattgtgattttgagatatcacagtctcttaaattccagtgccttcatggctctgtgggactcagctctgccaggtggtgaagaacgtggcctggccttcaagaacatcccttggctcctggtcagcctggctcaagctattcccggactgccagcggtggagcccactscctctgtactgtgcatttatcatgctattctctctyctctgaagcccgcagatttgtctatccagattgtggattgtacccagctttaatttttaaaaactttttacaggggctgggcacrgtggctcacgcctgtaatcccagcattttgggaggcccaggcaggtggatcacctgaggttgggagttcgagaccagcctggccaacatggagaaattccgtctctgctaaaaatacaaaataaaccaggcgtggtggcgcatgcctgtaatcccagctactcaagaggctgaggcaggagaatcgcttgaaccccagaggyggaggttgcggtgagctgaaatcatgcattgcactcmagcctggcaacaagaacgagattatggatttctggcaagaatttcccaggagcgtgcccttcccagagcatcatattcagagtgacaggaagtcatttggtgtcattatgaagatgtgaaccttgatcattagagttagacagtgcatgccaggtatccccactgcaaagttactattttcttcacttataattaataagtgtcttggaggggatgcaaatatcctgttccttctttaattttcacctactgattttagcacccattggtggatcttgcctacgattattatggtggtgtttgcctaatggtgcttttctttttcctacattccctctatgttaattggaatgctttgtaaggaagcactgyccctttcccctcattttatttatgtatttattcaattttttatttatatcagtagaggcccatgaatatttattttatcctctggattgtaacccaatacaatcattatttattttgttgctcaaattcttccagctttggccattgggagctacttcagttttgctcctgtgtcctttcaacatctcctcatctttttccaagcccttccttaatttttgacacactaccagatagttcaggttcatcttgtatttttcttttcttgccttamccctggaattcagcacttctccaaagagcactggcttctctggggggtagtatttaggaaccaagatctgagagttgggtgtgcccattgctgctgggatatcattgcttctaggccctctcggcaggcagagcctggaaatacaatatatagataatctaattttagaattactaacccataccctggtgagaaatagatttactaactaaaggacagtatttgtgtacagtgctttttgtctttagccttaagggatccaaagtattattttctgaagttacttaggttagttcctttctttcccatcccttcactatggtkttattatttatttgtgatacaattgaattaatttggttcgtattccgtcttgatatttcttccagccccctcatttcacatattctagttggtttatttatttattttatttattatatattcttttactagagacagggttacaccatgttgccaaggctggtctcgaactcctggactcaagcaatctgcctgcctcggcctcccaaagtgctgggattacaggygtgagccaccacacctggattattattattattattattattattattattactttgagacaagatctcgctccgttgtccaggctggagtgcagtgacacaaacatagctcacttcagcctcaacctcctaggctcaagcaatcctcctgcctcagcctcccaaagtgctgggattacaggcgtgagccaccacacctggattattattattattattattattattattattattactttgagacaagatctcgctccgttgtccaggctggagtgcagtgacacaaacatagctcacttcagcctcaacctcctaggctcaagcaatcctcctgcctcagcctcccgggtagcaaggaccacaggcatgcaccaccatgcctggctaattttttaattttttgtagagatggggtctcactttgttgcccaggctgatcttgaactcctgggctcaagtgatcctcttgccttggcctcacaaagtcctgggattacaggcatgagccactgtgcctgaccctcctgattggtttaattacttgttttttgagacatgacatgactcttgtcctaaaagtcaaaacaatgtgaaacagtatactcagagaagtatcactgtctcctcactcctactgacaagtttccaccctctttctacatatccctgtaattaaccaatccctttagatgttttgctattattccagtatttattgtgcacaagtgaccagatacatatatatttccttatattctcctctttcttacatagcatagcatacttgaaggtagatactttttgcacctagctttcttcacttaacagtacatccaggaaatcattgcaaatcagttcttagaggttgtcttcattcttttttatagctacatagtaccccctggtgtggatgtaccataatttgttcaaccactcatctatgtacgagcatttaggttgttttcagtattttgcaattatgaattgtgctgcaattaattgctagaggtgtgcttattcccagaagtgagattgctggctcaaatggtgagtgaatcgcaagttttattaggtattgccaaattcttctccagaagggttgtgcagggtgtgttcccccagcaatgcaggagaaaactgtttccccatggcctcaccgacaaaatgtgttgtcatattttttaattttttgccagtctgatagaggagaagtgatatattagtcttgttttaacttatggatttctaattataagtaggtttaatattttctcatatgcttgagggccattcttttttttctttttttgagatggagtctcactctgtcgcccaggctggagtacagtagtgccatcttggcttactgcagcctccgcctcccaggttcaagcagttctctgcctcagcctcccaagtagctgggattacaggtgcctgccaccacacttggctaatttttatatttttagtacagacagggtctcaccatcttggccaggctggtctcgaactcctgaccttgtgatccgcccaccttggcctcccaaagtgctgggatttcaggagtgagccaycgcccctggctgagggccattctttatatcttttttcttgaattgtgtattcaattctttttcccagttktctactgtgttttggttctgtgtccctcaattttcaaaggttctttttatattaggggtattcgccctttacttgtaatatatgttggcatattttcttctagtatgtcagctgggtttttttgttttgggacggggtcttgctatgttctccaggctggacttgaactcctgggctcaagtgatccttccacctcagcctcctgagtagctggaactacaggcatgtaccaccatgcttgacttgtctattattttttactttatcttgtgcccatcttttatgatccagctcaattactggacttgggtgaaaaacttaaacatccggcttagaaatctcttctccctcctttgaagttccagggcacttacaatttacatttcaaagtatttggtatctttttatgggacacttgtatttctcctgtgttttacttatttattcctaggagactcaaactctttaagggcaagattagtcttttttttttttctagtctcatagtactcagcagatggtcttgcacttaccatatacttactaagtgaacaaataagaccagaaatatggtttttgactggtagcagaagagctaccctgctcttcacctgaagaaatatgtgtgtgctcatgtgtgtgcatgtgtgcatgctgtgttcagccatgtaaaggagataggaggtgggggactccacagcagaagctgctccaacccctgctctcaatatatcttaattaattaattaattaattttttgagacagagtctgactccgtccctcaggctggagtgcattggcgggatctaggctcattgcaacctccatctcccaggttcaagtgattctcctgcctcagcctcctgagtagctgggattacaggcgcctaccaccacacccagctaattttttgtattttcagtagagatggggtttcaccatgttggccaggctggtctcgaactcctgacctcaagtgatctgcccacttcagcctcccaaagtgctggaattacaggcgtgagccatggcgcctggcctcatatatctcaattatttaaagcaggcaagaagtgtggtggcagtgtggctatggggacatctgcccagaaaatttggtttttaaatttcctctaacacagataccaatttaccattgctttataaatttttatctatataccaacaatcacaaaaatatttacctatatattatagattttataattacggtctgattagtttgctaggggtgatacaacaaactaccacagactgggcaactgaaaccaacagaaatttattatctcacaattctggaagctagaagtccaaaattaagatgtcagcagggttggttccttctaagggcagtgagcaagaatctgctccaggcctctctccttggttggaagatggctgtctttctgttcacatggtgttcttactgtctgtgtatctgccttcaaatctcctctttttttttttttttttttttgagacagagtttcactctgttgcccagtctggagtgcagtggcrcgatctcagctcgctgcaaccgctgcctcccatgttcaagccattctcctgcctcagcctcccgwggagctgggattacaggtgccaaccaccacttccagcttattttttgtatttttagtagacatagggtttcaccatgttggccaggctggtcttgaattcctgacttcaagtgatctgcctgcctccgcgtcccaaagtgctaggattgcaggtgtgagccaccgtgccctgcctcctcttcttataaggacacgagtcatactggatttaggcccaccctaatgacccattttaacttgattaccactgtaaagaccatctccaaataaagttgcatttgagggttaggacttcaacatatgaacttgcagaggtagggggacatacgccatgacagtccgtacaacattttagaaatgcagcccaatgttatttatcttttctttagagaattataattaataggaccttcagtcrgcaacgtgttctcagtgggttccagcttgtgtgggtgttgcrtgcagtgtgtcagcatgcatatgtttgataaagttttgatgtgaagaaggggaggccttagacctgcagttttcatgaattcactttgttctatctgcaacgtaggtatcagaatccccggaagacctcgggtgtgcgttgagaccccagagctcagggacagtgtacgaagctgccgctgtggaagtggatgtatctgcttccatcacactgcaagtgctggtcgaygccccagggaacatttcctgtctctgggtctttaagcacagctccctgaattgccagccacattttgatttacaaaacaggtaagtggaggaataccttcttgacataaaatgtggttcatttggaattttgtttcaagtttctgttcatgtttattgtaaaccttttttttttgtgagtcagggtctctctctgtcacccaggctggagtagagtggcacaatcttgtctcactgtagcctcgaccttccaagctcaagtaatccccccaccccagtcctcccaagtagctgggactacaggcgcgtgccaccacacccagctaattttttaaattttttctaggcaccatggtttttcaccatgttgccaaggctggtcttgagctcctgggtttaagcgatccacccacctcagccttcaaaagtaccgggattacaggtgtgagtcactgcgcctggcctcggcctgttttttgtaactcttatcttcagtgaaataatgaactaaaaatacagttagggcatcaatacatgacattatatatctgtcaaatctcataggatgtataacacaaaaaatgaaccctaatgcgaactatctcgctctgtcatccaggctggagtgcagtggcctggtcttggctcactgaaacttctgtttcccaggttaaagtaattctcctgtcttagcctcctgaatagcggggatcacaggcgcacaccaccacacccagctaatttttgtatttttagtagagatggggtttcaccatgttggccaggctggcttcgaactcctgacctcagatgatcctcccacctcggcctcccaaagtactggaattacaggcatgagccaccgtgcccggcccaaactatgaactttaaaattggttcatcaattgtaacaaacatatcacacctatacaagatgttaataataagggaaactgtgtgtggagggaagggcatatatggcatctttctgtgtcttctgctcaattttcctgtaagtctaaaactctctaaaaagtaaagttggttgggtgcagtggctcatgcctgtaatcccagcactttgggaggccgaggtgggaggatcacctgaggtcaggagttcgagaccagcctggacaacatggtgaaaccccatctctactaaaaataaaaaaattagcctggcatagtggtgcgggcctgtaatcacagctacttgggaggctgaggcaggagaatagcttgaagcccagagggggatgtttggtgagccgatgtcacgccactgcactccaacctgagaggcaagagtgagactccgtctcaaaaaaaagaaaaaaagaaacaagtctattaagttaaacctatacacacagacacatatataagtatatagaaagcagtgagtggctggcaaaatgtaaaacaaatagtgaaaagaatatctaggattttttttcctttttcttttttttttttttaaatatttttaccttatttacaattaagaatttttttttttttttgaggcagagttttgctctgtctcccaggatggagtgcagtggcacgatctcacctcactgcaacctctgcctcccagctgcaagcaattctcgtgcctcagcctcctgagtagctgggattacaagcacccaccaccattcctggctaatgttttttgttttcatttttttttttttttttgtatttttagtagagacagggtttcatcatgttggccagtctgatctcaaactcctgacctcaggtgatccactcacctcagcctcccaaagtgctgggattacaggcgtgagccaccgcactgggtctatttgggattttttaagtgtcttgttttttagttggatatcatgttaaagataaaatttagaaagttttcatttcattcttgttagtgtagcaagaaatttcttttttaaatttatttatttatttatttatttatttatttatttatttattgaggcagagtcttgctctattgccaggctggagtgcagtggcatgatcttggctcactgcaacctcctcctcctgggttcaagcaattctcctgcctcagcctcccgagtagctgggattacaggcacctgccaccacgcccagctaatgtttgtatttttaatagcggtggggtttcaccatgttggacaagatggtctccgtcttttgacctcttgatctgcccatctcggcctcccaaagtgctgggattacaggcatgagccacagcatccagccaagaaattctttaaaaaaaattttttttaaaggaaatttattcttgggaaatgcttgggaaaagaacatttgatcttatctattttgtttcacaatatgataagcagaattgcaatgttatgtgctatctacagattatttagtaagacattgatctgtctgtgaggaacatcgatctcatccagaaaaatgtcttagccaagatgtgtgggtaatgtcctaaccctgtatagctctatgctgattgctgccccctgctgtccttgtcctcttgccgaaatgagatggggcaaaggacataggtcaattaaatgccctcttaacgcagcctttcttttacattcttgtggctgtcctgttgtcccttaggtgtagagaaggcatgcgctttccaggaactatgtagtaaacagtacccaaatggcctgcaaggggtatcgggccccttgatagggtcttggagaacgtctctgtgatcaacttgtaccagttatttgtatttgtttttaaggtcaaatacattcttctcttaagtgatttgcaggacagtgagtatagttctgaagttgagttctaaatcttggaacgcattcattttcctttcctcttttgcgattgtattactcacttcttgttttttggctgcaaatgtgctgggattacaggcgtgagccacagtgccagccacattttttctttttattgggaaggcatctcaatatgttgcccaggttagtcttgaactcatggcctcaagtgatcctcctccctcgcctcccaaacttctgcgactgcagacgtggtggctcatgccaggcgaatggttcagagaaaaaaagcatatcatcaaaatagatctgcagaagcaaatcaagtatatatcctgctaattgactgtgtttaagaatgcaggcccatgttctattgaacctgcttgctgctttaaagcagggcttctcgaatataacctgtatttggattgcctggggatcttgtttaaaatgcagattctgatgagtaggtctcagtgggacctgagattctacatctttgtcaactcccagctgatgctaacactgttagagaaagactacactttgcacagttaagggtctaaaggtcagaaagtgtgaacttattttattattttattttattttattttttgagatggagtttcaatcttgttgcccaggctggagtgcaatggcatgatcttggctcaccgcaacctccgcctcccgggttcaagcaattctcctgcctcagcctcctgagtagctgggattacaggcatgcgccaccccacccagctaattttgtatttttagtagacagggtttctccatgttggtcaggctggtcttgaattcccgacctcaggtgatccacccacttcagcctcccaaagtgctgggattacaggcatgagccactgtacctggccgtttttttttttggttttttttttttttaatttttaaaaaatagaggtagggtctcactatgtggcccaggctggtcttgacctcctgggctcaagtgatctgccagccttggcctcccaaagttctgggattacatgtgtgagccactgcacccagcttactgtgcttttgttgttgttttttcagtttttttttgagacggagtttcactcttgtcacccaggctggagtgcagtggtgcgacctgagcttgctgcagcctttacctcctgggttcaagcaattctcctgcctcagtgtcctgagtagctgggattacaggcgcctgcgccattctcagctaatttttgtatttttaatagagacagggtttcaccatgttggccaggctggtctcgaactcctgacctcaggtgatctgcctgcctcggcttcccaaagttctgagattacaggtatgagccaccgcacccggcctcctgtgtgtttttagatgggagttttcgatcctagaagctcagagaaggtgagatgatggcaccggaatggagctctcccaccctcaaggggaggactggttaaaagtcagggttcaacgagcaacgcccaggctgagtgctgggcacatgacagaagctgtgttctccacagagcggcttccgtgccagtcggggaacgctggagtaccaaactgcctttttagtcactatgaaattttgtttttagtttcacacattttccaaaataactagttctctttcctgttttgcagaggagttgtttccatggtcattttgaaaatgacagaaacccaagctggagaatacctactttttattcagagtgaagctaccaattacacaatattgtttacagtgagtataagaagtaagtccagcctgctactagtattccagcctggaataccrcaatatttcaaaggagtggtttagaacccgttagcttgaycagctcctctagacatattcaggtttcccytgatacgtagttggattgattagattcctgtcaaccctctgtagaacctatagagaactgagaatcactgatgaatcactgatgtgtgccgtgggctctcagaatgtgactgctgctaaaaacgcctgggacgtcctctgttcagtagcagatggctgacagggaagaaatggaaaacattttgaccttggaatcagaagacctctgttctaattctggttctgatactaccacctatggcaggtcacaatttctctgagccccgatttccttattggtaaaatgaggataaaaatacgtacctcacaggattggaaggtctcagcgtgatccaatagaactttctgagatgatgaaaatgatcttgtctgttctttccaatacagtagccactggccacatggggctgttgaacacttgaaaggtggctaaggtgactgaggaactaaagttttaattttatttaattttaatttgttaaaattggaatgtaaatagccccatgcagctaggggctactgtgttggacagcgcaggcccacaygcgtgctagaccatatgcaaactgtaaggaacggtccagatgttctgaccaagggaggcagctgtgcagttggcagaggcaccacctgcgtgtgctttctggcttctccttgtttcgtccccatcatgcacagactccgtgctatgcacactgaacttgctgcttcgccttccatgaccaagaaggactaaaggtgtctgcattcacttaggtcctcgtgcctttaggggccagtgcagtgctccaaaaaccctgggttaatatcacttgaaattaggtccccccgacacattgacacaacttgccaggctcccctcttccttgtcagtgactaaatgtccggcccacagaggtgccctgggtcaggagtaaccacaactgccctttgctgaagatcttctgcctgtttcatctcagatgctcacagcgatcctgcatgcatgtagatgagaaaacagcccctctgagaggtgtggtggtgggcacagctggaggctttctgcaccacactgccctgggtcttgtgtgagaatgtgtgggtcttgctgtcaaagctactaacagaagagagcacgcaagagtcccagaagcatcatcttactggggttgggggtggagtaaggttctaaagtcagcctgtaaggtatacatgagctaaagtcaaaattacccaaaatttattctggaaagtcctttaattactctgaaaatgataggaccagagccctacaagctccaaagccgagaatcaccttatgttgctctttaatgtcggtcatgttccctgccccctttctagtccctcaccgcctctgtgggacagtaaatacgtgccccaggttggatgaagctaggacgtttcttgttctctacttctcttcctctttctccttttttctctccttttaaaattttcttgccaagtataaacagttgtataaggtaagtgggcatctgctgtgtctctgttatacttagggtatattcctttcacttaagatttacaatgtaaaaatgtaacaacagttattcaggtaaattataacttatttttagcattctgcaaggtggtgggatccaaaaaataggtgggagagatgtggcaacagtcagtgtgaaaaagaggaaagggtttagtcaaccacaagctcagtattaaccaccagcgtggcatggttgccaaaaaagtaaatttgaaccttggcagtgttcatgaaaatataacgtctaaattaaggaaattaatagaagcttattcatttcagttctacttttttaaagatgaatactgacaaaatgagcaaccaggatagtggaaaacttggaattctttaaattaggagcagttgaaggaattgggaatgtgtagtatatagaaggaaatgttttgaggagacgataagattgattgcagtgtaatgcagaggaaattcttttgggatttgagtcaggaaacctgagctaactagttaaagtaccttgtatggtaattatctcccttgatctcggtttctgattttaaatatttgaaagattttcatatggaatcaaagctagactttaaaaaagttgctctagaggatatgataagaaccaattgttagaaattacagggagaaaaagtaaaaatcacctcaagatgggaaaaaatacttgcagttcacaatcaacaaaggattaatagtcataatatgtaaagtcaataagataaacaatctatataagtcaataagtcaataagaaaaacgaacaaaatgaaaacctagtagagcaatgaacaaaggacatgagtaggcatttcatttttggaacatgaaacctaaatggtcaagaaacatgttaaaagataaacttaggcacgttaaagttgtaaagagtatatttgagcagaaagcaattcatgaatcaggcagtaccagatggcaagcaggtgggctccagtgaggagattcaagggtaagacttctttctataatgtgttcccggaagcaagacaaagaaaaaatttgattgtttaaagaaggacagtccctggattggtcagtttgcagttcctcattgattaagctaagttgcattttgctgctcatattgaattgggtttgttttttgctttttgttgttgttgtttttgtagagacggggttttggcatgttacctaggctggtctcgaactcctgggctcaagcgatcctcccgcctcaccctccctaagtgctgggattacaggcgtgagccaccttgcccggcctttattcttttcctttttttttttttgagttgtgttgtgatttgtttacctaggaactcaagctgttagagttgtctcagcctaatggactcccaattaattattttaacacatgttaaattaataatggagaaattaaattaagaccacaatgaaataccattttatacttgctggattgctgaaaattaagaagtcttggtaagtctataaagcaataggtgctctcatatcctgctgtgtaacataaattagtataaccactttggaaaacaaatgatcattatgtgtaaggctgaatgtgctcataccatgtagaccagcagttccactcttaagaatgttattaaggaaactgttatacacatgcctcagtacaaatgtgtagaatgttcagagcacatggttgatcatacaaaaaactgtggccgggtgtggtggctcatacctgtaatccaagcactttgggaggccaaggcaggaagatcacttgagcctgggaggttgaggctgtagtgagctgagattgcaccactgcactccagcctgggtgacagagaccctgtctcacacacacacacggaaggaaacaacccaaatgtctactgcaagaaaatgaaaaaataatgatatatttaccaatagaatattatgtagcagtaaaaaaaaaaaatgaataaagtatagctacatgtaaaaccatggatgaattttaaaaacataaggttggatgaaaaaatgaagttgtagaagttacatattgattgataacactattttgaagctcaagaatgaaaaaatcaatatattgtttagtgccacatatttatttggtataactactttgaagagtcctcgaataatcaacaaaattcaggataaaggatacgtgcagttgagaggtggggagaagcataaaagtagatcaaaaggtatttattaatattctagttattaggtggatagtggctccgtgggtatttgttgttgttatgctttgaaatttacactccatatattctttcatatatatatatatatawcaaacagtacatagtattttcaaacaaaatttattgtaaggagagaggctggaattcagtatagggaaactttctttaaaaaaaaaaaagtttgtcagaaattagaatgacctgccctgggaggtcatgaactccagtctctagaagagtcaaagtagaagtagaaagtttatgttagaaatagctgggagtgaaggatggtgtgtgtgtgtgtgtgtgtgatccagggtgagtgggaggctcaactaaacctcttaagttctgttgcaattccaactccaccctaccatgtttcttctgtctttctaaatcttagtatatttctgcctagttgcagatcaaattataggaagaaagttgaggtctaaactatgtgttaaacaagggtttaagccatatgttattgctaatttcctttttcctgtgcctatcaatatttgtattttcacatggcttcactcgactactttagttagctgtggatttgtgaaatacccaaagaaattggccaagaggagaaatgttcaagttgacactgcagccacagctaaatttaatataatggttggtttgcttttgatgcctttattatgaaaaaagaaaaaaatatgtatacgtaatggttgagaacttttcataatgacatagaatccttttctgaggggctgctaagagaattatttttaaaatagtaaaatgttaataacttatgatgctttagataccctgctttacacattaagaagaccttactttagaaaaatggaaaaccaggacgccctggtctgcatatctgagagcgttccagagccgatcgtggaatgggtgctttgcgattcacagggggaaaggtatgacacatccatggtagctgctattctcataatttccttttggcctttttctaatgtagttgacatcaagctgtatgtaaaatttaatttatgctcatttaaacaggaaactttggcttcttaaagttaaaaaatggccagtatagggccgggtgaagtggctcacgcctgtaatcccagcatttcgggaggccaaggtggacagatcacttgaggtcaggagtttgagaccagcctggccaacatggtgaaaccccatctctactaaaaatacaaaaaattaactgggtgtggtggcaggcacctaaaataccagctactctggaggctgaggcaggagaatctcttgaacctgggaggcaaaggttgtggtgagccaagatcacgccattgcactccagcctgggcaacaagagcgaaactccgtctcaaaaaataaataaataaaattaaaaaaataaaataaataagtaatacagaatggccaatgtgggcttcacagggaggacaaggatttttttggtaaggggctttttggaacccctcaaatcaactgcagggcccttcctgggcatcatgctacacaagtaaaagtccctctacgttccaggattgttggctccctgggcatctggttggggcaaaaagaaagatactgattttaaagtagaattatcttataagtaagaaattctaggctgggcacagtggctcacgtctgtaatcccagcactttgggaggccaagaccggcggatcacgaggtcaggagatcgagatcatcctggctaacatggtgaaaccccatctctactaaaaatacaaaaaaaattagccgggcgtggtggtgggcacctgtagtcccagctactcaggaggctgaggcaggagaatggcgtgaacctgggaggcagagcttgcagtaagccgagatcgcgccactgcactccagcctgggtgacagagcgagactccatctcaaaaaaaaaaaaaaagggaaattataggctgggcacagtggctcacacctgtaatcccagcaatttgggaggccgaggcaggcagatcacctgaggttgggggttcgagaccagcctgaccaacatggtcaaaccccgtctctactaaaaatacaaaaattagccaggtgtggtggtgggcatctgtaatcccagctactcaggaggctgaggaaggagaattgcttgaacccgggaggcggagattgcagtgacccgagatcgcgccattgcactccagcctgggtgacagagtgagactccatctaaaaaaaaagaaaagaaaggaagaaagaaattccttgtgacaaaatgtttaatttctgattatcctgtttgttctgggaaagcagtctaatatgattgtttaaagatatagaatccagagccagatagcctgggtttgaaccctggtttgcttagcagctgtgtggccttggacaagttacttactctctgtgcctcatcagaagaatgcggatgacaacagatacttataggattgctattctgattaaatgaattgatatatgtaaagcacatagaacagtgcctagccaatactaagtaaggtataaatgtttacatagtttttcatatatgccaaagttaagttcttacaaagtaaaaattcatgcagtttgaactaattaaaatttactaaacaactttttttttttttaaaataggaccaaatagaaggagaaaaagtaccaaatactttgttccaaagtggtacaaaagttcgctttctgctgaggcagggagaggggttttgctctgttgaatacttgggagtcttggctgacttcccttgtgggtgacaccttggccctcctctgttcctatgggaactcgggtgacttttgaaactttagcttccccctcccttactgcgtcccaaaaggatgcttaccttgctaaacttcmtgaaagcccaatcatgctttttctcttctctctttcttctctttttttcctttatcttctttctcatttttttccctttctttccctgtctttaaacaacagcaacaaagagatcaccaaacatgaacaattttaaactgttttgttatgtaattctccttagtgttatgctaattcattgcgataatgagtaactagctagctcccctctgagctcttagctgaaaccatagatatgggcttgtttaccttttgaccttttgtttaccatttgacccttaaaactggctctagaactttrttctcctcttgagcattcatttgtaattttaaaacttgtttagccaaatggtacttmttttctaattgcagctgtaaagaagaaagtccagctgttgttaaaaaggaggaaaaagtgcttcatgaattatttgggayggacataaggtgctgtgccagaaatgaactgggcagggaatgcaccargctgttcacaataggtaacactataatatcatgcactttcattttcagtgaccggttcttagcaactatcagggactaacagtaactgcgtaggtgatcattcaacttcagaaatcctatcattccttcaggtcacagtaaatgcaatattatggattctgtaaatgctgatttcttcataaaagaggagtcagtctctaaaagcttcttttattaatgtggttagtaatatttgagatgatgctaaagtctttgttcagaatgttcaggatatcttttgtgatgaggcaaaaatcactttttttttctcacttgggatgttttcatctcctagatctaaatcaaactcctcagaccacattgccacaattatttcttaaagtaggggaacccttatggataaggtgcaaagctgttcatgtgaaccatggattcgggctcacctgggaattagaaaacaaagcactcgaggaggtaataggacaartttgtattctgaaaatgcaggaacaattaactaatagtctggattgaaaacattaaatgmaaactctgttttattaaaacctagggcaactactttgagatgagtacctattcaacaaacagaactatgatacggattctgtttgcttttgtatcatcagtggcaagaaacracaccggatactacacttgttcctcttcaaagcatcccagtcaatcagctttggttaccatcgtaggtaatgcaggctgctcacacaatctttattcctatttttagtcgctgtagtgtggaatgtgaagtatgtggtacaaattctgatttcaatataatgctactatcaaacactaagaaagaaactgagttagaatagctttgcaaagataatctgcccaccctcttccttttcccgttaaaccaggctcgcttgaatgccactgtctttgcatataacacattgtaatatgaccatctgtttgtgtacttttatcctccagtagactgtaagtttcttaaggacaagaacaactcattctatccttgtagttccagaacctgacacagagcctgacacaaaaaggacaataaatactagttctaagaaccaactaaccgcactgttagggcagtgagcactgagagacagtacaagcccttagatgcactgaaattttggtggggtatgtaggatctgaaaataaccacagttcaataatctcagattagggcacagcgttcagccataatgaaaatgccgagaaatacagcgatgctcttagcagattaataaggaagtgttccataaggcaacctcgtgaatattgctagccagattgctcttttatttgtgccttgagtttattttactctctctcatcaatggaagagtggtgctggctgagagcaggggccagacagtcaattatctacatcccattctttttctttccttctttctttttttaaacatttcttaacttcgaaagatgatgagctcaggcttagaactagggataggactcctgggttttcacttggattatccaacctgacctgcagcatgccaacacttgagttttcctgtgttaaactgatgaatacaagtttattttatcttctcaatacgtttccctatgaatattattaactaactcataaatgcctattttttcttacagaaaagggatttataaatgctaccaattcaagtgaagattatgaaattgaccaatatgaagagttttgtttttctgtcaggtttaaagcctacccacaaatcagatgtacgtggaccttctctcgaaaatcatttccttgtgagcaaaagggtcttgataacggatacaggtgagaccacaaaggactctaagataccatttttagcataattctccttgcttgttgcccttgagaaggacagttttatacttatggaagcaaattcacttatgagtttaactattattgagttgaaattggagataagaaaacaataagcagatgtgaggatacagtagcagtcttaccattactttagataatataacctgctgcatgaaaacagaaagaaccgtattagtctggtctagtttgagtctggttctctggcattttctgagtcacaaggtagtttttacttcctgtttgagagtgcggtgtgtaggacactgagtctcccctaaaacatttgcagatgattgaggaagtaaaactccttaaaaacagaaaaacattactcataggtgtattgatttaaattttcaaaaaatacatgcagaaatagcccaatagtaagtgctgaaggaaaatgttgttttcctcsggatttgtatgagaaactatgcaagattcttttttttaagaacaacaaattttcttttctttttctttttctttttttttttttttgagatgaggtctcactctgtcacctaggctatagtgcagtgrtgcaatattggctcactgcaacctccacctcccaggctcaagtgatcctcccacctcagcctcccaagtagctggtaccacaggtgcacaccaccacacctgactaattttttgtatttttggtagagacagggttttgccatgttgcgcaggctggtctcggactcttgagctcaggagattcaccctacctgggcctcccaaagtgctgggattacaggcgtgagccactgcacccagccgaaagattctcttgtgggaggaattctccattccttctttggaaaacaaaaaacaactttcccctatatcttctatagttatgacatctcttgtctctttaaactaatgctatggaacatggttttggactaggctatgagacactgagacgcacatgttatctttcaaacaagtcaatggactagaataaatcatcctttctcagcatgtggtctgttgaacaactgtgtaagaatcatctgagcaaatgtttaaaatgtggattcctggctcccattccagacatgctgactcaaaactggggcaaaacgctcagactctgcttttttaatgagaacctttggtgattcctatcacaggtctagatctgtgctgtccggtacggtagccaccagccacatgtggctattgagagcttgaagtgtgtctggtccaaattgagatgtactctaattgtaaaatacacactagattttgaagacttagtatgaaaaaaagaatgtaaaatatattattaataatttttatattggccgggctcggtgggtcacacctgtcatcccagcactttatgaagccaaggcgggtggatcgcttgatcctaggagtttgagaccagcctggataacatggcaaaatcccatctctacagaaaatacaaaaatgagttgagtgtggtggtgtacacctttagtcccagctacttgggaggctgaggttggaggattgattgagcccaggtggtcgaggctgcagtagccatgatcacgtcaccgcactccagcctggatgcagagcaagaacctgcctcaaaaagaaaaaataataataaaattaaaacaatttttacattgattatatattaaaatgatagtattttggatatatcgcattcagcgaaatatgttattaaacttaatttcacctgcttccttttactttatacagccaacagaatttgtaaatgatgtacaaggcttgaagttgtgactcacattctgtttcattggctagccctgttctagatgaagagtaggagttcttttcaccttgattccgctaagtgtttgtttcatgattattgttactctttatacctaaaagggatttgtactaaaagtcccttgttgggacttttagaatctcagtgcagggtttgcatggagttgtctactgtctcttactgaaaccccccaatgttcagagcattcatttttaaagtaattaagaatgcagactggtctgggagctgactgaaacacactcccccaaactcagggtttgtcaacagtggcgctgctggcatgttgagctggataattctttgttgtgaaggactgtcccgtgcactgtaggatacttttcagcatcccgggtctcctcccactggatgccaggagcacattcccttttcccagtgtgaccaaaaatatctccagacactgccaaattgagaaaaataacccctggcattttttttttttttttttttgagaaccattgccttagaggcatcaacccacagtcatcgtaagctgttattcagaaatatcaagctttttttttttttttgagacagagtcttattctgttgcccagactgaagtgcagtggcacgatcttggctcactgcaagctcctgggttcaagcaattctcctgcctcagcctcctaagtagctgggattataggtgcatgccaccatgcccagctaattttttgtatttttaatagagacggggtttcttcatgttggccaggctgttctcgaactcctgacctcaagtgatccaaccgcctcagcctcccaaagtgctgggattacaggcgtgagccaccgcgcctggcccatcaagcttttaaatgtagaaggttggagagtcagcccctctttaccctagttgacttgattaccacttggcctgtgttcagaaggaaatcagcatatcactgtcccctctctcctttgtatcctatccccatgttagataagctcttagcattatgggaatctcttctgaacctgattcaaagagagaaggggtcgattcaatttagttcaacaaatattactttaatatcctcttgatgggtgtgatgctgtgatgggctgcaagagtgaataaggtaatgttgctttccctctcccgcaagaatgtacacagattgctactgtgctggtgatatctggtataaccttttgagattttacagaatcgccagttggggaccatgtcactgacatatgggtcatgggccaatgtagtgggctgcttcatgtagtttcattccatggctacaatccatacccatgaccccagattgttatcctatagaggtagccaaatgaatgaattaggtgagctcctgactcctatagcgttttgtacctcactcattcctacttatctggcaacagataagtatgtatgtcacatctcaccagggagtttataaactctaagaataggtatgctgccatatttctctatctttgtacaatgccttgttcagtaagtgtgtttaataaatgaatgaattcatcatcatatctggaatgcaactcacagtgcagtctgggccaaagatgagtcgacagcatcctcttcactgcaaggaccacgcacatggttcttagcacaacacccagtactcagtgtttattgttatttgaaagttcttgaagagctacagtgtttgtgctaatgatgtgcattgttggtactgataatgtaccaggtgttatgggccactgacgacacacagcaaaggaaagatgggccctccttcttcatgagaaaacatgctcaaagtactgaacaagaaacgaacaacacaaaatttgaacacgcctctgagtgctctaaatgtctttttctctccacatgaggctctatgttgagatggggatggaggactagattatagtcaggggtaatttccacttttctttgtttttgccttttttttttttttgagacagagtctcactctgtcgcccaggctggagtgcagtggcatgatcttggctcactgcaacctccgtctcctgggttcaagtgattctcctgcctcagcctccctagtagctgagattacaagcatgtgccaccctgcccagctatttttttgtatttttagtagagacggggttttgccatgttggccaggctggtctcgaactcctgacctcaaatgatacgcccacctcggcctgccaaagtgctgggattacaggtatgaaccaccgcgcctggcccttctttttgcttttttttttgagacggagtctcgctctgtcacccaggctagagtgcagtggcgcaatcttggcttactgcaacctcctcctcctggcggaggtgattaagtgattctcctctcggtggaggtgagtaagtgattctcctgcctcagcctctcgagtagctgggattacaggcatgcaccaccacactcggctaatttttgtatttttagtagagacggggtttcaccatgttggccaggctggtctcaaactcctgacctcgtgatctgcccgccttgccctcccaaagtgctgggattacagccgtgaaccacctttcctggcttctttttgctttttagagtcagggtcttgctatattgcccaggttggattctaactcctgggctcaagtgatcctcccgcctcagcctcctgagtagctgcaacttggcgtgtgccactgcacccgtctttccttttgactttttattatagaaagtttcaaatttactaataagttgaaataatagtgcatgagcattctttacctaccacctagattcaacaatttaattgaaccgaatttggtttgtgaagtacaatattttagtcatgtatcaagattttataggcaaagtgatacaattttttaaaaatctgttactgaaaggcccctgtaataacactacccctgaaaaaactttggtgtggtcatggtatgtgcaccagaaatctctcggcttccccactttcatggcttcatttctccaatttacttcctcaaatattacgccaaagtttactagggcttgcctttatgttttattaaattataactttctagccgtcctggtgtcctggtcctgataaaggtttccaggatatttcacccattagtttgtataatttcctatctctacagacttaattacaaattccaaatctaccttagctttttccacttttatgggaaaaaaaaaaggaataggactgttgtaattacttagtaacctcttctgaaaccttctccttagccttgcctaagcctgatgttttcctttttcctgaaatatttaattttccaactctgtgaatctaagttttgcccacagtaggcactaaccgagtgcttacggggtaaacagctgtgtggtggtcgtttgggttctgggtggtgagccagggtcctgctcagaagaaccacaaactgaaaagcaggctgtcacatacaatgagtgacacacaattgcagaagattatggagcctgggagaggagttgtttttttttttttcctattttctgaaggagttgagccttgagcacagacagaaaggagggaaaatgagggaaaagtttgagtctagagaaataccagcagctcctacctaaatgccgttcccattcacttctgcagtttgagacaacattcctggctgcaggtcttcccaagaccccactcagttgtaagttattaaccacatcttaagaagccattctgtgagaataaaagatccttctttgagctcttaccatgtgcaaaatcctataggtgtattacctcatttaactctcataatcccattttatgaaatgtggaaattgaggctaaattacttgcccaatcacagaaggcaaagccaacaccctttattccttctttttttctgaaattgccttawaaaaacacataattccacctccagagataacattgcagactttttctatgtaagcaccatgatagaaacatacaatatggatctttgtataaacatgaaataaggtaccatttgtaatctgatttttcacttaaaatatatcatgagtatctttctatattaataagtatgttgttatatctaccttattgctgtaatggctgcatagtattccacttttcagaaatttttattttaactaactcctgttgatgggcatcaactttacttttttttctttctctttctttgacatttttatttttattattattattattattattattattattattatwattatttcggatggaggcttgccctctcacccatgctggagtgcaatggtgcgatctcggctcactgcatcctccacctcaagcgattctcctgcctcagcctcccgaatagctgggattacaggcgtgtgccaccgtgcccagctaattttttgtatctttagtagagayggagtttcaccatgttggccaggctgatctcgaactccttacctcaagtgatcctcctcctttggcctcccaaagtgttgggattgcaggcgtgagccatcgttcccagccaagaaaccccttttcttagttttaatgagaacgcatcttcttagacaccgaggtattgttttactgtaaactcaaatgtcctgacctccgtctcctgccggctggccatttgtagaaaacccctaggcgaaagaggaagctttgcatctcccaatcagcctaattagttagtycccttggaattcccatggggtcaggacacggttgtcattgcagttgtcattgtttccagggttaactgtcataagcatgaggaaaggcagtttaaagccattggatattcagttttgtgttcctgctatttatgtgaccaatttcatacttggagtttgttcagaagagtgaaaaatgtttcaagtgctatctcttctaaaccatggcaaaccacactctattaagacagcacarargactgaggaagaaaaatgtttacgaaacattttgctttggtctgcctcatgataagtaattgtactggtcatttctttttccactgaattgactggtgtctctgacatgctctctggtgagccacactggcttcattacctcctctcttctcctttttcagggtctttggccattgtccagagagaattacactttctctcttagaagctcacgtctttcttctcttgggccacttccacgccagcctcttccacactgccttcctgaggtcgggcactggcatggagctctgtttcctcttctcctccctagggttgtaatctggctttcccccaatctttctattgtttccacttcaccagtgatttcctccttgttgtccagaaataggtcaggataagaaattcccctttttgacttcttcagccttcttgttaacaaagcaaaagaaggttaaacaccttattcaatgctcagcatttttttttttttttttgagtccgggtcttgctctgctgcctaggctggagtatagtggctccagcaattcccctacctcggcctcccaagtagctgggaccacaggtgtgtgccatcgcacccagctaattaaaaaaaaaaattctgtagagacaaggtcttgccatgttgcccaggccgatctcaaactcctgggctcaagtattgcaccctcctcggcctctcagagtgctgggattacagatgtgaacccctgcacgcacccaaaggtcaacttttaactgcctgaaacttttgataggtcagagagatgaattctcttgttcacaatacacagtcagaattaccttggcttacgagttcagggcacagaacaytggtgtcacacaaacgtgggctcaaaagctgcaattacgcagtggcgttttgtggattttttttgtagagatgggatctcagtagattgccaaggctggtctcaaacttctggcctcaagcagtccacccatctcagcctcccaaagtgttgggattacaggtgtgttttgagtcttggggaccaactgggattctcttctcccctttatcttctgtatccaatctagcccctgccatttctttttttctggtgcctctagggtttgctcttttctctcctttcccattctcctccattaaacaacgctccccttgtcatgctccgaaacctcaaatctgaacttttacttctcctatcacagaaacttcccacactcyaactgcttattacccctctaccttcaccaccaaattgtaaattctgtgagaacagaaacccaattttttgaatttgctgttgtgtcctcaatttccgtcacaaacaggttctaacattgacagttgaatgaaggaatgaatgaacgagttcttggattgctacaactgcctttaaacttccagtaaacttttgctgccatcagcaggtgcatataaaacactcttcataggccaagccaccctgactcatacctgttatcccagcactttgggaggccgaggtggggaggatggcttgagggcaggagtttgagaccagcctgggcaacatagtgagaccccatctgtacagaaaaattacataaaataaaattaaggctaggtgcagtggctcatgcctgtaatcccagcacttttggaggccaaggagagaggatcacatgaggtcaggaattcaagacgagtctggccaacatggtgaaccctgtctctatgaaaaatataaaaattagctggctgtggtggcgtgtgcctgtaatcccagctacttgggaggctgaggcaggagaattgcttgaacccaggaggcagaggttgcagtgagccaagatcacgccactgaactccagcctgggcgacagagtgagactccatctcaaaaaaaaaaaaaaaagttttattgcaatgctcagggcagtaagcattgttgtagaaaataagtaatttgtatttttaaaatgcgtaattcatcccggcactttgggaggctgaggtgggtggatcactaggtcaagagatcaagatcatcctggccaacatggtgaaaccccgtctctactaaaaatacaaaaaattagccaggcgtggtggcgggcacctgtaatctcagctactcaggaggctgaggcaggagaatcgcttgaacccgggaggcagaggttgcaataagccgagatagtgccactgcactccaacctgggtgacagagtgagactccatatcaataaataaataaagtaagtaaataaaatactgttcatgatattctgctcccatgagaagcttgccgttcctcctcattgcagccctatgacttcccgtctggcgccttcagtcgctgctttgtctcctccttggatgccttttcttttgtcctctcatcaaaaccaactcatccgtgaggctccagcttgagctctacctcctctatgaagcccccgaacctttcccaccgacacagacctctgccttctttgatcatctgctggacttcagtttaatgctttaatgattccacttgtatgggtcctgtctatccacccggtttaggtatctttgaagataggagctacctactttttaggtcttttgcatcctccacactcctcatctaaagctgcgtccactctgactcaccttcctaacctgccaggcagggtctttttgttttttaaactttaagtaggctaggccgggcgcagtggctcatgtatgtaatcccagcgctttgggagtctgaggcaggcagatcacaaggtcaggagatcgagaccatcctggctaacacggtgaacccctgtctctactaaaaaatataaaaaattagccgggcgtggtggcaggagcctgtagtcccagctactccggaggctgaggcaggagagtggcgggcacccgggaggcggagcttgcagtgagccgagatagtgccactgcactccagcctgggagacagagcgagactctgtctcaagaaaaaaaaaaaaaaactttcagtaggctatgtggaggtcgagttagatatcttcggtacaagccttagatttctttttctgttttaagggaatttttttctttttctccaattttgttactgtgagttcacgaaggcatattcaacagctcattgctgccctgcctctcctgcaccatccaacatctcactgcagtatccagcaacccacaggcctgctgggcgtggtggacagtccccaagatcaggttatcygtgtcaaaatattgagtggttgatgagtgctccaagtaggcactagagcctgctgagagcactcagaggtttctgcacaagctcagtggatttgagccctcatcrttgttcattgctatgtaagtcaagggttggtcataggtcctgccttggactgtcatttcaggaagcagggcagctacagcagcagtccccaacgtttttggcaccaaggatccattttgtggaagacaatttttccatagattgggggtagggggatggtttcgggatgaaactgttctatctcagatcatcggggattagattctcttaaggaacgcacaacctagatccctggcgtgtgcaattcacagtggggtttccgctcctgtgggaatctaatccctctgctgatctgacaggaagcggtaaagctctcttgcctgctgctcacttcctgctgtgtggcccctttcctaataggccatggacagttaccagtctagaggctggggggctggggacctctgaactacaggcttctccacctgcacaagttctgagaagttagactatccagagcaagaggggcaggaacttcctggtctcactgagaatcttcggccaatcycaactcccaatgggcatatgactcacacggtgatcatcttaaaatgcagattctgagtcagtgatttgaaagggacctgaaatcttgcaattgtaacaagctcccagatgataccaatggcgatgttgatgctgcctgtctgtggaccacactttgagtagcaagggtctacaatatggacatttccttttccagtgaactttagcaagtgaggagcatttcaaggaagacacctcccatgcacactgtcattagttgcagcatctcctgtagcaattgggctaaatctgtctttaattctttttcaaacagcatatccaagttttgcaatcataagcaccagccaggagaatatatattccatgcagaaaatgatgatgcccaatttaccaaaatgttcacgctgaatataagaagtaagttaaattgccgagaatttgatttttattttttaattccttaattttttattagtcttaactaggaaaagttaagtaatggcttagaagggctactacaaaactgtttttgtacgctgaagtgttttgaaactttactctcatatctactggcattgatcatatatctctttattttttatgttattttgttctgtttcatttttaagaccaggtctcactctaccacgcaggctggggtgccatggcacaatcatagatccctgtagcttcaaactcctgggctcaagtgatcctcctaagcctcccgagtagctgggactacaggcacgcgccaccatgctcagctaattttaaaaccatttttgtagagagggggcctccctttgttgcccaggttggtctcaaactcctggccttaagggatcctcataccttggcctcccaaagtgctaggattacaggcgagagccactgcacctggccatatatctctttctgtgtgtatcatcagaagctgaaagacttatttcacattgtctctgaatatgaattagtgttatgactttattgattttagtattttgaaaggtcatgttaaggaaaggctgaaagtcattttatctctcatttatttgtttttaataattttcatttctttggcttataaaacaatgagaagtccaacttctcctgaagctaagaatcattttaaggcatgcaaacaggtggaggtctgtacctcagctctctccagggagaggctggcaatggaaaaatggtgtgtagcagagaggttgcatggcaaggaggttgcatggcaaggaggaaagaagaaattaccagaggtctggaggcatcctaaatgagaaatcctcccagaagcacaaactgccctggagtaaatgggtagcctgtactgtaggcaactttgaaactatttccagaaagtaccatactccatgagcttattttattttattattttcagagacagggtcttgctgtgttgcccaggctggtcttgaactccttggcccaagtgatcctcccaccttggcttcacaaagtattggtattataggagtgaaccactatgcccagccagtgagcttatttcacacgttcttttctayagggaaacctcaagtgctcgcagaagcatcggcaagtcaggcgtcctgtttctcggatggatacccattaccatcttggacctggaagaagtgttcagacaagtctcccaagtaataaggacattgatgcctcttataatggaagaacataaaactctctgacctattgactctttcatgaatacggtttaggaggaaatgatgaaatatttaaaatgctaaccttctcaatcaaccataactctcaatagtcatagactgtttctgataacttatactggatgaatctcttttagaactcgctgcagaaatcctaacttccaatctgatgacagcacacctgtctaaattctttgccattttttttttcagctgcacagaagagatcacagaaggagtctggaatagaaaggctaacagaaaagtgtttggacagtgggtgtcgagcagtactctaaacatgagtgaagccataaaagggttcctggtcaagtgctgtgcatacaattcccttggcacatcttgtgagacgatccttttaaactctccaggtacaacagttgttcttgtgatattccaccatcaggaattccccactagaagttagtccccatcgctgacttttacttggggaattttacaggagagtatagggtcagtgtgtgagaaaaggtttcttgagtcaggcaagaatccccagagagactgtttcacaggttggggcggagtcctccctgtgcccttgtgactcatgtgtcacagtgaccgggagaagcagaaactsccrgtgtggtgaatctccatggaaagatctaactctagagaaacagattttgtcacttggagtctctgtcattttcccttttgattagcctccttatttgccctcagcttgctgttttataatttttggtttgctttttagagccctcctaagttaaacagttgtgaaacctggctgcccaccctagtagttaggatcaccaacctcacaaaactgacttctccactttcatgtgcgaccttcataaaagggatatgaacttcttttttctctgacttgtacatcctgtaggtttaaatccatgcatttttttttttttgagatggagtctcgctctgtcacccaggctgcagtgcagtggcgtgatcttggctcacctctgccagggttcaagcgattctcctgcctcagcctcccgagcagctgggattacaggcacctgccaccacgcccagctaatttttgaatttttttagagacgggatttcactgtgttgcctgggctggtgtctaattcttggactcaagtgatcctcccatcttggcctcccaaagtgctgggactacaggcgtgagccatcgtgcctggmccagatgtaattcttgtaaatttaccctagtaaatggttttaaagaatggattgagaataatccgcaattttctagggaggaaatgtatcctttacagggayattgcctgattgtctgtggggagtagagtatatgtagagtggttgttaggactgaaaatgattattactgaaacaggatgtgagagattataatgagttgtccactatttataatgtcacacaggaattctgtttcatcgctgagtgacactcttttgttgcaggccccttccctttcatccaagacaacatctcattctatgcaacaattggtgtttgtctcctcttcattgtcrttttaaccctgctratttgtcacaagtacaaaaaggtaaaagcaaaggtaaaaattcattattctttcctctatctgcagaactgcctattcctaactgactcatcatttcatctctgaagcaatttaggtatgaaagccagctacagatggtacaggtgaccggctcctcagataatgagtacttctacgttgatttcagagaatatgaatatgatctcaaatgggagttyccaagagaaaatttagagtttggtaagaatggaatgtgccaaatgtttctgcagcatttcttttccattggaaaatctttaaaatgcacgtactcaccatttgtctttgcagggaaggtactaggatcaggtgcttttggaaaagtgatgaacgcaacagcttatggaattagcaaaacaggagtctcaatccaggttgccgtcaaaatgctgaaaggtacagtatagtggaaggacagcaacaaagatgcmcaaaaatgggaggcacagtttcccacccatgccttcttctcttttccatccttttaatggttactgtttgccttgtttcaaggctaaaaatggagtggattggggtgtcaacccagtcatgaatacaaaattcaagtcataaatacaaaactccacctcttcttccacttctctctttgtttatttttattttcttttatttttttgagacagggtctcactctgtcacctaggctggagtacagtagtgtgatcatggctcactgcagcctccaccccctgggctcaggctcctcagcagctggggctacaggcgtgcaccaccacgctcagctaagttttttatttttggtagagacggggtttcaccrtgttgcctaggctgatctgggactcctgagctcaaactatctgcccgcctcggcctcccaaagtgttgggattacaggcgtgagccactgtgccaggcctatttagtttttataggctttgatatttggggatacagttgccacaggcagaagttctttcttacatttgtgttgttttattttgttttatttttagagacaggatcttgctctgttacccaggctagagtgctgtgatcatagctcactgcagcctcgacctccttggctctagcaatgctctcacctcagcctcacaggagtgtgccaagacaattggctaattttttttttttttkgtagatacggtgtctcaccatattgcccaggatggttgcaaactcctggctcaagtgaggctgccttggcctcctaaagtgctgggattacaggtgtgggttgaaacagactctgggtaggagagaaaactggggccctttgtatcctcacttcgttgctccatccattccgatctggcgtccagccccattgctggcctcaccgttaccaccgctgacccagcaaaagcatctccagctggctctcttgctaaggtcaacagtgacttcaaaccaaaccaagcctaatggatatttttcagtcctcattacttgattgttcagcatgaattgatgctgttgattcttctctccatccagaagctttctttctttgggttttgtgtcaccatattctggttttcctcccacccctctgcccttctcagtcctttgtgggctcatcttcttccatccagcttttgttgttgtggctgattttgaaactcagtcctttgtgggctcatcttcttccatccagcttttgttgttgtggctgattttgaaacacagccttgctctgttgcccaggctggagtgcagtggtgtgatctcagctcactgcaacctccacttcccaggctcaagccatcctcccacttcaggcccctgagtaggggggactacaggcatgcgccaccatgcctggctaatttttgtatttttggtagagatggggcttcgccatgttgcccaggctccatccagctttttatggggcatccctgtgggcttgctcctggaccgccttgcgttttcgctccacacactcaacacagtccatccccactacacccgtgatgtcctcccatacaccaagggccctcatgcttgcrtctcctttcggagcttcaggttcatatgttaaatgtttggatgtctcaaaggtccctttaacacagtgtatgcaaggtgaattcccctaaccctggccctgcaccagcagtcctctctgtgactggtaatgaatgccagtgaataaataaccacattctatatagttgggcacactagaaacccgtgacttttccttgacaccttcctctttctaacaccctgtgagctaatcctatcaggtttccgattagtgtctcttgattccatcctcgtccctccatctctatgaccaccactctagttcaaggctctctcctggacaaaagcttccaaagcaggttcctgtatccactcttgcctccctttggcttctccatactgaggtccaagtgacagtggcgaaaggctaagcagatcaaatggctttcctacttcacatttcctccaccacccgcatggctgggccaccgctgcctccccacctcttgctctcggcaccccagagcgctggccttctttcagttcccccagcactgtcctcccacccactgtggggcctttgcacaagtggatccttctgcttccccttcccctttcatgtaagtatctcccactgccccctcagatctcagcttaaacaccacttcctctgtctcacaccacagacaatattgaggcccttgcaatgtgcgacattagctctctgcaggctttcccccgtagaatccatcacctttgtcatgacattttttaacatccaattgttgtcccatctgtccagtagcccctgtgcctcatgagggcagggtctgtgtctgtggtgctgtgctctctcctttctcgacctttgcccactctttcacaaccctcagcactgttctcctccccttccaccatgagtcacctggccagctcccatttttcttcaggactcagtttagacattgaatgctcctttctccacccctccaaggctaaggtagctatcccttttgaccctacagtacccctgcactcctttgccacgttgcattttttcttttttttttgagacggagtctcactctgtcgcccaggctggagtgcagtggcaccatctcagctcactgtaagctccgcctcctgggttcacgccattctcctgcctcagcctccctagcagctgggactacaggcacccaccaccacgcccggctaaatttttttgtatttttagtagagacagagtttcaccgtgttagccaggatggtcttgatctcctgacctcgtgatccgcctgtctcagcctcccaaagtgctgggattacaggcatgagccaccgtgcccagcccaacgttgcattttttctttttctttcttttttctttttttgagatagggtctcactctgtcacccaggctggagtgcagtgaagtcatcatagctcacggcaagcttcaagtcctgggctcaagtgatggtctgcagcctttccagtaactggaactacatgcaggcaccaccaagcccagctaatttttattttattttattttatttatttatgtatttttactttattttatttttaagtagagacaagctcttgctattttgcccgggcctttcttgaacttctgggtaccagcaattctcccgcttgtctcagcctcccaagatgttgggattagacgcgcagggacccacgtcttgcctgccgtattgcatttatggcactgtattgtcatggcttatttacttctctgccttctccaggagactctaagatccaggaagacaagggttgtgtcttgtttttccttcattccccagtgtctaggacattggctcttacagagtaggcactcaataaatacttgttgaatgactgaatgaaagaggtaatggtacatgaaaatgcttagaagaagctaagcatgctaaaaaatgtaagatattattttagccatgaggaataggacatgaacaagtaaagccccgaatccctgtccagcgtgaagctgaagacatgatgtattagggggtcccagtgcccacaggaaatcccacccccaagctaaaatcttggaaacaaggatacccctgagagcttgcccaaaccaaaatagaggatgtcagcaccggagaagccactataaaggttaggatgccttcctggacaaaataatggaacctggcaatcgaaccaaatcttcactgaatgtaaagaagagttactatatctggaagaaaaagtctgttcacagaggggtggtgcctggagcctggagagggaagtccagagacyctgcccttgcccctgtggctgcccgggctgccctgaccaactgcacatgagccgcaatgacgggagcccttggattccatagygactttcctcacactgtgcttctaagtcagcttataagtacagtttgctgagctatctggaattttccctagagagagaatgcattggccaaccaatatgttctagcctgcttggcagttttatttctcaatgtcarttaatgggtctcttgagcacctgatagtgggaattagtcctctttgaccttctcccattggacttgctggcaaatctaatgttctagacctgagggccacaggctagagtcaaccatgctcacgacactgttatctctctctgactacaacagatccaagagttcaaacaaacaaacaaaaaggacgtttctcccttctgttaacttgtactgaggaggaaaagcatgtgttattattttgtttgtttgttttgagggccaactgtaaggatttttattttggtaggtagaggaaagtcctgttgaaaggtgcattaccagattcaacatttatactatagtctttgttttgttttgttttgttttgtttttgagacagagtctcgctctgtcacccaggctggagtggtgcaggggctcaatctcggctcactgcaacctctgcctccccagttcaagggattcttttgcctcatcctcctgagtagctggaattacaggtacgcaccggcacgcccggctaattttttgtatgtttagtagagacagggtttcaccatgttggccaggttggtcttcaactcctgaccttaagtgatccacccgccttggcctcccaaagtgttgggattacaggtgtgagccactgcgcccagccctatactacagtctgaattctgccttaggctgggcatggtggctcatgcctgtattcccagcactttgggaggcggagttgggaggattgcttgaatctaggagttcaagaccagcctgggcaacatggtgagaccccatctctacaaaaaatataaaaattagctgggcatgatggcctgtgcttgtagtaccagtaacttggagggctgaggtaggaggatcacttgagcccaggaggcagaggctacagtaagctgagatcatgtcactacactccagcctgggtgacagagtgagatactgtgtcaaaaaaaaaagaaagaaagaaaaggaaaaaaaaaaaaagaaaaaggagaaattctgtcttaaaacacaggatattgtttgtttgtttatttatttatttattttaagatggagtttcactcttgttgcccaggctggagtgcaatggtgcaatctcagctaattgcaacctctgcctcccacattcaagcgattctcctgcctcatcctcccaagtagctgggattacaggtgcctgccaccacgcctggstaatttttgtatttttagtagagacgaggtttcaccatattggccaggccagtcttgaacttctgacctcaagtgatccacccrcctcggcctcccaaagtgctgggattacaggcatgacccaccatgcctggcttctctcataattttgaatttaaataaataatgcagattgactctgagctgagaaaaattttatttaatgacataaaattcgtattttacttgagttttacatttttaatgctcctttctttgacagaaaaagcagacagctctgaaagagaggcactcatgtcagaactcaagatgatgacccagctgggaagccacgagaatattgtgaacctgctgggggcgtgcacactgtcaggtaacccacttccacgaaaatcrcctcatcaaaaagactgtagcttgatgacaaagaggatgtttgctctctctctctctctctctttttaattctttgtcttttctcagtcacagtgtgaactctcaaacccaagtggaattagacactgagcactctataaatcagaggggtcaaaataaagaatgcctcattcatctgctttatcgtgatatattgcataattctcacctgcttaaaaacaacaacaacaacaacattgcaagtacatttggtggtgtctgtgcttctctcccagcttggaagctggtgcacaggcgtggtgagagtggttacagagcctggccactgccccagttgggctgccgtcaaatacggcacagcctagctaggatatcagactttactttcccagaattctctggggcatgccctctgatcttctctcttctgcctagaaatacccaaatgatgtgcccaaggttcattctttctgcagcagcaggcctggggctggtactaaaaggaaaaagaggaaagtgaatctgagagaggactgggaatatatttctccctcctcaagcaaacagcaaatcagcatatagttaccaagtgttcacctataatacacagctagaacattactttcagttgccaactggagaatccaggaggccagtggtattggtgaggccacacatacaaaaaagggccacagagaatgtcaagaagatgctgctttccaaagaaatttgagcaaaagctgaaactgaatttaaagtataagaagagctaggctcagaaaaagttgtactgtccccaagtcagcagagaaccaagccctcctaagagtatgttgtctgctacatagacttctgaaataacagtttgctttgtgtatgcctataattgaaactgtaactatttcaggaccaatttacttgatttttgaatactgttgctatggtgatcttctcaactatctaagaagtaaaagagaaaaatttcacaggacttggacagagattttcaaggaacacaatttcagtttttaccccactttccaatcacatccaaattccaggtaagaggctgggtcagggtttcgtaattacacatcatagaacgtaggcaargtgtgctgttcaaacacacttcgttgaccagtttctaaaggcaccgtgaagtctgtgggtcctgcaacctagagatttcctgaatctttgctatagtttccctgttgacatggaacgagtcctgtccctttccttcagtacaggtactatagctgagctagtctctctccacccatgcctgcatcacaccatagacgcctatttggtttggggaaaggtgcattattcggtctttcaggacacctggttgcctcacaggtattggtagaaagaatgaagactttttccaaagtccttaacatatgcaaagagagcagctcgggtcctgggactattgcgcaaaagaacgctgaactcaaattggattctaagatattaggatggattgatcgacacgtgatggggacacagtaaagtagcagtaaccttgtctctgctctgtttatcctccgcatccatggggatcctgagagatgcttggtcctgcagggatttattgctttagcgggcataaatgagggctgtaggagtttgctggatctcctcctcatccttgaactttcttgctaattacttgagcatcatggctttgtagcacctttctctgaatggattcccaggcattctgatggaggcattcgttgagccttggagcattctttttttttttttttttttttcagacagagtttcgctctgttgcctaggctggagtggtgcaatggtgtgatctcggctcactgcaacctccacatcccaggttcaagcgattctcttgcctcagcctcccgagtagctgagattacaggcatgtgccaccacgcccagctaattttgtatttttagtggagacagggtttcaccatgttggtcaggctggtgttgaactcctgacctcagttgatccacccacctaggccccgcaaagtgctggaattataggcatgagccaccgcacctggctgagccttggcgcgttcttatttccctccctgtatggaagttctcccttattctgaagggtatttgtttattggagacttttttctttaccaggggctttttagggatacatttgagagtcccggctttgttttcttagaatgtaagttttaagtgcaggcctctggccttccaggtctgagacacagacccagtgtcttaaagccaccaggccccacggagatccccatgcacgtccgtgtgcagctgcccttaacctatgcatgcccgtcacaccgtcctctcctttacattcatttcccagctcatcgtctagaaatgagaactctataaagccactcatattctggaacagaggggctatcctactgagtccgatgtgtgtgaccagtatccactggtcagtacttagcccctttgattcgttctgttcactggaatattaaatacactgaaattattccttttggaatatttgtggtctgaaagcatgaagccatttcctaaagatatgtaaattgtaaattgggttaaactcgtatattagaataaattgaatcgtgatctacttataattcctacagagctcctcagggaagaatttttatataccttaaaagagatttgtattattgctatttattaatttcacagtaaaaagaaatgagctttacaaaggcaaactggaaaaaagaaggatggtgaaacgcttacgggactctcgggaagatctgtattatgtgagggaaagtgggctgagttcagaaaccaaagaatgagatcgatgtgagtcctggttccactcgaatcatatttatctcactgtgcctaatttctcttttataaaatgccacccatctcataggttgtggcaaggattgagtgaggtcctttttgaactgtaagattctatatggaaaacagggattacttttatcttagactggcaagcccagttacacagatgtttttaatgtacacaaaaaatggacaaatggatggtgtgcttttaatttaaaagtcaatttataactggaatccatttatttgatgaattacatttttaaaataaaatgtctgctgagaagaataatgtaaataatgaaaaaacaaaattttttaatagcatgcctggttcaagagaagttcagatacacccggactcggatcaaatctcagggcttcatgggaattcatttcactctgaaggtaatattttattctaagtagtagcactttaaaatggaaatgaatgcaaaagttttatgttagctattttttaaaagtgtgtaaacacaaaagcattttaaaatttgctaattgtcagatgatagctaaaagccagtttgtatactgtagattttatgtcaacattcaactaataaacactgaggactattttatttggtcagattattcatttaaagtcatatattaattacagccatcttattacctgacaagtggaagagataatgagttccgaagttacatagaatttggattaacttctgcttactttgctttctgactggatgactttggacaagttatgtgaccaccagaatcacaattttcttgtttataaaataggcctaacactaccttcctcacaggactgttagaaggagtaaatgaggggctggccgtggtggctcacgcctgtaatcacgccttgggaggccgaggcaggcaggtcacctgaggtcaggagttcaagaccagcctggcccaayatggagaaaccttgtctctactaaaaatacaaaaattagctgggtatggtggtgcacgcctgcaatcccagctacttgggaggctgaggcaggaggattgcttgaacccaagaggcagaggttgcagtgagctgagattgcaccactgcattccaacctgggcaacagagtgagacttcaactcaaaaaaaaaaaagaaagaaagaaaaaaaaaggaaggagtaaatggaagaatataaaatgcacaatatagtttataaaataggatagatgggccgggcacagtggctcacgcctgtaatcccaccactttgggaggctcaggtgggtggatcacgaggtcaggagatcaagaccatcctggctaacacggtgaaacccttctctactaaaaatacaaaaaattagcatgagcctgtagtcccagctactcgggaagctgaggcaggagaatccagttgcagcaggccaagatcgtgtcactgcactccagcctgggcgacagagcgagactccttctcaaaaaaaaaagggatagacaattaatattaattcctttcccactgtgacagccctacctagtgcaaaagagaagtatctaaaactcctgactaatcaatcaggaggtcatcggtcatcaaagcagttccaaagtttatctctaaccaaaacaagtctccagtgacccttcataggcagcataaacaggtcatctctaatgctgccgggaagataatgcgatagcttcatgtcttagcacctcacctaactctggcttgaataaycttcccatagagatttaataaggcaacttcttagagttttggcaaaagtgaagactggctctattttacagatgaaattgaatatgaaaaccaaaaaaggctggaagaagaggaggacttgaatgtgcttacatttgaagatcttctttgctttgcatatcaagttgccaaaggaatggaatttctggaatttaagtcggtatgctccttttaaagaaaaaacaaaccaaaaaaaagatttgaaaagatgtgcttatatatgttttcttgtttattttaacttgtatcccttaaagtctgccttttctcccctgttcactgttggartcacctagcgtgttaccttggctcttggctaattgtagtagcataaaggcctgggatcccttgtgaggtcacggctagcacagccctcccaggctgcacaaagtcccctgaaacttccaaggctgaaggtcgagataggaagtcctcagaaatccttcctcaaaacaaagcgtagcattgtcagtccctttcagaacggctgttcaggttgtgccctgcatgtgggcattcaacccaggggatgagaggaggctgaaaccgagccagccaccctgagtgtctttgtctaattctcaccctgcgtgctgtgggctggcagcagtcctgcaggctcactgcctcctctgttgctaaccccagatccattcgttggtaaggccctggagcctgccgtgaaccatgtctctaccccaattttgcactctttttgaactgcctttccacccgctgttctctgtgatttcaaatgtctcctgcctataagcagatcatagcccactctctggctaccttccttcctcgtttgcttgcctttcattaccttctctttatttcccaaaattcttccccctcatttttcttgcagtcttctaatctcctcctcctcttctcctccacttccttccccttgcctcttctctcctgttttctctctgaatttggaaagactactttcaattgtatttttttgttttgttttgttttgtttttggagacagtctcgctctgttgcccaggctggagtgcagtggcgtgatcttggctcactacaacctctgcttcctgggttcaagcaattctcatgcctcggccttccgtgtagctgggaccacgggtgcataccagcatgcctggctaattttttgtattttaatagagatgggaattcaccatgttgcccaggctggtcttgaaatcctgagctcaagcaatccacctgcctcagcctcccaaagtgctgggattacaggcgtgagccaccacactcggccttttttctttaaaaaattactgcctcagccagatgttcatggtgtgtgtctgcagttccagctacttgggaggccaaggtgggaggattgcttgagcccaggagttggaaactgcagtgagctaggatcgcaccactgcactccatcctgggtgacagagcaagtctctttctctaaaaaataaaaaataggcagccgggcgtggtagctcacgcctgtaatcccaacactttgggaggccgaggtgggtgaatcacgaggtcaggagatcgagaccatcctggccaacacggtgaaaccccgtctctatacaaaaaaaattagccgagtgtggtggcgggcgcctgtagtcccagctacttgggaggctgaggcaggagaatggcatgaacctgggaggcggagcttgcagtgagccaagatggcgccactgcactccagcctgggcgacagagtgagactctgtctcaaaaaaaaaaaaattaattaaaaataaataaataggctgggcacagtggtgtacgtctgtaatcccagtgcttttggagggaagcccaagagttccaggctgcaatgagctatgactataccactgccctccagtctgtctattcaaaataataatgaaataagcttaaaagcaataataatacaagttttaaaaaattactgtcacagtaatatttccacacctctgaactgcgaggcacatttttctcttcattttccccacctgctgtttggattcttcttgctcacgcatcttgcccacctgagtctttctctatttcacttatacaactacaatcctgctttcacaagcattttgtttttgtttttgagacaatgtcttgctctgttgcccaggctggagtgcaggggtgtgatctcagctcactgcatcctctgcctcccaggttcaagcgatcctcctgccttggcttcccaagtagctggggttacaggtgcacaccaccacacctggctaatttttttgtatttttgtagggataaggttttgctatgttggtcagactggtctcaaactcctgactcaagtgatttgcccgcctcggcttcccaaagtgctgggattacaggcgtgagccactgtacctggcccacgaacatctttatagaggtgggagaacacctacttagattgtctggcctggtttgctgcccatagctaagtaaatactcaaactactcccaactggcagtcaaggggcactgcttccccttcaaccccaggcttgtaataatatgaatttttgaagaacatccagtttcttaggccttctatccttttatcttcacatcaggcctcccctttgaatcatgcgtgtcactgtccccttcttgtctctyaccccctccctgatattcctctgggtgcccctcagtttcctctgtaggcccttgacttcatcaaacatttgttgagccccagctacatgccaagcactgtactagatgctggagatacagagtcagttatgatatgactcctgggctcgaagatcttatgaatgataggggagacagagacaagcagacatgcragtcgaagatgacactgaggccgggggtgggtggctcaggcctgtagtcccagcactttgggaggttgagacggtggattgcttgaggccaagagttcaagaccagcctggccaacatggcaaaaccccatctctactaagaatagaaaaacagccaggcacggtggtgtacgcctataatcccagctacttaggaggctgaggcatgagaatcgcttgaattgggaggcagaggttgcagtgagcagagattgtaccgctgcactccagcctgggtgacagagtgagactttctcaaaaaataaaaataaaaaattttaaaaagtttaaaaaagacaacactgtagcatgataagtgttgtgactgaagtaagttctgggaacccaggggagggatctgcacagcagacctggttgggggaaggggagatgcagtggaagaggctttctgagggagtgcgtgcttcatgcttggactaatggagatttttgaaggaaaaggaaaaccagcagggaatgtgggataggataggaagcatggaatcaggaggagttttttttggagaaaggtaatgagttggacatactgaatgtgaggtgccttgagcaaccaagtagagcgtggtctagcagacacttggacacttctcctgtctgaagctcaagagaaatgtttgggttggaaatagggatgtgggcaatggtggttgcatccctaggtttggatgaaatggcttgggtgagggtgtgggttgtgaggatgcagccctcaggagtgagagtaggctcgtgcacaaagcccctgagggagacaggagccggcagagcagtggggagaaagcaggagtgaaccatgcgcagggttcccagagggaggaccagaagcgggaggggctggccaacagcagcagacaccacagggaggtcccgtcagatcgagactgtgtgggtgccaagccagtcagtgcaggcctcggccagagcagcttgggcagacaggcaggaggaggaggcaggttgcagacctggggtaaagtgggcaaagtgcaggtagatggcactgaaaaaactgggtatggaggagggagctctagaggggctgtggcacagggctgccagtgttcatggtgctgctttttattttttaaagatgaaagagtgtacattggacctttgctactagtgccctgttccccttcagatcttcctttgtaaagttcattttcttgtcagacccctttgattaacatcacgacatctctcagctcagggactccttctaattccagttcagtaaacctctccaaactcatttttagctttttgtttttccgattatttccctcgatattactccatttattcctaaagctattttccagtcagaaaagagatgctggccaggcgcggkggctcacgcctgcaatcccagcattttgggaggccgaggtgggtggatcacctgaggtcaggagttcgagaccagcctgaccaacatggcraaacsccgtctctactaaaaacacaaaattagctgggcctggtggcgcgtgcctgtaatcccagcaactcgggaggctgaggcaggagaatygcttgaacctgggacgcagaggttgcagtgagccgagatcacgccattgcactccagcctggggaacaagagtgaaactccgtctcaaaaaaaaaaaaaaaaagaaaagagatgctatttctcacacccacaataagagtactggaggacagctctgagattccctctgaaggctcaggggagggcccctgttggggagcctctcacttttgctcggaatctgcaaaagatctgctcctctttggcctctggggatgcttcagaagccgcacaaagaactgcagccaccatagctgcagaattaggtctcctatattcactttgtttgttgcacatcatcatggccgctcacggcacagcccagtaaagataagaggccttccatcaccggtacctcctactgaagttgagtctagaagaaagattgcactccaggataatacacatcacagtaaataacactctggtgtcattcttgacagtgtgttcacagagacctggccgccaggaacgtgcttgtcacccacgggaaagtggtgaagatatgtgactttggattggctcgagatatcatgagtgattccaactatgttgtcaggggcaatgtgaggctgctatttcctacttatttttatacggctattttgtgttgtgtcgttatcrtggtaaacaactgcactcactgtggtgcatttttgatttatggtaacatcaaaaaaccctcacagcagtctgcttacttatgcttaaaaggtttttctgcagcttcagggaatcttccatctataataaaagctgagcaaaatagcatcacatctgtccttgggctagctagtcagagtagatcagttaggggcctttgagtgcaatcctcactttaaaaaacccaaaatctcaatacttgcacttagttcagttatcctagctataaagtgatgattgagttatgttttcaattatgtgaaaagctaatagtcacaataaagcactttaaaacatatatagcacatacctataaaatgttaaagctaaatacttaaatatgaattaatgaatatttatcatccttttactgttaacacaggaagatctaaaacatgagtgaattggctgggtgcagtggctcatgcctgtaatcccagcactttgggaggccgaggagggcagatcatgaggtcaggagttcgataccagcctgactaatatggtgaaactctgtctctactgaaaatacaaaaaattagctgggcgtggtggcgtgtgcctgtaatcccaactattcgggaggctgaggcaggagaattgcttgaacccaggaggtggaggttgcagtgagctgagatcgcgccactgcactccagcctgggcaacaagagcaaagctctgtctcaaaaaaaaaaaaaaaacaacaacaaaaaaaacagtgtgaattgacttggtaatgaaaaactaaggacagatgtgtttacaaaaagaactattagaagtaatagatgacaaaattgtgtagttgaaaatgtgtgtttttaaagaattacaatacctggctgggtgctggtggctcacgcctttaatccaaggcactttgagaggccaaggtgggagaattgcttgagcccgggttcaagaccagcctatggaacatggtgagacactcaactgtctctataaaaaataaaaaactagctgagtgtggtggcacacgcctgtggtctcagctacttgggaggctgaagtgggaggatcacttgagcccaggaggtcgaggctgcagtgagctgtgatcacgccactgcactccagcctgggcaacagaatgagacccttttttttgagaccctgtctcaaaaaagaattccctacttgtgaaataataataatattaaatgctgacttagtgcttactatgtgctaaacatctaagtgctttatgcatattaattcatttattcctcagagtacccacttggaaactgaggcacagaaaagtaactcgcccatggttacacagcatgtggacttgaacaggaatagtctgagccccgagtctgtgctaaccactatgttgtagtgtttcccatgagggttatgcacttacctcatagcgttgatgtgggaaaaagccaataaaaccaacgtgaaagcaccttgtccagggtgaacatccagtaaatgtgaaaagtcaaattaaactgtattcccactagaaacaaataatcatcttagctgatttacgatctmctcctactcatcatagactgctcatatgtagtcattcagtttctaccccaccagctggttgtctcttatgtgggaaagtgaattccatttggaaccacaattaatttctttaattaatcaaattaaccagacttgcctgcatgaatcaatagctcatcagtttgcatacatttaaaagagggtttacttggctgattaagcatgtgctgattaaacatgtgctgtgaaggactcgtcaacccatgtaaaagaaaatcagtacagccaggtgtggtggctcacagctgtaatcccagcactttgggaggctgaggcgggtggatcacgaggtcaggagttcaagaccagcctggccaacatggtgaaatcccgtctctacgaaaaatacaaaaattagctgggcatggtggtgcgtacctgtaatcccagctactcgggaggctgaggcaggagaaccacttaaaccagggagtctgaggttgcagtaagctgagatagcgccattgcactccagcctgggcaacaagagcraaactccgtctcaaaaaaaaaagagaaagaaaatcagtacaaagctctgccccagtaacctacccatcttgtgtcttgattctagtctgagactatactaagtcaaaactccctttcatgctagtggaaattattaaagccacagaagccagactggtatcatttctggaagtgatgrcgtgggctcccctcccgacattattgtggatgacatttccactaaaggtcttcccagaaatgctgtaacagaagatctcactaattcactagtacccacttacccctaggcaactgactggctattccttaatggaaagtacctctttccagtggaaagatggcaagttaaacttacccattccaagcacaagcctttgttcgagaggagttgtaaagaaatatgccttatgttttaggctagtattattagaatgttaatttgaaagtgaaaacctttcacgtgaggaatgtgattttctcaataaggcattaagagtggtcttaggaagatgatgcatttcatcttaatacaaaagaaaagaagtcatgtctgtatgtggaaaattcaccatcttatctcctctgggttttccacaggcccgtctgcctgtaaaatggatggcccccgaaagcctgtttgaaggcatctacaccattaagagtgatgtctggtcatatggaatattactgtgggaaatcttctcacttggtaagttgggcagctgctggcctcccttggctcctggctttgcatcctctgctctctcggtgccsccccacccctccccccaacactgatgggtcttacttgtattgcagcccatgactttatgtttatttgctggtgtcctttagcctgtcttcctcactggtctataacctgcttgagagcgtgaaccgtgacttctttttcccagccgcagcccrtgtgcctgcaacastgtctggcacatggcagatctcaatacgtgtttaattgaatgaatcaataaacaaatgaagaaatggatgaatggctgcaattgtctaatgttttcctcaggtgtgaatccttaccctggcattccggttgatgctaacttctacaaactgattcaaaatggatttaaaatggatcagccattttatgctacagaagaaatgtaagttcaagtcagactgtaatttgrttgaaatcagaaaggtacagtctgtctacttccaaatgcatgaccaaaaaaagtcaaactccttagtgcaaagcgtataggattctttttttaaaaaatagaagtgaggtcttgctgtgttggccaggctggtctcaaactcctggcttcaagcaatcttcctggctcagcctctcaaagtgctgggattacaggtgtgagccaccacacctggctgtctgattccattttaaaaagaaaagaaaactctttgttttgggagtttctgaacaaagctgaacctttcctgtcctcagaggcacctgcttcccggttttaattcctttgcttgagggctccatgaaggtcattcgattctatccactacgtcatgtttctttaaatgcatttctgcccatctgatttctcctttcggatatgaattcaaaatctggtagaggacttgccacaaaacaaacatgctgtaaataagcagctccagaggaataaatggtgcttcattatatggaaaatgatccattttgcttcattcagacttcttcatcttgttccttgttctattgcttttacagatacattataatgcaatcctgctgggcttttgactcaaggaaacggccatccttccctaatttgacttcgtttttaggatgtcagctggcagatgcagaagaagcggtatgtagcagccaggactttataaagctttacaaaggaaattggtaaattaaaacacttgttgctgtcttcctgtgaaccaaaggtaccaagttgtcattctcattgcagtttttctgggttgccctttcaaagttgtgtggggtaagactttatttatttgtttatttatttatttattgagacagggtctcgctctgtggcccaggctggagtgtgtggcgtgatcatggctcactgcagcctcgacctcccaagctcaagcaatcctccagccacggccttccaagtagctaggaccatgggagggcagcaccacgccaggctaagttttttattttttgtagaaatagggtatcactgtattgcccaggctggtcttgaactcctgggctcaagcgattcccccacctcagcctcccaaagtgctgggatcacagggcatgagctcctctgcctgccctaagacatattgataaaaatgtttttagggaaaaaaaacacctttcctgatttcagccaaatgattaataaattaaaagctcttaagagttcagtgcagtgaagtagacaactaaataaaactaaataaaaataatccctggcctccagaagccactagccctttcttatgaagcatgagtgtggaaaaatcacatgactcaatcatgctatatggtagcctggaaagagcattgacctggagttctgagggttgaataccagctgtaccactctgtctcccaattktgtccattatagcaaatcactttacttctctaagcatcagttttctcacctgtaaaatgggttgttaagttagattatcttttgagctttgaggacttggaatttctttgctaacgcttcccccatcaacaccaccacctggtatagtgaaaagaaccatctccagatgaaataaataaaggagagaaccttgggctcctaatactgaggttcagatcttggctccatcgtttacttgataagtcacttaatcttttggggagtctccttctcagtttctttacctgaaatatgtgattaacaaatctcacctcatggagttgtaagaaggagtaaatcaggtgatgtatgtgagaagagttagcacgtactgggcacttggtatttactccataaaatgttagttaaatataaatctgatttttaagtggattgtctgtcctcctttctaaattgttatgagtcagttttcagttctgtattctctatatagacctgggtagatagtgtgtactttcctactgctgtgatttttttgaaaatgacatggaaactaggttattgtcagagaattaggtcaaaaggccagaggaaatggaaagcccccagcagacttatagcctattgcacagatacctataaactgttcatgacaccataaggtaaactgaaagaagagtttagaatgaaacaggaagtgatctggtaaagaaagaatgtatatgtgcatgtatagctgtctagctatacactttttttttttttgagacagggtcttgctctgtcatccaggctggagtgcagtggaatgatctcagctcactgcagcctccacactgtgagctcaagcaatcctcccacctcagcctcccaagtagctgggaccacaggcacacaccaccggacccagctattttttttgtatttttggtagacacgggctctcactatgttgcccaggctgttctcaaacttctgagctcaagtggtccacctgcctcagcctcccaaagtgctaggattacaggcatgagccaccacgcctggctaagagaggactgattgatgttactcattgcatagttgggtgtggatttgtggggaacttgtgagctggatgtgaggactgagtagcatcttgtctgctggagagtagagggtgagtaggatattccaggatgaatgaatcatataaataaaagtccaaagttgaaaaagtagagtggcaagtagatggctgtgcctaatatacagggagaatgggggagtagagagggaaaaaaaagtgcaaagctcgtgtcgccaggatggaggcttcaggaccacttgggtcttggtttgagcttctcctttcctgtccccatactcacaggatgtccagatcccctttcctgtgttcagggggcctgtcaggtatcaggaaccgttgaatggcaacatatccatgcatgattaatcagctgagagaatccatgcttagggacagacggttcacaaactttttctcccagttccttccactctgttccctgaccctctgtgaccagtgtcagaagcacccagagaaaatggtagctcctttaagcaggttagaaaacaggcccccatggcccattgcagtgggtcacacatgtaatcccagcactttgggaggctgaggtgggcggatcacttgaggtcatgagttccagaccagccaggccaacatggcaaaatcccatctctactaaaaaaaaattagccaggcgtggtggcgcatgcctgtaatcccagctactcgggaggctgaggcagaagaatcgcttgaacctgggaggtggatgttgcagtgagccgagatggcaccactgcactccagcctgggtgacacagtgagactctatctcaaaaaagaaaaagaaagaaaaagagaaagaaagagagaaagaaggaaggaaagaaagagaaagagagaaaaaaaagaaagaagaaagagagaaagaaagaaagagaaaaagagaaagaaaggaaggaaggaggagggaaggaaggaaggaaggaaggaaatgcccccctccccgggtgggaggagtccagaggaaccccttacttagggctcatgcagcctgcctcagtctaagccagtctgaaggaggagagcttggcgtgggtctcagccatcttgcccgctctgctgggcacttttgtttggtgcaaggcacaacccacacagccacgcaggcagccctgcccactctgcagaatcctatctagtcccttggttggaaaactggccttgtcaccttccccagggtgatcttccctgttatatctgtgaaaggttttgtagaatcttctctcctcccctcccctcccctcccctcccctctcctctcctcttttctttttttttgagacagagtctcactctgtcacccaggctggagtgcagtggcatgatctcagctcactgcaacctctgcctcctgggttcaagcaattcttatgcctcagcctcctgagtagctgggactacaggcacgcgccaccacgcccagctaatttttgtgtttttagcagagacggagtttcaccatattgtccgggctggtctcaaactcctgacctcatgatccgcccacctcagccttccaaagtgctgagattacaggcgtgagccaccccacctggccctatttttctttttaatttattttttttagacagagtctcactccgtcacccaggctggagtgcagtggcgtgatctccgctcactrcaaccttcacctcctgggttcaagcaattatcgtgcctcagcctcttgagtagctgggattacaggcatctgccaccacgcctggctaatgcatctttagtagagacggggttttaccatgttggccaggctagtctcaaactcctgaggtcaagcgattcgcctgcctcggcctcccaaggtggggggattacaggcatgagccaccatgcccggccagaatctttgtttctgcatcaaggactagggaaggaaaagggccctcagagaaccagagagaaagagtgggaaatgcatggagaaaacataggttaaggcttttatgtctaacctcaacaccaatgggattagatcagggagatcactgattacatgattacctgtctaggcatttagacagtggtgaaccgatgaagatttttaggatggacaaacatgcttcaatctttaagaaccagatcaaatattctgtgctctgcaaagcctcccccaatttccctagtcagatttcaggctgctgcttctgaattctcattaacactttcagctgtaactccatgtgagactcaaatcctagtgtaggatgactttatattatgggtctctctctgtcgtcactagacttcattagcaagggtaaatactgtttcctgttcatctttacaccccatggggtagtgcttgccatgtgatattaagtaaatgaatgaagtcagcatgaaagcaagttggagaccacatctgtttggttcatcattatagaccccgctgctagcatgatgcttagcacgtggaaggcgctcagcaaacatttctggaatgagaaagaaaaagagagcataaaaggaagtttggaaaagcgaggcagaagatgagatgtcaggacatcagttgagaggggcggcagcagcaaggatgggcacgctgagggagcacactaggcaggggctgtgggctgataaaagggggcacatacttgtcccctgtttcagaaaaggggtctgaactaacatcacctcccctctcctactcagccccataaattataggaaataagtttgttttgttttaagagaagggaggccaagcgtggtggctgacactgataatcccagcactctgggaggctgaggcacaaacatagattgagctcaggagttcaaggccagtctgggcaacatggtaaaaccctatctctacaaaaaaatttgaaaattagccaggcgtggtggtgcattcctgtggtcccagctgctagggaggctgaggtgggaggatcgcttgagtctggggagcggtcatggctgcagtaagccacgatcatgccactgtactctaacctgggtgacagagcaagactctgtctcaacagaacagaactaaactaaactaaaataaaagtgaggccataattggctttgacagtaagaaagagatctttttgtggaccagaaactgtggaaaatccctgagacaatgaaagcagttaaaattgcacygcagagggaaaacccaccacagaggatgcctgggaaaaacaaggacaagggtaacacaaaggcagcaagaagtcctgggacactgcagaagttctgaagcaggagcagccacatggtgaaatcaacataagattaaatgtgggtgttaaaaatgtaagaacgatatgggtgagatagaaacgtaacacataacttctgtttcagtacaggggaagaaaatgaccatagaaaacataatcagtccaacaaaatgggggaagagaaaaataaagagagttcatggaaatagaaaacacaaaattagctgggtgtggtggtgcaagcttgtagttctagctactcaggaggctgagctgggaggattccctgagcccaggaagtcgaggctgcagtgagctataactgggctgctgcrctccaatatgggcaaaggagagagatcccatctctaaagaataaaataaataaataaaaattgaaaatacaaaaataaaacacaaaatggcaacaatcagtaagcctacttaggaaagagaatctcagaataaataaagttgttaacatgcattgttagtgaatgccacattcactaatctcaatacaatgtaataaaaaaatcacccaaccaaaaaagcccccaaatttatataccaaaattaaaaatcagccaggcgtggtagctcacgcctgtaatcctagcactttgggagtctgaggcgagtggatcacctgaggtcaggagttcgagaccagcctggccaacctggtgaaaccccgtctctactaaaaagacaaaattagctgggtgtggtggcaggtagctaaaatcccagctacttgggaggctgaggcacgagaagtgcttgaaaccgggaggcggaggttgcagtgagcctagactgcaccattgcactccagcctgggagtgcaaacagaacgaaactctgtctcaaaaaataaataaataaaataaaaatcatgcctcttaagcaagtctttgcttaagaagaagaaggggaaagagggagaaggagcaaaaatggatattgcctattaaaacctgtgagagttacccaaattcataattctaaattcatttattagaaaacaaagaaaaatgaaaatcaatagctaacctttttttccttttttttttttttttttttttttgagacaggttcttgctcattgcagcctcaaattcctggaatcaagcgatcctcccacctcagcttcctgagtactttttaaaaattctcttttgcagagatgrggatcttgctatgttgtgcaggctagtctcaaactgctggcctcaagcaatcctcctgcctcagcctcccaaagtgctgggattactggtgtgagccaccgcacctagcctgattaacctttcaatttaagaagctagggaaaaaacaaacaacaataaagaagaaggtggagagagagaggaggaggaaaatgaacaaagcagaaagaaggaattaatagagatatagccagatttaatgacacagaggaagtagcaacagcaaaataatagcgatgatcaggaaaaccaaaagttgttttttgaactaataatgtaattgctaacattttttgagtatttaatcatagagtttactaatgtattagccacaaaattaataactcttaatcctcacctcaatctcctgaagtaggttctattattatccctttagcagactagtaaattgaggcacagagaggttaagtaatttgcctaaggtaacatggtaaatgtcagacttaggatttgaatacagcagtctgagtgtagtctatactgtatattaatattgtatatcaacaaagtatacaaatatactactaaagctactatctttgaagtgaacaattaagaaaaaaagaagtcgggtgtggtggctcacgcctgtaatcccagcacattgagaggccaaggtgagaggatcacttgggctcagaggtttgagaccagactgggcaacataatgggaccccatctctaccaaaaattaaaaaattaaccaggtgtagtggcgcacaccagtagtcccagttactcaggaggctgagacaagagaatcacttctgcctaggaggttgaggctgcagtgagctgtgattgcaccactgtactccagcctgagtgacagagcgagaccctgtcttgaaaaagaaaaaagcacaaataaataacattcagatgaaaaggaaacgataactaaggaaaaaagaaccattttttaaagtataagaaaatttatgtacttctttataatgatacatttgaaaacctagggtttgtttcacaatttcataaggagaatgtatttaaaaagtcatttaaaggtcacttttatgatgttatctgtgagcctgttaaaaacaacagtggctgagggtggtggctcacgcctgtaatcscagcactttgggaggcctaggtgggtggatcacttgaggccaggagtgcaagaccagcctggtcaacatggtgaaaccctgtctctactaaaaaaatataaaaattagccaggtgtggtggtacacacctgtagtcccagctacttgaggcacaagaattgcttgaacctgagaggcagaggttgctgtgagctgagatcatgccacaacactccagcctgggcaacagagtgagactctgtcacaacagcaacagcaacaacaaaaaaaaaaaaaaaaaaggaaagaaaggtcacttaaagaaatggaaaagagtgatgtattacaactatacccagtaactagctatgggagtggagagagattgtcagagatggttctagaaacttctagacagtgagactggatgaagagcacatgttagttaattcaggtggaagattggaagtgttattggtatttgtgctacacaaacttcatgaggtggttagaaattcagtggtagagatgtacatttggattcaacaggttcaacaaatgctaactaactgctatgtctacttcacaaaaggcacgcatgagtagttactgttcatccttcagggtacaagcaaagctgtcattgtgcaacacctggttcacaatggatatattttgggtcaaaggatacacacacacacacacacacacacacacacacamaattttctagaaagaaaagtgaagtgtaggaggcagtctggacagttcacattaaaactgtcaaaaacaaagaaaaagaagtagacagtaacaagggctgtgggaacggaacaaatctataaaatttaaatagaatgcatgattcctaaatcataaagttcttataaacaaataataataaaaatgtatcaccttttaaaaacttatttcttttagagacaggatcttgctatgttggttagtttggtcttgaactcttggcctcaagcaatcctcccgccccggcctcccaaagtgctaggattacagagttgagccagtacacccagcctgtatagccttttatatacataaaaggcaaaggaaataggcaggctattcaaaatgaaaacaaatggacataaagtataggaaaaaggcccaactttgcagatagtgaaacatatatagttaaggagatagaacttcttgctcagcaaaagagaagagatgtgggaggctgacatacccattgttcagaaggctctggaaaatatagtttccaggcaccgttgataggagtagaaataaatacaacctttctgcagggcagcctggccttgtgtatcacagttcaagtgtgcatcctttttgatccagcaattccacttctgcttatcccaacgtcagactagattgagtgtgcacttttcagtttgtttcgtataaccagttggtcaaaaggttaattatgatgcatcagtactatggaactctaggctgccgtgaaaaaaaaatatgtggccatccttagtgaataatgtaaatatgtgacacaggcaacatatgagcagtataataacaatatattgataattcaaaataaggttccaaaatagaatatatagcctgagcccacagacacaaaattgtgtgtgcatagcaagctgtctataatggcgggtacttgtcatgacttgtagccttttttcttttttttgagatggagtcttgctctgtcacccaggctggagtgcagtggcacaatctaggctcactgcagcctccacctcccaggttcaagcaattctcctgccttagcctcccaagtagctgggactgcaggcgcgcgccgccatgcccggctagttttgtatttttagtagagacagggtttctccacgttggctaggctggtcctgaactcccaaccccaggtgatccgcccgcctcggcatcccaaagtgctgggattacaggcatgagccactgcgcccggccttctacgtctctttctgtatttctcaaattatctatatgaatgcatgttaacttcatatttgggaaaggaaagtaaatctcttcatttcagaaaaaaatatttaaaagtcgtgaaactccaagggaaaactcaagaatcagtcccttgtattaactccataatgaacagatttccttttgtggcctttctcttttatgatttttctgcatggttttaggatttctagagtgacattttatatctgagagtagactcaataatgaaataaaatatttgactatgatttgatttctccattaataaaaggaccaaaattgcttttttagttatatagaatatcctctgagacctatgcataataaaagtacttgtctacacgtttcctgaaaatatgtacatctattatatatcagtttaaacattttaaaagtgatgtctaggccgggcgtagtggctcacacctgtaatcgcagcactttgggaggccggggtggtgtgggatcacttgagcccaggagtttgagaccaccctggacaacatagtgagactttgtctttacaaaaaataaaaaaattagcagggtgtggtggagcctgcttgtggtcccagctactcaggaggttaaggtgggaggattgctcaaacccagaacatcaaggccacggtgaactatggttgtaccactgcactccagtctgggcaacagagcgagactctgtctcaaaaaataaacaaacaaacaacaaacaaacaaaaaagtaattgtctatatagaacaactgtttttatttaaataatttgtaatatgggcgcataacatgtgcatctacatcagatggtaatcagtgttctgtctctttcccacattcagatgtatcagaatgtggatggccgtgtttcggaatgtcctcacacctaccaaaacaggcracctttcagcagagagatggatttggggctactctctccrcagsctcaggtcgaagattcgtagaggaacaatttagttttaaggacttcatccctccacctatccctaacaggctgtagattaccaaaacaagattaatttcatcactaaaagaaaatctattatcaactgctgcttcaccagacttttctctagaagctgtctgcgtttactcttgttttcaaagggacttttgtaaaatcaaatcatcctgtcacaaggcaggaggagctgataatgaactttattggagcattgatctgcatccaaggccttctcaggctggcttgagtgaattgtgtacctgaagtacagtatattcttgtaaatacataaaacaaaagcattttgctaaggagaagctaatatgattttttaagtctatgttttaaaataatatgtaaatttttcagctatttagtgatatattttatgggtgggaataaaatttctactacagaattgcccattattgaattatttacatggtataattagggcaagtcttaactggagttcacgaamcccctgaaattgtgcacccatagccacctacacattccttccagagcacgtgtgcttttaccccaagatacaaggaatgtgtaggcagctatggttgtcacagcctaagatttctgcaacaacaggggttgtattgggggaagtttataatgaataggtgttctaccataaagagtaatacatcacctagacactttggcggccttcccagactcagggccagtcagaagtaacatggaggattagtattttcaataaagttactcttgtccccacagtccccttcattttatttttatttatttgtttgtttatttaatgttttagtgacagggtctcaccctgtctcccaggctggagtggagtggtgagatcacagctcactgcagcctgaaactcctggcctcaagcgatcctcccacctcagcctcctgagtggctgggactacaagcacaggccaccacgcccagctaatttttaaaattttttgtagagatagtgtcttgctatgctgtgcaggctggtcacaaattcttggcctcaaacagtcctcttgcctcagcctcctaaagtgctgggattacaggtgtgagccatggcgaccagccctctttgtcctttgaagcttagcaccctccatcctgtaggcttgtgaacttggtttgtgcccccgccccgcccacctccgcttacacgacaggtgccaccaaattctgcctcttctttctcctccacctcctgttgcatgtagtggtgagggacaagggatctggaaccggtcagcccaggttggaattctcttttcacctggccttagctgtgtcattggggcaagtaactcaacttctctagcctcagtttccttttctgaaaaatgggacactaatggcatctcttttatagagttgctggaataattagatgaattaaatatatacgtagcttagaaatatagaaatatagaacataaacatatacatcatgtagatcaatgcctggcacctcagtgtgacctaatagcatcatttgtgccttcctttatagttttaatcctttgcctagtaccaggtcaccataaactcccttagattaccagtccttttaatggcagcagcggcccatctggagtggccactgcaaagatgccagctgcagtgtgggagccacaggggctgtgcgctccgtggagctagtgggagccccgcccccttttgagatggcagggcgggagccccaccctcctgggagcagctgccaccagactagcggtggctgcagacttagacgtccctgcgctcccggccggggaagcccttcctgcccccactgctcacaagtgtctgctcttgctgcctggcctcttcccactcctggtggcactcagatttttgagcaaagttgaggctgagctcccccactgtcgccgccctgccaggtgtgtgcgcacttagggtggcgctgacatgccagccccctgctgccttggccccctctggactttggacaccgaccagcacaggagggaggccaagccggggctgagggtggctaggcatgggtctgcaggtgcccctcagcaggaacagtctaggcaccgtggatgacataatcgatggtagcgggaggcagataggctcctgggcagaaggagtcaggtccccagtgaagccccaccttcaagccagggactgcccgaagcatgggggccaagctgtcagttccgggtggggtccccagcagggagtgagaaattctggtgctttttcgctggcccatgcaccaacaatcggcatgcactttctcctttctgaagcccattaacctccccactccccgcacccacctccctgacccccacaactcagccagatttgcagagacctcaggacaacttgcctgtggaagggagctacccacttcaggtctcctgagagctgttctgttgctcagtgaagctcctccctgccttgttcaccctccacatgtgcgagtacctcattcttcctggacactggacaagaacttcggacccactgaatgatgggactgaaagaactgtaacaacctggtgacaagggaagaagacgtggcccttcagggggcccagacctcgagctccccaagccagggctctgacagcctctttggggctctgtggttcctggcgtctccaagctgccaggccaccgtgttccccttgtccagacatggatgcctgcagcagaagcggcatgtgttatatctaacccagctgtagcctcaccctgagctggcacctgtgccagtgcctggagctgcccaccccgctgcagcagccagcgtgcctggctgcacacagtggtcggacccttggtcactaacccacgcacccctcctggctctgcgcctggctcgcccttggcaggtgtgggatctgggcccatattgcaagctgagccagactgctgggctgagtgggtggaataagcccagaggctgcgagcaatactcaggcagaaggcatcgcgagccacaaaggtttccagctggcaaagcaacaccccaaggatcctgtgactccttcctcacctaactcttcctccaatctctccaccattcagtgttttctctaagccactgccaggttcatcttcctaaagtactgatttgcatatgtcgctgcctgcagggcttcctgggatctagcagctagttcccagggtctagcagcaaaagccacactctcttcctagcactccatgcacccacagcctggcctcagcattgctcagcactggctgcttagcctgtccctctagcgagtgtgtcttgaacattcccacctctggttttcctctccttggaatgtcaacttctgctcttcctagttacatccttgcttcctgaccagacttcagctctttcttctccttcaggtcttcgccagtttccgagcccatgagtgacggcttcctgcactgaaatgtaagggcttctggtctgtatctcaatgtagagcctgcctaccttatgctgttatttatcttcttaagtaaatgtcctgtcttcttaacaggattttaagaagtttgaaagcagatatgatttatgccaagttgtatgcttaactctgatttgggtatacagtcaagatacaataagtatacatagtcaatcacttttttacctactcaagtaaaaacataaaatacgcttgatgttaaaaatcaaatcattttgacccggcgcagtggcgcagtggctcacgcctgtaatcccagcactttgggaggctgaggcaggtggatcaccaggtcaggagttcaagaccagcctggccaagacagtgaaaccccctctctactaaaaaatacaaaaattagccaggcgtggtggcrggtgcctgtaatcccagctacttgggagcctgaggcagagaattgtttgaacccaggagacggaggttgcagtgagccgagatcatgccactgctctccagcctgagcgacagagcgagactctgtctcaaaaaaaaaaaaaataataaactattttttatttttacctataataataagtgggaccttttatttgtacaacccaaatcccaaaatactacttcgggaaaactactgataaagtttgaggtattggctggatgcagtggttcatgcctgtaatctcagcactttaggaggcggagatgggaggatcacttgaggccaagagttcaagaccagcctgggcaatgtggtgagagacccccatctctacagaaattaaaaaaaaaacgtaaaaactagctgggagtggtggtgtgtatccatagtcccagctacttgggaggctatggtgggaggattgctcaaaggagttcaaggctgtggtgagccatgatcacaccattgcactccagcctgggctacagagtgagaccctgtctctgaaaaaataaaaaagtttgaggtatatttcccccatcttcttgttaaatatatttacatggcagggcacagtagctcacacctgtaatcccagcactttgggaagccgaggcgggtggatcacctgaggttgggagtttgagaccagcctgaccaacatggagaaaccccgtctccactaaaaatacaaaattagcggggcatggtggcgcatccctgtaaatcccagctacttgggaggctgaggcaggagaatcacttgaatccaggaggtggaggttgtggtgagccgagatggagccattacactccagcctgggcaacaagagcaaaactccatctcaaaaaaatatatatatatgtatgtatattatataaatataaatatatatatttatataaatatatatatttatatacatataaatataaatatatatatttatatacatatatatatttatatttatatacatatgtatataaatatatatatttatgtatataaatatatatatttatatgtatataaatatatatatttatgtatataaatatatatatttatatgtatataaatatatatatctatatgtatataaatatatatttttatatgtatataaatatatatttttatatgtatataaatatagatttttatatgtatataaatatatatttatatgtatataaatatatatttatatgtatataaatatatatttatatgtatataaatatatataacatatatttatatataaatatatatatatttttatatatgtatataaatatatatatttatatgtatataaatatatataaatatatataacatatatttatgtatatataacatatatttatatataaatatatatatttatatatatataactgcacacacatagttacatatacacacacacacacatcttttttatgtaaatgaaatcatactggctatattgtcagacatgccttttattctttacaatgtgtcaatatttgcccaatatgtgtatctgtgaagggcttgttatgtgcagggaactagatgtgtgttatctcatttaatcttcctaactaccttatgaattaggttctaaacttataccaattttttctgaggaaattgaaacttgagctaataacttgctgtctccagtcccctgttaacacttaccttgagatgactgttgggttctactattatgtgattttctgtatttccttacttttctttcttagctttttgtaattctcattttgtctctttttatcatatctgtctattttttattgtggtaaaaaaacccacataaaatgtacaacctcttaaggagaaatgaaaatcaactcttattaaaccaaattcttaccacagattctatttcagtttgggtcaagttttgtacctgacataactacctatttttaacaccgaggaggaatgcaacttgctgttcctacataggctgttgctgcacaagggcagccctttccactaggcctttgtagtaatcttgccagcagctggcgccctagcacttctttaaaaaattgatctcaggccctaggcctgacttcgcgactacgccctgcctgcccctggaaaggcagattttaagtagcagaatgaaagaaaaagccaatccgctgattcgaaggaaaacaaccctctatgcagatagcttcaattcatttcttcagtattcagttgggttttaaaagttttattttaaactgacaaataataattgtatctacttatggggtacaatgtgatgtttcaatacatgtaaacattgtgggatgatgaagtcagggtaattagtatatccatcgcctcaaatatttatttatttatgattattatcattttttgagatggagtcttgctctttcgcccaggctggagtgcagtggtgtgatctctgttcactgcaacctccgcctcctggattcaagtgattctcatggcctcagtctcccgagtagctgggattacaggtgtgtgccaccacgcccagctaatttttgtatttttagtagagacgaggtttcaccatgctggccaggctgctctcgaactcctgacctcaggtgatctaattgcctcagccttccaaagggctaggattacaggtgtgagccaccacgcccggcctcaaatatttattatttatttgtggtgagaacatttaaaaccctgtgttttcgccattttggagtatacaatacattcctattaactacagtcattgtgttgtacaatagaacaccagagcttatgcctgctgtctaacggaaactttggaccctttgacaaacttctcccctca

SEQ ID NO: 17810 - DNA, 66916 bp, Homo sapiens
  misc_feature (1)...(66916): n = A,T,C or G, or insertion/deletion polymorphism (see Tables 1-2)
aattatgtaaagtggttagaaatgggctagtgcatagtaaacaatgcagaaatagtacctgctatttttttaaactttttttcaaggacccgttgctttgctttgatttgccttccacttacccatttattcatttttttgagatagagtctcgctctgttgcccaggctggaatgcagtggcacaatcttagctcactgcaacctttgcctcctgggttcaagtgattctcctgcctcagcttcccgagtagctgggattacaggcacctgccaccaggcccggctaatttttgtatttttagtacagacagggtttcaccctgttggccaggctggtctcaaactcctgacttcaagtgatctgcccgcctcggcctcccaaagtgttgggattacaggcgagagccaccgcacccgactacccatttattcttgatcgttcaggttttcaagatctttatgttttcaacggccggtgtgtattgagaaaggctgagcaattctgttccagggagggaagttctgagagagagggatgggggaggaactggagctggagagctgaagctgcagcagtggtgacttcgagagagtcactgtgtaacctctggcaagggggaaggagtggacaggaagaaagttcttgtctggttccttgcaccctcagccccagcctcctccttcatatcccttctctctcccccacatcgtctcccacacggccccagagggatcttcctccacccagaactgaccctactcacagccttctagggctcccaccacccccagataaagtcccaactcctgtactcagccctgccagatccagcccttgacaccactgcagcctcatgtcctgcctttccttacacactaacttctccagcctgacctcggcccatgggctgtccctgggctgtggcactggagaggctctgctttgagcagctcgagagagtgagggagctagacatgacggctccaagatatcgttcctgaaccggctcatcaaccacctgctcccgcactccccattcagagaccatctcatcatctacccagtcccaggagtgtacccagggccctgtcctcgccccctccatagtcctgtctctcctgctccttggctgtctctgatatttgtagagcacttgggacagtacctgcacatagtaaacctagtgtgtctgttagctcacatactatacatacataaacatatcaacaaaattcttcaaggttctgcttactggttacctcttccaggaagccttccagaaccacccagtaagctttcaggtggagctgaccactccctttgtatcctcctctcatctccccctcaatctcactctcactactatgggccactatctataatttttttttgttttttggtctttgtctaccccattaagttctgaactgttcaagagccgagatcagtcttggattctaaacgtccagtgaagggcatgcacatagtaggtgctcaataagcatttgttacattggaactgggttctgttaataggtttcagattaggcctgagcttctttgagcttcttgcaagctctaacgttctaggtttctgggtgatgtgtgtgtttgatgctgttccactttcagatctccgagtctctgtttctagaataagtagtgagaaagaagttgcaagaatgtatttcacaatacatgtttaaataactaccggtgaaagagctgttaagagtgtgcttactctgtgctggatgcctttctgaataatttacctatgagatagacactattatgtctcccattttccacatgaggaaactgaggccacagaaaggtgaagtcactcactcaacagcatccaccaagcatcagcagcgcaatggcccagagtccatgctctcgaatcctgtaacagctatcacttaaccagccaccccatgttccaggcaccagggttatgtgtttttctcatgtatgatctcacagtatcctcacaatggccccatgaggcgggtatcgtgataaccccatttcaaaggatgagaaaactgaggcttggagatgtgaagtccattgcccaaagtcacccatccaggaagtcgtggagcatgtctcaggcagcctaaaggcagagcctgtgttcttaagcactctgttcttgtctacagctccccaaccaagggtctcaaactcacacacctactgggaccaggcaggcaaaacaagcaaaagacagtgctagggatgaggcagcagagagtggcagggtttggggcaaacctgggcagcaaagccccatccaagaggggtggccgtctgccaatggaaacatgggctcacctcttccggtgttccagtggaagctggaaacctaactgtgtggggaacaacccctgtttaaaactggggtcagaccaggcaccgtggctcacacctgtaatcccagcactttgggaggccaaggcaggcagatcacctgaggtcgggagttcaagaccagcctggccaacatggtgaaaccctaaaaatacaaaaattagctgggcatggtggcgcatgcctgtaatcccagctactggggaggctaaggcaggagaattgcttgagcccaggaggctgaggttgcagtgagtggagattgtgccactgcactccagtgtggatggcagagcaagactccgtctcaaataaaataaaataaaataaagtaaaataaaattggggtcaatttggctgggtgtggtggctcatgcctgtaatcccagcattctgggaggccgaggtgggcagatcacctcagcctccttgaggtcaggagttcgagaccagcctggccaacatggtgacaccccatctctactacaaatacaaaaattaggtgggcatagtggcacacacctgtagtcccagctacttgggaggctgaggtgggggaatctcttgaacccaggagttggaggttgcagggagccaagatcgcactactgctctccagcctgggcaacagagtaagaccctgtctcaaaaaaataaagactaaataaaatacaattggggtccattaaaatacccctggccacctgggtgtgattctggctctcctggatttctcacctgcccctctttgcacagttgtagggaactacctgtgagcttgttcttttaacgtcaatctttctgtccagtcagaaagtaccagaagggcagggatttttgtctcttgcccaactccatcgctccaactagaatatccccagcccacagcatgggacctggccccttattcactgaatagatggatccttttctttatcctgcggcttctctgcagttcagtctcccagtctctgtctcccagtctttgtcacgtgtacaaaacctggctcttctgtttccctggctgtctctggtgtctctgcctccatgtctccatgtttctggaattttccgtgactattttctcctcttggggtgtgtgtgttttacgctctgcctctcgaagtctctattacattctgtaagtcaggccgggcacagtggctcgcggctgtaatcccagcactttgggaggcaagacgggcagatcacctgaggtcatgagtttgagaccagcctggccaacatggtgaaaccccatctctacaaaaatccaaaaattggccaggcgtggtggcgcgtgcctgtaatcccagctactcaggaggttgaggcaggagaaacaacgcttgaactcgggaggtggaggttgcagtgagccgagattgtgccattgcactccagcctgagtgacagagcaagactctgtctcaaaaaaacaacacaaagcaaaacaaaacaaaaacaaaaacaaaaaaccacacaaaaattagccgggcatgatggcaggtgcctgtagtcctagctactcgggaggctgaggcgggagaatcacttgaacctaggaggtggaggctgcagatggcaccactgcactcaagcctgggcgacagagcgagactccatctcgaaaaaaaaaaaaaagtctgtaagtcgggcccacaccatctcttgctccgtgagtatctttgtctctctagctcctcttcttctctcagtacatgtccctccttgactcccgcctctctgcaaggtgtatttggctgcctcagttggcctctccccctctgcatctctgggtggggtgttctctgcccgtctcccacccacacccacccccggtgctccccttccccccagcaggacagcggctcaggttcacgcaccccacggcgggccggctgggcgcacgcacgtccttgcacacaagccgcacgtagctgtacttgagcacgtcgatgagcgtgtagagcgggggcgcactggcccagcggcagcgcgccaggtgcatggagctcttgacgaagaagagcgccagccgctgctggcaccacgcgtcgaagaagcggctgaactcggcccacgagaagaaggcccgctcccgcagctcctgctcctcctgccccgcagccgtgccgggtgggggctccggccgctccatcctgggggcctgcgtggaggaggggagaacaggtggatatcagacccattcccacccggggtatctcatctactccattcttggcctgccccgtcggttgctggtgcctctatcgaggtgggtagcccggggtcggacgtgcctgtttttctccaaatatataaatatcaacctccatcctatctttggcctcctcccaccgccttatccctggttcacttggagcctgtcatcttgattcctaattccaactcgtctcctcctccgcagatgtgacccttaggtacagttggaatctctcctcccaaaatacgacccttaagctcagatgtcccttaaggacatctcctcaaatgtgttctcaaattccagctaaaacctcctccccttccagctgtgtctctcacccaagagtaacttctaactctcgtattcatctggaactcctccttccatgtgccaacagttggctgtaacccctccaaagacgctccatctccagatgtgctcccacatccaggccacggacccctcacccggtcacatgcttcatgcacctgtggctccgcactccccagatgtgcctctggcgtgcagctgttgccccttcccccgattatgaccctatggctcgccacatgcagctgtagctggggcttccctgagacactctcatctccagatgtactccccacatgcagttatccacgcttcgcctacaggtgtgtgccccacttgtggctagttctcctcggaagtgtcaccagtattcacctgtggtcccctcctcctcagatgcggcccccagtccagctgtgggcccctcctcccagttacatccaccatcccccgcaatatgcatcttcgttctagacatggcccctcgtcctcggatgggctccttcaccccagatgctccccccacgtccagctgcgcgtctcccctcgagcagccccatccagcccgctcccgaccctcctactccccccctccccgcccgctgcggcaccttccagccccgccgtcccacctagctgtgcctctcccctccccaagatgtgcacccttcccgcccctccccactcacctacccgccccggagcggcgtccacctcccacaatgccccgcgcccaggcctggcccggcccttgctcccgggatgccccgcgcggtctcccgcctctcttcccgccgtgcctcgcgggggcgcttccaccgattcctcctctttccctgccagtcactcctcagaccctcagccacacccgctcatccagggcgagggaaagcgcgggcattttcccagtgtgctctgcgggagggctcgccccacttcaccccttttcccgccctcctcccattcgggagactacgactcccagtgtcctccgcgcgacggcggcggtgcggacggtgcccaggtcccgcccctaggctctgccccgcccccgcccgcagacgtctgcgcgcgaatgccgtggcgcgaacttgggactgcagaggcgcgcctggcggatctgagtgtgttgcccgggcagcggcgcgcgggaccaacgcaaggcaagtggggccgtccgcaagcagatgggaggcggagggcggcgggtgcgccgaatgcttggggcctatgcttcgccatgtcggggtgtctgcagaggagtgggcgtggggacgctgaggctgccgagagcgcggtggagacggaagagcgcgggctgcgggccgccggagagtgcagagaggtgtctcccagagggaggggggccaggtagagggtagacgagagacagagacagttggacaggtcctctgagaagaggccttgaggtgcgagttcacctggaagggggagaggccaaatggaactgaggggcggggccggggggggggaaaactgtgtgggcggggccagctggaaatcggaaggccccccgagggggcggggctatctgggagggggaggggctgaagggagctaaggggcggggccggggaaaagattgcgtgtgggcggggccacctggaagggggaggtgccaagggtggggctggctgggarccggaagtgctgagggggcgggggccacctggaagtgctgagggggcggggctagaagaaggtaaatcgcgggcagcagcatcacctggaaggagtgggccctactggagggagatgggtggtgtcagggagaggtcagtggtaaggtccaggtctaggtaaagggctcgtaaaagatggagaatcatctgaatggggagacgtctggcctaatgtatgcttgataaagggatggagcttacctcttgtttttactttttattttgaaataattatagattcaaggaagttgtgaaaagagtatatccatcttcccctaatggtgacatcttatgtagtcccaatatcgaaaccaggaaattgacatcaatacagttctgttaactagattacagaccttgttcagttttcaccagtttgtgtggtgtgagtgtgattgtgcatctgtgtgcccgtgcagcttgattccttgtatagatttgtgtaacccccatcgtaattgtgatatagaacagttccctctccacataagaactcctccccaggcccctggcaaccgctaatgtgttcaccatctctagttttgtcattcggagattgttatgtaaatggaatcatatattattaggatgttaccttttttctactctgcacaatgccctggaggtccacccaagttgttgcttgtatcagtgcttcgtttctttttattactgagtactgtttcatccttacttgatatttttcctgtcattatctcttcattttggtaaccgctttattgagatataattcacaattatacagtttgcccatttaaagtgtacaattttgcccatttaaaatgtacaagtcagtggttttcagtgtatttaaagtgtatttcagtgtatttaaagtgcccatttaaagtgtacaagtcagtggttttcagtgtatgcgctgagttgtgcagttattaccataatcgattttaggatatttttatcatccccccaaaaaactcctataccttttatccatcattcatttaattttaaccctgaacaatattctaccatatggtattccagtaatgagggaaccagttccctaagggtagacattccaccagtttccagtcttctctcattacagttagtgctgcagcaggtaactttgtgcctcacttggtccacctgtgagggtctctgtgggccaaatacacagaagtggggttgccgttccgatagagacgccaggtggtcctccagaggcatcaaccagtttgttccccccaactcagcagtacacagagttgagaagccagccttgagtaccgtggtaaggagaaaggaacgtgggctttggagccagccacaccgggttttgaagccttgcctgaaccccagctatgytcctctgtcctcaktaccttcatctataaagtggggatgatctcacctgtcttggagggctgacttgaggattgagggtatttgagaatgtgatcagcctgtcaggcatagagtaggcttcccagtaaacgcttatgtatttctccttcccttgcaactcagtctggtggttaagaggtgagctgtggagcaggccgacytggggtggaacgtactatagatgcaggttaagttcctttgaaaacccctctgtgccttagtttctgtaacagagttgttgtggagagtcagtataattgagaatgtcaagtacctaggcagttgagcactcaggagggatcgtaatagttttctcctttgccctcaggattttggtggctaagtccctaacctgctttctgtgtgaactgtttggttgaagcattgcttacttcctgctccccaactggccctgagaaactctgtttggaaattgctgagtttcttttttgtttgtttttgttttgttttttttttttttaagacggagtctcgctctgtcgcccaggctggagtccagtggtgcagtctcagctcactgcaacctctgcctcctgggatcaagtgattctcctgcctcagcctcctgagtagttgggattacaggctggcaccaccatgcctggctaattttttgcatttttagtagagatggggtttcaccatgcgggccaggctggtcttgaactcctgacctcgtgatccgcctgtctcagccttccaaagtgctgggagtacaggcgtgagccacagcgccggcctactgagttttttgattccaaaattgagtttgagttgtggtgccaacatgtggcggccaaggctgtagagagtagtggagacttagaggygtgtggtgcgggacagagagtactgattccagaaaacgaaaggggaccccatgggttgaagaagatttctgtgcaaaggaagggaaagtcaaagaaaaccatttctgttgcccaggctggtctgagctggtctcaactcaagcaatccacgcagaggtcctgctagtccttttttaaaaaatatattcatagtggaaggaaatataatgtaaataattataattacataattataatgtgtaatttattttcttccattataaatattaaagatatagaaaatttataattttttatatctttaatatttataatggaaggaaaggctcagttccaattagaagtttacaagaataaagtcgtaatttctttcctgtcaaatttcatagaccacttgagttctgctcttggactcctgggttttgtggaccccagattaagaaccctttcttttctttttctttttctttctttttctttcttttttttttttttgagacagagtgttactctgttgcccaggctagagtgcatgatctcactgcaacctccgcttcctgggttcaagtgattctcctgcctcagcctccccactagctgggattacaggtgtgcaccaccatacctggctaatttttgtatttttagtagagatgaggtttcaccatgctggccaggctggtctcgaactcctgacctcaggcgatccacccgcttcggcctcccaaaatgctgggattatgggcagcagccaccacgcccggcctaggaaccctttcattagagttactctaaactgtggaagccccagtgactgttattgatttcattaaataacagactttttaaaaaagtatttaatttttaaaaatatattgtgaaggggtaacgtattccaattgttctgcctgcaaaagcatgcatattaaaaaatctccctccagcgtctgtccctcctgagrcracagcattaccagttttttgtcttccaactgagatgttctgtacatatacaagatatgtggatacatttatagtctttcttttgtttttgttttttgagatggagtttcactcttgtccaggctggagtgcagtagcacaatctcgggtcactgcagcctctacctcccgggttcaagcgattctcctgcctcagcctccagagtagctgggaatacaggcgcgtgccaccgcacctggctaatttttgtatttttagtagagacagggttttgccatgttagccaggctggtcttgaactcctgacctcaagtgatccacccacctcggcctcccaaagtgctgggatgacaggcgtgagctactgtgcctggcctatagcctttctcttttacacagttcagtagcacacactctgtgatattctgccctttgtttgaaataacagcataccttagaaactgcccaagagctartttatgtagaccagcgggtacaattttataagcttccacagttgtttcacggaattatgtcatcaccttaaaacaatttttcactaacctttaaacttaactccaaaaaaacccatttcaggtcctcagtctattcctcatattagatgaaaaacagtcttcttatggtaaaggaggcctcttatctttttctctgatttggagcttttattctgcaccagtaaatctcaccagcaaattattttggttcataaaaacaggagtttctttttgaaggggaaattcatgtttctgtttttttttttttctttctttcttaaagaaagggttttatgtgtgtttagatctctgcacaaccartcacctcaacaagtgtttggatttctgttccaggagcagctgacagacgaagaaaagtgctggacaggaagggagaattctgaygccaacatgcagcgaagtatcatgtgagcaccctyccttgcccctgagtctttccttctccaagtcctctgtttctttctctaaatctgtacttaaaaaaacaaacaaacaaacaaaaacycttacgttagattttgagttggaatttccaggagtcaagtagtatggaaaatgagccgtgggatatggaagacagtgtattgaacaacagtttttagttgcaaggagcagaaaccctaacgcagtggttctcagtcagcagcaattttgctccccagggaacatctggcagcgtctggagattttttttttttgagttggagtcttgctctgtcacccaggctggagtacagtggcgcaatctcggctcactgcaacctccgcctcatgagttcaagtgattctcctgcctcagcctcctgagtagctgggattataggcacgtgccaccacgcctggctaatttttgtatttttagtagagacggggtttcaccacgttggtcaggctggtctcaaactcctgacctcgtgatccgcccacctcggcctcccagagtgctgggatttcaggcgtgagccacggcgcccggccagtgtctggagatatttttggttgttacaacctagggacagagggtttgccattggcatctagtggctaaaagccaggcatgctgctaaacatccttcarttcataggacagcccccccaacaacacagaaccatcaggcccaacatgtcaatagtgtctaggttgagaaacctcgtgttaatgcagtccggcttcaggaagacaagaaagggcatgacttgacttatatcattgaaacctgctggagtaaacagcctcaggcttggttcgatccagttgccaaaacttcctccctgggaatctgtctctctccattgttcagctctactgtccttgaggttgtcctcaccctcaggcgggctctcccctcttagcggtccccttggaaagakggtgttagagcccagtttcactggcccagcctgggccacatacctatccctgaaccagccacagggatgcagcctggatcacgtgtccacccctggtcacaggcraaagggccagcccactcaaatcgtgtgtactgagagaatgtggggtaagaagcatcccaagaggaaaacggaggggctgttaccaggaggaaaaaatggatggtagagagacccagacaagggcatccatcccagaaacctgggcggtagtggcttacacaaatgctgggttccgtttttctcccgtgatgaggaatctggggattgtctctccagggctgatggtgccttcgattgctttctgtccactggcttttgcatgatttttccttttctttttgaagattaaataaacctcttattctggaataattttagaggtacaggaaagttgcaaagacagtacagagaggtcctgtatacccttggccagtttccattgtcaatatcatacattactatgatccgtttctcaccactgagatactaatgtcagtacattactcktaactgaactccatactttattattcagatttcaccagattttttttttaatgttcacgccttccaacatttttttttttttttttttgagacagagtcttgctctgtcgcccaggctggagtgcagtggcgcgatcttggctcactgtaagctctgcctcccaggttcaggccattcccctgcctcagcctcctgagtagctgggactacaggcgcctgccaccacacccagctaattttttttgtatttttagtagaagcagggtttcaccgtgttagccaggatggtcttgatctcctgacctygtgatccgcccacctcggcctcccaaagtgttgggattacaggtgtgagccaccatgccaggcmccaacattttatatttagttgtttgcttaatatttctgcccttcaccagagtgttagcttcttgaaggcaggaacttcgtgtgtctgggtcactgccaaacccctcaggcccagaacaggccctggcacataataagtgcttaggtaggccgggcgcagtggctcacacctgtaatcccagcactttgggaggcaggaggatcacctgagatcaggagttcgagaccagcctgaccaacatggtgaaaccccttctctactaaatgaaaaaaattagccgggcgtggtggcggccacctgtaatctcagctactcaggaggctgaggcaggagaaacacttgaaactgggaggccgaggttgcagtgagccgagattgcaccattgcactccacccttgggcaacaagagtgaaaactccatctcaaaaaaaaaaatttttttaggctgggcgcgggggcacatgcctgtaatcccaacactttgggaggccagggtgggtggatcacctaaggtcaggagtttgagactggcctggccaacatggagaaaacccgtgtctaccaaaaatacaaaaaaaattagctgggcgttgtggtgggcacctgtaatcccagctactcgggaggctgaggcaggagaatcgcttgaacctgggaggcagaagttgcagtgagccgagatcacaccattgcactctagcctgggcaacagagcgagagtctgtctaaaaaaaaaagatttaaaaagtgcatagttaatatttgttgaataaaacttgggatgtatcatatcttgcaggtgcgttagggcagaaaaattagtgttgcctcctttgtctgagtctgagtttccttatcagttaagttaaagggcttatttgaaattctctgttatgtgctgagatggaaatggtgttagaagttataggatgcggccgggcgcggtggcttaygcctgtaatcccagcacattgggaggccaagcagatcacaaggtcaggagatcgagaccatcctggctaacacggtgataccccatctctactaaaaatacaaaaaattagctgggcatggtggcgggtgcctgtagttccagctacttgggaggctgaggcaggagaatggcatgcacccaggaggcggagcttgcagtgagctgagattgcgccattgcactccagcctgggctacagagcgagactctgtctcaaaaaaaaaaaaaaaaaaggaagttataggatacagcatagataggcagggtattggtgctgttattctcctttttttacccccttttatgctcctctaggtcatttttccaccccaagaaagagggtaaagcaaagaagcctgagaaggaggcatccaatagcagcagagagacggagccccctccaaagtatgtcacagggctgggatatggtgaattttttcctttagcagtcaggattgtcttggttgcaagtgttcaaacctaatgcaaaatgtcttggggcccaaaaaactttttcagccaggtggccagaagtccaagagcaagagcagctgcaggcacagctggatccagggcctcggagttgtctgtacgtctctgtttctgcaggtcttggcctcgttctagaaccagacattctccataatgcagagaagctggccgctggccactggccacgtcttgatgctgtctcatctaagtagaagacaacagtactcttttttttttgaaatggagtctcactctcacccaggctggagtgcaatggygtgatctcggcccactgcactccagcctgggcgacagagcaagattccatctcaaaaaaaaaaaaaaaaaaggcatcccaatagatgctggagaccaatggcaaccttaggcagggactccatttgctcctcagcatcacccatcacagggcaggcactctggagacttccagagatgtgtgatgggtgggtgagtggatgagtgggygggtggattaatgcactgatggatgaaatgatgagatttgctgaggagacaaccagaaaatgttcattggatgcttgaaaggaagggaaggaaacagcaaagaaaccaaagtgtttgygggcagtgcccccactctgcctgctgtagtygcccctttacacccccatttccccaccttccagggcggcactgaaggagtggaatggagtggtgtccgagagtgactctccggtgaagaggccagggaggaaggcggcccgggtcctgggcagcgaaggggaagaggaggatgaagcccttagccctgctaaaggccaggtaggtccccatcaccctgcccatttttaccagaagaaactaattcccattaacctttggaacagagtgcagcagctgttcaggagaattctggagaaattgcccgggagaggtagatgtgtttcctggttgtgtcgggggcagacacaacctggtcctaattgcccctgccctaggacctcgggtgggctccttcaccacgttaggtcttggatgcctcaactgtaacatgcagctcctggtaacaccttcctcatagggtgactgggaagatgaaatgagtcgatttacatacagatctgagaataatgcctgatggtaaaacaagggctcaaggcccagcacaatggcttacgtctgtaatcccagcacgttgggaggccaacgtgggaggatcacttgaggccaggagttcgagaccaggctgggcaacatagcgagaccccatctctacaaaaaaatgttttaaaaattagccaggtgtggtggtgcatgcctgtggtgctatctccttgagaggctgaggcaggaggatcgcttgagcccgggtgttcaaggctgcagtgaactgtgattgtaccactgtactccagccggggtgacagagcaagaccttgcttcaaaaaaaaaaaagcaaaaaaataagggttcaaaagtatatctagcctctcctgtggtcagagggctttttaacttctccaaatacattggaccactctcttcccctgtttaagtcatttaatgcttgttcattgctttgtggatgatgtccaaagcgtggtgctgcttattctgtcagtggtgaggtcaggtcctgtgactccctgcccaaaccccctggtattaccaccacaggccaaagccaggccttgtggaaacctcccaggcccctcctgctgctcctctcttcccccgcccatcacatctgcagccgcatccacagctcctcctcagctcrctccatcctggcttcccacaccyaccaggtgcacttccacctctgggccactaccttctttcccagcctaaaactctctttcccagatacacgcctggctcagtcccctgctttcttccatgctttgctcagatatcacttcctcagcgaaactttcctcaccacctatgttagcttcccatttgctgccataacaattgaccacaaacrcagtggcttaaaacagtgtcagtttattgtcttacagtttgggagtcgtgagtctcaaatgggttgcactgggctaaactcaaggtgtcagcaggtctgcgttcatttctgggggctctgggggagaatccaggaattgccttttccagctgctagagatccccttttctccgttttcaaagcaagtggctgggtgtggtggctcacgcctgtaatcccagcactttgggaggccgaggcaggcagatcacaaggtccggagattgagaccatcctggctaacatggtgaaaccatgtctctatcaaaaatacaaaaaattagctgggcgtggtggcgggcgcctgtagtcccagctactcgggaggmtgaggcaggagaatggcgtgaacccgggaggcggagcttgcagtgagccaagatcgtgccactgcactccagcctgggtgacagagcaagactctgtctcaaaaaataaataaataaataaataaataagcaagtggcattgcctccttctgtgcctttcttctgtggccacatctcaccctgactttcctctcctgccaccctcttccactttgaaggcccctgtgactatatcaggcccacctggatagtccagggtaatcccactatcggaaggtcagctgattagcaacctcaattaccctttgcyatgtaacctaacatattcccaggttccaggtattagaatagagatctcttttggagcttagactttaccctgaggcttctggggagctaggaagagttttgggcagaagagaggcagagatcatttagtcctgggcagtgtttaaaatattcatctggccaggcaygatggctcacgcctgtaatcccarcactttgggaggccaaggcgggtggatcacgaggtcagaagttcgagagcagccaggccaacatagtgaaacctcatctctgctacaaaagttagccgggcatggtggcacgggcctgtagtcccagctacttgggaggctgaggcaggagaattgcttgaacctgggagatggaggttgtggtgagccgagatcgtgccattgcactccagcctgaacaacagggcaagactccatctcaaaaaaaaaaaaaaattatctgagacctgtatctccatcagggtctcaatgggagacagaaaccataccagtgatttgaacagagggagtttaaaggatggtcactaggtatgcagttgttaaataggtaactgaagggctaaaaagagaactaactctaaggcatcatggaggtagcaactgtggggtgcagtgaccatccctgtggcttttgagctgaaattcacacctctgtggtgggactgctggcaggtctctgagcttagagaaggtgccccgagagcctgcaactctgatctttcaggaagggagcactgggtgggagatgccagggtctctgatcaggtaccacgtggcaagccccgtgaatgttagaaaaaactgtcagtgggatccagcagctgcccccggcaagccggctgtgcctccagtcatgcagtgccctctgcttccctccattggcactgcctgatgcccaggtggcgccagagcaagaagaagatttgtggagtcccggtcctggcagcatgaaggagactggacagtgacaggtttggagctgagagaaaatcacttaataactggcacagggccctgtaagaagataagtgagtggttgaaaccgagacacggtagcagtggcttaggcaagacgcaaacttatttttctctctcctgagtgcagagtccgggattcatgtgaccgtctcacagggtcagaggcccagrcttcctctgtgctgtcrtttgctctctgtagatgcccttgtccctgtgaacatccatattctgccaacaggaagaggagggcaccccactcaacattaagtggatgttatttgaaccaggaaatgcatgttagtccattttgcattgctataaaggaatacttcagaccagttaatttataaagaaaagaggtttattttggcccacggtcctgcaggctatacaagaagtatagtgccagcatctgcttctggtgagagcctcaggatgcttccagtcatggtggaaggtgaaggaggagcaggtgtgtcacatggcaagagaggaattttaaacaaccagctctcatgtgaaccaggagaggaagaactcggttcctaccacaaggagggtacaagccattcatgagggatctgcccacgtgacctgaatgcctcccgccaggtcatacctccaacattggagaccaaattgcaacatgcgatctggagggaacaaacatctaaactgtatggagagaaggctgggcacgggggctcacgcctgtattctcagtgctctggaggccaaggcgggaggatcgcttgagctcaggagttcgagaccagcctggccaacgtggtgaagccccatctctataaaaaaaatacaaaaattagctgggcgtggtggcgggcgcctgttatcccagttgctcgggaggctgaggcaggagaattgcttgaacctgggaggcagaggttgcagtgagccgagatcgcgccactgcactccagcctgggcgacagaatgacaccctgtctcaataaataaataaataaaaataaaactatacgaagaggtgtacatcatttcccctgacatcccattgtgtagagctggccaacatagtgaaaccccgtctctactaaaaatacaaaaattagccaggcatggtagtgcaggcctgtagtcccagctacttgggaggctgaagcaggagaatcgaagattctgttactgtagaaaacagaagagctatgggggtccttgatgggaccatgatcctgcactggagggcgggatgatggcccaggtgagaagaggccacccctgagttagggctgagaccayagggtcagaaaggagggtagacagagaggtttcagtcccctctactctcaacttttggaaaatggrgtccctccttcccccgctcactctagaactgttctttcctcttccagaagcctgccctggactgctcacaggtctccccgccccgtcctgccacatctcctgagaacaatgcttccctctctgacacctctcccatggacagttccccatcagggattcygaagcgtcgcacaggtgagaacacacgggcccctgccccttcagtcgcctgcctttctttttctcttttttttttttttttttttttttgagacatagtctcgctctgttgcctaggctggagtgcagtggcatgatctcggctcactgacctccgcctcccgggttcaaacgattctcctgccttagcctcctgagtagctgggactacaggagcccgccaccatgcctggctaatttttgtatttttagtagagacggggtttcactatgttggccaggctggtctcaaactcctgacctcgtgatccgcctgcctcagcctcccaaagtgctgggattacaggcgtgagccaccgcacccagccagtcgcctgcctttctccccacttggattcccatccaaggtagtcatccttacaacagctctggtcttagtgttgtggttaagagcacgggtccaccatccactggctgtatgacctgggacaaatgactgaccttctctgagcttaggttgctttatctgtagagatgatgataatgayagcacctaccgcacagaaatatctgagttagaagataacacgtgtacgctgctcagaactgggcccagccctcagtcggggctcagtcattgtgggtcattgtgactgtagttatgcgctgagatggaggcctcacagctcatgtgggaacacaagcgcggggccatggctcaagggagacttccagaagagaggctaaccaagctgagccctttaggacaaagaagaggcaacaagcaaaggaggaggggagcatgctaggcaaggggaacatagaaattgagaaggcctgggggctgctgagggcctggtgtgctggcgtgtagagygcaggattggggatggtgagcaatgaggtgagaaggtcctggaaaaccagcttggggaacagcgtctttgtcctaagggggacttggaatgtttgctgtggggkaagaacagggcgagagacccattcgtaatgcggggcagtgtgagcccttgccgtccggtctagcctattgagcgctttagcgtggtgagtgtgacaggggagctgaatctttcatgttagatcctttcagttgaatttacatttgaaagctaatatgtgattcagtgcgtaaagactttgcactttttccacatcattttggaacagctttggtatgtgaatagctgtacattttatgaaacctacacagatcatgttgccgatgaaaatctggtgtccaacttgagatgtgcagtgagttcattggattttgaagacctagcatgaaaacagaatgttggaatcatactgttttagatgtattgagcaaaayagactcttcaaaccaagttcaacctggttttttccccctttttattaacgtggctgcaagaaagtttaaggttacatacgtggcttgccagatctttccatcggacgatgctgggtgacgcagggtactctgggagctcagaagtcaagcagcccaggggaggtgatggctgagccgagtcttagaagatgggttggggttggccatgttgagaaaggacagatgcatgcatttcagacaagaagggcacgtgcagaggcctcgagatgggaacagcatgggatgtttggggcctctcatctacttccttgtttctggagaatcggatgcgacctgggaagcagggagagtttgaggatagcacgtggtgagaggtgagctagagaggagagtgggggctggatctcaaaaggtcttgcactcccagctaaggagcctgggcttcgtgctgtgggtcctgggagccatggaagggctgtgaggtggggaggcaggttcatccctgaatgaaaggtggccataaggaagtcacagtgtggctgagggcatgctgggagctccaggtggacgctgaggttggccctgggggtgtgtcaggggatcttgttcagagggagcaacattgagctatgtcccraacctcacatgctgaggcctggaggggtgacacagcttggtgtgtctggaaacaccccagtttagcagtgatataaaagaaggtggagtatgtggtgtgggaagggttagaaggtcagatggagagagattaggtaggatcggggtagacatcaaaagactttatcctggataaagcagagaatgtggagtcatggaagggttttgagcagggagagacagtgccagccatgctgatagaaggtccctctggggccacgtgaaggagccactgggggccgggagaccggggaccaggtggcgcaatggccaacatgagatataacagtgaagatgggtacaactgcctttgtgtgagctcttcatcatgggttagtatctgagtttagaggcttttagaagcaggttctgaagctctgaaacagggattcaagtgcaagtggtttgtttaggaggtgcagggaacagagggtgattcaggacaggggagcagccaacacaggatgtgctgttgggtctgctatgtgttgggcagctggagcttagttttgtgggattctctggggaacggtgtaaatgctccagagtgacccccgagatgcgaggcagctggggtatttatacaccaactcctgccgatcgtggggtgagggcctctcctggggctagtttattycctgccacttccagacttctgaggttccggggaagctgtctggaacacttggaggcagttaagatctgaggggagcagtggggagctcaggggacctgctggaatcggtactgtgccaagtacattacatcattgtttactcgtggggattatttctattctgcagtcgtgagagagcaaagcacagagaaattaagtaacctgcccaaggtcacacagccaggaagcaggagggattgaagggtgcggcctgcactggggcagtgactgtgtgcaggcagagaaggggagagggcccagagccttccagaggctacatcagtgggtgtgagctctccgggatgggagcacacgagccagcgaggtcagatacaccaagccctttgcctccccagctcggaagcagctcccgaaacggaccattcaggaagtcctggaagagcagagtgaggacgaggacagagaagccaagaggaagaaggaggaggaaggtgagcccccagaaggagagaagtgtgtgtgtgtgtgtgtgtgtgtgtgtgragccaagaggaaggaggaggaggaaggtgagcccccagaaggagaggggtgtgtgtgtgtgtgtgtgtgtgtgtgtgtgtgtgtgaagccaagaggaaggaggaggaggaaggtgagcccccagaaggagaggtgtgtgtgtgtgtgtgtgtgtgtgtgtgtgtgtgtgtgtgtgtgtgtgtgttttggatctgcaaggkcaggggcctgagagctcaggatgtttggaccctgccgatttgatgcctgtgtccaggcatccaggaattccacctaccaatatgggaacttttgttctgaaaacattgtgggatatatttgtttggacatcttaatttagtaataattcaggcacagtttcccatttttatttgctatttttatatttatttaatggaaactattttcctctaaatgatttccttttccttgtaaattttaccataaagttgcagttcccaaacattcttagttcacagcacccttgatgtcttagtaatttttttmtgatgctcctaggccaataccttatcagttctattaagtagttatgtccaaacaactattagatactatacatacattggaaaaaaagtaatatttgtgctttttttttttttttttttttgagacagtctcactgtgtcgctcaggctacagtgcagtggcacagtttgggctcactgcagtctccacctcccaggctcaagcgattctcccacctcagcttcccgagtagctgggattacagacacaccaccacgcccagctaatttttgtatttttagtagagacagggtttcactatgttgaccaagctggtctcgaactcctgagctcacatgatctgcccacctcggcctcacaaagccctgggattacaggcgtgagccactgcgcccagcctgtattttgttcttaaataaccataattacttgtgggaaatgccttggatactctgtaacatcttaaacagtggaattcaattgaaaactgccaacgtcatttcctgttctatgttgatttttgtacagtacttgatttttatagcagcaacctatgaaaacccagctttgcagagatgcaatgtcattgcaaggaatgtgatttaatactgaaaactgaaatacctcgaactagtagttcacacactggccagcaggtgtcgctgggtttcctttgaaaaatctaaaatatcttgcagygcccagtgagttccctgcatgttggtgaacccaccgaaaacagccataaagatctgatcgattgatcatctggggcctgcatgagattacaccaattgcagcctttaacgtcgtttggttttttgtttctgcaaacaaataaaaggtccattttccagggcagatttaaatttggttaagatctgatttcttggccaggtgcagtggctcacgcctgtactcccagcagtttgggaggccgaagcgggtggatcacttgaggtcgggagttggagaccagcctggccaacatggtgaaaccccatccctaccaaaattacaaaaattagctgggtatggtggcatgcgcctgtagtcccagctactcaggaggctgaggcatgagaatcccttgaaactgggaggtggaggttgcagtgagccgagattgtgccactgcactctagcctgggcgacagagggagactgtgtctcaaaaaaaaaagatttgatttcttattgacaatttttagtacaaattttattgtaaactacacttttagccactgtcagtgtccagtgaggggtggcgggggtggcctctttctactaaggcagatttttcccaagttggtttttgtagtttgtattgtgaccctagaggtaagattttttttttaactttgaagatttttatttttgtctataacaggctgtcatttgcatttttaaccctttcagattctattttggggtgaataacactaaaggaatcattggtaaggaaagacacaccatttatgtctcggctacataggcaaacgggctggaccccctcaaggtcgctgccttgcttggggttgacaaggagcagggtcttacgtggcccactgctttacaggcacattggattggcacaagatagaactgtaagacctgcactttgggaggccaaggcgggtggctcacctgaggtcagtagttcaagaccagcctggccaacatrgtgaaatcccatctctactaaaaatacaaaaaaatagctggatgtggtggtgggcgcctgtcatcccagctactcgggaggctgaggcaggagaatcgcatgaacccrggaggcagaggttgcagtgagccaagatcacaccattgcacyccagcctgggcggtaagaaygaaaytctgtctcraaaaaaagaacagatgacagatgagggcagactgtctccagagtcaaaatgcccttgtaggttcaatgggatttttttgccatctgaccgttctgtctatcgtcagaagaggagaccccgaaagaaagcctcacagaggctgaagtggcmacagagaaggaaggagaagacggggaccagcccaccacgcctcccaagcccctaaagacctccagtgagtttctggtcctctcctccgccctgccccacctcctgattttggggtcagaagtctttggaggatgattaatttaaacaaggcatagattctcaaacttattgcttaaatgccgaatctagaagaataatagtttttattactcgggtttttttttttaattattatttttccccatgcatgtgggaaaggaggaaagagccagccattctttaaaaaatcttcctaggccgggtacggtgcctcacacctgtaatcctagctctttgggaggctgaggtgggtggactacttgagcccaggagttcaagaccagcctgggcaacatggcgaaaccccatttctaccaaaaaaaatacaaaaatgacctgggtgtggtggcacgtacctgtagttccagctacttgggaggctgaggtgggaggatcgcttgagcccaggaggtggaggttgcagtgacctatggtcgcaccactgcactccagccttggccacagagcaagaactcccccgcctcagacaaagtaaaagataaaaagtattcatagctttcagaagtcataggtgtaaattaaatgttattaattaagttagacaaccaaactgagttacaggattttagaggctgaagttaccctctcagggtggtccaagtgtccatgaggcccctgtgttagaaacaacacttgccgggagaattttagggatacagagttgtatctgattttctgcagctgctgggaggagtgggaatattttcttctcatgacgatgagatttctttttaccactattcctaagtctcctatttcaggccaagtgctagaattcckctagttagcactgaggagtagacagcaggcctgagatctcagctcaaagctaacagaaaggaaaagggtaggtgtagttatatcttccatctgcagggtcagaatgatcttgggggtaaaaaaaaagaaaaaaaaagtctcagggtcaaagagtttgcatcaccgtctgagctctctcaccgcagaagcagagaccccgacggaaagcgtttcagagcctgaggtggccacgaagcaggaactgcaggaggaggaagagcagaccaagcctccccgcagagctcccaagacgctcagcagcttcttcagtgagtttcccttgctcaccccacctcccggggttgtacaggcaggaggctggtgagcctctctccagaggcctgagatgctgcgaagacccttcttcctttcctgctggttggaaagtcggccttgtctctaccagcctgtctcccatctccctgagcactggggtggtgctgggtgcagaatggatgggaggtgggggctaccggaaggagaaaagacccactgttttctgtcttcattcctagccccccggaagccagcagtcaaaaaagaagtgaaggaagaggagccaggggctccaggaaaggagggagctgctgaggggtgagtcagtgtccaggtctggaaaggttcttcgggatgtgttcccttctctgcattccgacagccccacccccagctcaggcttcctcctcttgcaggacttggcaaaccttttctataaagagccagagagtaaatattttaggctttatgggacacatttggcccctgttgcaaaaccattmttagatcccagaacctgtagaaacggtccagggtyggagtttgctgaccgtggccccagccaccctctgaccctgcctccagtctttcatcctcagtctgatccccgtagagcctgggggatctttctaacacccagagttgactctgcccctctagggttccccagagccgtcaggagaaaatctaagcccatttggccactggctgycacctccctctctggcctcacttcctacctctctgttcctctggctctgaactcaccagattttttatttttgagacagagtcttgctctgtcgcctagcctgcagtgcagtggtgctgtctcagctcaccacagcctccacctcccaggttcaagcgattctcccaggtagctgggattacaggtgcatgccaccacacccagataatttttgtattttcagtagagacacagtttcaccgtattggtcaggctggtcttgaactcctagcctcaggtgacccacccacctcggcctcccaaagtgctgggattacaggcgtgagccagtacacctggcctgaactcaccagatttagtgtatgtgctggaagcctgcaggcgcrtctactctgccttaaaattcactgaacaccccttctttgccagccctgggcggcccacgaggatgaaccatagagagccggccgccctgccccakccctcgtgatgtgcttagtgtgctggggctgtgggacactgaataggttgttaagcaattaattgcttcactgtarttttgttaattatttgaagagatgtctgggctgattcccacgacatctaacatgcacacaggaggcygcactgaagactggctgaatggatgattggatgcgtgggtggataaatatcctataaagtaatgaggtcacccccccatctctgccatgctcaaaacccatctgcgattctccccagcatagaggatatgctgggcttcccagtgccctcatgagccagccctgtccaccttacattgcagcctcctggcatctgcagccttttcctgctccctctgcacaccatgtccccacgtgctgtcattcctccctgctttttttttttttttttgagatggaatctcactctgttgcccaggctggagtgcagtggcacgatctcagctcattgcaccttcaacttcccaggttcaagcgattcttctgcctccacatcccaagtagccagaattacaggygcctcgccaccaagcctggctaatttttgtatttttagtagaraccgggtttcaccatgttggccaggctggtctcgaactcctaatctcaggtgttctggccgcctcagcctctcaaagtgctgggattacaggcgtgagccaccacacccagcctcctccctgcttctgaacatgcttgaccccggcctacaacactgtccctaacccaccctgcccagcaggcttccctcaggccccaactcctattgcacctgcttagggaagccgggtgcctctcccttcatgtgtgagaggaggtgygtsyccccagcacttgagtcagactgtcttttatgtcttgtcacatggtaaagagcctccctaaccagacataagctccttcccacagagccagggctgtgggaggtcccagccttcttagtcttcttgcctagctcccagcactggggctggcccctaggaagcccaggaaatctgccatgaaagaaatttaaatgagcactttcagattttttttttcactagtcaatcatggactcatttatttactcagtaagtatttacaaaggactgattacgtgttagctactggattttaggtgcctgagatctggtaggaaacaaatcagacaaaaattcctctttatagaacttargttttttgggttttttgttttttgtttcttgttttttttttaaagacagggtcttgctctgttacccaggctggagtgcagtggtgctcctgggctcgggatcctcccacctcagcctctcaagtagctggaactacaggcatgtaccaccatgccgggctaatttttgtttactttttgtagagatggggtcctactacattgcccaggtcgagctcctggactcaagtgatcctcccacctcagcctcccagaatgctggaattacatgcatgagccaccacggccagcctgatttcttacataatcatatatccatctgaagttatttttttcctctaaagattgtgttttcaaatacaatgtgatggtgttagcagcgtggacttcatcccctcttgaattcttgatgtcctgaaagctaaaaaaaaattaacggaaaaggggtttggaataatccctgctgttcagcagaaaggacaggtgggttaaaaagtatgacgcagtgagtccaaaatctctttgatgtcacgcctctacaaatgaaacagataacgacaagaaattctttcagctttaacrtttcatgattacagtttaagtctaacaaaaaagtgttcggaggattcttgacatcaattttgtacccccaattgagaccttatcaaggaggttaaatagcacgttaacgtcctctctgcagtattcctgtggaggaagggagcactttagccattttacacacattgacatgattagcccagagaggttaggtcgggcctcgccaggtcacacagggaggtgggggtagggccaggcctgggaccctaaggaatgtttttgattcctagcagttatttcttccccattgccatatcgtgcctcctgagtgtgtgtccgtgtttgtgtatttataaatatgttttccaaataaaatcagtgtcctactgtatataaagttctgttttctatttcaagtgatactacgactgcttttctttcttttgagacggagttttgctcttgctgcccaggctggagtgcagtggcacgatttcagctcaccgcgacctccacctccygggttcaagtgattctcctgcctcagcctcccaggtagctgggattacaggcatgcgccaccatgccyggctacttttgtatttttaatagagacagacacttttttgttagacttaaactttaatcatgaaatgttaaagctgaaagaatttcttgtcgttatctgtttcatttgtagaggcatgacatcaaagagattttggactcactgcgtcatactttttaacccacctgtcctttctgctgaacagcagggattattccaaacccctttaatttctccatgttggccaggttggtctcaaactcccgacctcagtgatctgcctgcctcggcctcccaaagtgctgggattacaggcgtgagccaccacgccaggcatgactgcttttcttgcaccattcctagcctggtcacttcccctctgtctccaatggctgcctccaagagacaggcaaactttcccactctccaatttcctcacctctcagatgggggcacagtgatgagaggaagcatgttcttccacccactcttccccacgtgccaggcactcagcaacgggctttccctgacscaatgctccaaatcctcacaacactgctgggagtagattctgttgttatcctggtttcctgggtgagaaaagtaaagcggggaggtgggacagtattgaggacyggctaggaatcccagctccacctctctcagctgtgtgaccttgaggaagtgacttagcctttctgtgtctctcttctgaggatgtgaaacacttagcccagggtctggccttgattatgaccagcatgttgtcacggtaactgctgctactattcttatttgtttttaatgccatgctcaggccacacaggtggggagtggcagcattgtggttctagccaggctgactggctctagactcccctgcccaccacactctgctgcctcattgtaatgccggccaccgcttgttaaaccccaagttcataccaaaggccatgcacagccctgcagtggcactrtctgtcttggccatccatgccctgtgtgagcatnagaatcagctgaagagctgaaaaatatcctgaggtctctttctcccccccaacccttgtccccattttggtacagatgtaggcctggggctggggagtcctcattgttccatgaagtgcacccaggagtgggaaccctcactgtcattttttatgtaaccttcaggacaacctgtcatagtagggaccccttagctccccagacagatggagatgctgtggttcagagaggggaagctgcttcctcagcaggtacagctggccggggcagagcagattggaacccagatgagtctgaatgcagagtttggctggggtcagtgtgagctacttrcgatataaaggttgaggccgggcgcagtggctcatgcctataatcccaggactttgggaggtcgaggtgggaggatcgcttaagtycaggagtgagacaccagcgtgtgcaacacggcaaaaccccatctctacaaagatcagtcggrcatggttgcttgcacctgtagtcctagctactcaagaagctgaggtaggagaatcccttgagcccwggaggttgaggctgcagtgygcattgctccactgcactctagcctgggcgacagtgagaccctgtctcaaaaaaaaatagaggttgggaactgtctctagagctgygctgcttaccagctgtgtggccatgggtgagttaatcactctgtgccccagtttccttatccggaaaaggaagttagaaaggtcccttctggccaggcacggtggctcacgcctataatcctagcactttgggaggccaaggcaggcagatcatttgaggtcaggagttcaaaatcagcctagcgaacatggtgaaacctcgtctcttctgaaaatacaaaaaaatcagccaggtgtggtcgtgtacgcctgtaatcccagttacttgggaggctgaggcagaagaatcacttgaagccaggaggcagaggttgcagcgagccgagatcatgccactgcactccagcctgggcaacagagtgagactctgtctcaagaaaaaaggaaaggtcccttcctcccaggtctgattgttaatcgatgtggtgttagcatggcacctggcactttgcgacacccgggactatacgcacctccctctgtcccagctcagctacgcaatcccttttctgtttctcaagtttgtctgcacctcagcgcctttgcacacgctattctctctgcctggaatgctcgtcccctgctgcccactgtgctaacccctccctcattctgcccagatgtctccggccttccctgaccaccctgtgaagcagcaccctcatctcatcctcttcctctactcggctttcttttgttttctgaaagatttttttaacacctaaaattaatgatgtgtttatgtgggggctttttgcccactttcctctgactctcctgctggaatgtgagctccaggttagcaaactttgttttcatccagctctgcaccgtgtgccttgaacagagcctggcacatcacagttggaaggaatgactttgctttgacccagggctctatgcaattcartctccgttttgcctccgtagacccctggatccatctggttacaatcctgccaagaacaactatcatcccgtggaagatgcctgctggaaaccgggccagaagtgaggtttctcccttttcagactgtccccctccggtccctgttgccaccggaggctctctaagcagagtcttggttgggagaaatggtcaagtctctccctcctgtgttttggcgacaatcagcagcattgaaagggacagagagacagccctgggaagtgagctcatgcatttgggtattggcaagggtgtcccgaggaggcgtgaggaagcaagggtgcagacgggcagcatggtatagcctgcaccactgtcrctcttgcgtctcttttccttccctagggttccttacctggctgtggcccggacgtttgagaagatcgaggaggtgtctgctcggtaactaatgaggamtgcctgggtggggggcggggtcgcttctgggtctgtcctctgcatggcggtcygtgctgccttgttccgccaaaccctgtcaacttggcctctgaccccgctcgggcgtatgatcatggatgtcagacatggtcacaaaagcggctgcaggtcctcttgactttctgcctcattctcatggtcagagcaagacacaaggggcgagcccagatgtgcagggtaaggagacaggctccatctcgggatgactggcaccattgcacacagtccgtgattacttctagtccaccctgagtcatcaaaagtgacttcagtcttgcttacatgtctccatattcacaaaagaaggtgaggtctcagttatagcgaggaccccctactcattcacagaggttccctgcagagcgtcccaccccagtgatgcccagtgcatagcactgccccaccctggtccttctcagcagcatgttagcatcgctggtccctgccagcccccttctctgtccccatttcctcttctctccttgtcctcctcacccccagcactcgcccctgtgtatttagtttatataaatattatcatggaggctgggtgcagtggctcatgccttaattccagcacatcgggaggccaaggtgggtggatcacctgaggtcaggagttcaagaccagcctggccaacatggtgaaaccccatctctactaaaaacacaaaattagcccagcatggtggcgggtgcctgtaatcccggctactcaggaggckgaggtrcgagaatcacttgaacccaggaggcagagattgcastgagctgagatcacgctattacaccccagcctgggtgacagagtgagactctgtctcaaaaacaaacaaacaaaattatcatgggtacggctcattctgcttgccttcactatcaaacccgtttccacatgtgtccatgttggttgagtggttcgagcctgttgtgactgctctgtagtgtcccttcgttctcacatggcacatgccatttctcagttccccaacatgagtggagcatttcaggctgttcccagcactctgtttttttttttttttttttttttttttttttgagatggagtcttgctctgttgcccaggctggagtgcagtggcgcaatctcggctcacttgcagctccgcctcccaggttcacaccattctcctgcctcagcctcccgagtagctgggactacaggcacctgccaccatgcccaactaattttttgtgtgtgtgtttttagtagagatggggtttcactgtgttagccaggaagatcttgatctcctgacctcgtgatccgcccacctccgcctcccaaagtgctgggattacaggtgtgagccaccrcgcccggccctaattttgtatttgtaatagagatggggtttcactatgttggccaggctggtcttgaactcctgacctcaagtgatcsgcccgcctcggcctcccaaaatgctgggattacaggcctgagccaccacacccggccctcttctgtattttgtaaggatgctttttggattcagagcctaccttmattcactatgctctcatcttaatctacaggtacatccgcaaagaccttctttccaaatgaggtcatgttgtgaggctctgagtggacctgaattttgggggggctgttccatccactgcaccatccaatggtggcttttgcctacaatgattactgagggatttccctgatgttggtttttgtatttcttctctgcaccttaaaaacctcggtaatgagacttctgtaggaaaaacccagcttctgtttctaatgaggcyccctaagtttttcagtaacaaagccattctttccagctttgaagttttagacagaaacacggttttcgttttagaggtggtgcagcttggtggctgggagcacagtcctcaggcacacggccttggtgtacatctcagcttcatacttactcgctctgtgaccttgggcaagccacggactctttcggtgcctctgtttctttatccgtaaaatggaaataataatggtacctacctcagaggggagctgtgaagattctatgagttaaaaggtgcaaagggctggccgtgttggctcacgcctgtaatcccagcactttgggaggccgaggcgggcggatcatttgaggtcaggagttcgagaccagcctgaccaacacgttgaaaccccgtctctactaaaaattaaaaaaaawtagcygggcatggtggtgcgcaccggtagtcccggctactccggaggagaatcacctgaacccacaaggtggaggttgcagcgagccgagatcgtgccactgcactctaccttgggcgatggagcgagactccgtctcaaaaaaaaggtgcaaagtgctcaaagccagctcctgaatttagaaaatgctccgtagcatcagctgtcgtttctctgggctgatcatcaccatcttcatcattgttaccgtcacaccaagttactcccccactgtaaccgtccggtgggttcaccttgcccgctgcctagacagagccgatttatctagacgggggaactgcagtggagaaagagtcattcccrcagagctggctgtgcgggagaccggagtttcatttttactcaaatcagtctccctgagcatgtggggagcagagtttttaaagataatttggcgtgtaggggcttggtaagtggggagtgctgattggtcaggttgaagatggactcacagggggtcgaagggaggttttcttgctgtcttctgttcctgggtgggatggcagaacttgttgagccagattacagtctgggtggcgtcagactgagtgcagggtctgcaaactatcttaagcactcatcttaggttttacagtagtgatgttatccccaggagcaatcggggaagccagaggctgcgtgacccctaaacctaaatttctaatcttgtagctaatttgtgagtcttgcgaaggcaggtccttaggcaaaaaggggtcttttccagaaagggctattaccaatttcgtttcagagtcaagccacgaaccaaattccttcccaaagttagttctgcctatgcccaggactgaacaaggacagcttaaaggttagaagcaagatggaatcggttaggtgtgatttctttccactgtcataatttcctcagttacggttttgcaaaggcggtttcacctccagcaatctgtgattgtcctcatggctccaggccccagagcctgggactgttctgagccctttcctcttctttctccatttctttctagtgtccacccccttaaacccaccccaccccgacaccacactttgaccttgaggaaccacgtgttcatacccccgtcccctcctccaggctccggatggtggagacgctgagcaacttgctgcgctccgtggtggccctgtcgcctccagacctcctccctgtcctctacctcagcctcaaccaccttgggccaccccagcagggcctggagcttggcgtgggtgatggtgtccttctcaaggcagtggcccaggccacaggtaagggggactgtggttggagggaccagaaggacaggagctcagccagagaaaatgcagaggtcaggtggatcggagagatggtggagagaggctgtgaaacagggttgaggagaaggctgagagggaggagagcctgatggggacagatttgcaggggtgtgggagagaacacaggggcagcagttcaggtgagggaggaccaggcatgtgctgggacagggggtgtggggtgcagggaaggggagggctggggaaagatgctggaggcagagacagcaggatttgggggctgagatggaaggttggggcttagagaggtctgaaaggactttgactggagggattggaaggagtgggaggaaagaacatggtgtgtggggggccagcagcctgaaggggcccagccgccagtgstgggtggaaaggctggtgatgcggatggcccgcctgccaagggcctggagtgctcggtgcttatcatgaggacactggggagccatggaaggattgtgagcaggcaaggggcagcatccagggggaagaggagctggaccccagctgtagagaagagagaagagggcaggagagatctggcagacagtggatgtcagggtgaggaggcaggaggaatgcctccaggatctccctgggtgactggatggatgacaaagccgtcggcagcttgggaccctgrtgaggggcaggcacctgcagggggcattaatcaccccagcgtggggcaggcatgagcaacctctatctgtgggcccccagggccatccaggaagtttggaaacgggtctgaggctcaccaggtctggctcagagcccagggttcgggctggtcagtgtaggagggatgaccacccactggtgggttctcatccgcctggggagaggatgtgctgggagcactggagctggcttagggccatgggcaccaacatttagggaagkcrggggtttcaggctttcatgagaggacagagggactgagaaaggttgacttggatcaggaaagagttacgggcttatgggagccagaggagatgagactcaagattttctcactcattcactcaagatgtgtttcgggagcactgacgtcataccagacccagcacacacggggtcggttaagaatactctgagctgcaggtaacagaaaacccaactacattggcttggacaaagaaggatctgtttttcycacaaaagaagttgcagatgctggctttcctgcccaacaatccatggcagctggggcctcttccactgtctcatgcctccacccttgatgggtcgtgttcacactcacactgctctccgtgccgccttgtggcccccgtggctgtccaagtcccgggtttgttgtgagttgttggccactttggagaatcccgtcccctttgatgtgtgattcgataacatcccattggtgaggctcacactgtcggctctcccatttgtggcagtttcgcttcaggcgcgaggcccaccttcatgtgctctgtgccgcggctgagcatctgtggactgaaacgcgcacttgttcgttcattacggattgctttccctttcattcttttctgtgttagggttagggcgttatctcgataggtgtaggcaggttatgttatctccacatttyatttcagaccagaaaagaggtgacacacagtatctggtgacaagggtgtgttggttctgataggttgagagctgcttgtcacagctgtcaccgtgacttgaggctccatctccccagctcttacacccaggcgcccatgggacccagctctggacagtaagtggggccagagcacatcccacgtgtgtaagctggtggctccaaaacaagccgaagggtctttggtcactgccagagatgttcatgacccgccagaggaaagggtcccttggccttctctgctctgtccacactcacttccctagtgaccttgtcccgcctgtggctttaaatcccatccgcgccctgatgacaccggcccagatgtctcccctgagtgtggtcatgctcgttcatccaccgctttcctggctccacgtgcatgtttgctgacttcctacagccagcgtggctgggggcacgttccccaagccatttctaccaagtgggtgagcgttagacacagggaggtgcagggactcgccacaagcacacacagctggagaaaattcatccaggccgcgagagaagggagacacgcagccacaactgtcaccctygacacccccacccgcgctctcccctgaaggtcggcagctggagtccgtccgggctgaggcagccgagaaaggcgacgtggggctggtggccgagaacagccgcagcacccagaggctcatgctgccaccacctccgctcactgcctccggggtcttcagcaagttccgcgacatcgccaggctcactggcagtgctgtgagtggggcgggccgctcatcccggaccccagacatcttggggacctgaggccacgcgtgtgtcaggaaggcttctgggtagaccatcagctgggtcgcatcagtccttctcatggggtgcacagcttcctctcctccttcctgcacccaakcctaggggagtctcctcttcagagtctagcagacctaatgccatggctgccacatgacaggactcagtaaatacttcctggataaagggagagggaggcaaggaggagagctagctcgttcttactgccctaagagtgggcggccatgggagctgggacatggggatggggtgagggaaggagggcaggtattccaaaatgcagggcagcagcacggctggtggggtggaggtgtggtccctgccttcaccaggcactgacggctcttcccctgactctccagtccacagccaagaagatagacatcatcaaaggcctctttgtggcctgccgccactcagaagcccggttcatcgctaggtaagcgtgtgggcctgtgaggctacagagsgggactgcaggctcggaggtgaaaggagggagggactggcagctggaatcatcacaaatgccctgaccatccttggatgagaaaagcatgagcaggaggcccagcccctaaagagtgggaagggacaccatttcctttcacaggccagcttctgtcccttggtagtgctgtctagagaaggcccctgggcccctgtgggtgaagcatgctgtgattgattggtgaggtctgcctcggcttgggcgcgggccctgcagcaggaagccagggtttgtttgccatgacagtgagagcaaatccattgagggctcacatcatggarcatttcttgggagccctgccctgtgccccgtgccttacctcatcagttcctaccagcaactctgtgagactggtcttgttaccctcacctccagtttatagaaggggaaatggagacatggggaggcaaactaagccacttgtctcctgccactggctcaaagcaaggaccatgctggggtcctgaccatyacagtcaccagggcgggcgccaggctyagttctctccctgactcatcctcctcaagcctcgccaacccctcagggcagctgagatgggaggtgctggtgcacctacttgtgcccctccccagtctatgctagtgggcaggatcattactgcctggctcagtttcctcatctgtcacatggggctgtgtgatatctggggtcccttccaggctctgaagattcttctggtttttgaggagagggtctacatacatcaaggtcgaggagatcagagaagggaggaggcaagattggggaggtgcagacaagcccccttccctggcctgctctctccccaggtccctgagcggacggctgcgccttgggctggcagagcagtcggtgctggctgccctctcccaggcagtgagcctcacgcccccgggccaaggtgagctcctgtggcccgtctctgcatccctcgctggagttacctcaggcttcccycctcctcttcagaggcccatgcccgccccttccccagcgggcccctgccataccaggctcctctctcctgggtgggggggagggggcgtcttgggccgcggcatctgcattccttgccatacagcaaaccacccactgcaccctggtgtagccaaggatgtgggtgccttccaaagcctctggtgggtcttttcttagaattcccaccagccatggtggatgctgggaagggcaagacagcagaggccagaaagacgtggctggaggagcaaggcatgatcctgaagcagacgttctggtgagagctgggcagtgggtggagttgccaggggctgtgggcagagtgccagggtgggggtggagccagaggagcagtgggtggggccagtgaagtgacggacaggcatcacgagtgccggtcacggggtgactgagagcagaggtggtgatctagacaaggctggtgcttgacacaaggatggtgacaaagatcaggaaggtggcaaacagtgaagggtcartgaccccaggagaggtatagaaagacgctggcagcggccaggcacagtgkctcacgcctgtaatcccagcacttgggagcctgaagcaggcagatcacttgaggtcaggagtttgagaccagcctggccaacatggtgaaaccctgtctctactaaaaatacaaaaattagcctgtaatcccagctacttgggaaactgaggcacaagaatcatttgaacccaggagttggaggctgcagtgagctgagatcacgccactgcgttccagcctgggcaacagagtgagactgtcttaaaaaaaagaaagacgctgacagcaagggagggcagccggcaacatgaggtttctgagtkccagacagggctgtgcatgcagaaaggccttaagggacccagagaggagcaggtgactgacacatggtgaagggtcttgacagtcatggagaggacatccgtggagcggccacgagggctccagagagagccatgtggagggacctaggccagcagctgacccagggctggtgactccaagatcatgactgccccagagaggatgtcagaggcaggagggccgatggcagttccacagatggcctcagagcacctgctctgggccagggccccccactgggtgctgagcagagagtggtgaacaggcccgggcagcaagctcaactctgcctgcacgtggggctctatcagctgctgacctcaggcctaccccacaccagctacatcaaaatctttgtaggtggaacctagccttgaaaacctttgtctatttttattttgtttgagacggagtctcgccctgtcatccaggctggagtgcagcagcacaatctcmgctcactgcaacttccgcctccagggttcaagtgattctcctgcctcagtctcctgagtagctgggactacaggcgcgtgccaccacccccagctaacttttatatttttagtaaagatgggatttcaccatgttggctaggctggtcttgaactcctgggctcaagtgatgcacccacctcggcctcccaaagtgctgggattacatgcctgtaggcatgagccaccatgcccggccaaaaacctttttttaaaaactgtattcttgagtggtctcmtgtgtagccgagtagagaatcgctggtctcgtggtgacagatagggaacaggggcaaggccagactaagggagacaaagcaacagatagtgacacgaagggagagcacagagacagggtggcaagaggagcttggcaggtggtgactcagtgggcagaggcatccaggagcccaggcttctgggagcaggccgagctctctttccaaactgtgtgagttctagaaaggcttcccctatcttgttctcacccgccaccccagcgaggttcccgacctggaccgaattatccccgtgctgctggagcacggcctggaacgtctcccggagcactgcaagctgagcccaggtacaggccccaggggcgctcaccagcctggcagcagccctgctccctcctgagtcggcgtgagggtggccatcgtaggcgcccctctcagaacttgcagagtcctctcccccaccaaaaccaaatgctcctccctggtgctgaaacccactgcttttctccttggaatttccccttgtggagtagatagggtgtaggtgacactgctgtgataaacaggagccgggcgtggtggcgtgtgcctgtgatcccagctactcgggaggctgaggtgggaggatcgcttgagcccaggagttcaaggctgcagtgagccgtcatcgcgctactgcactccagctgggcgacagagtgagacaataaataagtaaataaaaatgggccagaaggcagtgggtcaggccagatagaatttctttctgtcacacagaagtgtccagagcaagggaggtggccagggaaggtacaggtgtgcagytgtgtcccagggatgaccyggggacccaggttcctgtgtccctctgccctccaaaggttgtcaccccaatgtctgtgatcaaatgtggctcacttccctgttctaattgtgggaggagggacgcagaggagggaggggaggcaaccagattccttgcaaggatgtgagccagacattgcacatgctgcgtgggttccaatcacatggcctttcccacctggaaggmaggccgggggctgtagtccccagtgggaggctaggtccccttctaaaacgtgggaggcttcgtgactgaatagcaagaaagcagaatggtcctggggcccattagcagttctcctctccatgttccccctctaatccattgccttccctctcctctaactcactctcctcctttcccagggattcccctgaaaccaatgttggcccatcccacccggggcatcagcgaggtcctgaaacgctttgaggaggcagctttcacctgcgaatacaaatatgacgggcagagggcacaggtatggggagtgggacatgtcccttccayagacaggaaaacgtcaaagagcaggggtgtggggtcactgaggcctgagcttcaagccggcctgcgccacagactgccgagccctcgctcatctctctgggcttcagcatccacctccatgcagtgagtgtgttctttttttttttttttttttttttttttgagacagagtctcactctgtcatccaggctggagtgcattggcatgatcttggctcactgtaacctccacctcctggcttcaagtgattctcctgcctcagcctcccaagtagctgggactacaggcgcccgctaccgtgcccggctaattttttgtatttttagtagagacgaggtttcaccatgttggccaagatggtctcgatctcttgacctcatgatccacccacctcagcctcccaaagtgctgggattacaggcatgaaccatcgtgcctggcctctagggtgtggtcttaactacctcaccagcttatccgaagctacaatcctccagagtcctgaccgatgatagtgggagctcatgaaacgtgggctccgctgatgctgctggtgggtgtgttcattttaacagccgttctgggaggtgcctacatgaccccttcatgccgtgacgtgcatgtgtgtcctgtgatccagggcctcaggcgtccttggtcctggggtctgtaagaatgtgttgtgtctcttctgtcctggcaagtgtggggccttctcacctggggataggtaagcaggcaaagtgggtgggagccacagggctcggggcagttasaggaagtggacccctgaggagaccagcctggccaacatggtgaaaccccatctctactaaaaccacaaaaatgagccagtgtggtggcgtgtgcctgtagtcccagctactcgggaggctgaggcaggagaattgcttgaacccaggaggcagagggtgcagtgagccaagatcgtgccactacactacagcctccacgataagagtgagactccatcttttaaaaaaaaaaaaaaaaaagggtggatccaacagacacaggatcagagatggatctccaaaatagtgttgagaaaaaagacacaagatgatttacgatagtgacaatgatttcttgacaactgttcctggaaataataacaaacatataagatgctatatatgccgccctgctcaagggctgtgaccggactgtcttaaaataaatagacatagaggctgggcgcagtggctcacgcctgtaatcccagcrctttgggaggctaaggtgggcggatcacctgaggtcgaaagttcaagaccagcctggctctactaaaaatacaaaaattagccaggtgtggtggtgggcgcctgtaatcccagctccttgggaggctgaggcggaaggctctcttgaacccgggaggtggaggttgcaktgagcagagattgcaccactgctctccagcctgggcgagactccgcctcaaaaaaaaatcagaatgagatctagagcataatgacatttaaacaaatcagcacccacatgcagcaaggtgcaygtgcctacatggggagaggtgtagggattggaaatgaagaagaaaatgatggtagggccttccagagcagggctgggaggtgctgttggaactgaggagatgattcgctcaagtctctgcaccagttcctcctccagagcttccagaaccttctaccagtgcaggtggggtcagaagagaaagctgaggccacatgaggggactcagctgatttcccctcccttctcccatcgtgacagatccacgccctggaaggcggggaggtgaagatcttcagcaggaatcaggaagacaacactgggaagtacccggacatcatcagccgcatccccaaggtgggcgtctgccwcacacttgcactctgccaggrtctgtggtcaggggtgcaaaggcctgaggcccatctaggccagtgtggcacagtgcggggtttattgggaggagatcaggttgcgtttggctgcaaatgacagagcactcagtcctgcgtggtgtaagcccatrtgattttttctcacatctagaggtgggcaccccagcaccgacttggctgagcactgatgtccccctgaaccaagcttatcgctacctctatcccctgctgtccttggctggttggcttttagtgccaatgcttgtccccttagagtttcccaaacagatgtcattcttccagacagaaagagggaaaagggattctagcttgagttaacactttcctggacacctcccacccacaacccctcccccgccgtggactgcagctgggagtcactgtccagcactgggttccatggccaccctagtgcaacaaagcctcrgaaagccagagtctaactctgcagcctctccagccaggaacgcggggaggaggagtcaggacgagtttggagggggccagcctgtggataggccccaagcctcagaaatagcagctcagagtcatacagggctgggcctcacaggccccagagttggggacttctctgcacccagtaggggtctcgtgcctgttcgaggagtcccctatcaaagagcctttctctttgcctgcccctaattaaataggaaataagttatttaagaaagcagggggcacggtgcccatcattctgcctgttagagacagtgacrgagagaggcacagttcagtgcacgtgttaggggagctcctgttccgtgccaagcactgttctttaaatcaattttcttaagatgtaatttccctaaaagttagtgattttcagtgtgcactatgctgtttgatgagttttgaaaagttcatacacccaagtaaccgacaccccaatgaatgtataaaatatttccacattctcatcattctaacatatttccgctgggcgcagtggcccacgcctgtaatcccagcactttgggaggctgaggcgggtggatcacctgaggtcaggagttcaagaccagcctggctgacatggtgaaatcccrtctctactaaaaatacaaaaattagctgggtgtggtggcacgcacctgtagtcccagctacttgggaggctgaggcacgagaatcgtttgtacccaggaggcggaggttgcagtgagctgagatcgggccactgtactctagcctgggtgacagtaagactccatctcaaaaaaataaaaataaaaaatcaaatatttccttgtgtccctggccaagcaaggccccctcctctgyccaacaccatgcatccaccagaggcaaccccaggtctgctttttggtcgccacaggttggttttacctgttctagagcttcctgttggtggtataatatggcactagtctcttgcatctggctgcttttgctcattcgttcagcaagtatttactgggcatctgctccgagctaggccccatgctggaggctgggagtgtaacaggcctgccatggtctctgccctcactgagctcacagcccagcagagcaggcagaccttcaccagagagtcctgcagctggctctgtaaattatatgtggagatccgggctccacaggaaaggaccagcattctgtgagcctatgtaacaaacaggcctggcyggtgacagtggctcctgtaatcccagcactttgggagggcaaggcgggtgaatcacttgaggttaggagttcgagaccagcctggccaacatggtgaaaccctgactactaaaaatacagaaattagctggatgtggtggcrtgctcttgtagtcccagctacttgggaggctgaggcaggagaatcacttgaacgtgggaggcagaggctgcactgagcggagattgcaccactgcacgccaggctggacaacagtgggagactgtctcaaaaaagaaaagaggccaggcgtggtggctcacgcctataatcccagcactttgggaggccaaagcaggcagatcacttgcggtcaggagttcgagaccagcctggccaacatggtgaaaccgtttctactaaaatacaaaatttatccaggcatggtggcatgtgcctgtaatcccagctactcgggaggctgaggcaggagaattgcttgagcctgggaggcagaggttgcagtgagccaagatcgcaccactgcactgcagcctgggcgacagagctagactctgactcaaaaagaaataggtgtggcttagacttggtgtcagggaagctacctggctccaggatacaacatgaatgctgcccccggcttgggcaacagtgttcccttgagggaaaagaaggcttgccagtggaggagacagacaggggcaggggttctagagggaacggcacatgcaaaggcccagtagtggaagaggcattgcccayttatttgagaaacagagaggctcacgtgctggggtgaagagaggctcagggggccaggtgaggcgagggacgacccaggctgacccgggagagtccccccagctttggggaatcatggggatggtttttagcagggaggtgctgtgatcggatttggggcttgccagtgtcaccctggctgctatggggaagctggattggaggggatcggtgcaggacagggaagcccagtaggcgaggctgagcagggagttggtgggaagtggayggcttaggaaatcatcaggttcactgaggaactgaatgtgggtgacaggaggagggagatgacaagagctcctaggtttccagcttgtgagaccaaatattacattctcagagacattagtttctgtctcctcttggtggggaataaaagaaaagcatctrtgtgcacctgcctctttgttagtgcatcttgagagctgcagaaggaaaagggaatttatctccccgtgtttgtctttccacctcatcttcyacctctctcaggccctgggtctctcccttcacttttcagattaaactcccatcggtcacatccttcatcctggacaccgaagccgtggcttgggaccgggaaaagaagcagatccagccattccaagtgctcaccaccckcaaacgcaaggtagcatcacccgctccactgcctgccaaggccccgtacttcctcatcttccacccagtcctggctgtgggtcctgcccagtgcccagaagggcagagtgtcagtctggatgcacttctctcagccttctgcagaatggctgccacagctccagccatcgcattctcatcccagcatcccaagtaggaagaggggaagggcccttttcgggcatctctgttgttttactatgaaagaagatctgttctggaaaaccccacaacctgcaccccacaggtttccccttttccatctcattggccagaactgtgccatgtcactgccattagctgcagaaaagtctaggagagcaaatatctggtgaaggggaatgaggttgtcggaattagctgagagccgttaasgatccagcacctggagccagcagcatggccgccytcacagatgggcagccagttaggtggcgagagggagaccggtagatgaatgctgtcggcctcaggcacagtgccccgtctcaccttcctgcactcacgaactccgttgtgccccaacccaggaggtggatgcgtctgagatccaggtgcaggtgtgtttgtacgccttcgacctcatctacctcaatggagaggtgagttccagcttcctgtccaggggcagctgaggggtgacggggtggggtgtgagcctggcagctgcccctctgacttccatttccgactctgccacttcacatggccaggaagccacacttgggcagcagttctcaaagtgtggtctgaggacccctgaggttccttaagattctttcaaggacatcttcaaggtccctctctttccaactccacattggcgtgaggtggatcttcctcaggtcctgcaacgagaagagtgtgtcgtagaagcacgcaggagaatccrgcctctgttaagccagatattagaggatttgcaaaagtgtaaaataatgcctctagtctcaccactttctcaaaacttgggttatgtttcatcaaaatatgttatttagagccaggcactgtggttcacgcctgtaatcagagcactttgggaggtgggaggatcgcttgagcccagtagttcaagaccagcctgggcaatatagaaaagaccttgtgtctattcmaaaaaaaaaaaaaaattaatattatttgggtgagcatattggatttatttttttaatttctcattttaaatttctaataggtgtaactataatattatgtaacccacatgaacaagctctatggagtgagtcttgaatttttttttttttttttgagataagagtcttgctcagtcacccaggctggagtgcagtggtgagatctcagctcactacaactgcctcctcccaggttcaagtgattctcctgcctcagcctcccaagtagctgggattacagatgtgcaccaccaggtccagctaatttttgtatttttagtagagacggggtttcaccatgttggccaggctggtctcgaactcttgacctcaggtgatctgcccaccttggcctcctgaagtgctgggattacaggcgtgaaccaccacgcctggccttgaataatttttaagagtgttaaagaggcctcaagacaacagtttgagaacagcttgctttaggatgtcaggaatctggagccaggccacatgccgtcatatcccagccctaaccttcctagcggcatggctacagatgaatgactcagcctctctgtgtgtcagtttcttgatctacagtaaggagctaacagtggcaggtgctttrtctgttagggtgagggctaaacagtgggataggggtgtggaactcagtagttagtacatggaagctctcaaaaaaaattagctgyaatcatcaatatcccagataatcttttttttttttttttttgagatggagtctcactctgttgcccaggctggagtgcagtggcatgatctcagctcactgcaacctccgcctcctggggtcaagcgattcccctgcctcagcctcccgagtagctgggattacaggcgtgcaccaccacgcctggcgaattttttgtattttagtagagacggtgtttcaccatgttggccaggatggtcttgatctcctgacatcgtgatctgcccacctcagcctcccaaagtgctgggatttacaggcgtgagccaccacgcccggcccatcccagatgatcatctggtagatgaaccacgatcttgtggtaacttggtcacttctgtcttattaatggatattgatgatcaatcatcttttcaggtttgttggccgcgtgcatttgttccgtgacttgcctccgcgtgtcttttgcctgcctgtctggtgggttctcactcatgtcttcctggtctgtaaacgttttttctccgttaggcccatctgtccttcgccgggacaggtggagctggtagtggttctaatgcagagatgcctttgatgctcaaacccccaatttcatgatgcagactgatgtttcactacatgaaattactgtaggaagacagtcagagtctgatttttgtttcccgtgatgtctggggagaggaaagtcaagtatcaggtgctttccaaacactggatactttgtgggtttttctgcaggatttgatcatccctgctcagctggttcctttgtctcccatgagcatttcaaatatttcttctcattccttcaaatattccttctttaaaatttattgatggcctattttgttgtataggacttgtttgagctattacttttacaaatttttttattagtagtagttgaacatggatgaactatttttatgtagtcaagtatatcattttttttctgtttaatgtgtcctcatccccatgattttttttttttttttgagacacagtctctgtcgcccaggctggagtgcagtggtgtgatcttggctcactgcagcctccgcctctggcgttcaagtgattctcctgcgtcagcctcccaagtagctgggattacaggcacccaccaccacacccagctaatttgtgcatttttagtagagtcggggtttcaccatgttggccaggctgatgttgaactcctgacctcaggtgatccacccacctccgctttccaaagcgctgagattacaggcatgagccactgcagtagcctacatttctaattttagagcttctagtagccatattaaaaggtaagaagaaacagrtaaaatcatattttctttaatccaatgtctaagatattatcctttcaatgtgtgatgaatataagaaattattaacatggaattttacactcttttcttggattaagtcttctaaagccagtgactgttttgcccttggcacatctccgattgaacttgctacatttcaagggctcaattgctacacatggctggtggcggctacactgggtagcacgggctcagctgatcttcccagacgtgccctgagtaggtattgctgcattttacagatgggagctctgaggtacacagagggaaacgcttgcctgaagtcaccagctaggaagcgtgtggctgggatgtaaacctgaaatggtctgaccccagataaattgtacctgcttaacccttgtggctcctctctctcatcttttcatacaaaatgttcatgagcacaattttacaacagaaaaaagctgtccatggaaaacacgtgaatgtccccctggagggcaagtggtgaaggtagtttaacatcatcacagagaagccctgagcaaagggcagaccagaaacactgcgcgtgggtggggaccgatcgaacaaaagagaaaagcaattcaaagccacaagacggattagtcagtgttgacatgtggagacaactgctttgtcctttgtttaaaaacaytcagatcacctccttcctctctgacacacactcttgcaaggtccagctggaactgatttcaaagcaaaacacaaaactgtaaatgtgctggaaaaactcagtgaaaacttttggaattctaaggaaaggaggactttttttttttttttwwaattatcttggggatgaggctggatgcagtggctcacgcctgtaatcccaacactttgggaggctgaggtgggtggatctcttgtgatgtgcacctgtagtcccagctactcgggaggccgacgcaagacagtcgcttgaattcaggaggcggaggctgcagtcagccaagatygcaccaccgcactccagcctgggcgacagagcgagattccgtctcaaaaaaacaaaaacaaaaaacaaaactgatgagatgcccgtaaagtgttaattcaagctccagcaaggccgcagccccccgtctgatgctcctgaagtcaccgactctaaatggtgtcgggccctcttgccagtgactagccccatgctttaagctctcagaatccttctgacatcagggttcttccctctcaaggctttccacgaacsctgtcactagttgtgacccgcacatgtcctgttcgcctcacatttagggcttattgtctttattctcacaaagatgtctyatctctcttctccctgccggccctgcagtccctggtacgtgagcccctttcccggcgccggcagctgctccgggagaactttgtggagacagagggcgagtttgtcttcgccacctccctggacaccaaggacatcgagcagatcgccgagttcctggagcagtcagtgaaaggtgagggtgctcacttttctctcctgaggtctgcagcttgcrctgaccccggcctcccagcctgtccccagtcctggaccgtttgaccagaatcctgcctgctccggcgcttgtgagccagggcttcccaaggaccacgcttctrtgtctccctcagactcctgcgaggggctgatggtgaagaccctggatgttgatgccacctacgagatcgccaagagatcgcacaactggctcaaggtgattctcgacccccaactgggccttctccaccccgggtctggaggtctgtcccagctaggcagtggatttcgagcctccactgtgtaccctgtctgagctcagggccccttttcacaatcccaccccagccccctgctgcaactgagttcagaccttctccctgctgcgagcccttgctcacgagttctgatggagaacagccccagcccaagcaccgcacatcccacgaggtgcagcgtgatgaggtgtctctctcctgagcctgccgcccgtgtcgggccaggctcttgggcaggaattaagccaggacatgaataagagaaagtcaggcaggagtgggcgccatgaagaaaagcaagtcagctccgggccagcaaggcggggctgggagtgccccggatgatcaggaagagtctttcccaaagtgagggacagagcactagggaggaaaacccccggtgcagagaccctgagggaggagcagcctctgcgtgtgcagggagcaagggcaggcgaggcgggaggtgagctcagagtggggagcaggccccagatgaggcagcacctggggccactgtgagataaaactggatcttcctcttgaaggtttcaggaagtcagtgggggttccgtgccgggagtcacaggttgtcattgtgcgaagctcctggggtttcccctygagtggaggacgggtgtgttgagggccagcgagcaggagcctgtcatcagtaagagttgatggatgtttgagtggagaggggcagtgaggggtggacaaggggactggagcgggaggcattgtggcactgagccggccaggcctgctgactagctcttcctgtgtacttatgtctgtctgtggctggtttccctccagcacagacctttcctgtctcaggaaatagcactgttgtgcccccagggctgagcttctgcctggcacatggttagcacttagtgaacgtttctgaaygaatgggaaaatgctctccctttggaggagtggccagagtgagttggccacgtctctgtcctgagggaaagacggcggcaaggctgactcctgaggtcccatcgatcccgcctgcgtttcccatttgttcttatttatttatttatttattttaagacggagtttcactctcattgcccaggctggagtgcaatggcacgatcttggctcactgcaacctccgcctcccgggttcaagcgattcccctgcctcagcctcccragtagctgggattacaggcacacgccaccacgcccggctaattttgtatttttartagagacggggtttctccatgttggtcagactggtctcgaactcccgacctcaggtgatccacccgcctcggcctcccaaaatgctgggattacaggcatgagccaccgtgcccggccccatttgttcttatttaaacctagaaacccttcccatgtccagtctcttcycaggggccatccttggggttccttctggaagttcccttcagacttacttctagtccctcctcagtccactgaggagcccctccccagcagtgagggccccrccttgggcgctcccccttctcatctcttgcctccccttctcccagctgaagaaggactaccttgatggcgtgggtgacaccctggacctggtggtgatyggcgcctacctgggccgggggaagcgggccggccgrtacgggggcttcctgctggcctcctacgacgaggacagtgaggagctgcaggccatatgcaaggtcctggggaactggggctgatggcagaagcaggagggaaggagattagactcccgggggtatttcctattgcacaacccagaccgaggggtgctcacatccccctgtgaaggatccgttctccccagtttttatttactttttctggttctatgagcaactcttgcttcatatagaaaaacaggctgggatagaaagatgtcaggaatgtgtgtcagtgagagattgagattagctacaaatagtggtggctcacataagaaaagaatttttttgttatgaaatgagaagtgtggagggggcagtctgatgccattagggattcaggttcctcctctccccacatttttttttgtccccacattttttttttctgccatgtgcctctggcctcatcatcacaatgtggctgcaggagttccagccctcatggccatgcctgctccacgcaccagggaagagcaaagggggttsgaccytgagtcagcctcagccagtgaacaccttctgctcaagttctgttgctcatcactttgctccatggctcacccctagctgcaaggaattctgggaaatgtaaagtgatttactttttttcaagttaaagtttttcttaaagctgtgcacattttggactagattttcttacgtatttcctatattcccctctccaacaaatttgggtcttttgccacagaaacagaacaaaatatcacctagaatcgtaccacccagagacacgcagtagtgacatttgagggaatgttttatttacatttttgcaaagttgtgatccttctctatgagtaattttcttttctgcctttttaccctggaagtactttgttttcagtgttgtatatgcccttaagcaatatggcaacaggacctgaatgcccgcacaagagttttcaagtgctgtgccccatagcacatagtgctgtgtcctgaaccagctccccgtggctgtgtggggaagttgttgccggctttgttctgatgggtaatgtgattacttagtgtccgttaacctaaacgatcagtgacagaagtgacttttataaatcacaaatgttttggccaccaatctacattgtcaccattttgcattatttagaatagatttttaaatgagctattgtcaggacaaaaggcaaaaagaatccttaagactctcaatgcaaaaggggctttccaggtgacgtttatattggtgattattgcccacttgctgcgtatctgccagcatccagcattactgctaatttttagcctttcctattttggtaggtgaaagaagctcttggcagtgttaacattggagatgggctgggcatggccactcacgcctgtaatcccagcactttgggaggctgaggtgggaggatcacttgagcccaggagttcgggaccagcctgggcaacatagtgagaccccacctctacaaaaacttttttaaaaaattagccaggcgtggtggygcatgcctgtggtcccagctacttgggaggctgaggcaggaggattgcttgagcccaggaggtggaggttgcagtgagccaagattgcaccactgcactccagcctggataacagagctacaccctgtctcaaaaaaaaaaaaaaaaaaaaaaaaaaagactggaagtgaggacagccagttactgggcagtgaggatgtgggtgagcataagggagtgacttcctggggccagggagacagtggaagcagcaagagtttctccataaagcagaagacagggagtggttcacggcaggcctgctgggagaacattcccacccgggagtctctggatggatgctccgcacccccagctccctacttccctggttttctgtggatactgcgtagaccagagyggggtgggggccatgagtgtacacagctttagatggcaggagcaagtgctgggcctgtggcyggctgagcctctgacctcccgcttcctccctgcagcttggaactggcttcagtgaygaggagctggaggagcatcaccagagcctcaaggtgagccatggyggctgcrcctcagcctccacccctctcccccctgcccctgacagcacagtccttccatgcagggctcttggcttccaccatcttggggctccaggtgtgggcaggagggcagcaggcagtggagctggctttggagtccagcatctccaggttcatgtctcagcactgccrgctactagctggtgaccctgctcaagcagcctcacctccccaagccctgtgcctcattcacaccaggggttagccaaaggacacagcaggtgccatagctgctccttgtgaagtgcctgtgagccctgatcaatgtgaatgaatgttgtcatggtcacaggcatttcaggcatgagtgtctgtcctacatattggatctgtattagtttattttcatactcatactgctatgaagaaataacccaagacttgccgggcgtggtggcgcatgcctgtggtcccagctacttgggaggctgaggcagaagaattgcttgaacccaggatgcagaggttgcagtgagctgaaatcatgccattgcactccagcctgggaaacagagtgagactctgtctcaaaaaaaaaaaaaaaaaaaaaaaggatcatttataaagagaggtttcctggactcacagttccacacggctggggaggcctcacagtcatggcagaaggcgaaagaggagcaaaggcacatcttacatggcgccaggcaagagagcgtgtgcaggggaactgccctttataaagccgtcagatctcgtgagacttcctcactatcacgagaacagcacgggaaaaacctgcccccatcgttcagttacctcccaccaggtccctccaygacacatggggattttgggagctatgattcaagacaagatgtgggtggggacacacggaccctgacaccatctctgtcccactctttggttctctctctccattgccctctctctctacatctctgtccctgtcccactgtgtctctgtctccttcctccaggtctctggccctttctctgcctctttttgtctttaatgtcctgcctcagcccccagggcctttcatttctttccatctcccattcctcccaactcccacctttctcaactttttacttcaagggggtcttgtttcttttcccttctttcactttctgtttctctttctatttctgtttacttcaagggggtgtcttgtttcttttcccttatttcacttcctatttctgtttacttcaagggggtgcctgtttttttcccttcctccctctccccagccctccaacacttggccttgactttgagattccagaccctctgttcctctcttcctctgctcactgcaggcsctggtgctgcccagcccacgcccttacgtgcggatagatggcgctgtgattcccgaccactggctggaccccagcgctgtgtgggaggtgaagtgcgctgacctctccctctctcccatctaccctgctgcgcggggcctggtgagtggcagaggacctggccgtggccctgtgtgggattctgggcgggcacacagagagcagagtagggaggggaccttggctcacatctgctcttccaggtaaggatcaggaagatgagcttgcattttatttgagtgtcagataaaaagatcaaaacattttttctttaaaaatgggccgggcatgggggctcgtgcctgtaatcccagcactttgggagaccgaggcaggcagatcacttgaggtcaggagttcaaggccagcctggccaacatggtgaaaccccatctctaccaaaaatacaaaaattagccatgtgtgatggcgggtgcctgtagtcccagctacccaggaggctgaggcaggagaatcgcttgaacctgggaggcggaggttgcagtgagccgagatcacaccactgtactccatcctgggtgacaaagcaagactctgtctcaaaaaaagaaaagaaaattcttttcttaaataaaagaattcccagggcaagcacagtggctcatgcctgtaatcccagcactttgggaggccgaggcaggcagatcacttgaggtcaggagttcaagaccagcctgaccaacacggtgaaaccccacctctaccaaaaaatagaaaaattagctgggtatggtgacccgtgcctgtagagacggggtttcaccatgttgactaggctggtcacaaacacctggcctcaatccgcccacctcggcctcccaaagtgctgggattacaggtgtgggccaccatgcccagccaagaacttacatttttgatctaatttttaaaaatgttttaccatgctgcacgttagacagccagggacccttagtaacaaggcacaggagccggtgtgtatccagcccttgctgtgcagtgggcactgtgtggtcatcagcgtgtcactcatagacactcatttaatcctctcaaaatccgtaagacgtagtgacacaaacatctccattttacggtgaggatgtagagccctagagagcctgagtaactgcccctgcatcacgcggctcctgagagttgggagctgggattggaatcccacagtcagattctagaacccataccctggcgccgtagttcagcctctcagcccgaattaccgtcattatcgtaacggctgtagcaggtggcattttttttttttttttttttgagttggagtctcgctctgtcacccaggctggagtacagtggcgcaatctcagctcactgcaagctccccacctcccggattcacgccattctcctgcctcagcttcctgagtagctgggactacaggcgcccgccaccacaccyggctaatttctttttgtatttttagtagaggcggggtttcaccgtgttagccaggatagtctccatctcctgacctcgtgatccacccgcctcggcctcccaaagtgctgggattacaggggtgagccaccgcacccggccaacaggcagcatttcttgagcacttactgtgcccgggtactgttccaagcactttgtcaacttgtttaatccttatgacaacccatcgttcggccccgtcatgtggatcaggaaacagtccagagtggaggagggaggagactgagcagggggtcgctggggctggaccgcaggagtctccatcccgcttccgcaggtggatagtgacaagggcatctcccttcgcttccctcggtttattcgagtccgtgaagacaagcagccrgagcaggccaccaccagtgctcakgtgaggtcctgggaagcaggggtgggccgcccagctgcttggccctaccagctttttagcgtggtggcctctctggaaccttgtggaggtgggagcagccagggagcttctgaccaccccgtcccaccctctctccgcaggtggcctgtttgtaccggaagcaragtcagattcagaaccaacaaggcgaggactcaggctctgaccctgaagatacctactaagccctcgccctcctagggcctgggtacagggcatgagttggacggaccccagggttattattgcctttgctttttagcaaatctgctgtggcaggctgtggattttgagagtcaggggaggggtgtgtgtgtgagggggtggcttactccggagtctgggattcatcccgtcatttctttcaataaataattatyggatagctactttgtgacagggtctgtgctgggctctgggggcaaagctgtcatgggtgtcacctgcatagcatgtagccatgtagccatggcctaggaactgccagagccagtgccagccatggaactgcctgcagtggtgggcgtcttctctatctgctctgtgcagtgtgaccgccactggccacctgcaatgcccgagcccttgacaggtggccagcatgacagaggatgcgaatttgttttgttttgttttgttttgattttgttttgagacagagtctcgctctgttgcccaggctggagtgcgatgatgagatctcagctcactgcaacctccaccttccgggttcaagtgattctcttgcctcagcctcccatgtagctgggattacaggaatgtgacaccacgcctggctaatttttgtatttttagtagagatggggtttcgccatgttggccaggctgatcttgaactcttggcctcaagcgatccaccctcctcagcccccctaagtgctgggattacaggcgtgagccaccacacccagccataccaaatattttatttaattgtattggacagcagtagtctaaaatctttacatacatatatttttttaacttgtttaaccttccagccatcccacagggaggcaccatcgtgagccctgttaaggaagacaaatgcagtgtcttaaaataacacagatgtattccctaaacagtttcggaggtcagaagttcaaaatcagttttactgggctaacatcaaagtggtggcagggccggttccttctgggagctccaggagagaaactgtgtcctttttccagcttccagaggccacctggttcctaggctcatggcttcttcctccgtcctcaaagccagcagcatcgcacctgcaaatctctctcctgaggtcatcaggtcacgtcctctcctccatcagatctctgtttctctcttccaagtactcaagtggttacatttagggccccctggatgatccaggataatctcatttcaggatcctaactcaatcccaaagtccctttagtcacataagatcacacattcacagaggccaggcacagtggctcacgccttggggaggacttggggaggctgaggtgggaggatcacttgaagccaggagttcaagactagcttgtccaacacagccagacttcatctcctctaattttattaataaaattaataaaaatgtaaaagggccaggcgcggtggctcacgcatgtaatcccagcactttgggaggctgaggcaggtggatcacctgaggtcaggagttcgagaccagcctggccaacatggcaaaaccccgtctctactaaaaatacaaaaattagctgggcatggtggcgcgtgcctgtaatcccagctactagtggggtgaggcaggaggatcacttgaatctgggagacaggttgcagtgacccgagatcgtgccactgcattccagcctgggcgacagagcgagactccatctcaaaaaaaaaaaaaaaataggtcacatcaaaggtttcagcgattaagacctggatatctatgggggctgttattattgcagccaccccacatgggatgatatgttagaggaaaaccatcgggaaatggtcagacaaggcaagcaggatgcctggaacacccacccagccctgggcaccacggggctggcttggggaaaacggctgcacgcggagcggggcccaggctcgggtcttccagagcaggaggcctctaaccccggggcccagcgtggaacaggagcttccgggcatgagagtgtcagggtgtcctgatactcccgcaggggggacacagggctcccagctgtcccctgcccctcacactctgtttctgcctctcacatctgccctccctccttcccttctctctcatcaggttcctctgcccttgtctcccacccgccctctctccccttccttctctatctgcgaggctttgctctctgccgtgcaagtctgtgccaggcttactttgctgtctgtcactgtgactcagcctccctgtctctcttcctgtgtctccatcatggtctcttgtgcacacaatctcttgggcattctgtttctatttgttgtagcccaagaagacaacattgccttccgagtctccttggggctagcagtggccctgtagccctgtgtgggcagacccaggggacataagcacaggggctgctggggacttctggagaaacatctttcctgaccaaaaaggacagccctggttgtggcagctcctcccctcctcctgccttgactagagatgatggctggagccaagtcaccaccttgtaatgatgaggaaaaagagtaacaaactctcctgacgaccctaaaccggcgaacctagggcagcagctgcctaactgtgggcttttgttcatgggagtaggggaagaataagccccagggcgattatgccactctaaaacatggctttcagccgggcacagtggctcatgcctgtcatcccagcacttcgggaggccgaggcgggcagatcacctgaggtcgggagttcaagaccagcctgaccaacatggagaaaccccgtctccactaaaaatacaaaattagccgggcgtagtggcacatgcctgttactcccagctactcaggaggttgaggcaggagaatcgcttgaacccgggaggaggaggttgcagtgagccgagatcgagccattgcactccagcctgggcaacaagagcaaaactccgtctcaaaaaaaaaaaaaaaaaaaaaagacttgtttctcatagctaagagttcctgatacagctctgccttaaagaactggcaaattagtgtgcatttgtgtttcaatttcaaataaaatgtttaaggcaaaaaaaaaaagtaaatgttgtatgtcaggggatccccacattactggctttgtgtggagaccatggttcctttgggcttggctcttcctccctgcaccagtgcagggccccaggaacacatctgccacacacggccgccatgtccctctgctgaagctagtcagggtcatcctcactcctcagtgaccctcatgatggctccaccaggtaggtacttttattctccccatttaacaggtgaggacactgaggggcacagggatgtaagttaccttccctaggtccactatctaggaagtggtgggccagggtttggtccatgctgtcagctccttgaccctgcatctataactactaactatactatggagagcctcatgagctcctgcgaggtgtagaaccttatcccgcaggcggggcagtggcatggtcaggtctaggagtgaaaagatcctgcgatggttggagttgcgggcactgaagaggtgagcctggcgttagggggagcaggggagaccatcttccccctggtgaaatcctgttctaaaattggtgatactcctgccttggcctcccaaagtgctaggattatggcctcatatctatttttaaaaaataagaattcaagctgggtgcggtggctcgcgcctgtaatcccagcactttgggaagccgaggcaggtggatcacttgagttcagcagttcgagccagcctggccaacatggtgaaaccctgtctctactaaaaatacaaaaataattagccgggcgtggtggcagatgcctatgttcccagctactcgggaggctgaggtaggagaatcgcttgaacccaggagacggaggttgcagtgagccgagattgcaccactgcacaccagcctgggcgacaaagagtaagactccatctcaaaaaaaaaaaaaaaaaaattcaaaacccatcgagttgggatgacgcttagtgctgggcttcaggaagagtaggcaggagggtagtatgggaggtttctaggagccactcttggaagcggtgctccccacagatgcccgattgcactgactggaactcggtcacatgaccacataactcgctcacatgaccacacctagctgcaaaggtgctgggaaatgtggtaccctgttgggaggccacttctgggcttcaaaccttcactgtgaatggagctcacaggttttctaaaaatggacattaaatgaaccagagttggccctaaggatctggctcactgcaacctccacctcccaggatgaagcacctgcctcagcctcccgagtagtagctgggattacaggcacatgccaccatgccgagctaatttttgtatttttagtagagaaggtgtttcaccatgttggccaggctggtctcgaactcctgacttcacatgatccgcctgcctcagcctcccaaagtgctaggattacaggcgtaagccaccacgcctggcctcaatatttctttttctgggtatttgagtatgatattatatatgatggttattagacagccagatgcataggaggattagctaatctgttttgaggaatacttatctccaatatagttatataacgacaacattctttttttgaatactggtctcgggtgcctaatgacagaagggtgacatcactaaggaagcctggaaagtcccagccctccacgtgatcccacggatgaaaatagctccgggtgagctctggaacagctgaaaaagctggagcaaccaagcagggcctacaagccgaggagggctgtttaaaggcgcaggggccattttaccctccaggttggccctgctcaggaccaggaggaaacacctccagcccgcgacctcctcccacagggggaaaaggaaagcaggaggaccacagaagctttggcaccgaggatccccgcagtcttcacccgcggagattccggctgaaggagctgtccagcgactacaccgctaagcgcagggagcccaagcctccgcaccggattccggagcacaagctccaccgcgcatgcgcacacgccccagacccaggctcaggcaagccgtgggggcagggagggctgtttcatcccgctggggcggccataaccaagtaccagggattgggtgcaattaaataacaggatttctttttcttttttattttattttattttatttatttatttattttttttgagacagcatctcgctctgtcgcctaggctggagtgcagtgacgcgatctcggctcactgcaagctccgcctccggggttcaagcgattctcctgcctcaacctcccgagtagctgggattacaggcgcacaccaccacacccggctaatttttgtatttttagtagagatggggtttcaccatgttggccaggctggtctcaaactcctgaactcgtgatccaccccactcggccttccaaagtgctgggattacaggcgtgagccaccgcgcccggctaggaatttattttctaacacttctggaagctagaagtccaagatcaaggtgttggcagggttggtttctcctgaagcctcttgcagaggccctaatctctccttataaaaccaatcaggctgggcgcggtggctcacgcctgtaatcccagccctttgggaagacgaggcgggcggatcctgaggtcaggagatcgagatcatcctggctaacacagtgaaaccccgtctcaactaaaaatacaaaaaattagctgggcgtggtggcgggcgcctgtagtcccagctactccggaggctgaggcgggagaatggcgtgagcccggaaggcggagcttgcagtgagccgagactgcgccactgcactccagcctagggcacaaagcgagactccatctcaaaaaaaaataaaataaaataaaccaatcaaaccaaattccaggccaccctcaggaccccactttaacttagtcacccctttaagagcctatgtctggccgagtgcgatgactcatgcctataatcccagcgttttgggaagccaaggtggaaagctctcttgagcctaggagttcaagaccagcctgggtgacataacaagacctgatctctacaaaacat

SEQ ID NO: 17811 - DNA, 26667 bp, Homo sapiens
cagttacttgggaggctgaggcaggagaatcgcttgaacccagaaggtggaggttgcagtgagcccagatcatgccactgcactccagcctgctgacagagggagattccgtctcaaagaaaaaagtaccacagatcaggtggcttaaacaaccgacacttattgtctcacagttctggaggctggaagtccaagatcaaggtgtgaacaggggtggtttctcctgagacctctctccttggcttgcagatggtgcctccctgtgtctacacatgattttcctctgtgcctgtccactccccaccttctcacctgtagaactcagggcttatttatgcttatttgttgactctctctcctcataataaggtgtgcagcagtgtggggtcaggaaccacatcactttgctcaccatggtgttcattctttcattcattgattccacaaacatttcctggatgcctgctagatccagtccgcccaggtcctgcagccgtggctgcatacaggtcagatgaggctcttgctcttgtagaatgtacctcctcccgggggggcaacatgacataaacaggtaaacaaagaagtcaacaggatggccatggagagtaagtgccatggagacgaccgaacgtgcggtgtgctgaggagtgaagtgaaagctttttaggaaagggtctgggggtctgggaaggcatcctgagggagagacctttcacctggggctgaatactgagaaggggtggccatgaggaagtcttggggaacagaattctgtgcaaaggaaaagtaaatgcaaagtgtctggagtgggaaagaccttgatctgtgtcttacctatgtctataacattctgtactaatataaaggcatatctgaggctcggtaatttataaaggaaagaggtttatttggctcatggttctgtaggctgtgcaagaagcatggcgcctgtatctacttctggtgaaggcttcagagagcatccaatcctggtggaaggggaaggggggctggcgtgttacatggtgagagagagcaagagagagagaagggaggaaagcaccagtttccttttaacaaccagatctcaagtgaactaatagagcaagaactcactcattaccgcagggaaggcaccaacccattcatgaaggatccactcccatgatccaaacatctccctctgggccccacctccaacactggggatcacatttcaacatgagatttggagaggacgaatttccaaactatatcagtctattcgaggaacagaaggaaagctgttattgctggatcagggtaggggaagcacggaatgaaatgtgattggagagatggacagagatcagaacttgtgaattctggcaggtatcatgacattcgatgtaggccaaagagttacctcctagcccagctcctgatacatgcttaataagcgtagtgttggataaataaacgtttacgtggtaaaagtagatcacaagagctccacaggaggaggtggtggagctccaggtcttctcaatgaatgaaagaatggatgaatgtctttctcctaagtcatgtatgacctgtagaggcttccaggtcttctaatcttatccagtgtgcaacactgcctacaaagcacagtggtaacttctaactttcctttctccccaggctctactacccgaaggatagtgcccgaagttgctgcttggcatagatgagcctcagcttccagggcactgtgggcctgttggtctactagggccctgaagtccacctggccttcctgttcttcactcccttcagccacacgcttcatggccttgagttcaccttggctgtcctaacagggccaatcaccagtgaccagctagactgtgattttgatagcgtcattcagaagaaggcgtccaaggagctgaaggtggtgaaatttgtcctgcaggtccctcgggagatcctggagctggagcatgagtgtctgacaatcagaagcatcatgtccaatgtccagatggccagaatgaatgtgatagttcagaccaatgccttccactgctcctttatgactgcacttctagccagtagctctgcacaagttagctctgtagaagtaagaacttgggcttaaatcatgggctatctctccacagccaagtggagctctgagaatacaacaagtgctcaataaatgcttgctgattgactgatggattagctgtgtgtgtgtgtcttggtctgccaccacccctgctgcggcccttttcaccctctgtgtaccctttacttgttcctttcttcccttccccctttcctttccatcttcttccatctatatctcagcaattaagcatggtggttccacagctgggtttggatcttacttctgttatctgcttaccatgagaacatgggcaagagccttcgcctccatgccccagttccatcgtctgtagaatagaccatcacggagcctgtatcctagaaaggcttaaatgagttcatgagtctcaagaccttagaatagttagtctggcaccgacggagttccagagcaattattattcatacaggctttccagaattaaagcaggactgttatgggatgaattgtgtgtcccacccccaccaaaagatgtggccattgtaacccccagtgcctgtgaatgtgaccttgcatggaaataaggtctttaccaatgtcatcaagtgaagatgaggtcactcgtgtggaccctaatccacaatgactagtgtccttatgaaaaggagagatttcgccgggcgcagtggctcacgcctgtaatcccagcactttgggaggccgaggcaggtggatcacaaagtcaagagattgataccatcctgaccaacatggtgaaacctcatctctactaaaaatacaaaaattagctgggcatggtggcacacacctatagtcccagctactcgggaggctgaggcaggagaaccgcttgaacccaggaggtggagcttgcagtgagccaaatcatgccactgcactccagcctggtgacagagtgaagactctgtctcaaaaaaaaaaaaaaaaaaaaaaaaaaaaggaaagaaaaggggggatttaggggagggagagcattatgacaaatacctaatgcatgcagggcttaatacctaggtgacgggttgattggtgcagcaaaccagcatggcacatgtatacctatgtaataaacctgcatgttcagcacatgtatcccagatttgaaataaaattcttttaaaaaagggggggggatttaaagacagagacaggcatgtatacagagaggaaaccatgtgaacatggaagcagggattggggtgaggctctactgaccaagggctgccaaactattgccagcaaaccaccagtcatccgaaagaagaccttgatagcagaaggatcctgttcagaattctgtgttgcattcagtcgtagcttttttttttttttttttttttttttggacagagttttgctcttgttgcccaggctggagtgcaatggcacgatcttgggctcactgcaacctccgcctcctgggtttaagcgattctgctgcctcagcctcccgagtagcagggattacaggcatgtgccaccatgccgggctaatttttttgtatttttagtagagacggggtttctccacgttggttaggctggtctcgaactcctgacctcaggtgatctgcccacctcagcctcccaaattgctgggattacaggtgtgagccatcgcgcccagcctcggccatgtcttcttagtctcctccaatctcgaacggttcctcaatctttccttgattttcatgaccttgacatttttgaagcttacaggccagttattttgtaaaccatccctccatgtgggttcgtctgacgtctgattatgatgagattcaggaatcttacagaagcgatgctgttctcgtgacatcctgtcaggtggtgtgaaattccaacttgtcacattactgatgatgtccactttcattgactaagatggtgtttgccacgtttctccactataaagtaactcctttgaaattggtattttgtagggaggtattttgagctctgtaaatatcaaacttctcacttagctttttatttatctgagtatggactcctggtttcttctgtggtcctgtataatttgttactatcattatttattttgactctcaaactgcccagtatggccaatggagcttcttcaagcagactcctgtgttctttccacatgttctcacaacactttgagcaatttcttgctttaagcataggacgtttgtaggctcatcttgttctttttttgctctagacatggaatcagccaaatttcctaggcactctggttccatttggtggagaatggtatatagaagtcaagatttggatgctagtggtgctcattcgtatgggccatcattgtttctatgttctcttagtggagagagctagagaatatgtgtacaaatgttcctatacacactgaaactatgtgtttatttttatctctctatgtataattgagatccatgaggacataccaacgcctccagttatagtccaacaccacagggctcattcgactttcctcctttctgtcttagtaactcccttttccaacagtaggagacctggcccccattccccttactcactgtgtgtagccaatttcccttttcctttgccatttcacccctgtggggatgtctttcccagcctagtctggcttcaacaccatacaccatgctattcccatgagtggacatttctctctctgcttgggttatgacaacccatgccagatcccctctatgtggcctccttcctaattgccttacagtgcaaacctccaccccagacaatgcctgcatataaatgcccccgccccactcagctcatgttccaacactgcacaccaagctgcccatctgtggatttatccccaccatctccagccccaacaccctgggtcatgctgcccctctatgtggacttctcctcaccccactaccccactggaatgctggctctccacgccagatggcccccagccccctcctcccctaaccctacctagtgtggagtcgcaaaacccctttgggctttgacaccaccataacttcacaccctccctgacacccccaccttgctttttccctctaaatcattcaggaaagacagaaggaaagagatgaacagaggaagagcaaatgccatgctcttagtcaccgtgtacgcccacttcctgaagtccatgcttgcatcctgctcactctcacacattcccgactcacccaggaaaactccctgaggccaggggtgctgagctctccatctcactgcccagaggccagtgttggagtgacccttcacatgcttgttggaacattgaataaatgatgccgtctgctctaatcctccattttcttttcttttttttctttttttttctttttttcgagacagggtctcactatgtcagccaggctggagtacaatggtgcaatcgtagttcactgcagcctggagtgcaatggtacaatcatagctcactgcagccttgaactcctgggctcaagcaatcctcccatctctgcctttggagcagctgggactacaggtgtgcgccaccatgcacggctaatttttttattttttgtaaagacagcctctccgtatgttgctcagctggtctcaaactcctgggctcaagcaatcctcccacctcagcctcccaaagcgctgggactacagacatgagcaccacatccagcctctaatccccatttataaaatgcactttccaattccactctggggataaaggcgtcacagaacctgactctgcatttccccacccatatcattcaagccagatggggaggcagggacagctctggtccctccccaacccgggtagagatttccagcccagctgtcacagctctaagacaccgggaccgaaggagaagccaagagaggcaggaagaggtggcaaaggagtgctggagaagataaggaggctgagctccgacagggagcagggaggaggggccatcttgagactggtgccctgcgagctccaccccacccctccatgcagttccccatgggccccgcctgcatcttcttgaggaaaggcattgctgagaaacascgggtgaggtggggagtgagggggaagggcggtgggcggggcaaagggagcaggggtgtgggacaaagaaggggacatgatggtgccacagaaccaggggaacaggtggatagagcaggagctgagaaggtataagaaattccaaggaccctggtggggtcatgtaagccagtgagataaatgggtgggggtaaaatcaaaagtcaggagcaaagagaaggagagaaaaggaagaaaaatgaaaagggaaagtgggatgatgtcattgttgagattaccatcattcttttctatggatgctcattgtgataatggtggtgatgatggtggtggtggtgatgataatgatgacgttaataacaatagctgccacttattaagtcattgttctgtgcccagccctgtgcaaagggatttgcacacctgatgttatttacacctcagaacaactcatgaggtcagtgactttcattcccattttacaggtgaggaaagtgaagctctgagtcatgaagtcatttgccttaagcttacacagttagtaagtggcagggtcggccaagtatagtggctcatgcctgaatcgcagcatcttgggaggcagaggcgggaggatcacttaagtccaggagtttgagaccagcctgggaaacacaagaccccatctctactaaaaatacaaaaaaatagctcagcatggtggcatgcatctgcagtcccagctactcaggtggctgaggcaggaggatcgcttgagcccaggaagtggaggctgcagtgagccctgattatgccactgcactccagcctgggcaacaaagtgagactttgtctcgttaaaaaaaagtaagtggcagggtcgggtttgcttgattcctgtgggcatgctttttaaaatttttttatttttccatatataccaacttgtccagatatgtgggcatacttttcattgttaggctttaagatcaccaaaaaaagagaataaaaaaggccaggcagtggctcacgcctgtgatcccagccctttgggaggccaaagcaggtggatcacgaggtcaggaggtcaagaccagcctggccaagatggtgaaaccctgtctctattagaaatacaaaaattagccgggtgcagtggcaggcgcctgtaatcccagctactcgggaggctgaggcaggagaatcgcttgaacccgggaggcagaggttgcagtgagccgagttcgtgccactgcactccagcttgggtgacagagcgagactgtgtctcaaaaaaaaaaaagagagagagaatgaaaaaaagggtgataagggaccgcaaggaggggatcagatgaaagagaagctgagggaaaggctccagggataaagggagatgggaaggctaaagagaccagaggtcagtagaatttccttgttaacatgccatgtatatgtaagcccaacccttcaggtatgtgcaggagtaggtggggcagcaataactggacattctcagagtgtttaggaactggtcatgctggcactgaccctcctgcctgaaagccattgaatgctgtttccatgcacagagattctaacctttggcaggaagattggaggcaggtgagaaaggagtgaatgggggctagtgtgaagaattctgacttgggagtcaggagccctgaattcaaatcccaatactgtgtctgacttgccccatgacctccagggagcaggtgaatgccttcctcccttgggaggggatctgctgcttgtgagctgtgtgaccttgtgcaggttccttaacctctctgttcctcagctttctcatgggtaagatggaaacgagatgtagatctgcatcacagagcagtactgaggtttaaatgaaatgattgtggaaactgcctggcacagagtcaccactctgaatgagttagctgtggttgtgaagtctcacttttttcatctggagattggactccccagtgtttaagaccccctttgacacaatgtgatgggtgtttgtctcagaaagggagaaaaagggagattgggattcgtgggtgggagagagacatcgagaggggggtggggagccaagaactgtggaacaggagtcaggagatgggaaaaggaatgggagggatggaggaggagagagagaatggaaagagaaccacgagagcgtggggaggagcttgggagaacaaggagaccctttggagaatgggtgaccctctctccaaattccctctcatctgcattcctttccaggaaagaccactgggacaagatgarattgaaggtaacaccgtcttccccagttgcttccacgttgccatccacccacctgacctgccctcagtccctttgtgcatttcygtataaattccattacatggaatttttacaatccctctctcttcccactcaactgtaattttgtagaactctttctcgtggcagttgaaggacttcccaaagtatttcgaaggcatatccatcctcaagtatctccaagactcaggagtgaaaacaaatgagtttctctcttggtgactttgaggttccccataacttcatccaggaatctgaaggacgccagtgctctcatttagtggtctcaggaatgatgcctcttttgctaacacatttcatacatcactcctttttgaatttttttttcttttttgagacagagttttgctcttgttgccaggctggagtgcaatggcacgatctcctctcactgctacctccgcctcccaggttcaagcgattcttctgccttggctgaggcagcctccctagtagctgggatcaaaggcatgagccaccatgcccrgctaattttttgtatttagtagagatggggttctgccatgttggtcagtctggcctcaaactcctcacctcaggtgatccacccacctcgacctcccaaagtgctgggattacagccatgagccaccacatccggccttggtttttttgttttgttttgttttgtttctaatgtacgctcctttaaggagtctctagttggagcctcattgatagcttcaagagatgccactcttccccactgactgcttcaagttcccccaaagttctctcttaactttcagagctgcgggaagcatttcttgagttcgataaggaccgagatgggttcatctcttgtaaggatctggggaatctcatgaggackatgggttacatgcccasggagatggaactgattgagctcggccagcaaatccgcatgaacygtgagtccagggaatgggagggatggccggggttagggaagggatcagggcagaattgggaaggatgtagaggttaagagtagagttsggggtggagaggaggatgagagggactagaagtctggaagaaaacaggtcagattcgactcaggaaggcagcatttgaagtggttaaaagcttttagagataggtctgggttcaaatctcagttctattatttactaattacagtcattttgaaaagtgaagttatccgctactcttgagtttccatttcctcatctatagaggaagatgcctctctccttacctcatgggactgtggaaaggaagagaaggaagagataaagatgctgatgcagttaaagtcttagcctccagtaaattcttattaaaggtagttattactatcaccactaagattcatcagtggagcacgagattggagctgtattggatgttggaaacaaacttggagctggagctaatgttggtgaatacagctgcaaaaaggatggatggatttttggatggagatcataactgatttttagattttagctagaataaaattcctattgaggctgggcgcagtgtctcacacctgtaacctgtaattccagcactctgggaggctgaggtgggcagatcacctgaggttaggggtttgtgaacagcatgggcaacatggtgacaccccgtctctactaaaaatacaaaaaattagccaggcgtgatggcgtgcacctgtaatcccagctactcgggaggctaaggtacgagaatcgcttgaacccgggaggcagaggttgcagtgagccgagatcgcaccattgcactccagccttggcaacagagtgggactctgtctcaaaaaaaaaaaaaaaaaaaaaaaaaaaagctattgggtttgcttctgggcatgtaacgaactaaacaaggttgaattcaaggtaatgatagtattcatatctgaaaaaaawttgtatgctcatttaattcatgctcctctttgtacaggtctacagaggaggagaaacatcttaaccaactgtctgaaagtcacacaggcagttacttccaccataccacaccctatccactcctgttcaggctagagggacatgagtttggagcttggagttagctgctggagggaggaagtcaaagacggctcttatagggcagggagaagggagctgatctaactgactcgaagcacaaagtgaggtaatggaaggccagggcttgtggggtctcgctaatcctgtgccatcytcctcagtgggtggccgtgtagactttgatgactttgtggagctgatgacccccaaattgcttgcagaaacagctgggatgatcggtgtccaggagatgcrggatgccttcaaggaggtgagttaacagtgtcatggtgctggtgatggtagaggcagaccctctgakgtctgcctgtaattagccaatgccatggacagcacccaccaaccaggcccccacctttttttttccagccatggtgggatcrataaatagggaagaaaaataacrtattccaaacacctgcaatggatcaatgcctctgtatactttatctgatttaatcctcaaaaaaacaaacaaacaaaaacaaaaacacrcacacaaacacattaggagtaagcaagcagtcatgtatcccaattaaacagatgagaaaagtgaggctcatgaagattataaatyttatccaagatcctgccatctctagaataaatgttaggactttwtttttttgagacggggtttcactgttgtccccaggctggagtgcaatggtgcaatctcggctcactacaacctctgcctcccgggttcaagccagtctcctgtctcagcctcctaagtaactgggattacaggtgcgcgataccacacccagctaatttttgtatttttcgtagagacggggtttcaccatgttgaccaggctggtctcgaactcctgacctcaagtgatccacctgcctcggtctcccaaagtgctgggattacaggcatgagccaccgtgcctggccagggcctctattcttagtgcctgtaacaggaagaatccaagaatttgagatcccagaagggaatgcaaagtggtcatmtggtacgaaccacttgctgcagacatactaaaaaatatcagacccagtgagaataacagacttgcttatatcccctgataaaataccttctcgttctgagagctttcagcaacacaaggtgaaaataaagagtagtagagtgtttgggagcaaaggatttggaaccaggcaaacatgggttcaaatcctaggaggcctccacctattggctgtgcaagtgcctcccccagcttcttataaagatctacagctggccgggctcagtggctcacacccataatcccagcactttgggaggccgatgcaggtggatcacaaggtcaggactttaagaccagcctggccaagatgctgaaaccccgtctctactaaaaatgcaaaaaaatttagccagacatggtggtgggcgcctgtaatcccagctacttgggaggctgaggcagggaattgcttgaacctgggaggcagaggttgcagtgagctgagatcgcaccattgcattccagcctgggttataagagtgaaactccatctcaaaacaaaaagaaaaagttgtctggattgagaagtgctgtaagtgtaacgtgaacactgtattaagacttagtatgctaatataattagcataacgtacttgtatacttaagtaaacttctaggctaagtatcctaattaagcatgctaagcacctactaagaacttagaacttactgccttatgaaatccagtgtgtataaaaagaatgctacttacatagctaaattaataatttttaagtggattacatgatgaaaggataacactttagatatattgtgtcaaataaaagagaatattaaaaattagtttcatttgttccttttaacatttttttaaacgtcactactagaaaattttaaggccaggtgcagtggctcatgcctgtaatcccagcactttgggaggctgaggtgggtggatcacctgaggtcgggagtttgagaccagcctgaccaacatggagaaaccccgtctctactaaaaatacaaaattagctaggcgtggtggtacatgcgtgtaatcccaagtactcaggaggctgaggcagaagaatcgcttgaacccgggaggcagaggttgcagtgagccaagatcgcaccactgcactccagcctgggtaaaaagagcgaaactccacctcaaaaaaaaaaaaaaaaaaaaaaaaaaagctgaatagtattccattgtgtacttatgccatgttttctttatccactcttctgttttgatggacacaggttgcttccataccttggctattgtgaatagtgctgccatgagcaggggagtgcaaacatccctttgatatactgatttcaattactttagatacatacccagaagtggtattgctgggtcatatggcagctctaggtttaattttctaaggaacctccataccattttccataatagctgtgctaatttccatacccagcaaaagtgtaccagggttcccttttatccacatcctcaccaacacttgttattattcatctttttaacagtagccatcctaacagatgtgaggtgatatttcattgtggttttaatttaaatttcccaaatgattagtgatgctgagcatttttttcacgaacttgtttgccatttgtctgtcttctttagagagatagctgttcacgtcttttgcccatttgtcttctttagagagatggctgttcacgtcttttgcccatttgtcytctttagagagatggctgttcacgtcttttgcccatagttattagattgatgcaaaagtaattgtgattttgccattaaaagcaatatttgtcattatgcagtattattaattataggcacaatgccacacagcagatctctagaacctatcttgcgtaactgaaactttatacccatggtacaatatctccccatttccctgtcctcctaacccccagcaactatccttctactctctgcttctatgagtgtggttattttaagtacttcatatgtaagtggaatcatgcagtatttctccttctgcgtggtatatatttaaatgcaatattcagccttacaaaagaaggaaatcctgccccacacaacaacacaaatgaacctggaggacagtatgctgggtgaaataagccaggtacagaagacaagtatttctaagtgtcttgcttgctgctccgtgctcagtcccaagaacggtgccttccacatgggcactactgacacatttttttttagcaatatggatacatatgtgttgaattaatgaactgcctccaaagctctgccctgcacacccttaactagtctaccagaaagtctagtacgttcaatttccaaaacatcggggagtgaactctccttcttgagctctgctggtgctaactggctcaaaccacaaccatctcctaccaggatgatcatggcggccctctaattggtttcctggctcccatcgtggtcctactgtggtctgttctctacacaacagggtttcatgctcacattcttttaaaatgtatatcagatctggtcactcccctgcttaaaattctccagtggcttcttgtcttactcagaaccaaatcctgacaacgtcccatgacacacaagcccctacgtacttgggccctgccttctgcaacactgagaccttgtctatttcatgctcatttctccccagctcacgcctccctaaacactccccacttctgcctcttcctcaagtacaccttcctgccttacggcacttgttaacttgcagcttcctcagcctacagctgtgtcatccaaaataaatacaatgtaagcagcatgggtcatttaaaattttctttctctttttttgagacagttttgctcttgttgcccaggctggagtagaatggcacaatcttggctcaccacaacctccacctcccaggttcaagcgattctcctgcctcagcctctcgagtagccgggactacaggcatgcgccaccacgcctggctaattttgtatttttagtaaagacggagtttctccatgttggtcaggctggtctcgaactcctgacctcaggtgatccacccgccttggcctcccaaagtgctgggattacaggcatgagccactgagtccggcatattcagcttttaaaaagaaggaaactctatcatttacaacaacatgaataaacatgaagcacattattctaagctatataagccaggcacaaaaggacaaataccacatgatgttacatgcagaatcttaaaaaattgaactcatgcaaataaaaagaaaggtggttagcagaggctggggagccacagagaaggaatggacagttgcttgtcaaagggtacaaagttttggttagacaggaggaataacttttgagatctattgcacagcaggataactatagtaaataataatrtatgtttcaaaaatcacytaaaaagtaagttttaaatgtatcgctgggcactttggctcaggactgtaagcctagcactttggaaggacaaggtggaagggttgcttaaggccaagattttaagaccaacctggccaaaatagtgagaccccgtctcattaaaaaaaagtttcggccgggcacagtggctcaagcctgtaatcycagcactttaggaggctgaggcaggtggatcaactgaggtcaggagttcaagatcagcctggycaacatggtgaaaccctgtctctactaaaaatacaaatattaaacaggtttggtggtgcgcgcctgtaatcccagctactcgggaggctgagggacgagaatcgcttgaayccaggaggtgaaggctgcagtgagctgagattgcaccactgcacttcagcctgggtgacagggtgagactgtctcaaataaaaaaaaaaaaaaaaagaaagaaaaaaagaaaaaaaaaaacagaacaaaactgtcttttggagctgacgttctagtggctcacattcccaaagcttttatctcagtgcttgacccacagtaagcgataggtaaactccatcatctcgtggctatcatcattgtcattgctgatataatctatttctgcttctattcagtttgacacgaatggagatggggagatcaccctggyggagctacagcaggccatgcagagactcctggggragcggctcaccccccgggagatctctgaggttgtccrggaggctgatgttaatggagacggcacagttgactttgaaggtgacattgacggggcgtggtggggagcgggggcagccaccgcaggaatccacttccaactcactgtcagattttccaagttggccactccttctcactcctctccaagtttgagaatggaagcgggtggcaggttttggaagcatytgttctgtccctttcttcccaggctattcatttcaaagagctgggtgtcscycacttctggtggctccgaggaacacctcagccaaggccctttccttcccatgctcaggacgcccttcygccttgcccattccttgttagtttgcagggcaccttttatcctaggaagaacttgtcccatcagaaagagactggactggctagcagctggagctctggggtcaggttcaggrgcttcaaattcaggatcatcgctgactcagcatgtggcttatgctactccctttttctctttaagggtcagttttcccatctgtaaaatgaggtggatgatgacaccttttggagaaaactaaaagaaatcatgcacaaagcaccactgtatttttaaattwtccttccctgtctttgctcragttgtccttccgtctggaataccctttcccctctcccctggctaaytcctagttatgttcctggaaggtacctcccacctctcttactgggctccgtgtccctctkctgkctccccagtaatacctcccgcttgcttctgcagtaatacggattcgtggcatctctagagtttattgcctatttccttctgagaccatggaccaattccttcatcatcactatatccccaaatcctagcactgagcccagcatgagtatattggatcactgaataagtgaaaaggattggggttctacatggatgagacgtggggttcttttttatgtgaggcataggaaggcatgtcggccggacatggtggctcacgcctgtaatcccagcactttgggaggccgaggcgagtggatcacctgaggttagtagtttgagaccagcctggccaacatggcgaaatcctgtctctactacgaatacaaaaaaattagccggaagtggtggcaggtgcctgtaatcccagctacttgggaggctgagacaggagaattgctagaacgctgggggcggaggttgcagtgagctgagatcgcgccattgcactccagagcaacactccgtccaaaaaaaaaaaaaaaaaagcatgtcaagttctaattgtgacattctttggttcaaagatctcagcacctatctgctgcttatggacaaaaatccaaaattctggccgggctcagtggctcatgcctgtaatttcagcactttgggaagccaaggttggcggatcacctgaggtcaggagttcgagaccaggggggccaacgtggtgaaaccccatctctactaaaaatatacaaattagctaggagtgacagtgcacgcctgtagtcccaggctatacgggggctgaggcaggagaattgcttgaacccaggaggtggaggctgcagtgagccgaggtcacaccactgcactccagcccgggcaacagtgagactccatctcaaaaaaagaaaaaaagaaaaaaaggccaggcgcgtggctcacacctgtaatcctagcactttgtgaagctaaggcaggcagattgcctgagctcaggagttcaagaccagactgggcaacaccgtgaaacccatctctactgaaatacaaaaagttagccaggggtggtggcatgtgcctgtagtcccagctacttgggaggctgaggcaggagaattgcttgaacttgggaggcggaggttgcagtgagatcgccccactgcactccagcctgggtgacagagcgagactccgtctccagaaaaaaaaaaaaaaagtccaaaattatttgtctgatatgcaagtctatccatcatctggcctcgcccacccacccagcctgtatcttctgtagctattctctgaacttttaagttctggcacaaacttggtgcctgctttatgttctccaacctccgttcctaggcatcagatgctccgtccacttaccacatctttcagtctcatccatccctcaggaactcacatcaaggcaacctttgtcaggaagcttctctccatccttccctcatgtcttcctcccagctgtgaagtcttacagaagtttttctgttcctctccatggaagttatcacagcagaccttgctgtgttgagttgtattagcttccaagrcctccatcctagatagagaggaggaagggccattctctaaaccatatatgctgtatgtcccagtatggaaacayagtagaggctggttggacacctgctagatctagccaggattaggtgtgcagtggacatcaagtgacatctggagaaggtggggtgggggtgggagatgatcctcaggccaaccaaaggcaagggaaggtcaggatgacctcaagaccygggtgggcagcaagatcgtcttgagccacagcaaagtcaggtgcaacctgcrttccttccagggttcaccattcactatccacgtggcctcaggyatgttggtgaccctcgctggcgtaagtttccttatctgtaaagtgacacttatccctccaggatggttgagatgatgaaatctsatagtgacaatcacaggttttttgggttttgttttttagatggagtctcactccgtcacccaggctgcactacagtggtgcaaccttggctcactgcaacctccacctcctgggttcaagcaattctcctgcctcagcctgtggagtagctgggattacaggcgcccgccaccacgcctagctaatttttgtatttttagtagagacggggtttcaccatgttagccaggccagtctcaaactcttgacctcaagtgatccaccctccctgacgtcccaaagtgctgggattacagttatgagccaccgcgcccggccaacaatagctgtttatgggatacttaatctgttttgtgagcattatgccattaatggtcttaaaaaccatataaggaaatagcaatactaggattcccattttttaaatttaatgttttatttacatgcaagattattttcataacagaaatgaagaaactgcaacatactgaaattagtctttcagaagtaggagcataataataaccacagtagtttacatggggtgactgtgatggcaggcacggttctgagcaaattttatttacctatttaattttttaatttttttgtagagttgggggtgtcgctatgttgcccaggctggtctcgaactcctgggctcaagcgatctgcccacctcggcctcccaaagttctgggattacaggcgtgagccaccgagcccagcctgtaagccaattttatctcaacctcatgaggtagmtctattaaacatgccaacttgacagatgagaaactgaggcacagggttaagtaacttgccacagagatctgattcccatttcatagatggagaaatggaagcatagagggattaagtaatttcccagggatcaccagcagtgcctgccacataggaagggctcaaaaaataatgttgggggcttttacaacgagatgccttactggggattyttttttttctttgcagagtttgtgaagatgatgtctcgctgaggaggtcctggaagctccagaccctctccacctggtcaacatggagcaagcgcttgtggagaaccaaagcccmaaagccccagatcsccttaaagcagagagggagggcaggcgggagggagggcattggcatgcggcgctgtgcatggggtgagacccagagcggtatctttgccaggatgggggcgtctgcagaactagrttaagaaggaagagtctgtggatggaaataggaagcgtgggagggtccagttgccacccccaaaaattccaatgattcttgacatcttttcacttcacgtagtcctaagtccctgtgacctgccagagtctcttccccagcttccccttgggtgaaaatagtctcttctcctgttgggtatcaaaaggttcagaacgtagtctctactcttcccctgcctgcatcaactgttgcaaatcccgtttctctctcccggtaaggggacaaattatactttattcaggtgatggttacatgaacagcccagacttcaccactacgcaatatatccatgtaacaaaaccgcacttgtactccctaaatctatagaaatacaaaatgaaataaaaaggatgcaaatcagtcacagagctggaaacagagttgttgttgaggctgggcttggaaatggctcgtgcaagtggcattcaaagtcaactccttccttttcctgatttcctggaagcactgtctggtttctctctctctctctctctctctctctctctctctctctctgtctgtctctgtctcccctcccacatcccttcctttgtgtaagatactcaggggactgaattaaaccacaaatctggattatcaaggtttagagctagctgatccttggggaattaatcccctgaaaaaatgtcatcatgcaaagagagagatgacaggatcccccaaatccccagttcagccaggttgttgcaaagtctttcctagaagcctcctacctccgcgctggtctgtcctggaccacccagaggctgtgtctctgttagatgggtcgtctgttccgtccctcacgtcctgacatcgatctgtgccatgaaacagaaaagagagattcctcctgacctccgcccaaagcaagacactccagcaatgcaaaggttaaaataaaagtcaaaataaagaattaacttcatgccttcctccaactttttcttgctttgaagtccatgaattagatgtttaaaatgagtcatctggttcaatagctttgttttattttattttattttatttttgtatttatgtattatgtatgtatgcatgcatttatttatttatttttgagacagagtctcactctgtcacccagactggagtgcagtggcgcgaattcggctcactgcaacctccgccttctgggttcaagcgattcttacgcctcagcctccagagtagctgggattacaggcgtgcactcgtgtgccactatgcctagctaatttttttttttttttaagtagagatggggtttcaccatgttggccaggctgtcttgaactgacctcatgtgatctgcctgcctcagcctcccaaagtgctaagattacagacgtgagccactgcacccagcctatttatgtatttatttttgagacagggtctcactctgttgtccaggctggagtgatctcacctcactgcaacgtctacctcccgggctcaagccatccacccacctcagcctcaccctcctcagctgggaccataggtgcatgccaccatgcctggttaatttttgtatttttttttttgtaaagacagggttttgccatgttgcccaggctggttgcaaactcctgggctcaagctatccacccttttcagctcccccaaagtgctgagattacaggtgtgagccaccacacccagccaatagctttgttttataaaataaaaaaattaagaaaaagtggagcccttggggaagccgaggagggagggtcacttgaggctgggagttcacaaccagcctggcaacatgagaccctatctctacaaaaaaaaaaaaaaaaaaaaagaaagaaagaaaagaaaaaaaaaatagccaggcatggcagtgtgtgcctgtgatcccagctactcaagagactgaggcaggaggaaagcttgaactcagaagtcaaggttacagtgaaccaagatggcaccctgcactcagcctgggtgacagagtgagtccctgtctctaaaaaagaaaaagtggaagcagaataatgttatttcctaatctcaagctctttcctcagctccatcccattccatccacacatgcacccatccgccccttcatttcttcagtcacccattcaaaaaagattttctaagtacctggtctatgcctgacattgtttcaggtaatggaaatagagcaaggacaaggtatttggcctcaacagtctcatattttagaaccatgcaattcaatagaatcttctgcgaggatagaaatattccagacccgcgctgtttattatggtagccacatgtgactactgagtattaaatgtgtgagcaaggctgagaaactaaattttattttatttttatcaagtgagaacagttttattaatgaatacataagtgcattagtctgttttcatgatgctgataaagacatacccgagactggataatttataaagaaaaagaggccaggcatggtggctcatgcttgtaatcctagcactttcagaggccgaggtgggtggatcatctcaggtcaggaggtcaagaccaacctgatcaacatggtgaaaccctatctctactaaaaataaaaaaattagccgggtgtggtggtgcatgcctgtaatcccagctactcaggaggctgaggcaggagaatcacttgaacttgagggggtggaggttgcagtgagccgagatcatgccacttcactccagcctgagtgaaagagcaaaactccatctcaaaaaaaaaaaaaaagaaaaagaaaaagaaaaaaaggtataatggcctcacagttccacgtggctggggaggcctcacaatcatggcggaaggtgaaaggcacgtcttacacagcagcaggcaagatagaataagagccaagagaaaggggtttccccctataaaaccatcagctcttgtgagacttattcactaccatgagaacagtatgaaggaaacttcccccataattccattatcttccaccaggtttctcccacaacatgtgggaattacgggagctatgattcaagatgagatttgggtggggacacagccaaaccacatcaataggtaacatgggaattatgggagctacaattcaagatgagatttgggtggggacatggccaaaccatatttccatcctcgcagaagattctattgaattgcatgtttcaaaatataagcttgttgaggccaaataccttgtccttgctctatttccattacctggaacaatgccaggcatagaccaggtacttagaaaatcttttttgaatgggtgactgaagaaatgaaggggaagatgggtgaatgtgtagatggaatgagaattgtgggagctatcattcaagatgagatttggttggggacatagccaaaccatatcggtaaggaatgttattaattacttaagttaaatgtaactagctccttatggctagtggctactatattggacatcacaatttcatgttatatgcctgggattattctaggtcctggaatgtgcccagcaataaggtcttttggtttcttgcaggctacattccagtgccaggggagtaaaaaattaaatccatcagaagcagctcagattgggacaaatactttgaggataaattgggatggttggatacaaagataatttggggaaggggcttaatcagagtggtcagaagggacatctctctatttttttcttcagacagagtcttgctctgtcacccaggctggagtgcagtggtgcaatcacagctcactgcagcctcaaactcctggactaaagcaatcctcctgccttagtctcccaagtagctggaactacaggtgtgagccaccaaacccagctgatttttgtatttttttgtggagatagagtgttgctatgttgcccaagctggtctcaaactcctggcctccagtgatcctcctgccttggcctcccaaagtgctggggttacaggcatgagtcaccatgccctgccagaatgggcatctcttaaagatgagctgtctcaggttgggttccccagggctcctcctctgtccaagagcagagacagcaggcaggaggcttatcagggagtttccttgggatcagttatggaagggaagggaaggaactgggattggacagagggagaggttgagccacggtgcaggctctacaacctcagcggaacagacgggagctctggatgtagctctttttgagttatctcacttggactggaatagccaggcctttaaacccagcattggtcattcgttagttgtggcctaccctgggaagggcatggtttgggcgagggaggccattttgaagctgagaccatctctgatttgggctgaacaccaaaggctgcctgcagacagcactcactggagctgggcagcaagtcctttcttgaagggggatctaggaagcccacgtctatctccatcacaggggcaattccacggacaatgagtgaagggaggaggagactgcaggaagacaaggggtaagagaattccagcacaaggaagacacggaggcggggggaggaggaggagagggagaaggagagggaggaggagaaggaggaggtgaagagggaaaaggagaaggagagggaggaggagaaggaggaggagaaggagagggaggaggagaaggaggtggagagggaggaggagaagagggaggagtagaagaaggaggacaagagggagtaggagaggagtaagaggagacatggaggagaaggaggagaagatggaggaggaggagagggagaagaagagtgaaaggaagaagaagaaagaacaagaacaacaatgtgaatttccatctggactgagagggaatcagattctgtaatcagttcttgatatctgccatgggcacagggagggaatggttgaggcagtcttgtggtgaattttctaccctctgtttacttcctaatttattcattaataatttaatatgtatctacaaacaccccacccaaatctgtgatttccctcagaagacagagcaggctgtaatgactcctagaggtccctggcctgagagtctgacctctccacactatgagactcgacagcctggctaccaatctttccttccccacacattcaccatcggtctcatcttaggaagcagaaaaggcagatcccagggttaaatcaagactcctttattggtggttatgccgcattctctctacgttcttcacaaaggaccagctgattgaagcaggtggtgcagagggtatttctaaaggtggttatttaagcttgacagatgcaatgaaaaagacaaatctgtgctcagcctcagtatggcggcagtcttcctctgaagatatttctcctttccttgaaaatagaagcaaagatctgagtttaatgaataagtaggcattgactcaaagaggaaggtgaattaaaaatgactttgtattggttttccagacttagtcggaagcagctgagctgagaggaatcagacgcccccacccccacatccctgcctagctcataggagcaaggagatcaatgaacaatgagctcctcaatctcacctctatgctaaggggaaggggacctgcaaagtgccagttctgctgtgatggacagaagtcagaggctggacgctgttcctagtcctagccacagactgaacgccactgtgggtgttttttaatatctaccctgttaagatggtgcccagagttccaaaccccctcctttccctctcctctattccaggaagatgattttcattaccaaggcaaaattcaggaagggcccgctaatttagtgtcatccataagccacatgcattgtaaggacagacattgctagaaccaccagggttttccaccccaaagggaggagggatggggttttgtctacacatctgatgataagggcttctctttttttatttagattccagaagtcacagagcagtgaggtcagttgatccatgcgggagatttagagaccatttctacaggctggagaacatctttcaagcttaaataaccacctttagaaataccctctgcaccacctgcttcaatcagctggtcctttgtgaagaatgtagagagaggaaaagactagaagaaaaggagggataggccaggtacagtgactcacgcctgtaatcccagcactttgggaggccgagttggatggatcacctgaggtcaggagtttgagaccagcctggccaacatggtgaaaccccgtctctactaaaaatacaaaaaaaaaaaaaaaaaaattgctgggcatggtggcacacccctgtaatcccagctactcaggaggctgaggtgggagaatttcttgaacccaggaggcagaggctgcagtgagctgagattgcaccactgcactccagcctgggcgacagagtgagaccccgtctcaaaaaaaataaataaataaaataaagaaaaagaaaaaaataaagaaagaagaaagaaaaaagaaaaaaagaaaagagggataaagttggttctgtggaggtacttgatgaccagcgggctgaggtggggcaggaggcccaaatggtgaaggaagagaaataaaccccatttttcccttggtcagctactcagtgatgggggcaatggatgcacaccatggtgtcttggcttctgggttatccttcctttccttgcttccttccctccttccctttcttccctccctcctttcttcccttcctctctcttttcctccctctctctttccttccttccttcatctttcttccttctttccttcctttcgtccatctttctctttttctttcttagacaaggtctcactctgttccccaggctggggtacagtggtgtaatcatagctcactgcaactcctgagttcaagggatcctctgacctcagcctcctgagtagctggg

SEQ ID NO: 17812 - DNA, 13884 bp, Homo sapiens
tgagacctccaagagagagctccctcccacggggccgcgagctgagccccagggaggcagcatcccgtgcttctgctcccagcatgacctgcgtccatgccactcttcccctggattaaatgacaattagagtgtaggcagaggagctgggcgtgagcgagcaccacagggggaccgcctgtgcactcctgaggggactgtttcccattttatgtccacctccctccgatagcgcaggccatgcagttcatcttgtgtcccagcggcctggatcatgtgtctcagcaattttttcttttctttttttttttttttttttcctgagactgagtctcactctgtcgcccaggctggagggcagtggcacgatctcggctcactgcaagctccgccacccgggttcacaccattctcctgcctcagcctcccgagtagctgggactacaggcggccgccactacgcccagctaattttttgtatttttagtagagacggggtttcaccatgttagccaggatggtctcgatctcctgacctcgtgatccacccgtctcggcctctcaaagtgctgggatgacaggcgtgagccaccgcgtccggccacagttttttgaggcttatccgatttgccatcaggtcaaagccaggtgcaagggaattcccattctctgaaaagggtggccttcaaggccacagagctggagtccaggccaccctgggtgccagcctgcagcctgtcatttgtgagctgcaccatgagggctggaggccaggaaatggcgctctgtgcccccagtgtggggcacctcaagctagcatctgcagtgactgtctctttacggccaggagcggacaggtgagcccaccacagctcaacggccaggagcagacaggtgaacccaccacagctcacctgtggactgggaccaggcgaggtcccctctgcggctgctcagcccccggccacagccctaggcacctcagtctggagctgggtttgaactcgcaccgggtggcagtggaccccaggtgtggctacccatccctctggctcttggacactggtgcagaggggcctgtcctaggagggtgactgcccccatgtggtctagtggagaggatgtttggtcaggcagctgggaaggacggccttgctgtgtgacaggcatcgatgggcgtccacgccctccagggacgtcctgctccaggtggttggcactcacgttctcctcgctccccatgcagtgactagaaagcctgtgtgggattctggcaacggcatccgcccgccagcccctcccagggggtgccccagggcctctgccctctgcccgcagctcctcccccacagccacgcttccacccacccgttcggctgggctttgggtgggcaggcagacgtagaccctgcttggaggcggtggccctagagggatccacagatggggaaaaggccgagacacacgagaccactcctgccggggaaaacccatgagggggtgggggcggccgcgccgcagggaggggccctctgctgtcccagccaacgtcccatgacgattttgcacccccgccagcagtgccctcggctggacacacctgcgttgtgggcagccggcagcgcgtgacccactgtgcacctgcgccttgatgtaggggggagaccctgcagagagcgcttccttccgccctgtccagtgccctccctgcctcacccctcttcccgcaggcccgctcagggcgctgaagggctcctgaccgtgggtccgtccttcgctgcgtctggggggcgtcccccgcgctgcctctgacccgcccggccctgcgtttgtctgaagcccctcgttccgcatctccggaccagggtccgggggcgtggtctgctgggggcgggcccgggttgtggtttgagagccgctcggcctgtctgggcctccgcctccgggtcgccctccagccttcctgccgccgcttttccagtcttgcccaacccggtatttctgcgcttgcctcagccacccgcaggagcgcaggccgcccttcgtcctcccgtcctctgcgcccacaggaccccgggccccgcccagtccgcaggtcccgcaggtccccccgggcgtgtcttcctggccctgcgacccccgggacagcgctgagaacacgcggaaggtggggagacgcgcggcgctggccgggtccctggcgccgttctcgcggtgcagcctgtgcctgggagtccggccgtcccacctcagaaccagagcaaagcgggagatggggcggcggccgctggggagaaggcagccccgggtcggaggaggaaggaggcgggggcggagcggagtccgcggtggggctgccttcttccatcctcccctgggcggggcgcaggatgcgggggcgcccagccgagggagggaggccggggaggacactcctgtgcccgagggctccggcttcttctgctcactccctcctgccgaacttttccactcggccatttacctcctcaggcactggctgccctcatcaggccgaccaggtcctgcccgagggaacggcgtgtgtgacccacgtgtggacagacctgttccccatgccaggagggagggtcactggctccaccgggggatgggggacgagggcactaggccgaggtggggggcttctcgctctccccgtcttttcctggcgttttcctccattccctctggctcctattccctcccccttcctctctttcttgggtatggttgagcaggtcgtgcactgcacaaggactcccagcagaggacgaggactgacatcaatttgtctttccctcccaacactgtgcgttccctaaccctgcacgaaggcaccctcctcccctcctcaagattccccacccggcctggcctgcagccctagccccaagccgcagctgggcaggttgggcagagcactggggaggccaggcccggccatgctgagcccggtgactcgtcagggtttccacaaaacatcttgagcacccagctgcaggcccctcgggacgtttccaatgaggctcccctgggcccctctctgtggcagaagggaccccggggctgcttcgtaggtctcaacccaggggaggcccccagagactccggagccagggaggggcccagccccctacccccaggctgtgcttggcatgcagagattgcggggggtcttgagtttttgtccccagaagaatggctgagtggactctggagaaaagacaaacacccctgccccactgccgccgccctgtctcccaacagtaagagtgcttgtcagcctcctggcggcaggtgctgcggcctgcgaccacctgagccaggcaggtgatgctaatgcgcctcagggcagccctggcactggagctgctatcatcccactgtacccatggggagagccgctctcctccctcctttttccattctgtgttatttacagagcaccctcctgtatgccctgcactactctcaaccctgggtacacagatggggctgccacagacgtggccctcaaggcgctcaggccgccttttggggagggccgtgaggggctggaatttttctgagacagccaagcgcccgtgcagagaggcctgtatcagcccagcctaaggcagggccaacccacacaggagcacctgtcctgctggggatgcagtgggttctgctgtgtcctggaaaaggctctacccacaccctaacccaacctgtgaacgcgcgctcatttggaaaaggggcttttgctttgatgtaattagggaaaggatcttgagatggctcatcctgggttaaggcaggtcccacgtcctgagaaggggggagggattatcttttagactgggccctacatccaacaaccagtgtccttataaaccacagaagaggaaaaggcgggtgcagcagagaggccacgggaggagccgccagcccgggaaactgagggctggaagagcctccaggaggacccagccctgaacacgcccagctccacggcctcgtggaataaacttctcccatttcacaccccccagtttgtgttgcatggttagcacagccctaggaaaccagcacggatagtgagctccccgtcacaggaggtatgcaagcagagggtgggtgggcaggggcactgtcgggaggagcagccctggggactccagcaatctgtctttgattcctcccagactgttaaccctggggcacagcctccttcacccccagaggcccacagcagacaagctgagagccacacagcggccaagaggaggtgctggagggcccaggggtcccagtgctgcctcagccccacccgacttgggagcttttgtgttcagagagactgaggttttcagcttagaggacacctccgtggaacacatctgcaccgcggcaggggaggaaaggctgggggcacacaagcaccctccctcccgccctcaccccgaagctgaggggaccagggcggacagattcccccacctctgatgtggccaggggccctggggactccaggacaaccctcctcaggatgacgtcaaacccccggcattcaaaccttcccaagttctggctgcagctgtccctttccggggaaacaaaggcacctccagcgcccccacccccagccagcctcaccgatcaaggaggccaaaggcagctcccggccccgcttacataaagcttcctgtgtgtgctggtcacacctcacacctcacgcctcacgcctcatgcctcactcacacctcacacctcactcctcacacctccaactcagactttttagcttgaacttttttctcaataaaaccacagaagcccaggccgggtgcagtgactcatgcctgtgatcccagcactttgcgaggccgaggtgggcagatcacgaggtcaggagatcgagaccatcctggctaacatggtgaaaccccgtctctactaaaaatacaaaaaaattagccaggtgtggtggcgggcgcctgtagtcccagctacccggcaggctgaggcaggagaatggcgtgaacccaggaagctgagcttgtagtgagccgagatcgcaccactgtactccccgcctgggcgacagagtcagactccgcctcaaaaaaacaacaaaaaaaaaaacaacacagaaacccaacagagacctgaagacgtgcctgcctcccccatctccgggacctctcccacctgggtgaagggggcacgtgagcctcacctgatcttgaccatctcagctaaaacactgaaccacccttggcacccaccagcagcagacggagaagaactgtatagggtgcaaaagcgccccgccaccatcaggtccagatgaaaacctacaagttgaatcagcaaggtgctgacggatacgcaagcagaaaccctcttataggaggttcaaggctgggcgcagtggctcactcctgtaatcccagcactttgggaggccaaggcgagcagatcacttgaggtcaggagcctcagaccagcctggccgatatggcaaaaccctgtctgtactaaaaatacaaaaattagccaggcatggtggggggtgcctgtaatcccagctactcggaagcctgaggcaggagaatcgcttgaacctgggatgtggaggttgcagtgagctgggacagcaccatttccctccagctcgggtgacagcaagaccctgtctcaaaaaaaaaaaaaaagtttgagaatgtcagacaaggcagcaccctgtgtaggtgctcaggttgggcggagtctctctcgggggaggggggtaacaggacagcgcctcccggggcctccttgcatgtctgtgtcctgatgcacagcaggcgggggctgcggggaccagagaaggaagaagcgccccagctgggcacttcccgaggaggaagtggtgccggaatttcccccaggtgtggcctcaggtataagagcggctgctgccaggtgcatggccaggtgcacctgtgggattgccgccaggtgtgcaggccgctccaagcccagcctgccccgctgccgccaccatgacggtgagcctctccacatgccgctcggatggatgctgcttggatgtgcagcctggcatggaagggctggggttctctgagcctgggaggagggtgttgggatggggtctgggaaacccctcagtctgggggtaggggaggcagctgcagatcctcggagcgctggcatgctgggtgtcttgggctgaagggctagcctctctgggcttcagtttccccatctatagagggagggctgtactccatctttccgctgggaacaaggaaagctgaggtggaagtgaggtgccccctgccctgggcacctcctaaccacccacctgcctgtttcaccagctcctccccggcctcctgtttctgacctggctgcacacatgcctggcccaccatgacccctccctcrgggggcacccccacagtcacggtaccccacactgctactcggctgaggaactgcccctcggccaggcccccccacacctgctggctcgaggtgccaagtgggggcaggctttgcctgtagccctggtgtccagcctggaggcagcaagccacagggggaggcacgagaggccctcagctacgacccagtgcccggtgctgcggccggaggaggtgttggaggcagacacccaccagcgctccatctcaccctggagataccggtgaggacctggggattccgctgtggcgtggggctgcccctcccctggcggggccctgactgcccggagagctctctgggccttggcggttctcacctgtcaagtgggcgtggccacctgagctccctccctccggccctcctgacctggacggctgagctgctgcttgcggctggccgtgccctgcctsccactgtcctaggtggccagggtcccctggggaaattctgggcccktcacctgagctcctgcagaagtggggctgggtgatgaagtggaagggaggctcctagaggcctccggaccctgctctgtgctcttggagggccctggggagacgtggattaccaccacatgtgagcccgactgcaccccaagcccgtgtggctcagccctcgctgcctcaggtcctatcctgagtacacggagaggggccctgaggggagaggggcctccaggaggacagggtagggccagagactcactgtgcaccccgtcccgcagtgtggacacggatgaggaccgctatccacagaagctggccttcgccgagtgcctgtgcagaggctgtatcgatgcacggacgggccgcgagacagctgcgctcaactcygtgcggctgctccagagcctgctggtgctgcgccgccggccctgctcccgcgacggctcggggctccccacacctggggcctttgccttccacaccgagttcatccacgtccccgtcggctgcacctgcgtgctgccccgttcrgtgtgaccgccgaggccrtggggcccctagactggacacgtgtgctccccagagggcaccccctatttatgtgtatttattgttatttatatgcctcccccaacactacccttggggtctgggcattccccgtgtctggaggacagccccccactgttctcctcatctccagcctcagtagttgggggtagaaggagctcagcacctcttccagcccttaaagctgcagaaaaggtgtcacacggctgcctgtaccttggctccctgtcctgctcccggcttcccttaccctatcactggcctcaggcccccgcaggctgcctcttcccaacctccttggaagtacccctgtttcttaaacaattatttaagtgtacgtgtattattaaactgatgaacacatccccagaggccaacattcaatgcgacattctcccgttcagccctggtccaggccagccatggacccaattctggggtgtccttccagaaaggtctacgcagccgcgagcagtgcatgcaggtgggactgagctgtagcacgggggggtcacaggtgtccctgctctgcccacacagtgtctcccctgaggacacccctgggaacaggaaccagcctccttcctcaagcagtgccttgagccctatgctttgtaatgatgtgagcgcctaggggcaccctctcggcccccaaggcaagtctctgaggatgaactgcagggctgtcggctcaaggcagggcccccagccttcgtggttcggatcaacatccaaggccaagcgccctccctgatggtgaactagccacgcttcgggacccaggctctgttggagattttagttaaggggccccggggggagcagccccagtcgtggaaagggggcccaggcctgtgacagtctcagggtctcagtctctaggcccccggccccaagggctgacattgccatggggctgctgggcagttgttagcccctcccctgcctggccccctggctcacccacctactgcgtccaggtgcctggagatgggggtgggggtgctgcacagaagaacaaggactccactcagactcccaaagcaagaggcctcagggaagacttcctggaggtggtggcccttgtccaggagatggaattttcattcaacacatttattgagtttcttttctttcttgaaaaagggtctcgctctgttgcccaggctggagtgcagtgtggtatgacttcagctcactgccacccccaccttctgagttcaagcgatcctcccagctcagcttcccagtacaggcgtgcaccaccacacccaactcatatttgtatttttagtggaggcggggtttcgccatgttggccaggttggtctcgaactcctgagctcaagtgatcctcccacctcggcctcccagagtgctgggattacaggcgtgagccaccgcacccagccatatgagtttctactaagcacctggcactgggaacaggccgagaacaaaatggtgaaaacccttcctgcctccacggtgactaatgaaacaagtggtgtgtagtctgtgagtgagtccaggacagaggctctgggggaggggctgcagttcttttttttttttttgaggagtctcgctctggcccaggctggagtgcaatggtgcgatctcggctcactgcaagctccgcctcccgggttcacgccattctcctgcctcagcctcctgagtagctgggactacaggcgcccgccaccacgcccggctaattttttgtatttttagtagagacggggtttcaccgtgttagccaggatggtctcgatctcctgacctcatgatctgcccgcctcggcctcccaaagtgctgggattacaggcgtgagccaccgcgcccggccaaggggctgcagttctaagcagagggtcagggaggcctcgaagacctgaaggggaggaggaaggagccaggcagccatgcagggaacagctccaggcagcaggaagagcccatgcaaaggccctgagaagacacatgctgcgtgtgtccaagggtcagagagtggcctgcgtggctgatgccaggtgagagggggaccgcaggggcagggcagggcgctgggggtgcagatcatgtctgccctggggccatcagaagcttgtggctgtcactggaggtagctgagcctgtgggttctgagcctgcggattctgagccggaggcactggggtgaggctttgggtttcaatggcagcatcaggatggtttcaggggatgagggcagagcgggaggcggcaggtggcctgggtggggatggcccatgtagctggggtctggatttgggccaggattggatgtggggtgtgggggtttcaagggtgacctgaagcttggtgacctggggggacggctgagatgaggctggattgagacgtctgtatggtgccgagtgttggctggtggggggtggattctgaaggcccccaggaacagaggaccctggctctgaagtgtgagttgctgggagagcaggtggacaagcagcaggcaagggcttctccggcctcaggggagtgggtgccttggcgagagcccaaaggtgggggacgtggctgacgccgggcaaagctttgggggcaccgggctggggtggtggtgaggacctgtgggcaggtgtgtgtgcagccagccacagcctccgcacaagtgaggggaaggggtggccagaagcccctgcaacttggcctgagcgtcctgggcagctggggggccccccagcatcagtgtgggggcaaacaaggccacatccgccaccagcttcaccccagcttctacggaaaagaggcgcagggtagaggctcaccacgtggctccgaccctgttcccttttcacttaacgccagcggcctcctctggaatccaagccccttagggaggcgttaggtgtggagggcctgcagggcctgcaggagctgtcaagggaggactctgctgcctcctccaggcccgggaggacctttctagggaggcacacacctggaatccaggtactatatttcgtggaatatacggtacccgggatttcgtgtgctgctgagaaggaaggcgatgctgatgttaatgaaactggaatgcggcccggctggcaggaaacggggtgcctgcccaggcctcgggaaccatcgctaccccagccccgcccaccggccccaggcagaggctcacgcgctcccggcttcgctgcatttattgcaggtgggtgcacctggcgggagggcaggtccggggcgaggtcacacgacctcgtcggtcaccgggatggggttgacctggggacctcccgggggtccccccgccgccgccgcagcctcctcctcgctgggcttcttgcgggcctcggccgggggccgcggcggggggttgctgggcggctgcttgatggtgcctccgatctgcggccgctcccggggcttgggctcgatgggcgtccactgctcgccacgcacagccgcctgcggggcactgaagggttgagccgcgccccagcgcccgccctccctccctccctccctccccggaggcccaccccgctaggggccctgggacaggctcaagtctgaatcccacgcaggatggtgtgactgccactcagagaggttaagtgacgcgcccgaggccacacagccaggacctgggtcggcctgacaccagcccaagctatttcttcatgccaggagtggggcccgaacccctgggcttctggaagatcccgtggtggacactcccagatgcaaattctagtactcaaattctcctctcaaggtgccaagggcagggaaggcagggaggcaggcccgaggtccagcaggaggggtggcccaggagagtagcaggccctgctccgtctggtgggcgccattcacccacgctggccggcagccccccaagggtgcccaggcatttctgcacatgggggtggtggggggagagcttgaagaccacgggattccactggcttttactaaaaatacagactcctgggcccatgcccggaggttccactgcaacaggtcaagtggacctgggagtgtgtgcttttcatcttctatcccataatatctggtggaaaaatatgtcacatcatatacgtcatgaacagaaagagaaactggacatgtgtgatcctacctgactccaaaacggaaacattccattctgaaaagcaaaactagaaggctgatagaagaaaaggcaggaacgtgaaggcaggacccagggccagggaaaggtgttttcacaaagcacagaccatagagcaggtgaacagggaaacctctgctcttccgtgcagtgaaggactccacgcgccaagttaacagaccctcaccagaaagcatgaaggcatccccagtgtttaaaggttacaaaggctaaatagctaaaatatatgtggacttcctgcaacttaagaaaaagacaatcaggccgggcgcggtggctcacgcctgtaatcccagcactttgggaggccgaggcgggcggatcacaaggtcaaggagatccagaccatcctggctaacgcggtgaaaccccgtctctactaaaaataccaaaaattagccaggcatggtggcacgtgcctgtagtcccagctactcgggaggctgaggcaggagaattgcttgaacccaggaggcgaaggttgcagtgagccgagatcacgccactgcactccagcctgggcgatggcgcgagactccatctcaaaaaaaaaagaagaaaaagaaaaatacaaaaaccacaatagaaaaatgggcaaaggatttgaacaggcaactcaagggagaagaaactccaacagctcaaatccacagtcagagaagggcgagtccaagctccacacggccagctcgtgctgtgaaactggcaagcgtgggagaaagcctagtgcatggtgggagagatggggccacatggctggtggtgggttgtctgctggggagcagctgagcccggcagggtgaacggtgcagaggctgatgcctgacccagcaattcctctctgggtttagcacaaggaattcctcccgaggtctccaggagccactagctgtgcgtggcagcagggagacgggggggatgcgggtggcccccggaaaacaaagcaacagcccagatgagcacttggcaacaggaaggggttctaaaggagagttctgccggtggcaggtcagtgaggcttgaaacagaactccacttccatacgcggaaggcgtacacagaaagtgctgcacctttcccacgcacacacactagaagacgcacagcaaggggagggcagttgcctctgcgggcaggagggacttggctctatggacaaaaggatttaaataagcaaagtctgagggctctgtccacccagagacccccgcagtgagaggtggcctgcagccgtctgttccggagcccagggcaggcagagggcatttcacccaaggcctggccaggctgcgccctgtcctcccacccatccctggcctctcagagagatcactgtatcccatgggatgggcagccttctaacagggtgcagcagtcataaaccaaacgcaggtgtcggcagtttaagaaaatgtctgcgtcctggcaccgcccatgaatcagcgcgaatagggtttaggtgagaaaagcctgataatgggacccaagcgcaggcacggtcttcggccggctgcgtgaccccaggccagtcacagcacctccctgagcctccgcatctttgtctgtaaagtggggaccccagtacccctcccagggctgtggtgcgggttaatgaggaaatgcaaggaaatgacccgacacactagacacgccaaaaatggcagcagcaaccgctgcgtccccgccgtgctgtgagcacacgcccaggctcacacttgctcccagccttggctcagcctacagagccggcttcaagggccatgcgtgtccgagggtgtcagggcaggggctggggatgggggtggccggggccgacctcagagggcgccactcaccagtaggtagatgccgctcgcaatggccaggcaggcggtcccaaggatggtggccagcaggaagccggcgggcaccgagagcctgggggacagcgggtgagaggcagggacacagaagggcactcagaaaggggaacggagccccaggtctgggggccaaggccacaaagtctcaggacaaggcagactgcagacccaggggacgtgcgcggaccggggcttgtttcggtcctgggtgttctcagccttgatgtggacactagcggctctggtgcacttgctcggaggaagcagccacgtgtgggtgtcctggcctcagccggcagtaaccagcagacacacagcacggaaccctccacc

SEQ ID NO: 17813 - DNA, 66686 bp, Homo sapiens
gagcctatgcgcctacaagctgggatctcttgagtcagacagctgaggccaaagactggcatcaccctgtggagcagcgagtgtgggggagatttgggctgggtgctctgttgcctttcaggagatggctcttaccctatggtgtgatgcctgagcacggctcattcccactgaagaaaagatttgttatggttcatgaatgagtgcccactaggacaggggtgaaactaggagtgttccagggatggacaagtccctggatgaagaaagggagaccctcacctgatgtcaggcttaccaatgaccttgggaggggatggatagggaagcaaggtctgggtgaagatctagttctcatcttctaggaaatgggggtggccctcaggacagataagctcctttgcaaatgtacagacatcttgcgaggagagatacacgggggagggaaggcagagcccacctaggccaaaacatcattgtgggctttaagtttcaaactaggcttttaaaagtcgacaacagttaaggctagtgttgtggtgtacacctgtagtcccagccactggggaggctgaggtaggaggatctcttgagcccaggagttcaagccttcagtgagctatgatcatgtcactgcactccagcctgagtgacagagcaagactccgactctaaaataaaattttaaaaaattcaaccaggtaaatctatagggttaaagctaaaaaaatataaaaggcatatagaaaagtctccccacattcctctacccccatctactccacctacccccagaaaacagaaccactattatgagtagatctttgtgtagtttccgagaaatttttatgcagatataaataaatattttttgccttctttctccacaaatgctggcatactctacatgccattctgcactttgaattttcttttttctttttctttttgagacagagtctcgcactgtcacccaggctggagtgcagtagcaccatctcggctcactgcaacctccacctcccgggttcaagcaattctcctacctctgcctcccaagtagctgggattacaggtgcccaccactatgcctggctaattttctgtatttctaatagagacagggtttcactatgttggcaaggctggtcttgaactcctgacctcatgatccgcctgccttagcctcccaaagtgctgggattacaggcgtgagccactgcacccggccactttgacttttcagttgaacactgtatcccagggaccttcccacatcagtgtatgcagagtttccttgttccgttttatggctgtacactgttccacttcatgattagctggaccataattttctttaccattcccccaacagagggcactaagtgctttccaaccttttttaatgtaaacaatgccaccatgaaatgagcaagctggtatacctttcacttttcggggtgcggctctatcatcaggataaagataaatttctagaagggaaacagctggatcagagtgggtgcattggtagctctgagaggtattcataaatagttctccaaaaaggagacaccaatttacactcccttcagcaagtaggggggtgttttactttttctttttgagatggagtctcgctcctcgcccaggctggagtgccgtggctcgatctcggctcactgcagcctctgactcccgggttcaagcaattctcctgcctcagcctcccaagtagctgggattacaggcacccccaccacgcctgactcattttttgtatttttagtagagtcaaggttttaccatgttggccaggctggtcttgaactcctgacttcaggtgacccatctgtctcagcctcccaaagtgctgggattacaggtgtgagccattgcacgcagtcgtcttactcttaacatacccaaagtgttcaacttttcttccaagtctgcctctcctccttctgtcaccaccatcacccatttgctcaagtctgaaggcaggacgccacctttacacctccacccttgcaccccagcagaacgccctgacagtacttctagaagaatctgtcccttcctgccttcactctggttacatctggagttagcctcagcccctctcacctggacacctgtgcaggtcccctgcctctccactctccaccctcctcgccagcccaccccatcctccacactgcaagccaaggggctacaaatgtcgcagccgggtgggctcactctcagcccatcatagggctgagatccctctgcaggatccaggctgtttggcatatccctcaaaacccaggccctgctgtaaggcctggaccgggtggggtcctagaggtcatctccctgcacccatgtgaagcttctgagcatttgtccttggggttttgccccatggcatcccagagccacccaggcactatgttcacctcctgctgcccttcaagatgaacaagaagaagagaaacaaagggagttcgccacaggcctgagtgtggaggagacagagaaagaacagcacagaaaagagaggccaggaaggccccagatgccaggtcaggttcatttcatgtagaaatcacttcagcagattgctctgctaaagagaagaaaatacacttaacatgatgcatggcccccgcttggctcaaagctgattgcatctctaggctagcgacaagctggcagagcttattaaaaacagtgcacatgattctctgcccaagctcagagccctttccctctgagccactcagggcatttcccagtgtgggtgaggaagtgtgcaaggcctggtagaccttagactgcatggctgcagtttctgtaactattgttcatcctgagaagtgaaggtttggaaaactaaatgaagacacccaagaatgccatctgctttcttgaggcattggttcaatgtttactcagcaaatgtgcatcgtgctcctgccctgcactgggctgagctgggagcaggattagacgctaagacaaagtcatggagaagtccggtgccatgagctctgcaggaaagatggacccagggctctgtgggcagacattgggcaggaagaatgatgaggctgtaaatcctgagaatgcactccctcccgcagacattctcagagtcccagagtgttagggggcaggaggaattccagctgtggttctggaggattgttaaacctttttggtgtgtttcctactctgaggcatgtttgttttactcacaatgatgatgcaattctccaattacctagcaactatactaagactctaaagaaaaaggcaggttcttccaatacatagataagtcccaggtggaaggacaagaccccagcctggagaggtgtttgtatcgggaggagaatgagaacgtaaatccctgaagctgggagtgggtctggtgctgagcaaaccctttacagttctggtcagtgctgaaatttacttcaaggtcctttctcagttgctggggcatttgaaggggatgctcccagagatctgggctggtaatcatttccctgccgaggtgtcaccagaaatggatggccctcacattgccacacctgtctccctaggttgccctccttaatcacttcgaaacagagccgtctgccagggcagtgggcaatgggacactcctgggcagctccatcatctctagccaagaatcatttggactggccagaactgcactctggtcccagccagaggaccccagttccaaagtccttcattgtgcaaacaaagagacaaaagagatgccttgcaagttgaggcaagtcaggctcagaaggagaccatgaaattcagcagcatctgtgggaggggcagggggtgcagagaggataggggaaagggaggaatcagcagctcctgatcccctccatgtgccagactttgcaagtggctttgcttccacaaacccgccatgcctctagcaggcagcaccgattatcctgattcacagcttggaagcagggacagacagcatggataactcgcccaagatcaccccagggaaaactgggaatttgtcttagttcattcaggcttctataacaaaacagcacagacagggtggcttataaacaacagaaatgtgttgctcacagttctggaagctggaagtccaagatcaaggcactggcagattccatgcctggtgagggtctactttctggttcctgtgtcctcacatggtggaagggaggagggggccctctgtgacctaatctttcataatgacaccaatcccattcatgagggctccactcttctgacctaatcaccccttagaggccccactttctaataccattaccttgcagggtatgggttcaacatacaaattttggcggggtcgggggggtggtgcggaatacaagcaatcaggccatagcagagtaaaacccaaatatccccaactctaatgtctagacctcccctgtaaaaccatatgcaggatctactagacagaacgtgtgtcagactgagtgcacactcctgggaactgtgagcttatataaaaattcacatcatggccttttaactgtacccattaactcaagaccccttgtctccaaacctcaactttgactagttagagaatcacacagaaatcattataaagtgcttagaacatcagagttttcacgtggtgactaatacttttattgacttatttttattgatacataatatttgtacgtattgatggggtacatgtgctattttgttacatgtgcagaatgtgtgatatcgagttggggtatttaggctatctatcccctccagtatttatcatttcttttcttctttccttctctctctctcttttctttctctctctctctcttttttctttttttttttttttttttttgacagagtctctctctgtcacccaggctagagggcagtggcacgacctcagttcactgcaacctccacctcccaggttcaagggattctcctgcctcagcctcccaagtagctgggattacaagcatccgccaccacaccgggctaattttttgtatttttagtagagacagggtttcatgatgttggccagactggtcttgatctcctgacctcgggtgatcaaccctcctcggcctcccaaagtgctgggattacaggtgtgagccaccacacccagcctgtataatcatttctatgggcaaacacatttatcaaaccacctccatcctctaacatttgttttttctcagacgtgagatcctatttgtaggactataacaacaaggaactttattaatatgatgtctagagaatgaaagaggcacatgtgccctagaggaagagccgatgtcctctgtgagttctcctctatcaggggtcaggttggatgaaatctaacccccacctgcctttgtaaataaagttttattggaacacagccacacccattcatctgtgtcacatctacggctgctttgtcactacaacagcaaagttgagtagttgcagcacagactttgcgtggcccacaaagctgaaaatattcatggtctgggcctttacagaaaaggtttgctgaccccagtgctgaatcactatgggattgcctgtgcaggagctgtgccagctgtgttcacataatgcatcctgctttcattcaccaacctcccttccgactacaaaactctgccattctctgatgcaggagatgggactcaagaccacaccgtgcacttctccgtaaagccacctcctggaccagttgggtttcttgctccttttccttctgaagcaatcctctctctcccatgaggccccctgagcgcactaagcagaggtgccgcctctgagtggaatgtgccaggccccagagctgcctctgagtctgcaggagtgcagagtgggcagagggctctctctgctgttttccatcagggcgtgtcccatctcagtctaacagggaggtgcccagaaaataggtggaggtgagggccactcagcccagtggccctctgagctgttccttcttgaccggcacacacagctcgcttcttcactttcttttccatccactgccggacccaagccagccttccagggagcagccatgccttacctctaccgggccccagggcctcaggcacacccggttcccaaggacgcccggatcacccactcctcaggccagagctttgagcaaatgaggcaggagtgcctgcagagaggcaccctgtttgaggatgcagacttcccagccagcaattcctccctgttctacagtgagaggccgcagatcccctttgtgtggaaacgaccaggggtgagtggggygagcaggggaaggagcayagatgaggccgaggytcagcagcccccgcaggaagtggaaacaggggtgctggggaggggccggctacgctcagtgcaactgagktgcatcatcccagtctaccgtggaaagctttgcagtttggaggcagaaaataatgtacaggcctgggatgctctgcggtggggaccsggggcatctggttgtacccgctccccggctccaagctgtctgactccyaccgaggctgaggacctggagtcagagtgggtcttgtcagcaggtgataggcacgaatcaaaaccttatccacaaggacaggcccccaccctgtgtgtggtaacactgagatcacgttatgcacagtgttctgtggcttctggcccagagctgagggtgctcagtgtggatggatgtttggctcagcaaggtctcagcaaccgggtgacagatggaatacaagggaagcaggaatcttctcccragaaccatgcaccccccattcccagagatcagggtgaacagtgccccacctctgacagtctggaggtgtcgtcccaagaggcaccagctggtcactgggtcccaagaggtgctagcttgtgcctgggacgccatgtcaatatttgcggtgctggattagtcagggctctacctctgacccggcgccagctgggctggcttccattccctccaggtgkgtacgggcctgggagtggctcctgtggggtccggttgcttttgggcaaggaggggcagtacaagggatgctggtcctacaagtgagatcctgagtgccygtcttatcctgacaatttgtctcatgcatatagtcatatcacttcatttccctgagcctcagtctcctcacctgtaaaatgggaacaataatggctaaygcaggccaatgtctagcacacagaaggtttccagtacattacagctattgtcacattattactattactgatactattattatcatcattacaatgattattagctctgagtctcatcttacatatgagtagcaaaggactcatcataactacctcctcactatctcccaacattaaaataatgttgatgattaaaaacaattttttttaacgcacattcacaaaacttctgggctcttcaggggcagggccaaagtgaacctaagtgggtgtttccgaagtggtaagggttttattgctatttcctgcagtaggcagtgtggggtgtatgtgtgtgcacgcacttgtgtgtgtaggaatttgactgtgtatgtgcatgtgtgtgactgtgtgcacatgtgtgtggatatgcataggcgtgtatgtggggggtgggtgactgcatgcataggcacacaggtgctttgatcttcacctgccaggtaattgatcccacaaggtgccatgttcatggggaaatcacagtgagcattcagtggccctatcggagttggggtgaaagctcccaggcaccttcctcaccgaagccacgctgtgattgtttttggttctctgcatatggccaattgcagtgtgaggtcacggcactggcagatcacgtggggttgcactttacagacaggattagtaggtcatgctctgctaagtaagaaaaaggacatttccaaactaaaaaagcagaagttacaagacataaaagagtgaccctctgaggggcaccgcccacgaccattaggtctccctgggcttatttccggcctcggcgcatgaacaaatgggcgcgtgggcagctgcccaggctgcaggctgtgggtgcatttttaactgtgggcagagatttccctgcagttgatgtcaggagccctgggaaatagagttagagaaattgatttcctgggcccctggtgagcagagcccctggccagaagcagcggctctttctgtttgatccagggtttcatacagatgctcatgttctctacaggcacttgatatgaaaaggttggaagcactttttctcttccttaaaatggggacaataatgcaacttatggggtcctcatgagggtcagctgcgttaccatgagtagagcacttagcaaagagcctggtgtgtaaagaatcagtgctggtccttgttatttctactgctgtcattgtaacctaacaccatcgtctcctgactctaggagggcccccatccttgcagtctatattgacatcatctagtttaaagtgtaatctgtactctacaactcacttactttttgtcaaagttagaattctccragataaaagctggacgcacaaaccagcatggagggcatctttgtctcccccttcagaagtctyccctcctgggaccagggccaccaaggcctscccagcgactctagagtcccagatctctgctccaaggggctgtcttccttagtattatctcctctggcattgccccaaacgctgggtgaggccttcatccacaggccagggcccttgatacacacaagcccctgccaagatgcaccccgacctgccacccagcccatgcccctgtaccagccctctgtcccttcttcatcccactgtctccacctacggcagaccctttattgatcttaacccaggtctactgtgttgctgtcgttcccacagactcattttcagaatctgttctgccttttcctttgtctgcaactgaagattgtccctttggtctggtcctcattcycgtacccctatctgtttcttatttaggggagttagragctttacatcatatcttacagatttctgtaaaatcaggaacaaaagggctgaggatgagcatggagactcttyttgcagcatagagtcgcagggagccggggggtagcgggccatagggaaatcacaagcattgccaggttccctgcagacctctgtggcttgggcatcatttgcagtrggactcagcattacacggtgcacrtctcagcagcccgtgggaccgtggggctggacggccctcctcctcagcaccaccttcttgtcaaacacagctgtrcttggggagggtgggcagagcacaaagccaaggggacattggagggcagtggacagccaggcttgccctcaagggagcccagggcaaggagtgcactgagggtgactcagggaactggctgggaggggctgggaggcagagagggtgataggctcaacctggagagaaggtgagatcacccccaggtctcatgcaagggactgtggacctgagtggaagtgggtgcacagaaagaggaggagggagtatcgggtgaggtctcccagcctgatggggaacagccaccatgcagtccatccctccttgtctgcctgtacccatttatttttggccaggcaattcccccccaccaattctcagtgtaaatccaggacacctccccgaaagtgcccacacccctctagcccatgtgaacaacccctgtggcagacctgtgcacagcgtggcatgtgaccacagcctctcctgcacggtgagcttgccgttccctgtgctgctcccctgacccccaggaggggttgtcagttgttctgggacagccccaaaggccccatggcctccacagtgctgggcacatgacagggatcggcacatagctatgaacagcagcgtctggcatctccagaccttgctggaaatgtggcttttcttcactggaaggccatgtgaaagacagaatgaatgaaaaagaaagagagaaagaaagagaaaaagagagaaggagaggaagagagagagggaaagggaaggaagggaagggaggaagggaggaaggaaggaaagaaggaaggaaggagagaaagagaaagaaagatagaaaaaaagaaaggaagaagagaaagaaagaaagaagaaagaaacaaagaaagaaagaaagaaagaaagaaagaaagaaagaaagaaagaaagaaagaaagaaagagaaagaaagaagggtggcttttccctttgtgaattattcactgtgcttagtagaggaaagtgtgtcttcggctgagccccgatgatgtacaaggtaaacagaacagtccctgaaagcaaacattccagggtgcttggcccttagtgctccaggaaaaccacctggtggtagggctgtggggtgggggaggggagggggagggggaggggtctgcgtgcctccctcggggcttcaggcagcagtctaggttcacttcaggtttgtcaagacccctgcaattgagacacctctgatcgtcctatcacaggactgtagcttcaggtaaccccttcctcatggcctcccaagcaacatttcacaggaacaaatgtacatccaggatcgacacgcacatgcaggacactcacacgtagacaatgctcccaagtgcacatgcaaccagcatacatgtggagcatgcacaagcacacacgtgtaccacacctgggcacayacaacaaggcaagtcacaggcaccttgcacatgtgggcatgtgggccgtcagcatacacaccactcccaggcatctaacccaggcccaccgcctagctgccccttccacacatgcgtccgcagaaccccctgtgactggcacgtgtgcacaccaattmccagaarcactgacccacagaggagtcggtcacacatccagacacctccccaatttatacccgatggctaatttgtgtttacttggagagtttctgagttttttccttttgtatttttctcctcattgggtgcgatytggtttaaaacaaaaacaaaaacagacctctcctgaacaaaacaaccaattgcaagataggagctgggaggcggtggcagctgcaggcacagttggtacggttggcggggccaggcctgcagaaggctgggggaggggaggggcagggaggatgggaaggaggcgggcatccgggaacagccctgccccaggagctagcacagcctgctgggcagggatctgtggcttttggagtacattttatgtccacttgaggagtgagtagcattggcagtgggggcattgcttgccakggctatcccctggcaggggctgggcaatcaagacagggagggcttgggggactcctgggtttcccttcgggcaggcacattctgcarcaagcccagaatgtctaagctggtgacagatgaggatgcagccgtgagaagttaaatggcccaccctgaaccctactgctgagcsgggcaggctattcctgggactctattgaggcccactgacatggtcctggtttgcattgtccttctgggctcagctcagagccacctgcaaactcctgcgctagccaaggtggaggaggaagaagagcagtgygcttcctacagatgagaggggtccgcacaggcaagccaagccaggaccccagaactgagcagctgccccccaccttcactccctttccagccaccacggagatcagagtcatttaatgaaatggcgccaaagctacctggagctgggggtgggaatgcaaagacgtgtgagacctggcagaggacaggccagcatttgggaggtccttacttctgccgggcctggggttttggcgcatctaaaaacaccccgtgttcttcagmaattctcctggccaagctttcttgagtattttagacactaatgccacacatagctctccctgggcaggcgcccctggtgtctgtcactcctccaggttgtcacatcctggggaatgcagagagagcaccagcatttgaagcttctgctcttggtcctgataatccccttgacttcaaagaaatctctgtcctgcctttgattctttgggacacaagatgagaggagaagcagggtgctgagaagcctgaggaagacaattcaaagcagaggtctctcggggaaggcggcgcagcttgagctccccacrtggcgtccgcccagacactgctggaaccttccacctccagcccaggcccctcctcagtcctggtgcctggaaaagtgggaagaggtgggaaaaatccttcactcctctgcaggccccggcccagttaactcaccacccctgcagggtgagccagaacgkgcctcgctgccacaggwttggctgttacctctcccgrgaccggcccggcttyctccctccctccctccctccctccctttgtttaggtctgtgctcctctgcttcccccagagacgcctcccctgctgactgctgtagctasccttgccccatcccaccccttccctctccatcctcgctcttttctctcctggtttatggtttgtctcttcctcaaatgcaatttgcaaaactctcctgaacgaaacaacagcttctgggaggtggtggcagctgcaggcacagtgggcgccgtgggtgaggccagggctgaggcaggctgggggaggggcggggcaggaggctgggaaggggcggggcttccgagagcaccgccctccgcgtccagggcagctccaccagggcaggggctttccctctctctttgttgtcgtccaatgtcaggaatggagcccagcaactcaaagagtggaagaatatatgcatatcataagattgctttctacacttttttgttcatgttttataaatacccctccatattgtatatgtatatattaatatgtattaatgattacattaatacacatagtgtatgtgcttatgtgtaatatagaataatatatatatataatgcacttcggtgaaacaatatgagagatgtgtgcatatctctctttatatggtatagatacatgaaattttacctaagygcatctctgtaaaaagaaacactgagcagggtggcatgtgtctgtaacctcaataccttgggaatccaaggcgggaggatcacttgaggccaggagtttgagaccagcctgggcaacatagcgagacccccatctccacaaaaaaaaaaaaaaaaattaaaaagtggctgggcgtggtgactcacgtctgtagtcccagttacttgggaggctgaggtggraggattgcttgagcccagaaggtcaaggctgtagtgagctatgatcatgtcactgcactccagcctgggtgacacagcaagattctgtctctaaacctatatatatttggaatccactttgtgggggaaggattatataaagaaagaaatggagaagmtgggtgggtagggagtatgtttagtccaaggccccagcctgtggtacatgcattactcagctccttgaagcccacagaggtcacagagctcacagctgggatagccctggactcctagcccagtgcctgagtgagcacaggaatcctcagtgtgtggctgatgtccagctttgtggccgggtgtggcctgtgtttctggccagagattggtgctgagtgcagctcaggaggcaggacctctccccggcggaggagatttaccaaagatgagcccagccttatccagagcatagagaggtggcagccttttacatccacgtggccctcctcagggaaaagaatcaagcacagggaaagccctctgccccaagaaagcagagagaccctgagcctaccctttcatagtggcttgcagcatggcaggcctcagcctaataacactctcattcctccaggaaatcgtgaaaaacccagaattcattcttggaggggccaccaggactgatatctgccagggagagctgggtgagtgtaagtggatggagcatggcraragggaggttgagtcactgggacaggcaagcaactgcagcatggggtccctgaggacccaagaggcayggggctgggggaacaacactgcttyggcctctgcttcctcactccctctgaatggagtccagtggcctcaagcccctgcacctcygttcctctagagtcagacatgcctgtgatgtggggctcacagccccggagtttacagaggaaagtgacacccagcagcgttggtcgggctctcctacaccaccacagtagctaacacctgcacacatgaactcagtcacctgcgaggtactctccccagcacacattgcctcattccatcttcacaacccaccctcctaacgtcacagatgaggaaatggaggctgaggaaggctaagtaacttgtccaaggtcacagaggtggtagacaggcaatcaggatttgaacccagacactccagcagcagagcccttactgctaaccattatacacaccctggggagccgctccccagcaatccagtctccctcctgcaatgaacctgagtgcacctcaagtcactcaaattgggtcctgcattttaggacttaatccaactgggctgggtttacctttgttctatctatgaaagacagagaragtgagagagcgagagactttcttttaaaaaataccagtgaaatcagcctagagaacaaaccactgcaagcttgtgtggaccctgacttatttctagctgaggttgtcactgtggtctattggttaagaaaggccatgctggaacctccatgctgagcaactgagctatcctaaacacaagatccaaagtcacaaacctagactgatgttagttaattagctagacagagagacaattgagagagagagagagagagagaagcaaatggatagatagatagaaacatagataataagtaatagatgataggtagaaaacggatgcataattagatagataaataggttgataggttgattgattgactgatagaccatacaaaataaatatataataatagatagatggtagtaaataatgataggaaggtaggtgggtaaatacatggatggatgggtatagatagatgatggatgatagacggaattacagttgaccctttaacaacatgagtttgaacagtgcaggaccacttctaagtggattttttttcaaccaaacacagacagaaaataccgtgttccaggctgagcgtgatggctcacacttgtaatcccagcactttgggaggccgaggcaggagaatcgcttgagccgaggagttcaagaccagtctgggcaacatagtgagggctcgcctctactaaaaattaaaattgaaaaattagccaggcttggtggtgcatgaccatagttccagctacttggtaggctgagatgggaggattgcttgagcctgggaagttgaggctgcagtgagctgagatcatgccactgcactccagcctggacaacagagtaagacactgtctcaaacaaacaaaaaggaaaaaaaggaaggaaagaaggaagggagagagggaggaagggagggagggaggatggaaggaaggaaggaaggaaggaaggaaggaaggaaggaaggaaggaaggaaggaarggagaaaatatactattccaggatttgaaacccgcatatacagagggctgacttggtataggcagattccacagggcttactgtgggacttgagtatgcacagattttggtatacacaggggtcctggaaccaatcccccatgtatgccatattctagatacaatgtagacttttcaaaaggtttacattcaggtggtccttctccaggagatcctccctgccgctgcccacctstccccctcttcctctgcctcccttcccctcgaccccgtagtcctccattgctatccaataggaaatcattctactggctcctttgtttttcaaagttttggtttgtcacattggcataaacatatatttggagttacaaccttatattttaccttagtggatggttgattctaaagattattttgtaacacttttactacaccaaagtactgtacatggcatatatatgttataaagaataacaagaaaatgaacagccgtgatctgttgccacccacaataagaactagaacatctggtcatgtagagtgctcacacctgtaatcrcagcgctttgggagggggaggtgggaagatctcttgagcccaggagttttagactagcctgggcaacatagcaagaccacatctctatcaaaaaaaaaaaaaaaactagaacacacttggaacagcatcaaggcatgctgttatctgcagggggtgggggtaggggtggagctgggtgagtgtgaggggatggagcatggcgagagggaggttggattgctggatcaagagcgactgcagtatggggtccctgagaacccaagaggcacagcgttccccctgcagtgagccgagatggtgccacttcactccagcctgctcctcccatagtgccctctgctctgcaccacccagatagccgagcaacacgctgacccacagagggcacttcttccaggcacagctgggtggccagccccatccatctgcccaggcccaagagagagaaaagcaatcttgttttggcttctcaatctccccgccaaaagctcagagcatttctggctgaaaacacgtgaggtgttgagttctcaggccggaaaacactcattttcctcaactgggcaaagttgaaacttggaggagagctgggaaaggtcagcccacagcagaggtcactctattagactcctgttggcctggccgccctgaagctgaaagcagacaccaagtctctccttatctttgcatcttctgcgtggcacaaggtctgccaccctagaggcacttggtaaagtttgctgaacaaacgatcctgcaggttccagccatgtcacttcctagtagcatctcccaaagctgacctgaggctcccaaagaccagcagatgcattagaaaccaatccttctgtgctccagctaaggctgggggtggcttgtactctgctggtgacacctctcagaaagccagaaccagggcgattcggaattagctttcccgatgttcrgccctggcgagtctctcttgcctgtgtcaaacagccagaaarggccatattacaatgtcccaagcccagtgacatacggtgctttccagaaatgtgaactcagaaactgccaagctgagtgtgatgggctyttakgttctgatgacgttgatgttgtctactgaaaacaagtgaatctggataaaggtgattcggataaatggatcctcccagatatctgcttacacaggcggcatctgagacactgtgaggcacacaccagacacagcccacactcagtgtgggcaaaggaatgcctccaggagtctggaacagcacagatagcacagataaaatcatgtttgatgtttgacttcactttttagttttcctccagatgtgtgttaacatgaagacacagctgggaagttcagtaggtcagtcaataaatcttgaaaatgcaagataatttaaagcaaatggagccaccacggagataccattatctgtaattaagctgwgtctrggttggggctgcagggagatttctaaccaccctcccaagtactgccgaaccacttgggtggcagctatgaaatgtctgctcgcccagcccrtgctgacactgatgtatgcagwcttggwcctctggaaagggagttgctggaattyacagagctgatgcatcaggcagccatatgtctgaaacccaagtaagcatgtcctataacagtgccaagaaggcaacagctgtttatgatagacgggcagagaagagcaggcaagggaggcagaaggggaggagagagttatttgttggtgtcctgtctgtttttaaacaggtagaaaagatgtggccacatctgaaactccccacatccccttctgacacagagttttcctatttgctgtgaaatagcaatgaaaattgtgatttatggcttccattttgcaggagactgctggctattagccgycatcgcctcccttacgcttaatcaaaaagcactggccagagtcatcccccaggaccaaagmtttggccctggttatgccgggatattccatttccaggtaagagggagccctgrgccagtgggtttacctctctggggcccrgcatgagggcaggtgcatttccacactgcctggtaaccctagaaaaaaatgtcatcagatctgtgtgacatatggtcctaaaccatgctaaagccacattttatcatggaataacagctaaatgcctcagaagaacattaacggcattgcacggtgaatccttatggagcatacatttaaaactataagtgatgttttggcaaatctggaggtccatctgttaagggttttattatttggaatttcttgtgctttaagcacaaattgactaaaccaattatacctccaggaaactggttgatttctcataaacagagaggttctctttatggaagaattgtaaatttggagatcttgagggattttaaaaaataaaaactgagaaaaatacagacaacatctgctggagtcccgtgtgacccgcagaccctcagccgaggtgcacatcaggagaggcttgcccccaggagatggtttcctgctgcttcacctcactttctatccctccagtctctcctccacccctgtccttatatagggttcgaccagatactgaaacttgccccttgttcttacttaggtgggtgacctcagacaattttcttagtgacattaaacctttctacactcgtctgaaaaaaggagagactgacagttccctgcaggcttccygtagagctaaatggcatcacacacaggagcyggcacagagccaggcaccgagtaggcattccttgaccttccaccccagacagtgtcaccttctcctgactcacaggccaccactcagggccagcccgtttcttctgtccctgargcctgcaatctgataagcagaggtactctcaagccctgtcaccaatagcacagaagtgtttcaaaggcaaagagagtgagcaggtcacatgtagctcagggagcatgcaattcccaggggtcaggcctcctgcgccggctggggacagagccactttgggtcccagggaaactctacccctgctctctcacagacctgccaccacctggctgtctcccttcccatcctgtgacttctgctgagaccacagtcttggtttgatggcgcccccaggagccggtctttccccagtcctcttaaacacaccagggtggcagtgttgggggtggttaagctcagaaaatccagcagaactactgcctctaaaccagaaccagaaccagcagaactactgcctctaaaccagaaccagaaccaccacctcttgggctcccaaaaggaacagtgttcttgtcccttgaatgtcacagctgggaggagccttggcaatcccctgacccagtcctctcattaactcccgaggacactgagtcccagggagtggaagtggttgatccagggtcacaaaacaataagtagccaagccagacctagaactcaggagttctggatccagcatccttttgtgctgccagggatcatgtgggggtggggagtgaccctgttgatgcctgtcagtcccgcaataacaatactccgcccgctcccctccttggccttctaggaagcagagctttggaaataaatccacctccttcacactcctcttccactcctcagccacagtgcaggtgtgcgtgctaggaagttagcagagctctctgggctggcagataatctctcctgactcacaggccccctgagccagcccctctgcaaggaaagccagccctgaggctcctccccactgctcccctgctcaggaaccccaaggcccaggcccgaactttaaacacctaacccaactgtgcctcagtcccacctgaagctgtggatagccccaaaagcgggaagccctggaggggaggtccagctggagcaggtgacaagaatcttccttaaaacacacacacacacacagacaccctcagccacatcgtggccaactcttctgattgggattgaatcactgatgcagcaagatgctcaggatgacacagcaaagctgtaaataaatggctcccaaaaccactgtgcctaccctcctctttcaacccttttcttyttactcttagaggttaccttaggatcgctctcaggccaactgaaccagaaggaacgggtaggaggtgggtcactgcaggatacacagagaaactaccatggtccttgactcgttccaacctcccttcctgttcccagcagaccacacacaagctcatacacatgcatacatgtgctcaaacacacacgtgtgtagaagcacttgcaaacacatgcrtgcacacatacatgcacacacatgcacacatgtgagcaaacacaygctttcacacatgcaatgtataaataaaccacaaacagtgcacatacctgtcatgcctgcctgtatgcacatgtatacacatgtgtgcgcacatgcattcacacacacccacactccactcatgtctcctcactggcacgcagggattactgagtccacctgcctcctatgtgaatggccaacaaatcagtcttaggggctccacttatgggcgaggagggagcaaggttaaggaaaattggagctagaccctgaaactggatgggagagaataacagagaactgggctacaaaacagcaaacccaaaccccacgttaccattctccctcccccacaaaaacaactttcttgtgaagaagaaaaactaattcagagcaccgtagagtgtctacttgtgagtcctgtcctgccccctgcatcgcctgcggctttgatgggttgaccctgagtctttcagctgatgtcaatggttagtgctgggtggaatactcagcttgtaacttggwggacaaagcccaggtgccctaccttggaacccgtgtgtgattttcaaagctgtctatgggtagcttggtcagaggggaaaaaagcaacaggatcaacatttacaaacagggcctggagctcccatgtagctgactcrcatcatttctgtctttttcctgggcaacagttctggcagcacagtgagtggctggacgtggtgatcgatgaccgcctgcccaccttcagggaccgcttggttttcctccactctgccgaccacaaygagttctggagcgccttgctggaaaaagcctacgccaagtgagtgacagcttccccagctcargcagcctcccgacaggagtctctayactagtctttgtagtgagcatctaagggctgggaaaaaatcagggctctgggtttgcaggtgaggctcggcaggacccaaccctctcagggctcaagcggggttggaggtggttttcctgtcgtagcctagatgtgcccatctttgggagcagtsgctacattcatgaccctttttctccctgggccatgaatctggcctttggaagagctgggaaggcaagcggaggggaattctggctgtgccgacagcacttagtgcttcacacttccctcggacactggcatggctcaaacatctgggctattacgcacgtkgatatagagacatcaattgtccgtcctacgggatgcttcttttttatttttaaaaartcgtatatgacatatcgataaataatcgtatatgataaaatgtatatgacataaattttaccatttttaagtgtkcagttgagtagcattaagtacatccatgttgttgtgcagctatcaccacgatctatctccagcactttttcatcttgcaaaactgaaattctgtccctattaacaaataacttcctattcctcccttcccccagcccctggcaacaccactctactttctgtttttatgatttatctagtctaggaacctcatataagtggaaccaagaaattcatttttaatcaccagccaaatggcctcagtttcctcaggctctcaatttccagcccactagctcgttagtgaaaggccacaacagcctgaatttgatccacagatgatggcagagctcctgggagccactttcaggttcagcctggatcttcaagccatgagaatactatccccagagacagaagcaaggatggtcttgcttctacctccaagtgggacataaaagtggcaaaatagaggggagkcatactgtggttaaattaatcctgaaatcagcaggacagaattaaagccatcaaataagaaccaaagatgcccacgcttgccctctgtcccacccaggtctgtgcaaacaccatcagtgccaccagacaggcttaaggggacaaagggcactgtttccaagtccagtgggtgggacccaagcccacctctgccccttggtgagtgccccccacatcaggatgcaagcaaggcaacagmaactgtgtgccatctagtttctaaacataaaaaagatttattggggtcayttaaaaaggccaaaaatggttggcagaacagctcaccaaaaaaaaactgtatagatggtgttatggttagttttatgtgtcaacttgattgggccaagggatgcccagatagctggtgaagcattatttctgggtgtgtctgtgagagtgtttctggagaaaatagcttttgaatcagtagactgagtaaagaggattgctgccaccaatgtggacgagcattattcagtttgctaaagatccaaataaaagaaaaygacaaaggaagggtgaattccctttccctacttgaactgggacatccatattcccctgctcttggacattggagctcctcgttctcaaacctttggactcaaacttggacttacatcatcaaccccccaattctcaggcctttggactcaaactgaatgataccaccagctttcctggttctccagtttgcaaatggcagattgtgagatttcttggcgtccgtaactatgagagccaatttcaaacgtatgaaataacctcattgaaggggttggagagaaaggtgctgacctaagtaactttggaaatcagtggagtctgtaagattaaaggcaaaagaaactgtacgtgagtgctatgctctagttgctaaaattgtttcttgtaggagtacaaatgaaaaattgatctaattatacatgtatattgagctgaacaatcgagtgaacggatggtggatggcgggagccgagtttctcactgttggattgagaggttacagataggcaaggggaggaggccagaatgatccatgcagattagagttggagattccagaatgaacttagatttagcttaacagagatggttatgtagagatacatggatctgtacatgggttatcatacacatatatattgatctatacttgggttatcatacacatatgtatttccttgctttgtcagtgagaggaactagaagcaatgacaatcctgtagcaacaagcacacctatgtctcaagtcttggtttctaagatcattcttcaatcaaaggaactggggcttcttggagataaggctgattctaggactggggcatacacacatacatacatatatatacacatacatatatacatacatacataaaatgaacctagatcatcttatagtgccagaaaatgagaacacatgcaagacacacacacacacacacacacacacacacacacacacacacacacaaatgaggttatgccaaaagggcacaagagcatactgaaggagctccaaacagccaaagctagaagaattcaaccaacgaaatagacaaagcagtactggattatgaacccaagtagaagctgggtgcagtgactcacacctgtaatcccagcactttgggaggccgaagtaggtggatcacctgaggtcaggagttcgagaccagcctggccaacatgatgaaactcagtctctactaaaaatacacaaattagccaggcatggtggtgcatgcttgtaatcccaactactcgggaggctaaggcagcagaaccacttgaacccaggaggtagaggttgcagtaagccgagatcatgccactgcactccagcctgggcaacagagcaagactccatctcaaaaacaaaaacaaaacaaaacaaaaaaacacaaaataaacccaagtagaaaataaatatcaatgggttcatactaatttgaataaatgattgtataaataaatgtggaagaaggaacatatatcctgtgtagaataattccaaataaattatgtttatattccatccttgaggaggtggagtataactccctgattttttcatgcggccttcacataatgattccttccaaagagttcagcatggaaaggggagagaaggagcaactttccagtggagacacctgactaacactaccttagccaggtgatcaaggccagcatcagctgtggtaaggcatgtggacggcaggtactcttgatatsatgagatgagagggsagctttacctctccggtcttccttccactaaccaatagccccactcttttttttattattatttacttttttttggagacagggtcttgctctctcacccagactagagtgcagtggcaccgtaatagctcactgcagcctgcaactcctgggctcaagtgattctcctgcctcagcctcccgaaatgctgggattacaggcaccaaccaccacacccagctatttttttaatttttaaaaaatgtttcattttttatttttatggatgcataatagtgcataatagtatacatattgatggggcacatttgatattctgattacaagcgcacaatgtgcgatgatcaaatcagggtaattgagatacttatcacctcaagcatttatcatttctttaatagccctagtcttaccaggagaaaaaacattagacaaattctaatcctgcagtatgcctgcccaggactcctcaaaaccgtcaaggtcatcaaaaacaaggacagtcttataaactgtcacagccacaaaaagcctaaggatatgtgaggactcagtgcagtgtggggtcctgggtgggattctggaacagaaaaaggacattaggtaaaaactaaagaagcccaaataagctattgtattaagtctgttttcacactgctgataaaaacataccctagactgggcaatttacaaaagaaagacattcaattggactcacagttccacgtggctgggaaggattcacaataatggcagaagacaaggaggagcaagtcacatcttacatggatggtggcaggcaaagagggcttgggcagggaaattcccatttttaaaaccatcagatctgatgagactcattcactatcacaagaacagtgcaggaaagacccgcctccataattcagtcacctcccaccagattctaaaattctaaattgaaaagcttatttaaaaatcaagcagagcacatatatgtaaaatgcatatgaataaaagagatgactatgacaaaaatggttaggagtatgtgagaccagagaagaagggaaagggcctctctctatccacatagccaggccccgttccatgggaggttagagagtgagacacacgatttgaacctcacagcagtcctagaagggagagcacaactctctcccccattttgcatataagaaaatgaaggcactagcgacttggtcattcagatggtaagtcgtagaaccaggatttgaacctgcggccactcaggcaccagagctgctgctctataccaccacaccacactgcctcccttgcaggaaggtcaggatctttggcttcctcgaagctccaaacaaaccctgataacttgcttcccgtcttccttccacaccacccagccagggcaagccctgggagatgcttcaggcttagttagaaaagctctgaaagcagggtgcccyrgtggcctccctaggtccctgactctctcctctctctcttgccacccttgcaggctaaatgggagctatgaagctctgaagggaggcagcgccatcgaggccatggaagacttcacygggggtgtggcagagaccttccaaactaaagaggcccccgagaacttctatgagattctagagaaggctttgaagagaggctccctgctgggctgcttcaytgatgtaagttgctcatgggctcccattccaggcactatgctgrggctgcatagtgcattccaggcactatgctggggctgtaccaggtaccccagccacacccaaggaggggcataactcttgggggcagtgtttattcctgctaattaaaacacaagttttggggggaggtgggagggatagcattaggagatatacctagtgctaaatgactagttaatgggtgcagcacaccaacatggcacaggtatacatatgtaacaaacctgcacgttgtgcacatgtaccctaaaacttaaagwataataaataaataaataaataaataaataaataaataaataaataaaaaataaaataaaataaaataaaaataaataaataaaacacaagttttaaccaagcatggtggtgtgtgtctggagtctgaggcaggaggatcccttgagcccaggagtttgaggccgcagtgaactatgatcgtgtcactgctctccaggctgggtgacagatcaagaccctgtctctaataaataaataacaaataaaacacaagtttttatttaatagtcgtcaaataacaaaggtaagatgtacttgctgtatcagatggaacaatcttgaggcccatacaggcgcatttttacctccctcccacccgtttctcagctgcctctgttctccagctccaccctgggactgggatcacctggcctgtatccttcccagctctctatctgctcgtacaaacaggcacacacttccacacacaaacatcaaggtcagttggtttgattttactgaaaygggatcttyctatctagttttctgaaatttgttttttttttttcatttcatgtactatgaaaaaaatagcagatagaagtctaatgatattttttaaaattttctctatgcatacaaacacacacacttataattttatctcatctttttaaaactttttgttgttttttatggactgctatgacactatgtattttttttaatcaattctagttttctgtttcctcttagattagccttggggtctgttttttgctaatgaattagccagttcctctgcactttcaggtttgtgacgcagagctgtgtgtcctgttgttatattcttcttttcgtctctgggatgtatgtgattgtgtcttctctctcacactatactacatgaaggtgacaagttgttctgtttggggacaaaatagtgaactgttctttggagtccacactggaagcgagcgcctccccatcctgggaagagactggaacttgcttcatgtcactgctaaacatcctaggggagccccgtgcatagcccacgcacatggcctgcacctggggcagcagaaggggctggaggttgtgacygggccaggcatgtagctgggtctgatccagcaggggaggcttgacttagacggtgggtgtgackctgctyttyccatgttttagaccagaagtrctgcagaatctgaggcccggacgccgtttggtcttattaagggtcatgcctacagtgtaacgggaattgaccaggtaggcgacttgaactccaactgcaggctatggggagacatgtgacaatgctaatcccttaggcatttattcagtgcattgcagtttaaatgtctgcctttcaggcatttcagagattatgtcacctaaagaggcaggctggaattcaaaacggcaagccaggaaagagagaaaccatgtgattccaccgcagcacaaaactcgtttagcagctgtaagcgcctggtctttgtttatttttaatttcctttctttcccaattctccttcagtcctgtgttagtcaggattcttcagagaaatagaatcactagggaaccaaatatatatacatacaattaaacacacacacacctatctatctatctatctatctatctatctatctatctatctatctatctatctatctatctacatcacacagttgacccttgagcaacacaggcttgaacttatatggggattttcttccatctctaccacccctgagacagcaagaccaactcctcctcctccttctcagcctactcaacrtgaagataataaggatgaagacctttacaatkacccagttccacttaataaatagtaaatgtatttcctcttccctatgattttcttgataacatttcttttctctggcttatttattgtaagaatacagtatataatataaataattataaaacatgttaattggttctttaygttatcgataagacttctggtcaatggtaggctattcggagttcagctttagggaatacaagattttttgacaatgcaggagggttggcaccccaacccctgacattgttccaggatcacctgtaatacgatttattgtaaggcattggctcatgcaattgtgaagagtaagaagtcccacgatctgctctctgcaaactggaggcccaagaaagccagtggtgtagttctggtctgagtctgaaaggaaggcctagccaccaggaacaccaatggtaaaagtcccagtctgagggcaggagagacggatgtcccagctcaggcacccaggaagagagagtgaattcccccttcctctgcctttttgttcwggtcaggtcttcacagatgagatgaggcccacctacactggggagggcaatctgttttactcaatcaacttaaatttcatgtcacccagaagcacccttgcagacacaaccagaataaccttaaagcaaatatctgggcaccccatggcccagtcaagttgacacataaaattaatcaccacgagtcccattcttgtagctgtagcccagggtggaactgatcctgggggacacccagactccacacagcaccaccctgacttcaagggagctgttggttaggaggagagatccttgaggggcacaaggggaagagwaagaaagaattgaatgaaagaggaggacaagaagccaaaggtatcactctgccagactcaagctcagcaaagcccagcagcctgccttgcccactccatgcctccctggaccagtctcaagcccagtacttagaaggtgcagatgcacctggtcttctgtagccacccaccttttgagtgacatcctctgaatgcgtggggagtaaagaacactgaagggagacyctgcccttcctcctcactggagccaaggtgtgagacgccrttggactctttgggattctttagaatgttagctatttgtgttggctcctttgtcctccttcaccatccatagatgacttgcagattgctcactcaagcrggcatgtgatgtttctaggttagatcttctacgtattccacgtaacaacagaaacctctcatcatcttggtttgcttgattttgcttcctctcccccctacaaggaactcacctgccctgaacctttcaaattaaatgagcccctttaatggtgagccacaagccacatcttggactcygaagagttgatgttacttgaatttttacacatccaaaatataatttatgccaaatgcatgaggataaaacattctgactgctacagtttctggttagtygataactagaagtcttttactttcactctctctcctctaaaacccttctcaaatgcattggcccttgtccctgctcccaggcagagcctgagggcacacaggctcaagggtgattgaggtgaacagcaggaatcctcacagacacctgaaataaggagaatattgggtctagaagacrtaaaagctgtttttgtttattgttgtgtttaaatccccaacatgtgcttattttcttatcattcatctgtgcatgggatgctaggatgaagaaagttcagtaatagttccatgagcacctttgaggactactctttaccattcaytctgctagatgctgaagatgcctaagacttggctcctgcctctagggagatccaagtctagagagaaacccatttttagattcatatggactaatttcttgttaattgcaattctactttacttcccagatgtggcataagcattttggtgcttaatataatatcattggcaatagtagcaattattcaataggaattagaaggttccaagggctggttaagaactggcgaacttctacataccttcagcagcattttaggcaagagactttcaacagaaccagttctggatggagctggtccacctggagctcatagatgaatgtggccaaacctccaccatatttatcatttcacacttccctcatgcttttcccttctaggtaagcttccgaggccagagaatcgagctcatccgaatccggaacccttggggccaggttgagtggaacgggtcrtggagcgacaggtcagtcaccctatcctgcctctctggctggttcccggggcgtgtggggccaragctggcttgtgcagacatgtgaaggagtggcctgtctactatcctcccgggctctgactcaggatcctgtccygattctgaggtgccccttcttcctcccctttcagccctcaggcccaccttgcatcaaggttgattctcaagaaagacttttacaacagcactctaactttcacgaattgtatttatgtcaatacataaatgtgttacctcccatggtgatgtttataacccagtgatatggtgaaaagctttatctgtagttgtgagtaactccagtaagcagtgtgcatatgcataartgcgtgtgtgtttgtgtgtgtgtgtgtatttggagtgtcggaatccctgaaatattacctagcatgtaactataggattctctctgatggtcactgaccatggcagaggcccaatagcccagcagagaaatagaagtgaggctgagcatggtggctcatgcctataattccaacacgtcagcaagccgaggtgggaggatcacttgagtatgagagattgaggctgcagggagctatgattgcaccactgcattccagcctgggcaacagagcatgttgaccccatctctttttttttttttttttaaaggaaaaaaaatagaggacatggaattggaattttatctattacagagctgttaaccagagttttggcccccagttatcaagaaaggtctgccttttctgtgtgtgtccccacagctcctccagctctggtcccttgggaagtggaccaggtgactaagaaccagggatgtttgtgtgggtgcgtggcagggcctgcctgargctgttgctcgtccgctgcttgttgggctcctgaagccctttcctgccacatccatggcccctgagcttctggggaaatctgaagctagtctagaacttggttaaaactgagccagtgtttgtcttcagtccagacacagctaccaggtcrccagacatggtgcagccgctgctgtattagccagaccccagcgtgagggcagggcacacaggcctgtgctttccaggctgtcatkgtccccatggaggctctcgtcccaccatcctctgctctggccttggctgccgccttctgagaaccaagaagcattggcagagatgagctgagatgggttgaggaggaaagagattggcctccctctcctggcagaaatggaaagcacagagaactactgaaaccaaaattagtgagactgcgtcacgttgtaagatgtgcagtgcccctcaactttgagatcgtagcctataaagggaaaatgggccattgtctcccattttctgggactcacagaggtagaaatcaagaaagkgactgagagccaaggctggaataaaatttgtcttccactcatgcagcctccatgggtgatgggaggggcaggcgccrtcccgaytccctgacttygctgtgctgctggtgacatgtgagtagggttgaaggcaccgcatggccagcctgtcaggccaattatctgggtgtgagccacttaggataatggctccaaaagaaaataatggctgccagttccactcttctgaccctggcccgagcacctggagacaggtcccggctgatcctccccttggatcacctgagcactcccctgaggttgagttgagatcacaggatgagagggagctgccacgttggctgtagcaccgcaacagtggtgacctactttgaactatttggaggcggctgtgggagtcacagaaaatgcaatgaacttggagtcacaaatcctgagtttggagagtgacaggcagccattcctacccctactcttccctgagagtgtttccatgggcctacctgagccctcttatctgcaggacgggcacacctagctcacagaaccccacctggcttgccagcgaggtcacatacaaaaggtgccgggtacagacaacatcaagcatgggcaggtgtaaggcattatcacctttccaagtgtcagcttgtccattaaggaagggccaagtactgctccaggtcacatggcaagttggaggccaagcacgaaagtcagcagacttgtggcttccagccgggctcttctgctaccccacgggcatgcaatgccttgtgactatcccaagataatcttccatgtcggtggttcagatcatcctcaggggtattttatccatcagcaacacttggagatgtactttctgaccagccctcttatttgggggccagtggctcacctgccgctacatccctgggtgcatttttgggacccagtgagtagttactaagcaggtcttatttcctccataaccgcacactgtgggttccacatcaaggccattgttgctcttcatcatgacctctgcctgaacaccaattttgtttactcctagttctccggagtggcgttctgttggtccagctgagcagaarcgtctgtgtcacactgctctggatgatggggaattctggtaccgtgcttgttcctgtgttaactgcagatacgagcaagtcccatggccctggggcgtaaggagcactgtgcttctctctcgctttcctttttctttctttctttctttttttttttttttttttgagacggagttttgttcttattgcccaggctggagtgcagtggtgcgatctcgtctcactgcaacctctgcctcccaggttcaagtgatactcctgcytcagcctcccaagcagctgagagtacaggcatgcgccaccacgcccgactcattttgtatctktagtagagatggggtttcaccgtgttggccaggctagtctcgaacccctgacctcagagaaaccacccaccttggcctcccaaagtgctggaattacaggtatgagcyaccacgcccagccttctctctccatttttggcaaatcaaattcatctgtctcagactcctcatatacacccagattagagggaaatttaatctccctcctgtcttggtgggggctcaccccagctctcggtttgttgaagagtcttcagggggttcctgcaatccaatagaggaagagcctctggtctctagcctgacacacctccttggcactctttgtcatccaggtttacacagtgaatttgaagacaggcagccctactgctcacaggatccattccctccacacccatcttgatgagaggtacctttgaaggcagctgccctgagagcatctaaagatatcgacctacgtaggaagtaaacatttctactctggactttcccttggcctgaatctctttgtttaattgaacatttgtattgggccttcatctctagaatctttttcagtcttatttcttcctgtttgggttctagaagttggcccttctaaccctgtgagaccacaaatttctggtttctggctctattccctttcatgtgctccaaccaatcaagtcttgcctgagctcatctctttcttgtaacagcttttaaaatacaacagcagggcacggtggctcacgcctgtaatcccagcactttgggaggccaaggcgggtggatcacgaggtcaggagattgaaaccatcctggctaacacagtgaaaccccacccctgctaaaaatacaaaaaattagccaggggtggtggtgagtgcctatagtcccagctacttgggaggctgaggcaggagaatggcgtgaacccaggaggtggagcttgcagtgagccgagattgcatcactgcactctagcctggacaacagagtgatactccatctcaaaaaaaaaaaaaaaaaatactacaacccaaaaccatgactattccagcctttttcattcttttcccatagaacacagcctcagtagtgatttgttctgccttctgtatttttatagttgtcttagtctatttgggtggctataaaaaaataccatagactgagtggcttacaaagaacaggaatttatttctcacagttctagataccaggaagtccaagaagatgacacaggcagtacctgtatctgtggagggccctgtttctgatttatagatggatccttctcactctgtcctcacatggtagaaagagggcaaggcagctctctggggcctcttttataatggcactaaccccatccatgagggctccaccctcacaacctagtcacctcccaaaggccccacctcctgacactactacttcgagggttaggattcaacatatgaatttaggggagaccacaaacattcagtccataacaacatgcaacagatttacccaatgttttgccactgcataacatagataaccattttccagctcgaacagttccatgatccctcttgctcaactgctaacatattttagaatttcgttgtggcagttctgtaattcaaggcaccaatgactcaaggtaacactagctgcagtagtgaatagaccccaaatatataaaggctcaaacacagtaaagttttttcctcactcattatgacagtccagggaggatgttcatattctgtgggtggctctgttcatacagtgattcaggaacccaaacgccttctattgtgtggctctgccatcttctarggtcacgtcatcatctgcacatagccagcagaagagaagaataaaataaaacattgaaaaagacactctcactttctaaaaatcttgactcagaagtaaatgcgtcacggctcacattctactcccaaatggaaggagtggggtgcagtcttggtcctgtgctgatgactgccagccatctctgcctcgggaaccatgagggtttaggttccccagatttgtggaacacatgcagggtgcttgagagattcccaagctgtcaaattagaaattacagataaactttgaattttgaagtacaggggactttgagttagggggttacaagagaggagcaaaaactgcaggaagaaagctgagttctggaattagtamcatcacagtaattgctgcatatgagcaggaggtagaaaccagagtttgagaggctacctgaggtcaggctagtggaaagaaggtctgrtgcagacggtgggagaagccgggcagaggaaactcggaaattcacagcaggargctccacaaagaagagcgtccatgtgagtgatccattgccctgcccctcttgaaggagcagccccaacaccwgggctgagcctgcccaaggtgatgggtggtgttaaatcatgcactctgtgcgtggagcccttcctcctggaatcctgactctgaagccctgtgtagcctctttccattcttcaccrgctctaggatgtacctcctgcaactctcttctctccccttacgtatgaattccccccttcttctgaatcattccccttagcactccaacactatcatttctcctacctgcaaagaaaaaaaaagcctctcttgacccactcaagtgaccaacccagctctctcctgtcctctacagcaagcccgccagttcctcttctcccttactctctcgactccactcagctatgagtgtgccccaccaccccactmaccctgatcttgccagggacgccaccgactctcactttgctcgatcagattatcttgatccatcaggagcccttgacgtgctggattgcgggggaccacacgccctggtggtcctcctcctacctgagctccttctcaacatcctgtcctggccccctctcatctccctaacctgttagcactgaggtgtcccaggaccccatccatggtccccctcctggctgtctattcccactctttaggcgtctcgtctggtctcttgactttaaaaactatctttacactaattctcaggtttctatcttcagctcctttccccaggattccagagtcacatattcaatggtctactttaacatctctccttgaatgtataatagacatctcacattcacgtgcccaaacctgacctcctgagcttctctctcaaactgccccaccacagccttccccatctccatccttccagtcactcaaatcaaacatcctgattcctttcattcgctccttccccacatccagtccattagcaaatcctataaaatttacctttggaatgtgtctcaaatctggccactgttcatcacctcccataccatcagcctggaccaagccacccttgtctctcacttggacaccggcactaacttcctagctgcctctctgcttccacttgtgtccccaaagtctgttctcaacacagcagccatggagcatgtgactcctctgtttactgccttctaaaagctctccatcttctcagagtcaaagccaaaatccctatacctatttgacgtactatgatctcttgatcttattccttacagacacctcgtgccttcctggtgttctgtgagcacctcaagcacctctctgcctcggggccttgctgtccatctgcctagacccccagagagctgccctgcccaggacctggtagttcaggtctccactcagaatgtgccccatcagtaagggcttctcttacctccctgtttaaaatagcatcccacccctacgctcccatccttcagcccaatttggtttttctctgtagcacttaacatctacaatcaatctatatttttagcctggtttttacctttttaacctttattttacttttaaaaaattttccatctccccacactttgcagtccccccactccttgcggacaggaacaagatgatttaatgaataagtgaatgatttaatgaatgagtgaatggatgatgccctcactcttgccctcctgtgcatcgtgtctctcmgctttgctgcaggatggcatttmaggacttcaaggcccamtttgataaagtggagatctgcaacctcactcccgatgccctgraggaagacgcgatccacaaatgggaggtgacggtccatcagggaagctgggttcgcggctccacggctgggggctgccgcaatttcctgggtaggtaggctgcctgtcactctctctgccactcccaagtgtcccttccaactcaggacaccaaaggataagggccgggtcctcagagaaagcctgaaacatagtaaggtttcaaaagtgactggggaaaaaaggctgcaaagatttagttggataagaattgtttggggaaacctcctttgttttaccacttaggttattttccattacaagtaatggaaagcatgactcatgccagtttagcaatagaaaggatttgttatctcacataattgaagagctcagaggaaaagtagggtgggcttcaggcacagttctatcagggccctggttccatttgcttgtaattcactgttctgccctcttttatgtgttgacttctttctctgtctggctttctttataatcacaggagggctggcagcagtatccagggcttcctgagccctcattcacacgaacagcaagagctcctgggggtatcaaaaaaaagccctcaacttccctctaattggaaattccttgaactaatattgtccagtgaatgctatgcattgattggctttgtccaatcctcggtggcaaaaaggactggcacagaccaatcagaattcatgctggagcagtgctcgaggtcaatcctactcaaacggcccaccatcaagtagatgccagggggacaaccagaagtccactgcactctcctttgaaatactaagtggaaaaaaaactgatagaacaagctttagcagactagacccagaagaatgtccttaagaaactgcataggaaatggttgaagagaaggtggaaatgaaagagaggatattttgcattcccgttggggattatcaaaagtagggtaggaggacttattgaacagggagagaaggtattactttctcatgtttggtaggacatataatgagggcagataggtgtatgtgcgtgtgtgtgtgtgtgtgtgtgtgtgtgtgtgtgtggtctttgtgggttgttttttaaaaggggaaaataatctacctctcccaaatgacagataccttttggaccaatccacaaataaaattgtctctgactgagaaagatgaggggcaggaggagtgtagtttccttgtagccctgatgcagaaagatagaaggaaactcaagagatttggtgccaatgtgctgacaatcggctatgccatttatgaggtaggtgggaaccacactgcatttcagagttctccatctgagttctaaattcgcggctcctcctcggtctcacacccgagactcaaccaagagtccatgaattgtgtccgaaaagccaagaggaacttccctaggaaacccctccctttcttgcccattgcagtgccctgacaaagaygaacacctgaacaaagacttcttcagataccacgcttctcgggccagaagcaagacgttcatcaacctgagagaagtctccgaccggttcaagctgccccctggggagtacatcckgattcccagcacttttgagccccaccaggaagctgatttctgtctgagaatcttttcagagaaaaaagccattacccggtgagtcagaggaacagcttccagaatcccacttcttttagtggtttattcacacagaagtcacctgggaactgctggagccaagactccattcttccctttcccatgtgtacctgagaaacaaggcaggatggtttctttcttttcttttatttattattaatttttttttttgaaatgaagtttcactcttgttgcccaggctggagtgcaatggtgccatctcagctcactgcaacctccacctcccaggttcaagcaattctcctggctcatcctcccgagtagcaaggattacaggcacccaccaccacacccggctaattttttttgtatttttagtagagacggggtttcaccatgttagccaggctggtctcgaactcctgaccttaggtgatccacccgcctcagcctcccaaagtgctgggattacaggagtgagccaccacgccaggctgcaggacactttcttagcttatctgcaaggcaaggcacatatcccttctagctctgctcctcgctccctcaagcaaaccattgaaaagttgctgttttctactggtcccagagtcatgctcacaagacattcttgggtggagaccttcatttttcagaccctattaccaagaagcttcttggataagagccacatgcagggatgctagacatttctgggcatgatgaagggggtggctattgcaaatttcaagaatgacatgttctttcagctccaatttaaataaatgttggcaaatctgcctctcattttacatacccaatattccaccacattttcctcacagtgtcttagcgaaattactttatatcagttacttctatggaaaatgtttcccattactgcccattcaccattggttgctctgtggcacagggggaaaaatggttcaagacagaggaatccatttcttttcccgatgacaatattctaaagattaaggagaacgctaaaatctgctaattctgtatttaagctagataagtctccaacaaaagatcaatctgcacagagttaacaagagagacagctgtgaatacatgactcactctagtttcatctttcgtttagtgagagagaattagattggtggcatgcattgaaaagactctcaattatgaagtctagtggggtttcccaagctgattacaaaaggcatggttctttctcttggctaaatagatgcagaaaagtctttaatttttaaacactctaccagagaatttttctccagccttctcccagatactagtacaagatggggatgaatatcctagtatctgttcacacaaaagtaccctgtatgagatccatgcagattgacatctcttatgggtggcaagaacaagagagacccaagttatgccaatgccatgcctcttgttctctatcttattagtggggtgagctcagagtcactgacatgcataaggtgacttgtacatggcaaaaaactccatactcaatcttgctctgaacaagattctttaatctgctatgatattgagtataagaatcagctctgtagcttggtaacaaaaattcacactgagctgtgttygcattggtttagctctcagacagactcctgattaaacaaacagaagttctgaaagggttatgttatggatgcccaggggatgaggaggaaagggaggactacccccaattgatgttaatgtttatttgtattccctttgactttgtatcagtttttctttgagagcccttcaagttttagtctatgagactgtattcttccaaatgtttttagcatcatcaaaagctgaagcctgctcctcctcttaatattactactatccaaatattacaagtccccctaaatatgtgaatagcaaaaaaacatgattgcatcatttttcctctttttccctaacataagcacagagacacccatccctccccaaccccaccagtggaatcaggaatttacatctgtgatgagaggcaggagttagggatgcagcttcaaaaggtgrtctttaggccaggcacggtggctcatgcctgtaatcccagcactttgggaggccgaggcaggaggatcacctgaagtcaggagtttgagaccagcctggccaacacagagaaaccctatctctactaaaaatacaaaattagctgggcatggtggcacgtgcctgtaatcccagctaattgggaggctgaggcaggagaatcacttaaaacccaggaggcagaggttgcagtgagccgagatcatgccattgcactccagcctgtgccacagagtgagactccgtctaaaaaaaawggtggtttttttggttctgattcaactttgtaatcttttaaaatgcaccccctccccagtgcctaccactcaataggctgaatggtctccaacagatatgtatctcctttgaagatgcaaagttcatggagagtgaatgtgtaatgcaactgcactgtttatgcgtctttggaggtgctgctattctacaaaacactttatcagttgcccttgttaaagtacattaaagaaataaggagtgactgctggcttaacttcttttagtttcataaatccagaattcacaagttcttggtgatggctgatttagtttgaatatgtgtccccatcaaatctgaagttgaattgtaatccccaatgttggaggtggagcctggtgggagatgtttgggtcatgggtgtggatccctcatggcttggtgctatcctcgtgatactgagtgaattcttgtgagatgtggttaatagtatgtggcacctgccccacccctgctcctgcttttgccatgtgacatgactcttcccccttctgccatgattgtagtttcctaggtctccctagaagtcaaggagttaagttaacttctagggaatacaccatgcttctttgtaaagccaattgaacctcttttctttgtaaattagtsttaggtatttctttatagcagtacaagaacagcctaatacagaaaattggtacagaagagtggggcattgttataaagataactgaaaatgtggaagtgactttggaagtagataacaggcagaggttggaagagtttgaaggcctcagaagaagacaggaagatgaggaaaagtttataacttcttagaggctggttaaatagttatggcctaactgttgacagtgatatgaacagtgaagttcaggctgccgaggtctcagatggaaaggaggaactcattgggaactgaagcaaaggttatgtgtgttatgccctagcaaagaacttggctgaattgtgtccatgccctagggatctgtggaagtttgaacgtcatagtgatgatttagggtatctggaagaagaaatgtctaagcagcaaagcattcaggatgtgacctggctgcttctaacaacctatactcagatatgggagcaaagatatgasttaaagctggaatatatacatttaaaagggaagcagggcataaaaatttggaaaatttgcagcctggctatatagcagagaaagaaaaagctttttcgagagaggaattcaagcaggctatggagcaaccacttgctagagatatttacataactaaaaagagccaagtgctataaccaagacaatggggaaaaggcctcaaaggcattttagagacctttgcagcagcacctcctcccatcacaggccgagaggcctaagaggaaaaaaatggcttcatgggccaggcctagggccccactgctctatgcagcctcaggacactgttacctgcatcccagctgctccagctccagtctctgctcaaaggcaccagatacagtttgggctactgcttcagagggtgcaagagtgcaagccataagccttgacagcttccatatggtgttaagcctgcaggcacacagagtgcaagactgaatgaggcttggcagcctccacctagatttcagaggatgtatggaaaagcctgcatgcctaggcaaaagcytgctgcagggacagagccctcacagagaacttctactagggctatgcagatggggaaatgtgaggttcaaggtctcgcacagagtccccactggggtactgcctagtggaactgtgggaaggcggycatcatcctccagacccaagaatggtggatccactggcagcttgcaccttgagcctggaaaagccacaggtactcaacaacccatgacagcagccaaagtcacagggacagagcttcccaaggccttgggatcccaccctttgtaccagtgttccctggatgtaggacatggagtcaaaggagatcactttggagctttaagatttaatgactgccctgctgggtttcaaacttgcatggggcctgtagcccctttcttttggccttttggaatgggaatgtttacccaatgcctatactcccattgtattttggaagtataaaatggaatttgtatatcttggaacttgattttgatttgacaggctcataggtgatgggacttgccttatctcagrtgagactttggactttggaattttgagttaatgctggaatgacttaagactttgggggttattgggaaggcataattatattttgcagtgtgagaaggacatgagatttgagggcccatagcagaatgatagagtttgaatatgtgtccccaccaaatctgatgttgaattgtaatccccagtgttaggggtggggcttgatgggaggtgtttgggtcatgggggcggatctctcatggcttggtgctgtcttcacgatagtgagtttgcacgagatctggttgtttaagggtatttggcaactcccccataccaccctgctcctgctttttccatgtgacttgcctgctcccccttcaccttctgcaataattgtaagtttcctgaggcctccttagaagcagaacggatgccagcactgtgctcctgtaaagcctgtagaaccatgagccaatcaaatctcttttctttataaattacctagtctctgttatttctctatagccatgcaagaatggtctaacacaatggctgtccctcttatttacattctgagcaaggtctgagtgactaagggtgggggtgtcaatgcatggggtctgcaaactctgtgaaatgtaaacagcactgaacaataagggattcaaagggacagaaccttcccaggctctgggctcttcagctctgcagatcccaatgggaagttaatccacaattgaggcagtgtgtttttctgcccctacagggatatggatggaaatgtagacattgaccttcctgaggtgagtcttctgatgttgctatggagtatgggattcaggtgatggttctggaaaccttccttctaatcacagcatcatgtaaaactctgcagttcagggatggttacatgcaatcaagtaagcatctatgattctaacctcctggagaccaagatgtgtgtgttctagtctgtgctcttctagtccacaaggacctggcatgggagtgaggtgggtgcttggtataaagttctgttcsatgtcatcttcctctgtgctactgtcaactgaaataacaaacacagagacactctctaaaagaaaagctatttatttagggataaagcactgcaatgggaaggtgcatgccatagtaaactatgcacctatttggggaggtaaaggaggacaaaggtttttaaagaaaaaatgagaaggattacataattgttttgaaataattatccttggctacaaagatcaataacaaaagtgaagccagtctgatgttggacaggcagttgctaggcagaggtagaagtatttttgtgtatggttgcgagggcctctgtgaaaggttgtgggttttgcagccttttgtgatatttttgttatcaggcaaataagcatgagaaccttctggccttcccgagctctatttgtcagggttttcttaacattagtgacttcattttgactcaataactttcacactaccaactccacctgagagaaggctgccgcttctgaagtgggtagacttttaattgtattttaagaaatctaatcaatgaaaagaaaaccagagaggcagggagatgttttttactgtggactcaggggaacayattacatctcccctatgttatgtggtgtggaaggggtgacatgggggtggctttaccctcgtccaagggctggaggactcgcaagaggccctgagatactatagctggaaatagtctgacacgtccagggacagcagagatctgcttttaggagggaatttgctgttccatgctggggcacagcttattaatggtgctaaaaaaccaaagaaaccaaaaatcacccaaaacatttactgagctctttctatataccaagcccagagcttagtggtagaaacagactcttgccttcaacgattttaccagctatcaaaacagatgatgaagtaagtcattccagtccagggtggtaagaagtaagccagaggaagggcaggaagcatgaaaatccaatggccaggacctaacttaggcacgggtcaaggtcctttggcctcctcgtctgtaaggcagaagggctccacaggtccagctaataaagtccttctagtctcaccttctaaaagagccttcatgagaaaatgttcctcacgctacaggacgcagcttgtgcacacygcctcaggagggtgacatggggctgggcacacaggstcctggcttctttcctgctatttttgtcatgtttcttttttgtggatcattttgtgcaagtttctttggctgttttttagcctccaaagccaactccacctgaccaggagacagaggaggagcagyggtttcgggctctgtttgaacaagtcgctggtgaggtaggacatgccccacttccatctccccaccagsctgagggcctggacctgcttcctagcaaagggttgcagtcgtggggttggtcagcaacgtcatcctgaggcatgatggagcttgttgcaaagtaagaccagcactgatcattcaaggcccaaagaccaccctgtttacaacatttacttacacagtctgcggctgtggatggggccagtgagcccaaagaagcttggaataggcccagacgctttgttttttagttctgttttgctttagacagagtctcactcttttaccctggctggagtgcagtggyataagcctagctcactgcagcctcaaactcatgggctcaagagatcctatcacctcagcttcctgagtagccgggactataggcacatgccatcatgcttagctaattaaaaaaataaataataaagagtcttgctatgttgcccaggctggtctcaaactcctaggctcaagcaatcctctggcctcagcctcccaaagtgctgggattacagtcatgagctaccacgcctggccccaggtgctttctttgggaggctagagcaagccttgaagaggtgactcctttgaactctgcctgaaaatcactgccattagaatactctgtttgctgtagtaaaggggatcatgttcaaggaggtccctattcaattgcaacttcctgtcccccaccctatcctagctctttccactgctcagcttcctttttagggacactggatggagcctcacacagatccaggctcttcctccacctgctggggtcaggggagggaagtctttctagaaactgccccagaggtgctctcttggagccataaatacaatgagctgatgaactaattcatgtcaaggtgctaatgactctattagcttcatgtgtttccccaaactggggttcctgaattatgaaaggggtcacctggaggggtgatatctaaacctaggggctgtctgatggtagtatattaggcactgcaataaacaggcaagrcagggagattaggggaccacaggatcggatggagaaaatgggggctcatgtgactgcttaaagcacagcaggaaggtggctgagcgyagccctgggcgggacagagcatggtgaggggggaaggcagtggtgacctccctgctccaggtgctatctggagcatgctgggtcagacccagcaagacaggctcagaggagttaaagaggttcatgcgggtgcgcagaagttgtcagatggagatccagagtttggaagggaagcggtgaatgttgcaggagtttcagtcgacctttattaacaaccaaaaagtacctctagagttcagccctccttgactcatgtcctgcttttcttccaagtagttggatgacttgggcacatggctccatttctctttcctcctctttcagtgggggcctggctggggcagtgctttcttaccaacaccaaacatcccaaacccccattccccaggcccagaggcttcaggacggacatgtgttagaagcactccacagcataacacacggctagcgcaaaaccctgactaaaatgaggtctatgtcagtgctactcaaacacacatgtgcataaagtcacctgggcatcctgggaaaaaaaacacagattcctcatcaataggtcaagagcatcctgggcaacatagggagagcccatctctgcaaaaataatcagcccagcatggtggtgcatgcctatagtcccagctacttgggaggctgaggtaggaggattgcttgagcatgggaaattgaggctgcagtcagctgtggtcacaccactaatactccaatctggatgacagagcaagaccctgtatcaaaaaaaaaaaaaaaaaaaaaaaaaaagcctgagtctcagggcaaggtctgagactctccatttctaaccagcttctggggtgggggctgctgagatttcctggagtgccttagatccatgattctgaaattcacccttattcttaattctaaatcaactcctaggtcttaaaaataggaccatattctcaggtcctctgatttcaagattccctggggtaagccccagatgcgggactattttaaagctctgcaggtggttctactgtacagaggaagactcagtctggttttcccaaactgcctccaacataggaatcatctgaggagcttaggacaattccaggagttggttctgaccctcagggaagctgggaaaccactgccttgccctgcccagcttttcatgcgctttcctgggttgggatgtctctcaagttaggctctctcctagttgggctggcatgyccctaaaacatgtgacatatgagacacatagctgcagctacacaggagataggtacatctgcccacagcagggtcctgaaggctggtctgtcactggagccaaatgaagctcagaactgatttaaaacaaaaataaactataaaagaaggtgccaagggctataamaaacaattgtctccacttcaacaggacatggaggtgacagcagaggaacttgagtatgttttaaatgctgtgctgcaaaagagtaagtgccaaccccatcrgggtcctggggcacctatggagggacaagcgaccacactgcctgggtcccctccctgctcctccgagccgcagatctgcttcccagggctgatttgtaggtagactttaaaaatagctttcattgtttgttttcctgattccaaaaacgatgcaggtttatagtagaaaattcttaaaaatgcagaaaagcctaatgacaaagatagtcacaaatgatctcaccaccataaataaccactcttaacatatgtgtatctgcatgtatgtacatgtgtgtcatatgcgtagacatataatgttagaatgtttcatcactccaacaagaaaccctttacccattaacagtgttaaccctgtacccatttcccccagccccaggcaaccactcatctaytttctctatagattctatttacatattctgaatattttatataaaaggaatcataggccgggtgyggtggctcacgcctgtaatcccagcactttgggaggccgagacaggcggatcacctaggtcaggagttcaagaccagcctggtcaacatggtgaaaccccatctctactaaaaataaacacacacacacacaatcagccaggtgtggttgtgggcacctgtaatcccagctgctcgggaagctgtggcaggagaattgcttaaacctgggaggtggagtttgcagtgaaccaagatcacaccgttgcactccaggctgggcaacagagcaatactccgtttcagggggaaaaaaaggaatcatacaatatgtggtcctttctgactggcttttctcacatggtgtgatgttttccaggtccatccatgctgtagcatgtatcaatgtctcattccttcttacagccagacaacattccatcgtatggatgggccctgttctgtttattcattcatctattggtggccacgtgggttgttaccggtttttggtcattatgaataatgcaactgtaaacactcctatacaagttttttgggtgggcatgtgtttttacttctcctgggtatatagttatgaggatggttccatcacaatgcaacagtctatggttacatggtggcataaccatcctcttaattatatgtttagttaagaggattgcttaactctatgtttaatgtttttaaaaactatccaactgttttctaaagtgactatttcacattttcaccagcagcagtatgggagtacaaatttctccaacaaatttaaatcctgccattaaatatgctgcaaaaacatgattcctaagggtcgtataatacttcattatatagacatagcctaaggtattgaccatgcctctctattggtcattatttcacttccaaatttttgccactataaataatatgatgacaaaaatcttcatatgtwattctttgctcggggttcttagaactagaataaatggatgaaggcgtattcccacttttattgcttttttcacatttagccaattttccttctgaaaggtcatgttaacttctactcctaccagcatcataagagagtagccacatcacagcccccaacagccctggatttagccacattattgggctttcagcagatgggtacataggtttatcttatcgggtcaactgaattcagctttcatgtgcaatttcagaaaaggacatcaaattcaagaagctaagcctgatctcctgtaaaaacatcatttccctgatggacgtatccttccaaatatttgagcagaaatagacatggatcctgggctttaagcacagtagagtaatcttcaatagtgcagactctccaagaacatgacatccttagccagcagaatagtcttcttcacagaaaataacccaaagctgggggacccccatgctgaaattggatcagaatcaagatgcacaagactgccyagtggtgggggtggggagcttttgaagggacttgggggtcttcttgccactttgggatcccatccaagggaacagagttctgtttttgtgaactttccrggaccacccccattccacttctgccgtttcccctcttcagagatttgtggtttaatcattaaaaccacttccccagggccccaaacctgtgcacccaggccagcccatcggccctccccctctgcagtcccagagctgaggtcccacgaggagcctcaggttgaaacactgctcatgtctcccttaacccacatggcacagaccagcggcaatgggaagctggagtttgatgaattcaaagtgttctgggacaagctgaagcagtggattgtatgtaacctggagcagggcttggcctctgggggacccagtgaacctagagcagaggggatttaaaatggtgcagcaggctgcaggctataggctagaggaattgtattyggacaggggagaagggaaaacagcatcatgctattccgatrcttacgggagtaccaccgtgcttccacccaagacgaaaaggaagacaaaagggagaccgacttcttttggaaggcccagtccaactgtggcctctgcggcccctagagggtagctcccccgggctggctgtcacccatttactgccaycagcgatgcctttcaggcacgctccttctcaaggcttctgctctccaccctttagaaccttttccttcggtttgatgctgacaagtccggcaccatrtctacctatgaactacggactgcactgaaagctgcaggtaaagaaaagactggagtacaggtggctgactgcatgccaggtactgcctgtgggcaacctgagcagatggcaggtcttctctctgctgcccaggaggtgggcctctgagcccagttggtgattcttaaggtcayggcccttggagtggtggcaccagggttcagacccaggactcacttcctgacaccagggccctcattttaaaccactgtgaacattggtagaaactttttaaatgtatctgctaaaaatgaacttggcctgccctctggaggcctcatagcctctgaccatgttttctggcccagtacttaacacatggctctttggtggcaagctgcagtgattccaaacttctcatttctgctctcagatggttgttatcgtggatgagacagagcatgcagcacccatggtttggggtccgcacgtccctctgccacctgtggccctgtcccgggttttatcagcatcagactctgaatccaaaatggatgactgcatcatagtttataccctgctcccttacccaaaggctgggctccaggtggcatttcccactcttgtccggtgctggatggctgtcggcatctctgtggtcccatgtcctgcacacacaaccgtagtttccacragcgctctgcagacctcccgcctgccgggctgcctgcgcttctcaccaagcacacctcacagataggggcctcctgaaccttttaaagtggttcyctcccagggaaagcaaaatctggaaacatgtccaggctcaggcctgataaaaggatgaagtatacacagccaggaccatctcgggtcctatgtgagggagaagaaaatcagatgatttataaatgagcaaagtgccaggctgagaaggggcgcctgattttcttaggggatgatgactctgtttccatggtaggaggaggaactgagcaggggacaaagggagcactcagagaggaggggcatggctgtgtctttcctaccctgacgtggtgtggggagaatcgcccctcatccccctcctctagccccaaacatcaggattctggccaaggctggcagccagcactgccgtgcaggctccagrgactctgtgctctgtgtctgacctgcctgctcctctgctggaattaggaagaagcagaaagaccctgggtggatttctgaacaatcctgtgaacacctcctagaaagtgaacatgtagacaaaaatgaaagggggaaagaaatcacttctaagggcactaattagaaatcaaagcactggccaggtgtggtggctcacacctgtaatgctagcactttgggaggcctaggtgggtggatcatgaggtcaggagtttgagatcagcctggccaacatgatgaaaccccgcctctactaaaaatacaaaattaaccagttgtggtggcaggtgcctgtagtcccagctactcaggaggctgcagcagaagaatcacttgaaatcagaaggcagaagttgcactgagccgagattgcaccactgcactccagcctgggcaacaagagtgaaactccatctcaaaaaaaaaaatctaaatatcaaatccagaaggaagttcactttgtctaaactcctcatttgacaatgaggaaaccaaagcccagagaactgaacccatatgccacggctggagcagtgccagggctcagatccaagcctcctggctatagcctgtcattcttcccccatcgtggatgtgtaggaatgggccctggcagagtatcattctccgtgggcagcagcatcccctccaagaaactttctagggccacagctggaagtgacctgagacatagaacrcgaggggaggctggtgtaggaatgaacttggggctcagacaccacccagtgttaagttcccccaaacaaagcttcctgtaaagtcagcgagactctatgggtgatgttagcatcaaaattaagatcacaaactcgctaaactcagaagccattaaacacagaaagcacgcctgagagtcccccgcacactcgcccctgcaccacagattcacactctcacgctgcattcacaccaagggcagcagtcccactgggtctggggaccccmgctttgaggagtgaaacagtggcttcctcttctgagccctctcctcagctgcctgggagctccctcaaaggtgcagactcacctcggggctcggatacagcgagtcctgggtctcctcctttgtccccacaggctttcagctgagcagccacctcctgcagctgattgtgctcaggtatgcggatgaggagctccagctggacttcgatgacttcctcaactgcctggtccggctggagaatgcgagccgtaagtgtccagcgaggctgagggtgcacctcggggtggcatcttcagtcaccctccatgagcgcatgagaaacagcctggttaaagtaatggcaaagatagaccacagagagccatggtctgatgtgtgtggacccatgggcctgtgcggttagctaaggagcagaatgtgccagcctcccctgcagcaygtttcttagcatcgcctttctttatacattcacagtgcctctgtgggaggatgatgggctggggcaggtttgtgccttgtgtttgaggaaaggttcaattgcaggtcaaatcccatcatagcatatagaaacaggagagtctcagtcccccttcctccccccttccccgccctgtaagccctagacattgacccagttatctcaaataagatttgttacaccacaaatagagagggattatgtgcccgtgcgcttcagtgtttgcagtttattgtcatagccatcctgcccctcaaaggtggttttgaaggtgaggctgagtgaagcatgtccagggcctgtaactcagtactggagtggctatgaggacatgccctgtgtgcaggtgccaaaggacccgtgccctcaagggtgcctcgtgcttggtttaatgttctggcgtttccatcttgaaagtcttcacaacttaggagcagggggccccgcatttccattttgtcctgcttggtattttctaatctgtgttccataggccacttcgaggtatgaatacttgattaaaaaaaaaaaaaaggcagggggctgggcacagtggctcacgcctgtaatcccagcactttgggaggttgaggcagttggatcgtgaggtcaggagctcgagaccagctcatagcgaaactttgtctctackaaaaatacaaaaaattagtcaaatgtggtggtatgcacctgtaatcccagctactcgggaggctgaggcaggagaaccccttgaacctgggaggtggaggttgcagtgagctgagatttgccactgcactccagcctgggcaacagtgggagactccatctcaaaaatataaataaataaataaataaataaataaataaataaataaataataaaattaaattaaattaaaataaaaaggtgagggctgtgacccttggttatcagcatgatagctccctctgcttctttggtaatagaacactaattacttgcctgaagcacagcccctctagactctaagctccaggagagccgtaatttctggacaatcaatgagtatgtgttgattaaggaatgatgagagaaaatcagagacagaccagcaggccccaaagggtctagtatatcaagccaggaagccggctttccctaaggggttactggtagctagtgagaggtgcattctagaaagacccctcctgaaacagaatcygttattagacttacagggtggtcagagctgaccctagaaataatgagatttgctagtttctcttctctccattgctctttccctttctaaaccacccaggtgtaatccttcccagaacggggggtgggagtgcctcagcttttcttatagtagaggaatattagggtgaagaccctttaggcttaacaccatccactctggcatcctcacattagatttgcctggagaacttttagaattaccaaggatggagctttgctgcagtattattttaactttttattgtaagaatgtcaaccctccagttagatataaagaatcataataggttcccatgcactccacatcagcacttctcaaacttcgctgtacattacaatctccaggggtgcctaaagaaatgctgatgaccaggctgcacagttgaccaattctgttagaatctcaggggtggcacacagcattgggagttacgcaaattcgccaggtgtttccagacctttacacccaacctcaacaattaccatcttgctaacttttcccttgtgctcccgcaacacatacattttccccctaaataatttaatagcagatctcagaaactctgtccattcatctgagtatctccagctgatagacttgtttttagcatcatcttcataccatttgcacacctaacgaaattctcagcaaaccctcaacattctctagtgcccggttcatgcccaagtcttccaggccacctttttacagttgcttggttgactcaggatccacacaagacccagtcaccatgtttggttgttgggtctcttccatttcttgtgtccagtgatggtcccccaccccgctttgggttgtattattaaagctacccgagagattctcaagtgaagccagggctgattggctcgacctcgtcttctgaaggtgaggaggctgaggccccaagagggcagtgacttgctcaggtgcactcaggtcactacaccatgcggtagacccagcccccagctcagtgctggcacgctctcctgtgccactctgtcctctgacagcacccacggcaccttcctacaagggcgagactaacaactttcagattcatgcaaaactttacgtgcgtgtgctttttttctggggcctatggatttcaagggccctgtaccccccagaaggttaagataggggcgttgctttggctccaggagctgctggccggctgactggcttaggtgaccactggcttgctacaggactggatgcctccatccgttcagagaagttcaccttcagcccgcccttgatgagagtcccatcgccgcccttgatgaaagtccttgtttaccaccagatggagcagcttccccacaggctccactggaaggccctttggtcgctgggaaacaaacttggtaaaggaattgtctttaaaaggatgcctttcccccttctytcctatcaggggtgttccaggctctcagtacaaagaacaaggagttcattcatctcaatataaatgaggtatggccaatccagaccctctgctcagggacccagctggggcccagcagagtccacgctgcatagatgtttgccgaatgcttgatttcatgcaagggctgacatctagctgtgggagtgattataacaaaatagctaatatttttgagatactatttatcaagtaatcaattaagccattacaataattctgtgagctaagtaccaatagtatccccattttgcagggtggaaactgaggcatagagagattaatcaccttgacttgagtgagtgagcagactctgccttcttgtccttctcttccttctgtcatttgggtaacttagcctgcctgccttccagctgccagtttgctcactctcccttgctcatgttgtcccgtggttcccatgacactcccccagactccaataagtacaaaactggccagttaccggggccaytgtagcaatgacgggggtgggagaccatgggtctgagtgtcagaggtatgggagaaggattcyagggggtttcaatcaccctctccccagaggatcccagtggacccatctgctcacagggaggtccatgggccagcagcagcataggcatcacttaggagagagcgttggaaatgcagagtgccaggccctgccccagacctgctgaatggaagtcgtctttcacaggaccccactgattcctgtgcacatgaagcttgggaacgctcttgagacattctcctgcccaaaggcagaggggaaactgtggagcagtttccttcaatggttctgtaatttttatctcccttttccttctttccctccctgtatctttctttccaggtctgctttctcttctacctaacaactctgaagccaggcagcctgtggctcctccccagtctctggagtttctcctctccaccaatttccatactcacagtcacagccagctcatttccaaattcattagtaactttgggtttggataacatttaattgaatatttcaagatgaagaggttgatgacagtatgtgttttagaggattgtacctcctcccctcttttgtgctctgatttcgattaagcaggctgctcggtgcctcagtttaaccatttacagaaagagacataggccttaatattacacccaaagctttgctttataataatatcatataatttggcaattatgttgactcaccactaattttctcaagtgtgtatctcagatccctggacgcattattatttcattgagccaattacgtattattacggtgagccaaatggggatactattggtacttagctcacagaattattgtaatggcttaattgattacttcataaatagtakctcaaaaatattagctattttgttataatcactcccacagaaactaggcatttttcttctctagttttgtctttcaacttcagcatgtargacacatgtaataactatacctcctttgatcaatccaagattccaaagaaagatgtgcacacacaaattattcttttatgaaaataagaggaagctgggcatggtggtgtgcacctgcagtcccagctatttgggaggcctaggcgggaggattgcttgaggccaggggtttgagcatgcagtgagctatgatctcgccactgcactccagcctggaagagagtgatagcaagaccctgtctcttaaaaaagaaaggaatttgtaatcccagcactctgggaggctgaggcgggtgaatcacgaggtcaggagatcgagaccatcctggctaacacggtgaaaccccatctctactaaaaatacaaaaaattagcctggcatggtggcgggcgcctgtagtcccagctactcgggaggctgaggcaggagaatggcatgaacccgggaggtggagcttacagtgagccaagattgtgccactgcactccagcctgggcgacagagtgagactccatcaaaagaaagaaggaaagaaggaaaagaaagaaaagaaagaaaaatragaaagaaagaaraaagaaagaaagaaagaaagaaagaaagaaagaaagaaagaaagaaagaaagaaagaaagwaagaaagaaaggaaaaacaagagagacccctaggtccacctttatttatcatttactttaaggtaaatgataagtaatgtcactaaaaaacatgaggaagtgtgatggctgcccctggtccatggtggaaggagacagtgggaaggtttgttactcagcggccccctggctagtcaaaggctccagagcaccagcagtgtggaggaagtattccagtgctgcagcttcaaggtagaagtgtggacacctctaacgcaagtgtccacaggtgtaggggctggaataggctcctgccctgccccatatcatcaccctgcagtacaacagtgaaaaccattgcattctctccctctaaacctaccatctttacatctggctgcatgttagcatcacctggggagatttaaaaatcctgataccccagccactccctagatcaattaaatctgaatctctggaggtgaggcccaagcattgtttttctttaatccccttggtgagtccagtgtgcagccaggtctgaagtatccatgttttaaagtccctctccttttcccctgacccatcctaggaagcaacaggagattttcctggctgagttggcctcacctgcaatcactttcctaaaaaggcctgtgcacctttcattacagtagctctcatactatatacactgtgcccaggarggaggacagagaagggagaaaaaaaccatctcatataatcacgttgccccaagtcaccatgctgtaataaacaagctgttgggaaggaggaggcagggtggactcgggagagaaaatgaggaggaattccatgctacttctccttcagctcacttgtaacaccccccagctatggaacctgcttccacttcctgcagcccctccagggtggagggccacctctctcccaaaggtgagaggacccctcatcaacaaggaaaagtcacttaatactgccctgcccaagatgcttcagcgaggctgtcctcttaacagggagaaagcacattttcccgtctctgtcttaccaactgtgcttgatatgagctcacttggaaaggactcaggtcctccagaaaatgtcaagtgctgagaattcatttattttctttaaatggtttcctgctgagacagacatccaagttggcaggcaaaatgatcaaatagcagatctcctgtgatatcagcaaactggggccactcctgaggctgaggctggaagggacatggaaggacaacgacccctcatctctctctctctcttcccagttcatccatttgacaatgaacatctgaggctgccttgtagagatgcagcctgcccagctgaatcttggcttctggaccttgaccttcagaacttctcttggtgtggaaccattacgcccagggttcactcccctctcatcgtccggccttctcccttcatcttgatctgggaagaatgaaatgaactcagctacactctctgattttgtgctactcctttgtaaagtcactgccttaagggggctgatggcgccacctgtgccttacatccaggttcaggcatcactagctttcccacactctactttccttatttccttccattaagaattactcagagttctaacgcacagaatcctgacttccatgtagctccagtcattgtgatcagacatcctttataaaacatgtttttataaatgtgtatgtggaataagatgaggaggaaaaggagtgaggtcataatttagcatttctgcatcataagtgtgcttccttatcagggaagacatcaggtagttccgataattggacaagagtggatctccgataagagtggatcaaggtgacaatctctacctcctcctacgagaggtggtaactaaaacagtcactatccagtccagacattctttgtgtctgaagactttgggtcagaaaagctgaatgatattatttcttctcaaggagtccagattctggtgaggtttgatcttactcatccccaacatgatgggggataacagacccgagaatcctcattatagctcactagtgctgaacaggagtatccactgaactagaataatgggaggtaacatgagaagatactggctcaatacatgccaagccccacattcttactggtacacttgtggcagatgaggtggaggatgggagcgggagataccgagagggaaagagggagaatggctgggatgaagatcaagttagaagtggaggctgagcatggtggcttacacctgtaatcccagcactttgtgaggccaaggtgggaggatcacctgaggtcaggagttcaagaccagcctggccaacatggcaaaacccaatctctactaaaaatacaaaaattagctgggcgtggtggcgggtgcctgtaatcccagctactcaggatgccgaggcaggagaatcacttgaacccaggaggcagaggttgcagcctggcgacaagagcgagactcagtctcaaaaaaaaaagaagtggagcttcatcagaaccctgtccctgatcgtggccaaggtaccatgatcttctcctttaccttccagcccttccctgggttcacgcagcagtggatgcaggacaagagccctctctcaggagcaggcttaggaccaaggctctgtgctggggcacgccagtacaaccccagacatgccatctcctgtgctcggcctgtgcccactctcatcgatgcacactgctgccatattgtttgttagatgtcgtgaacactagccctgctcacaggtaaaacttggaaggggactcaccatatgagcttctttgtctagtgtcactcccacagggtgcctttaggcctttatgtccaggagcacataactgtctctcactgatttttcctctgcttgaaaggtacccaggaaatgaagtttatgaactgggcgtcctgttttctttccatccatatgtccctgggaaagttattaaactctctgagacttagtttcctccactcacaaggatggtaatttctgcctcactgagatcttatgatgaataaatgaaattgtaagtagaaggtgccaggcacagtacttgacacataacaggccctcagtgcaactaaggcccactgttgtgaaccagtgttttcttaaatgtctaaaagagttacatactatcacatgctttcggtttacctctgttcttcattgcaagaatccaagaattatagaaccagtcttgaaggagagttcaatagagctctacagactattatatgatcatgagttgagaacaaaaaaaagtgtatgaatttagcttctatttgtttctgaattacatggtctgatactgacacccagaaacaaaggaagatgtttcacatgcatgagtttgattaactataattaaagtgattttgtagcttataattcaaaccaacagcttttgagtgtgaaaggaataatattagttattacaccaggacaatagatgtaaactggagctgtcctaggaaaattgcgatttatggccattcacattatgtctatcaccacctgcataatatatgctttaggtcttggcaccaaaatattcgtgccctactacctttaaattaaacagtggctgggcatggtggctcgcgcctgtaatcccagcactttcagaggtcaaggcgagcagatcacgaggtcaggagttcgtgaccagcctggtcaatgtggtgaaaccccatctctgctaaaaatacaaaaatcagctgggtgtagtggtgcgtgcctgtagtcccagctactcaggaggctgaggcagaagaatcgcttgaacccaggaggtggaggttgcagtgagccaagatcgtgccactgctctccagcctgagggacagagcaagactccatctcaaaaaaataaaaaatacaaaaaaaaaaagagagagagaaaacaaaataactgggtgtggtggtgcatgcctgtaatcacagctactagggaggctgaagcaggataattgcttgaacccaggaggcggaggttgcagtgagccgagatcgtgccactgcactccagcctgggtgacagaacgagactttctcaaaaataaaaataaaaattaattaattaaacaatagtatacacgagctatctaacgctactgcttcacaccaaaatcacatgaaatacaaagagatacacacctagacacatcaaagtcaaactgttgggaaaaaaagagaaaatctgaaaagcagcttgagaaaaatgactcatcatgaacagggaacaatgcaattagcaactgacttctcatcagaaatgacagacgacagaaggcagtagaatgacattccaagtgccaaaggaaaaatctttcaatcaagaattctgtttttccactagaactgcaaaaatgaaagcacaataaagatattcccagttaaacaaagactgagagaattcattattagctgacctgccactggaaaaatattaaaggatgtatttcagggtgaaaggaaataaaactagatgagactgtggatctgtagaaagaaatgaagagcactcaaaaggatatctgtgggtaaatgtaaaagactatataaacgtgttatcttccattctaattttgtttgaagacattagattatataaagcattaattattgtactatgttgttggatttataacaatagagagatatattataaaggagagaggaagaaacaaagtattgtagcaatatttctatattttcttagaattaagtcagtattacctcaggtaatgatattagatattagatggttataaattaagatgcagattgtaatctacagagcaaccactaagaaaataactcaaaaatacagtaagatagcagaggaatcaaagcagaatacttaaaaaaaatgtttagcacaaaagccgtaagggaagaacagattttaaaaataagacatagaaacaaaatggcataccttaatccagccatgctgataataatattaaatatgaataaaaactacaatcaaaaggcagtgattgtcaaaatggataaaaaagcaagattcaattgtacactatctacaagagatacttcatacaaaaagacaaaagttggaagtaaaaggatgaaaaagagagtaccatgcaaatactggcaataagagagcttgagtgcctacatcaatatctgagaaaataaaatttaagacaagaaatattattagagagaagaaatgatattacagtatcataaagggtcaatacattaggaatatataataattacaagtgtgatggtacctaatagtagagtctcaaaattatgaagcaaaaattgatataattgaaagaagaaacagattattcagacttaacaattatagttagagagttcaataacccatttttaataactgataggacaactattcagaaaattaacaaggaaatagaagacatgaacaacactatcaaccaacttgactaactgacatttatagaatactttaccctcaagtaatgaatacacattttttcaaaagcacatggaactttctccaggttagaccatatactagaccataaaactaatttttaatatatttaaaagaatttaaatcactcagagtatgttctccagccacaaaggaattaaattagaaacaaaaataagtttgggaaatcctcaaattttagaaattaacacatttctaaataactatgagttgaagagaaaaattacaatggaaattagaaagattttgaactgaatgaaacaaaaataaactatgtatttacacatgtctatacacatccacattaaccggattaagctaaagcaggacctagaaaagtagagtgttctcaaaacaataatttaagcttccatcttaagaaattagagagagaggcaaattaaaccttaaaaggaaagaaataaagactaaagcagaaatcaattgactagcaaagagaaaaataatagagaacatcaaagaaacaaaaaggtgattcttaaaaaagattgcaaaattgataaacttttagctaaactgaccaagaaaaaagacagaaaacacaaattaacaatcaagaatctaagagcagccgtcattgctgacccatcagaaattaaaagaatgataagtgaatattttaaacaactttatgtcaacaaatcagacaacttagatggaatggaaaaaatcctagaaaaagataaattaccaaaactaccttcagagaatactgaaaatctgaatagacctatgcattagtccactgtcacagtctaataaagacatgcctgagactgggtaattgataaaggaaagagatttagttgacttacagttcagtatggctggggaggcctcaggaaacatataatcatggcggaaggtgaaggggaagcaagataccctcttcacaaagcggcaggaaggagaagtgccagcaggggaaatacaagacacttataaaaccatcagatctcatgagactcactcattttcatgacaacagcatgggggagactgcccccaagattcaattaacctccacttggtcctgcccttgacatatgaggagtataaggattaaattcaaagtgagatttgggtggggacacagagccaaaccatatcaacctacaacatgaaacatatcataccatatcaacctataatattttggtcctgagaccaaatcctttggacagtgcctggagagagcctcaggccacagtcatgtttatctgaaatacagggcctacctccaggctcctctccaccctgtcctgtgcagagctacgcagtgcgctgaggggccagggcttcagaaagcccagagcatgtgacctggttggcagaggtaccagggtcattggtgccagcccaattcagtgtactggatcattagtagaaacaaagcaccattctactgagagccaagaccgcctgccaagtaccagtgcgaaggctgcctcgtcaccacagctgtgaatcaagagtaggctgtgcttgctactgatgccagcctggggcattttcccagccccacagtgcctttctgaagtgggagaaggagaagcagagggttagactctccttggtgcctgaacagtgcctctgatggaagaacgtagctcagtgatattcccaaggaggtttattggttcattatcagtaggactctccaaggaaagggaacagctgaaccatatggagcaactgcaggctcatgtaatagaagcagcattgaacttagagtttgagtcctgtattctagtctagaacttacctccagctagctgtgtggacttaaccatatcactttacctctctgggctgccttgcaccttgaaattatgtgattccttctctcactctgggaactagaaggccaggtcagtgtggctcagtcctggtctaattggatggatggagagaaggtagcagaggtgggcccagcaagcctgagaattcatcttactccctgacagagctcagagttctgagaagaatgtggtcacgcagaagactctctgtaggccacatcaggaccaggcttcttggaaagctgtactcctcctgcctttcaacatcttaacacactcagctcctccattatacacacttacctgaacccagcttgtctgtatgggtttagcattctctcttgtccttcccagtctaccctctacattctaaaaagagagtctcccacccagacgatctccttgcagtcacttttcaatgcaccagaacagcttccttagttggaacagtgaacagtgtgttttcaaacaaaagggg

SEQ ID NO: 17814 - DNA, 23208 bp, Homo sapiens
  misc_feature (1)...(23208): n = A,T,C or G, or insertion/deletion polymorphism (see Tables 1-2)
ccagctgatttttgtattttttagtagagaggggggtttcaccatgttggccaggctggtcttgaactcctgacctcaagtgatccgcccgcctcggcctcccaaagtgctgagattacaggcgtgagccaccgtgaccggcccctttgactttgaaggcagagtagggtatctgatcaggaccgcaaatatggtgctgctttttatagtggggccagtgtgtggggtgatatggtgggaggagctgcaggaagacagcggattgagatctggactcaagcagtcctgtggggaagccaggtttctctactgactcttgtgtagaggagaagactaggcgtggtggctcatgcctgtaatcccagcactttgggaggccgaggtgggaggatcacttgagcccaggagtttaagacaagcctgggcaacatagcaagaccctgtttctacaaaaaaacaaaaaaattaaaaaattggttgggtgtggtggctaagtctgtaatcgcagtacttcaggaggccaaggcaggaggagtgcttgagcataggaggccaagtctgcagtgagccgtgaccttgccagtgcattcagtctgggcaacagagtgagaccctgtctcaaaacaaacaaatgaaaaataaaaagtaagtatctaacgcaggaataggaaatcaaatactgcatcttctcacttataagtgggagctaaatgataagaatttatgaacacaaggaaataacagacacgggggtccacttgaggggggagggcaggaggagggagaggagcagaaaagatggggggagggcaggaggagggagaggagcagaaaagatggggggagggcaggaggagggagaggagcagaaaagatggggggagggcaggaggagggagaggagcagaaaagatggggggagggcaggaggagggagaggagcataaaagataactattgggtactgggcttagtacctgagtgatgaaataatctttacaacaaactcccgtgacatgtgtttatttatgtaacaaaccttcacatgtacccccaaacctaaaataaaagttaaaaaaaagtatcaaattgttaactcctctggaataaacatttccttgtctttttttaatttaaattattatttttaaaatgcccatattccctgagtcctcgcttctttttacctctccaatcgcctggcttcatggtgtttcacatttgctgactgcttccagaaaaacattcccactgaaggcctcccaacgcaaggcagatatagagcaagctagacacatgccttcctttccagttgctttctgactttttaaagtcccagatgcctgggcttggggaaaggacaggaagcgccaggacgcaggaagccccggggatcagcagtaggatgctgtgcaggctgtgctcggggcccctctgctggcctgtccaggccaaacccccagggctgcaggcctggaaccaggcaggacatgctcagccctggctgggcttcccctccttgccccaacaccagtcagggcccacccacgggctccagctgtctggcttcccattcatctcccagaccctctcccctcatgaatcagtgccacacacagcctacccataccatactcagcaaagcacccatgcctgtggctcaggtgcggtggtgtgatcagagctcactgaagctttgaactcctgggctcaagcgatcatcctgctttagcctctctagtagctgggagtacaggtgtgcaccactacggccagctaattttgaaaaaatttttttgtaggctggatgcggtggctcatgtctgtaatcccagcactttgggaggcctaggcgggtggatcacgaggtcaggagatcgagaccatgaccatcctggctaacatggtgaaaccccgtctctactaaaaatacaaaaaaattagctgggtgtggtggtacacacctggagtcccaactacttgggaggctgaggcaggagaatcacttgagcctgggaggcggaggttgcagtgagcctgggaggcggacgttgcagtgagcctgggaggcggaggttgcagtgagccgagattgcaccactgcactccagcctgggcaatggaacaagactgtgtcttaaaaaaaaaaaaaaaaaaattttttttttgtggatatggtggagtctcgctatgttgcccagactggtcttgaactccaggcctcaagcagtcctcccaaatcccaaagtgctgctgggcttacaggcatggaccaccatgcttggcctattttcgacacacatacaggctgaggttcaggagagctgggctacaggcgtcagggtggggatcgatgtgtgacatctttcagggaggtagtttatcctagttctccactcaataagggagtctgcccacaagcacactgtcggcacccattgctacatggctcaactgtgagtataacttagataattgtaataatgaaaataaggaatgctgatggagggataggataagaaggtatgtgactgggagatggaagagaattccttatttctattgagtcataatcaatagaggttatctaaaacttaaaaaaatagggccaggcacagtggctcacgcctgcaatcgcagcactttgggaggctgaggcgggcggatcacaaggtcaggagatcgagaccatcctggctaacacagtgaaaccccgtctctactaaaaataacaaaaaaaagtagccggtcgtggtggtgggcgcctgtagtcccagctacttgggaggctgaggcaggagaatggcgtgaacgtgggaggcggaggttgcagtgagccgagatcacgccactgcactccagcctgggtgacagaccgagactctgtctcaaaaaaaaaaaaataataataataataaaaacgccaggcatggtggctcacgcctgtaatcccagtgctttgggaggccgaggcaggcgtatcacttgaggcaaggagtctgagaccagcctggccaaacatggcgaaaccccgtctctactaaaaatacaaaaatttgccgggcctgctggtgcacgcttgtaatcccagctacttgggaggctgaggcatgagaatcacttgaaaccaggaggcagaagttgcagtgagctatgattgcccccctgcactccagcctgggtgacacagcgagactctgtctaaaaaaaaaaaaaagagcagcctgggcaacacagtaagacctccatctctacaaaataaaaaataaaaattagtcaggagtggtggcacttatcacagctacttgggaggctgaagtgggaggatcacctgagcccaggaggttgaggctgctgtgagctgatggtgccatcgcactccagcctggacaacagagtgagaccctgtctctaaacaaaaataaattgtttttttttctactggacttaaacaatctgccctccttggcctcccaaagcaccaagcctgtgtcttctttttcatcacagccgtggcagaaggaaggaggtgactggaagccccactctctctgagtagctgagggaatacaccctgactataggccgagacagtccacatcagctcttcaataggatttagtggctttgcataaaatggaaaagcagctgtgattgcaagagaaattaaaaataaccaccatctgaaatgcaaattgaaaacagtgagacaacacatgtcactctggcaggtgacccactgtgctggtgaaggcatgcaggcactctcagacttccgcagagagacctgagtaatcaattgacttccacaaagggcgacttgccaacagctatcaaaagtactcaggcacatcccacttggcccagcaattccacttccaggaatttctcctgcagaaatacatgtgcacaaacaacgtaggaaagcactgtttatagtaacaacccaactaggacagaccaggtatatttagacaacaaacaaggaagctttttactaaattgggatgatctctaagaagaaggtacgtagaaaaagcaaggtgggagaacacgctatgtgcttgtactatgcacgtcaatgaaaaaatacacaaagaattgacaggccaggtggagtggctcacacctaatcccagtactttggaagactgagatgggagggttccctgaggccaggacttcaaatcagcctgggcaacatagcaagacccccccacatctctacaaaaaaattaagaaaaaaattagccgggcatggtggtgtgtacctgtagtcccaactactgaggaaactgaggtgggaagatcccttgagccaggaggtcgaggctgcatggagctttgatcgtaccactgccctccagcctgagcaacagagtgagaaaaaaaacagactttttttctatttctggaaaaaaataaagaatttataagtatgatggttctggtaatagaagtaggtggctaggcagagtggacacttcacactgcatactcccatattttccgaaatctgagctttttttttttttttttttttttttttttttttgagatggagtcttgctctgtcaccctggctggagtacagcagcaccatctcggctcactgcaacttccgcctcctgagttcaagcaattgtcctgcctcagcctccccagtagctgggattacaggcgtgcaccacacgcccacctaattattgtatttttagtagagacagggtttcaccatgttggccaggctggtctcaaactcctgacctcgtgatccgcccacctcggcctcccaaagtgctgggattacaggtgtgagccaccatgcccagccaatctgagctatttaaaaactaaaggtaaaattttaaaaggggaaggggaaaatgggaagtcattgttttaaggggacagagtttctgtttggggtgagaaaactctagaaatagtgggggcgtggcacatgattggaatgaatggcagggaacggcacgcttaaatgttcctgtacgtttcacaggagaagtcaatgcacacacaagcgccgcaacccagtccaaggctttgctcctacagggccttacagggggtatttgagacgcccaccttaatgcaggttggacccagctccgggctgccgggcttccccgccccggggtctttcgtgtgagccccgtggcgggggaccctggcccaggacatggcgcggagaaggctgtgggcggcgggacagggtgccttcggctgccgggttaagagtggatcccgggatacatcctccagcgcctgccctcgggcctgtgtgcacccccatacccagcggggccgtccaagagcttcaaggagggcacagcgcgacccgccctcccctcagccccgcacaccgtcccacggccccgcacagcctccctcccacacagcgccccacggcacccgcacagcgccccacggcacccgcacagcgccccacggccccttcatggtccccgcacagcgcctcacaacccgcacacagcgcctcacggaccctttacggcccccgcagagtctcccacacggcgccccacacagagcctcacggaccccgcacagcgcctcaaggtctccgcacagcccccagcacagcgcctcacacagcccttcgcacagccccccgcacagctcctcacgggccccacacagctgtcgcacagccccgcacaagcccgcacagcaccagcagacaggtagcccccacaggcaacagcgcccacctcgccgcgcccagaccccggatcgccgacgcggacgccaggcgcctgggcacacggcgcctgcgcagacaacaccacgccccaggcctggcgagcgcaccctgcgggtggggcggacctacgtcagcaacccatcgtccgatcccgtccattggctgagaggtaatgcgtgcgcccgactcgccgctgattggtcggcgcgcgagcagccgggctcgcacgggccaatcctgtggtagcgcgtgaggaggcagaggcctctggggtgggatcgcgggccgtaagtggctgtggagctggggtcactgcgcggtgggaccatggcctcggagaagccgctggcggcagtcacttgtacagcgccggtcaacatcgcggtcatcaagtactgtgagtgccgcgggccggcctgggacggggatggccgggagcgaggccgggtacgcgggggtcgcgcgctgattcggcggcgcgctccgtcctgccctcccagggcctcgacagacggggaaactgaggctcagggaggggcgcggcggtggtcgggcggggccgcgcgctccttcgcgtgacaagctcggcgccacccgttcccccgcgacggctgccgcccctgcagggtcgcccggcgcctgcccattagcgattaccgaactatcgaaatcatcaatcatcgattcccatgaatcgtaagaatccgccgtggtggtgcgcgtttgtggctccagctactcgggaggctgaggcgggaggatggccagagcccgggaggtcgaggctgcagtgagcggaaatcgcgccactgctcccccagcccgagaccctgtgtccctccctcgccccgtttctcccagcggtaacctccaaggagcggtaatggggggcccgcaggcccacatccgtgcgggggaggccggtccgcacctgtgcgttcacagccccgcccctcccctcgcgccggggttacctggccgccactgaccactcatttctgtaacgtcatttcaaaatgttctgaaactggaatcgcagttatgtggcccacccagtatcttttgagtttggcttatttcattcagcatagaatgtggacgtgccccgggattgtatcagtgctttgcccctctgttgctgagccagtccgtggaatccatggaccaccctctctctagccaaggcctcaccccgcaaagagcatctaacgttttctttctttctttcttttctttccagaagccgccaccacgactggctaatttttttgtgtttcccttaccaataaagctgccataaaaygttgtatacaggtttttgtgtgaacatacatttccattcttctgggataaatgcccaggagtgcggttgctgggtcagatggtagatatatatatatgcctctctgtctctctctctctttctatgtatatatgtatgtttgtgtgtgtgtatatatatatatacacctatatagatatatgtgtgtgtatatgtatacacctatatagatgtatgtgtgtgtatatatacatatatatattatatatatactttttttttttttaaagaaactgtctaattgtttttcagagtggctgggccattttgcatccctacggtgatgcagattttccgcatcctcaccagcatttggtggagttgctgtttttcattttagccgcgtcctggtagggatgtgctggcagggtgctgtggtcctcattcgcgtttccctgttggccagtgacgtggagcatctttctttgtgcttatttgccatctgtgggttttcttggtgaaatctctcttcatattctgtgtccacgctcgaactggatggtttgcttttttactataagtttggagagttcattacacattctaggctgggcacgctggctcaagcctgtaatcccagcacttggggaggctgaggtgggcggatcacctgaggtcaggagtttgagaccagcttggccaacatggtgaaacccccgtctctactgaaaaaaaataaaatatgtattctagatattagtctcctgttggacatgtggtttgcaggtattgtctcccaaactarctaatctttttgtcctcttaacaaagagccagtttttcattttaaagaagttcagtgtatcaatgttgatgtcaagtctaagacctctttgcttagccctatgtcctgaagattgtctgctttcctccaagttgtacaggattgccttttatatttaagtctgtgatccaaggttgtccagttagcccagaaaggctatccttcctctattgarttgcttttgcacttttgtaaaaaaaaaaatcagctgggcatgtttgtgtgggtctatttctggattttctcttctgctatttttttttttttttttttttttttttgagacagagtcttgctctgtcacccaggctggagtgcagtggcacaatcttggctcactgtaacctccgcctcctgggttcaagcaattctcctgccttagtcttccgagtatttgggactacatgcacgtgccaccacacttggctaatttttgtatttttagtagagatggggtttcaccgtgttagccaggctggtctgaagctcctgacctcgtgatctgcccacctcagcctcccaaagtgctgggattacaggtgtgagccaccgcgtctggccttttatttttattttttatatttatttattttatatttatatttttatatttatttgtattacttttatatttatttttttgagacagactgtcactgcgacacccaggctggagtgcaatggcgtgatctcggctcactgcaacctccgcttcccgggttcaaccgattctcctgcctcagcctctcgagtagctgggactacaggtgtgcgccaccacacctggctaatttttgtacttttagtggagacggggttttgccatattggccaggctggtcttaaactcctgacctcaagtgatctgcctgcttcggcctcccaaagtgctgggatcgtaggtgtgagccactgaggctcaccaacagtgatatttatggaaacgtgtccattttcttgtaacgttcaaagactctggtcttctttaaaccttacgtttgagctggtttttgatagcgcgctggtggaggagggggtgctggctcaagataaggaggcagaagtccaggttcccctccccaccaacgctgtcccatccccaccaggccctcaggaattcctgagtgtctgcttggcctctgacaagagccggcaggtcaggggagtccagtctcccgtgtgctctccaatgactcctggggaggtgaaagtccccactccttcagggagggaaagggggcggggcactgttccagcctggagtgtgggagggatctgtttctttttttcttttctttttttttttttttgagaaagggtctccctctgttgccaggctggagtaaggctggagtgcagtggtgccatctcggctcagtgcaacctccgcctcccaggttcaagcgattttcccgcctcagcctcctgagtagctgggataacaggcgtgcgtcactacagcctggctaatttttgtatttttagtagagatggggtttcaccatattggtcaggttggtctcaaactcccgacctcaggtgatctgcccacctcgacctcccaaagtgctgggattacaggcgtgagccaccgcgcccggccaggagtctgtttctgtgttgctaggctgcccttcctggtcctgctagggagggctggctttggttggcagttccagcttctgcagggctaggtctagggcaagcagaaaagaaagccccgggctccccctgcactgtcccacagccgccctctgtcacccgtgagagtctcacctgtgatgtccagggtctcagttgtccccagtgggaggaagcgggagaagtcccctggcccaccttcctgaaagcagaggttcgcccggcctgtcagggcagcggcgtccgcctgcaaggagggccgctcagtgctgtgcgtgaaagagcctcgcgagctgcagggcgtggttctctgccaggtgtccgcgtttatcacccctggaactgtccgccatcctcagagacctcccctcgcacaaaaccgagcagatggtgtgcttagcgaagccgccgtggaataagacttcagctgaagcaccacgcagcgctcccagggcaaacgtttcctttcgggctttctggaagtttgatttcacgtgctgtcccatggccgtgctgggcagaaaggggtttatcctggatgttcctggggcatatgagcagtgagatgtgaggagttctcagagctgggctccttttgtttgggaaggtggaggggaggcaggccgcggtgggagcgatscgcacctgggcactcacggatgctggagtagaagcgatgaaggaatggggagcggggacggaggttggctggcctccagctctgctctgggagcctgagctcagtggggtgggagcagttcttgcaggcckgggtctggcaggaggaggggcacacaggttgtgcggtgagagacgggactgaggcggatgggggccgtgggtggggggtgggggcacctgtggggaacactgggggagggtgggccgggaagcccaccggcctggccctggctgttcattacagggggcaagcgcgatgaagagctggttctgcccatcaactcctccctgagcgtcactctgcaccaggaccaggtatgtgtggactgacgactaaacaccacagtgccatttccagaacatttgtagaacagttggtacccgttgggtatggtggctcacatctgcaatcccagcacttggggagagtctcttgagcccaggcattggagaccacagtgaaccatgatcgcaccactgcactccagcctgggtgacagagtgagaccctgtctctgaaacaaaaaaaaaattggtacttttttacctaaaggctaggatgagatggcctagcgacgactcccagccagcacgcagtgtctgttccatctcccagtattaggagagctgagcacagcacacaygtgcccccaggtctcgtcacacatgcgcacaccgtgccccagggsctcccctgggagtccccgtctctttattcaggataaggcctggttgctccacaaggtgtggcccacgctttcatcccccacgggcttccccactgcccagctgagactggcctttccccccctgccctcagcagggctgaccttgctcgagtgggcagccatgaggctctctcagtagaaaggggtacctggctggcatcggtcctcartgctggcctctgaggtggccctgggtttccttttcagttaaaaaccaccacaacagccgtcatcagcaaggacttcaccgaggaccggatttggctgaatggccgggaggaggatgtggggcagccgmggctgcaggcctgcctgcgggagagtgagctggggtccccataagcccatccctccctgttgtcagcagggwccgagcatccagaaagtgcttytgcctctgtgcccctcctgaggcagcaggcggggtggctgggaaccagacatgcccgctgggccgccagctccagggcagtggcccacctcaatgaccagctgggcttgggtcagtctggggttttcccgggtaagaaactctccacgaggagtctggcaggcagaggcctggtgttcagctgtgaccccgggcaggtgggcaggagcagggcgggcagggtgctgayrgctgggccacacgctgtctcattgtctctgcagtccgctgcctggcccggaagcggaggaactcacgggatggggacccgctgccctccagcctcagctgcaaggtgcacgtggcatcggtgaacaacttccccacggctgcgggcctggcctcctcagcggcgggctatgcctgcctaggtgggtgcccacagagacccgcaggggttctgggctgtgggcgcaggagccacttcatgctcttcccgggtcagggagcccactgctgggcgtggctaaaagagcatcccctcaccccaggcctccctggcctctctggagttgttcagtctcttcccagagcacatctgaacattttcatcttccagttgcagctggcgtggggctctcgcctgtaatcccagtacttaagaggctgatgggggagaagcactgtaggccaggagttcaagaccagcctgggcaacatagtgagacccccccccatctctacaaaaaataaaaaaatcttcccgttgctgtatgtggagcccctctagattgtcagtgatagaaaccacttcaaactggctcagccctaaaatagcgatgattttgtggctcacgtaactgaggattccaatgggcacagctggttgcaggccccgctggacccagctctctgctggccccaggccacttgctggcagcttcccacccactgtcagagcctgtccccccggtggtggtctcacaccatcttcacccctcaactccaggggtgacgcttcctggcccacctgggctcctgygccttccctgaaccaccctcggtgaccagggtgggtgaccagacctggaggtggggttgccctgctggagccctgtgggaggaggggagaaggtggctcccgtgctgggtgggcagggggcgcgtcttgtggagtccagctctgtcctggcatcggtccctgccccacacagccttaaaattccttcccaccctcaaagcccagcttgggtgtcctcgggggcctttctcccgccttccatggggcttcctgctctgccgcaggtaccttttgttgcccttgtcgcaggccgcaagctctgcaggccgtgaacagagagtgtccgagagtggaastagcggaggtgggrgacagacggctgggccggtgaatgctggcctcaaaggctgatggcccagaagccctgtcatctggaaatccccatttgccgtggggtgtgggacgttcctggggcggtgagctgtcagggagcacagcgcaggcagctctgaggaccctccctgaatccgcatgcctgcagcctacaccctggcccgtgtctacggcgtggagagtgacctctcagaagtggctcgccggggctcaggcagcgcctgccggagcctgtatgggggctttgtggagtggcagatgggagagcaggccgacgggaaggacagcatcgctcggcaagtggcccccgagtcacactggcctgaactccgcgtgctcatccttgtggtgagtggggtggggcgggtggagcagcagcccggtggcctctgtccctagtcagggctgctgccgggagcaggagcgaaggcgtccatccaggctttgcttggctcctggggtcagcgggggctgaaggaacagaagcgtggttgagtgctcaggaaccgctcccatgcggcgggygccaccacccgctgggatctggaagttgcccctgcgtcacccctgctgtggccgggaggcctctgtggtcaggcaggtggcactgactcccacccccgctgcctgcattggctgagggagggccgagtgtttgaggctgaggtccttggggctggccccctgcagggtgtggcccaggctgtctctccctcgtgcaggtgagcgctgagaagaagctgacaggcagtaccgtgggcatgcgggccagtgtggagaccagccccctgcttcgggtaaggccaggagcgggtggtcccggggccctgggagtcacgcttgtgcccrgctctgccctcagcctctgtctgggcccgagtgttctcacacctgcggcagccccgccaagaccacgtgcaggagccaaatgcagagatggggctcgagccgggcctccaaccccggagtctctcctcgaaccctctgctgtcgagacccccagcggctccatgggaaacaccctgtgccttgcagttccgggccgagtccgtggtgcccgcgcgcatggcggagatggcccgctgcatccgggagcgagacttccccagcttcgcccagctgaccatgaaggacagcaaccagttccacgccacctgcctcgacaccttcccgcccatctcttacctcmatgccatctcctggcgcatcatccacctggtgcaccgcttcaacgcccaccacggggacaccaaggtgacgcgggccgggagggcagaggctgcgctcgcgctgtagcgcgtgtctaggcttgtgctgccgtggagacggccccggggctcgcgtgcagggcaatctgtgtctgaaagctccaccctgctgtgtgcgaagctcactgaccatctgggttcttctgtttcattttgtttcttgacttgcccgggtcacggccccaccaccttcttcctgggttcacaggcagacgtgtcaagtaccaggcacttggggtcacagctccactccagtgtggccctgagggcctagactgagctcttggagagcccaaggccgcctggcagaccagagggttggggagacaagggtcaggcaccacgtgaatagccagggtgactgctgtgggttccaggtggcgtacacctttgacgcgggccccaatgccgtgatcttcaccctggacgacactgtggctgagtttgtggctgctgtgtkgcacggctttcccccaggctcraatggagacacgtgagtgtggaccccgcccctcctcctttttgggagatggtgccaggaactctggtcggaagagacggaggcacctgaaggctgtggygctgagacagggagtcccagggcaggcagcagtcccccgagtgtgggagccacgggcagggtgtccccatagagccatcccacagcccacgtccacagggaagaaagagaggccgctcacgcgtgtgtgagcaacgcccagggtctcccacctcctgagtgacagcgtcccctgcagctcgggaccccgcaggctcttattctatagaacagtggcttaggaaacacgcctgcactcccagatgtgtgcgtaagtgtccgacattttgaaggaaaggagtcaaagcccctgatttccttcttactgaagcgagttagagccagtcaaggcggcygggtgttgaccccgccccggcagttgggtgtcttttcttgggtggggtccggcagctgcatcttggygccacagagcccccatgtacgccctcctcggtgcacagcttggccctgaaccgcctcttcccctgcgctgctctgtgggggtgccacagagcccccatgtacgccctcctcggtgcacagcttggcccagcctccttacgccccggggctgttgatttcttccctcccgtgttttcatggtgtcttattctcaatgtgagaggcgcctcccatttaagggtgtctggaagcgtgtggggatgtgcgtctgtcccgggtgggagcaataacaccttctaatggtcaggggcctgccctgtggggtggactcagacccacaccccaggactgcccgcctgggaagcaccaggctcgtggctgctgctccgggtggggcttgcaggcttccgctgttytgcagaacacggtgacgaacgcaccagcttgaattgggcgcttccctgagctgttaccccatggggcttggcagcacccttggccagatgtgggtccagcctgggcatagctgtttaccacataacctaaaatttcctgtcycagccattcgagagcatataatcctgcggtgttgaggacattcacagggtcatgtgagcaccacctcaagccacctccttaactttttcatcamccctaaaagaaacctgtccccacagcagccacctgcygtctccccctccctgagccctgacggccaggaatgcacttcccatctctggacttgcctgttgtasactgttgtagacgcttagagaaacggatgcattcaccgtgcccctgccctgcktttccaggtttctgaaggggctgcaggtgaggccggcccctctctcagctgagcttcaggctgcgctggccatggagccgacccccggtggggtcaaatacatcattgtcactcaggtgaggcctggggctcacccagtaccccggggtttcctttcctgccaggggggcccgcccagcccccagggcccttaaaggcwaagcgcggctccctgtccctaccgtgtctcaggcaggaagccagaacgcctttgtccattcatttgctctcaaagtggacattacaggccactggtgatgctcagagcagcagggctgcgctgagggtgggagggtgagtctgacacaggctcccagggagacaggtggggagtatcagacccttgaatagggagcgcctgggtnnnnnnnnnnnnnnnnnnnnccccaaccaccccagcagaccggggttcctgccctctgacctgctccgagggccaagcttgcatccagtgatcacggccgcccaagccattgccgccaccttcctctcaggggctgcctgttcccaggctctgtggttctctgtcccccctgtgacagaagcagtgcccagggcagggggctcgcagctggcaggggcggctgtgcctgcaggagctgcgtgtgggtgtcaccactcaggcgctttaccttctgaccaggacccacaggaagggcgggggcacaccgctaccctcctgtgtccggccctacagatgctgggcacaggatgaggcgctgccattcctggtgacctgacatggatttctatccccaggtggggccrgggcctcaaatcctggatgacccctgcgcccacctcctgggtcctgacggcctgccgaagccagctgcctgactgcctcagcagggascgcatgcygcttggagaaggggtggcctcgccggagctagggagcggatgtrgtgggctggccggactcctgggacatgtgggtggtggcttgaccccgggcccatgggcagcttgctgtggggcagtgcagggagtcctgcggccgcccaggtgtcaggagaggtccccgccgagtgcttcagctgccctaagctgcaccagcgctttgccaagatgggatggggagggggtatgagaactggcagagcctcggtgcagcagggctgaagggctttctcaccccagctctggctatgcccagttctctgagaaaggagctcagtggggaggtggtccctccagcggaccagggaaggggtcacygtgctgggagcagcctccttgggcctcaggaaaccaccaagtgcctcggatggtggctgcccacggcgcttctgctgagaccctgcccccggcccaggtgtctcggagggtggctgcccacggcctgggtgtggctggaatggtggcaggagtgggcaccagtgcggccccggtggccatggggaataaaccagcattrctgcctccggcctccgccgtttttctgtttcgtaaaccagcatcccggggttcctgctctgagtgaccctggcacctgtcagggagtccaggtgtgccccatgagggcctgggggaggggcaggctgggcagagccacagaggggctcccctcaaaccccacattggctcaggtgggaccctcaggagcaaccccaggtctaaagtcttcccatgggcgctgggctcaccacccccacgccagcccctgcctcccgtacccaggccggacgtgacggggccgtccctgcattctgtgctttcccagttgtacacatcctgtcccctccctcgagtctcagtcacagttcagtgacctggtgacgggaggccccctgcagtgtctgacccaggccacgcctgtgccagcccagagccagggggaggaaatgggggctgggcctctggtccccatggggaggccacccttgtccttggtagcatcagggtgcagaggtgttcccgggctgtaggggtgactcccccaccccccaaggctctggagaggccgatttgctcaggaagccgaccttcacaccttgtcctgctattaatagacgcctggttgacacgggaccctcggttgggtccggagcattgggcaggggcacttgtcagtgtttgagagctgaagtttgggaagccctggggaagcgcaggaactccccgcctgggctggggctgccgggcagggcccctcctatgcctcggcgtggctagagagggcgggggcagaaggctccgggacagccctgcaccctacagatgcgggtctccgcccagccgcggtcacctggggggctgggggcggggcctgggcggggcggggttcggccgggagcgcaggggcggcagtgcgcgcctagcagtgtcccagccgggttcgtgtcgccatggggcagatcgagtgggccatgtgggccaacgaacaggcgctggcgtccggcctgagtgagtgcacgtcagggacggtggaggctgcagcctggaggggtgtcccaagaccccagccgggacctcgggctacttacagggtggggaagtggggcgccaggcgggccaggccgggccggggtcaggccaggagggtgcggggaacgggggcgggaccctcaggccgcgggctggaaggaggagttctgagacccccagtaattcccttgcagaccctgcggagcgcggcgcccctcccccattcccttctctcggtcccccgactccgcgaaggaggaagttgcagcgcaggggaagaggcggttcagccccggtggtttccggggtcaccgccccgaagcccccgagtgggggctccggcctgggcatcgggagaagctcccctgcccctcggtagccagctggcctggaggtcgctctccctgggcttggggtggggaatgggctcatgccctggggctcagcccttctcatctggagtctgcgctggaggcggtctgagatttcacaaggcgccgaaaccacccagtgacggccctgcccagcccagctgcacaggcactttgctcttggggtgggatggcacagcccccagtcaccctcctgtgcatttgctcagaggttctggtgagggcagcggactccatttggaaatggaccctctcgggaccagggccagggagtgtctggcccagcacgggtgaggctgggctcaggcgaggtctgagggcagaggcaccactgcagcagctccaggaaggacctgcaccgggggaggagtgcctgggaagggcctgggggctgagggtgaggaggaggggcccgccgccaccactcccctggggctctgagcgccctccctgttgtctggagggtgcgtggcagctggagtgggagcagagacctcagggtgggagggctggaggacggggccctgcagcctgtcctgtgcccaggaaagtgaccgcctgcttcgagtcagcggccaagaagtcggtgggtcagttcagacagctctccccagagctgccccgtgagactcaccctgcctgccccgcactccctacaggaagtagacggactgagggcacccagctgggagccaggagacctgggctctagtctggcctcctgctgaaaccctccaggggctcctggcccgaagagttagagccagactggacgccctgcactgcccgccctggcctcccggctctccggccccctcctccagctgccgtgcttcctttctgttcctagatctcctgagcgtgccccagggcctcggcacaagctgctgcttctgcagagcctcatggctgtctcatttatttctcaattcaaatgccacctgcctggggaggtccttccagaccgtgcagccccaggaggcagctggcccggagacagcagggccttgacaaagagtcccccctgtacacagcaggtgctctgtaaatgtggctgggtgccagaatacgtcctcagacctccctggtggcaccagcggcagctttgcaccctctttcggatggcaggctcgggaccaggacggtccccaaagatgcatggacaattggctgagtagactcaaggacactgccctcccctcctccgacgcagacagacaaacccagagagttaatgtgtagctgggctcaaaccaaggataggaaatcttccaacaagaccatgtggagacaaaaacagaatggctggcagggcaaggtggctacacctgtaatcctagcactttgggaggccaaggcgggcggatcacgaggtcaggagatcgagaccatcctggctaacacagtgaaaccccgtctctactaaaaatacaaaaaattagccgggtatggtggcaggcgcgcatagtcccagctactcgggaggctgaggcaggagaatcgcttcaacctgggaggtggaggttgtagtgagctgagatcacgccacggaactccagcctgggtgacagggcaagactctgtctccaaaaaaaaaaaaaaaaagaaataaaatagtaggaaggaccaggcgccgtggctcatgcctgtaatcccaacactctgggaggccaaggcgggcggattccctgaggtcaggagttcgagaccagcctggccaatgtggtgaaaaccctgtctctaataaaaatgtaaaaattagctgggcatggtggcgggcgcctgtagtcccagctactcaggaggctgaggcaggagaattgcttgaaccctggaggcggaggtagcagtgagtcgagatcgcgccactgcactccagcctgggtgacagagcaagactccgtctcgaaaaaaaaaaaaaacagtaagggggaatattggacaatacccccccaaaaatgtgcagaaatagccatatcagacgaaaccgaaattaaggcaaaaccgctgacgggttaagaggaactccgtatcggggggaaaaagacactcccccaagaagatgcagaaaccacactcggcctgttagctttcagtgcatcaaacaaagactcatggtgacaagggggtccatttgggggtcccagagcccactggggcctgcaggtcgggctgtccttggccactcctgggacccagagcccgggcatgtccagcaccccctccgccagcccgtgcgccacaggctctgctcttcaccagtgcagaggggtgcctcctgggggtgtccccgaccctgtcactgtgctgtggggatgggtagggggcagctctgggtggcctggtggcccacagtaggtagagaaggggggtggcccaggcccccgggacaggagccccacagtgcctgacccacttctccccgcagtcctcatcaccgggggcatcgtggccacagctgggcgcttcacccagtggtactttggtgcctactccatgtatccttccacctgaggctggggtgggcggggaacgcccagggcagagctggggagccacttcacagtgagctgtttgcctccgctccccaccaccgcagccaggctgggacacagggtgggctgtgcacgggttgggcagcccaggccccagcagccaggcccctcgccaggaccatgtggcgatcagcggcagacccgccagtctaagtcctggtgagtggtgggcagggggtgtcaccagagggccagggccagcactgaggcctccctgttggactgctgggatcccctctgcccgctcctgtcagtcatcccccttgaccggcccctctacctcctctgccccatctcagccctgccgcccagccggaccttgcgacaaggagcactgggcagggtggtgggagggagggcgtgggcagccccgagtgccagacctgttggaacctcccgtggctgcctcctggctctgtgacctcaggcagtggctgcccccgaccttttttgagacagggtctcgctctgtcccccaggctgcagtgcagtggtgcagctgtgactcatggcagcctccacctgggctcaggccaccctcttacctcagcctctggagtagctgggaccacaggcacacaccactgcacctggcttttaaattttttgtagagatgagggtctcactatgttgcccaggctggtctcaaactcctgggctccagtgatcctcccgcctcagcctcccaaaatgctgggattccaggcatgagccaccgtgctcgggcccctctctgtgttgtcttcagtaaagggagttccctgtggcccctcaggctgagctgggctgttccttaaccacatggcttcagtgtggcgggcgtgtttgtgtgcctgctggagtacccccgggggaagaggaagaagggctccaccatggagcgctggtgagtctcctcctgctctggggtctctccgggggttgcggggcccaggcagggctcacagggttgggtggagcttggtttctcacttggaggctccggaaccaaccctttggtgcttgtgggtaaaccaaggccggtgcctgcccggtgtgttttgtgggaggaaagaggcctgggtgccctggggtggtcagcagggcagcaaaggagtcccgagtgggagaggcccagccgcgccgtctcgccttcctccctcccccaggggacagaagtacatgaccgccgtggtgaagctgttcgggccctttaccaggaattactatgttcgggccgtcctgcatctcctgtgagtccccgtcccgcaccccctctagggctcaggagggcttggagccgaccctccccactgtcccaccggccgggctgcctggacaggagccacccccacttacctcagtgtttttccaaacaaaaattcgggtccctggctctggcagggcctgtgtctgctgtctagtgtgcaggatttgtaaggatccactccaaatccgaggagctccgatccgtcgccagggtctggggtcagcatgcactgctggggggtcttgcctgggcttcctggtagggtggagggttccgtgctgtgtgtctgctggttactgccggctgaggccaggacacccacacgtggctgcttcctccgagcaagtgcaccagagccgctagtgtccacatcaaggctgagaacacccaggaccgaaacaagccccggtccgcgcacgtcccctgggtctgcagtctgccttgtcctgagactttgtggccttggcccccagacctggggctccgttcccctttctgagtgcccttctgtgtccctgcctctcacccgctgtcccccaggctctcggtgcccgccggcttcctgctggccaccatccttgggaccgcctgcctggccattgcgagcggcatctacctactggtgagtggcgccctctgaggtcggccccggccacccccatccccagcccctgccctgacaccctcggacacgcatggcccttgaagccggctctgtaggctgagccaaggctgggagcaagtgtgagcctgggcgtgtgctcacagcacggcggggacgcagcggttgctgctgcca

SEQ ID NO: 17815 - DNA, 48203 bp, Homo sapiens
ggatctccatatggaaaagagtgaagttggacccctacctcacaccatatacaaaaataacttaaaatgtatcacactaatatacaagaatttacttaaaactccaatagaaaaagtaaaactataaaactattaaaagaaaacataacagaaaatcttcatggcattggatttgggaattaggtatgatgccaaaagcataggtaataaaagaaaaaacagataaactggactctataaaaatttaaaagtgaatcaaagaacaatatcaaaaagtgaagaaaacccacaaaatgggagaaattatttgcaaatcatacacccaataagggtttaatattcagaatatataaagatctcccacaattcaacagaaaaaaaaactcaattaaaaaatgggcaaaggacttaatagacagttcccaaagaagacatataatggccaataagcacattaaaagatgctcaacatcattagtcattaaagaaatacaaaataaaaccacagtaagataccacttcccaccacctactaggatagctataatttttaaaaaaggaaattaagttttggtgagcatatggagaactggaacacttgtacactgctcccatggaaaaacagttttagcagttccttaaaaagctaaactaaaagcttaccatgtgatctagtaagtccacacgtaggtatattcccaaaagaattgaaaataggaactcaaacagattcttgtacaccaatgttaataacagcattattcacaatagccaaaaggtggaaacaacctaagtgtccatcaacatatgaataaataaatatggcatatatataatataaacaaatggaatattattcagccataaaaagaaatcgagttctgatacatgccacaacatgggtgaaccttgaaaacattatcctcacaaaagactctgaatagccaaagcaatgttgagctaaaagaacaaagctaggggcatcacactacctgacttcaaaatatactaaactctagtaattaaaacagcacggtactggcataaagagacacacagataatagaacagaacagagacccaagaaataaaaccacatatttatagccaactgatttttgacaaaagagccaagaacccacaatggggaaaggtcaggctcttcaataaacggtgttgggaaaactgataaccatatgcaaaagaatgaaagtagtcaattatctctcaccacatacagcatcaactcaaaatggactaaagacttaaatgtaagaccccaaaccatgaaaccacttgaagaaaacacaggaaaaaagctccctaacattggtcagggctagaggttcccaaccccagggccacagattagtaccagtccatggcctgttaggaaccaggccacaaagcagtaggtgagcagcaggcaagcaagcgaagcttcatttttctttacagctgctccccattcctcacgttaccacctgagctccacctcctgacacatcaacggtggcattagattctcatagcagcgcaaaacctactgtgaattgcgcatgcaagggatctaggttgtatgctccttagaagaacctaatgccttatgaactgtcactgtctcccatcactcccagataggaccctcaagtttcaggaaaacaagctcagggctcccagtgattctacattatggtgaattgtataattatttcactatatattacaatgtaataataatagaaacaaagtgcacaataaatgtaatgcgcttgaaatatcctgaaaccatcccctccctcctgtggatggaaaaattgtcttcgatgaaaccagtccttggtaccaaaaaggttggggactgctgatctgggcaatgattttttggatatgacttcaaaagcaaaggtaacaaaagcaaaaatagacaaagggattacatcaaaataaaatgcttctctgcacagcaaattcaacagactgaagacagaatctacagaatcggataaaatatttgcaaactatacatctaataagaggttaatttccaaaatgtttaaggatgtcaaacaactcaatagcaaaaaaataaaaaaattaaaaaaccatatttaaaaaatgagcaaaagacctgaatagacatttctcaaaaggagatatacaaataaccaacaagtatatgaaacattgctcatcaataaccatcagggaaatgtaaatcaaaatcacaatgagatatcacctcacacctgttagaatggctattaccaaaaagacaaaagataagtgttggcgaggatgtggagaaaagggaactccttcctcgctgttggtgggaatgtaaattattactaacattatggaaataactcaaaatattaaatgtagaactacaagcgggtccagcaaatccactacagggtatatattcaagggaaatgaaatcagtatgtcaaagagctatctgcacttccatgtttcctgcagcactattcaacaatagccagaatatggaatcaagctaactgtccatcaacagatgagtggataaagaaaatgtgatatacatatacaatggaatagtattaagccataataaagaatgaaatcctgtcatttgcagcaacatgaatggaactggaagacattctgttaagtgaaataaaccaggcagggaaagacaaatatcgcatgttctcacttatatgtgggagctaaaaaatttgatgtcattgaggtagtaagtagaatggtgattaccagaggctgggatggatgggtggtgggaatgaagagaggctgttaatgagtacaaaaatacagttagatagaaggaatatcatagggtttgagagctatatagagacaaaaaaataggtaagtgattgctaggaaagcgggtgggattgagtactaatggttatggagattctcttttgggtaatgaaaaagtcctaaaggtaattgtgataaaggttgtacaactctgaagacaaactaaaaaccattgtattgcacactttaaatgagtgaatcatatgatatattaattatatctcaataaagctgtttaaaaaagaattctgagtggaattggccagatacaaaaaagactaagatggcaaattttatgatatcttactccaattttttagaaacataattcagatcacgtttccctaacaactctccaacagcttcccatctccctcagaatgaaagccccaattttcaatatagcccataaagtcctacacattctggcccctttccctttctggcctgacctctgacctcctctccgctctgctccagctcactaggcctcttaagttgctctctgaacataaagaggcaggttcccccagggcctttgtactttcttctcctccagagaacgtcaaggtaagttctctcacttccttgagctctggactcaaaaattcccttctcagcgaggacgtccctgaccacttattgtaaaactgcagctccctacagccccccacccacaacacacacacacactcttcatccccctttcctttttaatctctattttcaccttctgtcatcctataattttactttttgcctgtctctttccactaaaatgtaagctccaaaaggagagagatgtttgtctgttttgttcattgttggtatctctagtgcctagagcagtccttaataaacatttgttggattaataaagggagaccactgtgggggaaaaaaaataaaagaaaataaaattttagctgaagaatgcaagcccctttaaattatcaggcccagagaggcattagaatgaaaaaacagtcccgtctcactcccggtctgagctggataattatctcttaaagcccacctgctatatgggctctagactggaaccaagaagccataaaatgccatatgctggacacgataactcataccctatgagttacagtgtacagccaatcactaagcaatggtatctctgtaaaccaataacaattcctgaccaactttgtctcagcccactcttccccttcgcctttaaaaacctgcttgtaaccaaggctgaaggagcactccccaaggcaactgggaaatgagtcctgggcagctgtcctcattttggctgaagtaaacactttaaattataattttgtgccccagcctcttccttttaggtagacaccactattcaatgacatcaagatctgaactgtcctacttatcccaatatcccacccctaaaaagaaatgtaccgaaccataaaaagcctgaagtactccgacttacagactcctgtattagcatcctaagaattatattaccctcttcaatagggagtagtatttttcatatcaaacctagcctgagaacaactgagattcaactaggaaaaaaagaaaagaaaatccattaaagactgagtgatttgaactcaaaaatatccatcatcacttgctaaatcatagacagcaggttatttccctcgactttgctgtgcagacctgtagtggctcaatttctgccataataaaggccgtactagaaagagcaatcctaactaagcgcgcaaggtaaacatcaagctggggccgtcaggggcggggaaacactttctgaatggcggaagctccgagagacgcctttcccagctgctccagaggggaaaggaaaagggagaaagtctgtttttccagaatctcccaaacacagcccaggggcctgctccgcgggcctaagcgcctccacgtgtctcagaagcctagcactatagataccccggggcacggagctgggaaaacgggaataggaagacactttaccccgagaagatccagtccaacaggtcttcttcagccggatgactgtggagcgccaccacaagcagggcctgcaacccaggcatccaggctagacaccaaatcagcaaactttattcccgcgctgccgagtacaagccggcgcctccccggcgcacacagtacacatcagctccgggagacctacccgacccgcccctccagcgccgtccccgcccccgttcctgccccacccctttccccgcccccggcccggctcgcctttctcgcggcgctgcaaccctcccaccacagcccatccagccccgcccagcgcgccgcggtgcgcatgcgtggaggccctcgctgccgctgagcacctcgggaagtgtagtctcttcgcaggtgcggctgggcagctagagtcctgcatcccggtggaatccggagaagtgagaacattcccgccgcccggtcctcattcccatcttcccacctgtccagtcccctcgcactcccgctgcaccccacgcgccgggcttcagtcagagagtgcactgaggaagagcggagaccccctcttcccctcagcaggctgtgccgggggaggcggggtccaccgcccgccccccgccgtcgctctccccgcctccccttccctcccctcctggcgggtgcggggccggtgtccgaagtcaggcggcggcccccgcagcggccgcaggaggggcggctgcggtgggcgccgcgggcgatgcccctgcccggctgctccggcggggggcagtgcgagcggcggcggcgggggaggaggcggggggcggcggctgcggcggctgcagcagaggggccgagagctggcggtggcggcggcggtggtcgtgaagggcatcggcggcggcggtgatggcagagatgatgtgagtgcccgccggctggagacctggggccgcggagcgcgggacgggcggcggcggcgtgcgggagcggccccgggggcggcggagggatgcggggagcgcgggcagagccggagcggcggccgccaaccggccggcagtggctggagccccgcgctgcggcgccgggggagccgggcccggcgtgggggtcgcgggcggcggcggggcggtcaggccgaggggcgtctgcgattgttctcaacacccctcccccaccccatcccgtgtgtctgtttgttacttgcagctgaagatggaaagagccaggcgaaggggaggcggcggcggccgcggccgcggaggcaagaatgtagggggctctggcctaagcaagagtagactctatccccaggcccagcactcccactacccccactacgcggcctcagccacccctaatcaggccgggggcgcagccgaaatccaggagctggcctccaaacgagtggacatccagaaaaagaggttttacctrgacgtgaagcaaagctcccggggccgcttcctaaagatagccgaagtctggatagggagaggccggcaggacaacatcagaaagagtaaactgaccctctccctgtctgtggcagcggagctgaaggactgtctaggggacttcatcgagcactatgcccacctgggcctgaaaggccaccggcaagagcatggccacagcaaagagcaaggctccagaaggaggcagaagcactcggcaccctccccaccagtctcggtggggtccgaagagcatcctcacagtgtcctgaaaacagactatatcgagagggacaataggaaatattacctagacctaaaggaaaatcagcggggtcgcttcctacggattagacaaaccatgatgcgggggactggcatgataggttattttggccacagtttgggccaagaacagactattgtcctcccagcacaaggaatgattgagtttcgtgatgccttggttcagctgattgaagactatggcgaaggagacatagaagaacgaagaggtggagacgatgacccgcttgaactcccagaggggacttctttcagagtggacaataaaaggttctactttgatgtgggctctaataaatatggaattttcctgaaggtaagtgaggtgagaccaccttaccgtaatactattactgttccattcaaagcttggacaaggtttggggagaattttatcaagtatgaagaagagatgaggaaaatttgcaacagccataaagaaaagagaatggatggcagaaaggccagtggtgaagaacaagaatgcctcgactagagtgaaattgaactccatcaggcaaaatttaaaatcacaaattggctaaaagtactgatccattatcctttgaagaagtttttcctcttttttggcccgttgttattagtaatacctctagtagttgatacttcaggaagtctgattctcatgttatgttacacatagatcactataattcttacgggaattccaaccttcccagagctaaatagtttagctgcttcaactgctccagactattgaagtatgcaaatcagcacaaaatgtgacattctgacattctaaataccataactaagatttacattgcactatgacataatcccgaaaaaagatacatatacttaaatagaagtgtgactttcccccaaaagtatttcaattctacttcattaaaagctgctaagcttacctgtagggcagttaccacagaaacagaaattgacctccggtatatataaatatttacttataaaagtacaagtagacgtatattgtccgttgaataactgaatataccatcaaaggatcaaatcttattacctaattaaaccttaaaaatataatgtcataatatttcttaagaatactatagtattctataatttcaaactttgtggtaaccctacattttatagttgccatatcaaagccatgggagagttttaattcgttattctaagtttagttacaatcccttctttacctctacttaatgttccatatatttttattgactttccaaagtttcaggaattacttttatgtcacattgagtgggaggcttcatccaatggctttgctatggaaatcttggtggtgtagcttttcatgctaatttaaagattgcaagaggtttcttccccaaaatatatcatggactcaaggtgttatactttatgcttcttctttaacactctttcagaagggttggtgtaccaattaactgatataaaaatatacctgtaataatatattttagtagcacttttgcaattgctacccttaaaaccatgtcaacacttccaatataatcctgwattttacaggtgttttaattctggagggggtggggattttttttttctaaaaataatttagaatacaaatttccagtctgagaaaaatattatttgaagattggttataaatatatttgaaaggaaaattcaggcattttccaaggtgctctttctgactttacacaagactcacccatttacctgtattaaaaattactttccaggaagtgccacagcaatttttcaacacctaagcaattttttaaayaagtggatatagtgttatatgtgtaccaacccatcctgtattaattgactgaaattacatctattcagctatattttcttctgaatgaaattattgtcttttatcttggctttattcacctcccacacaataagtccatctaatcatatttaagagccagaacactgatttyaacccccaaatatcactctcattgatgagagctggctgcatggattcaaatcagaatgtagctcttcttttatatgctaaaagtaatttaaaattatatcagcgatttttttcttccagagttttgtcccccaatacctttacgtgaggtcactaagaaaacttgatggtatgaattaaaaaaattaatttcattggtttatgttacttaagaacaagcaatcagtaaccccgacatatatactagtgttggtttgcagattgtatttcacatttcctctagtagcgtgaaggaatctcattagttcattataattgtggaccatctggatcactatggaacaactgaaggttaggagataatgttagtactagagctaatagcacatggtgggtgttgagactctaaaagtagcaaggatttttaaacagtcctaactgtaaaataactatgtaggcttgctaaaaaagtagtttttggtctatgaaggaatgatgtgcacttgaattactgtactactgattgttattgctgcccatcatagtgcctattaataataatcaacctgtcagattttggcaaactggagctgtgaatattctagtatttgattgttcctatcgctattgctatgagtgtatacactctcttaaagtcttcctttctaaaatatttatatccattaggtctaaatgatttccttttaccttttgggtctgataagatttgggtatgtgtctatatctatatatatacacacagacatatgtatatacatgtatacatatatatgtgtgtatacatacatacaataccatgtcagacttaaagataaatatctttaactcattgtatataaacattattaaatttagttttccattaattatttaagtaaagaattagttaagcagccagattttctactttgtatgtatacttcaaagtttttaccatctcaaagctgcagattaaatagatgcatatatactggcaattgagtatactctaaaattattaagccttctgccagtccttttgtttcatttttttcatagttaatcattcaaaaatgagatgatgctatgactttttgatacttaaaattcccaagaattcattagccgtaattaaatatgatccagttcaaaactctggtcttaggacatgtattgccatgtatcttataaaataagctactattcttatctgtgcaatatgcattttatttattgtcatttgtaacatacatggagctgcaagtgttcatggtatccttcaaaataacagaatccctgccttgaagacattaaactcttaaggcaactggaagttagaagttaaaaaatgagcatgaaagttagtaaccaaaagtactagttcactgtataattctaaaacactgatgatgtttgcacctaataatccaagcataatgtggtacaggctcaaactgtagtaatataagctaatagtatgaaatttggaaacgggttcctcttgatagttggcagtgtgctcctagcaatcgaaagcagcactaatctgttgctttatgcaaaagatgcaatgtattataaagatattaaagttcctctacattttataattttccttgttaaagccccagactgccatgtccctgaaacttgagtcaaacacaagcttatttgcactaaagagcatggccaaaaaaataaatgacagggtggaaaagctagttggaacctcttgaaataattggttctaatatgagaatttcacatttgtctatttgaaagctgtatggtccaggcagacaatctgtcagttcactaatttaataatgcactttaccttttgtatatagaagatgtacatttatgccacttgacaggtgggatgtgtttcaataactatgtagctagaatctataaggtgatcccgtgcatgcatatgtttgtgttggaactgttgttgtaacaggtttccattaaatcagtgtaatggagaagggtagaagatgcttttgaaacaaatcccagtatatttaacaaagaattttaaagtagagttcacatttgatgtcttaagaactagaataaataaaatactatttctaacccaaattcttattacagttgagactatatttagttgagattccccacagtgccctgacagttaatttggggaatttgtctagacaaaatttttttcaatcattgtttcattgttgatatgtgtttaagtaatgaataaatatgcagtacataatattatactcaaattaaaagtgtggttagctgatgtggcattatttaaagaacattcagactaaagaagtaaggtttcaagttaaggaaatgcaaggaacctatgaacagtcactaacacaaatatgatatctcagaattcacagaagtactaaccttccccaactaaaaagggtattgggggatttagtgkatccttccatcttaaaagcttcttaagatgtacatttgaaaactagataactgttgcttaataatactttactgagaaacactgtgtactaacaattcatcaagagtgtgctatatttactgagttcattttatatctatagataagaataaattatatagtcatcctaccttaatataatcatgtatttatattgtaattttgcaaatattttccataaaataaacatttatctgagctgcacaatttgaagaggatgaaactggaatataccctcagatgctcattttaaataagcagctaccattgaaagctgatgtatgtattatcattcctttaaatttgggtttatggtatattttaatatttaaatgaataggacttaatttgaattttaagtggttttctgaaaataattttttcataagtgtgagctttttttccttcttatctccaaatgtttttcattggaatatttatgaaatcctattcaaagcttkatgtaaggggtttgcttagtcaccacttagtttgaagtctgtctttactaaaacaccaaacatctttgacaacatacaaagaggagttaacattgattctatgcctacagaataatacaggtgtaatatttatcacggcctgaaaaggatcttaaatccttctgaaatttccttaaatatttcttgaatttcaaagagaaatggtggctaatggctagcccatcagagaaaaagaataagtatgttaacatgctgttgaaacaactcatagtccaccatactgtagcaatgaagttcagggaaaatgtgtttttcccaacttaatatcatgtgaaaattgggttttcagatcacagtaactctgtcgtaaagaaaatatacccaaatttagtaggtagagcttagaaaaataatataagtatatattttcatgtataatggaaaaaatccgtacttgttattaatttgacatgctattttaaatcatttaaatttattttggtaatgagattttaatcaatatttttgaatagggaaaaacatacatatagtacaaaatggaaacagtacagatgggtagagggtgaaaagtagcaaccaatgttagcaatttcttgtgtatccttctagagttactctgcatatacaagtatatgtgtatgtatrtatatatatatatatatatatattctttttaaaacatacagatgaaaacatattatatatactatcttgtacctagtagattcaatttcagatctgtcattttaagtgacttttttttaacttagatatcatacttgagctagttaacatatcacttaatttgaaatatattaactataccaaggaaatatcaaggaaattttgaatgaatcccattggtatttacttaaagtgcaaatatatgtgtattttaaatatacaaatattcagttcatcctactagtttcctttctctcttcctagccatcttgccttcctgtattcccctcacaaatatattggtctttttcctgaagtagtgcacttcaggagtgccaggatattaaataatttaaccaagtgttatcttaaaccgtattccctaatgaaaaacacccatatttaaaagctttaataaagtatcacgttcagtcaatttttactaattctgttactattatctttatccaaagaccttgcccttataagagcaaatgagtattagaactatagtaaaaaggtatatttctgttgaaatactttattagcatgaagcctttatctttatgagaaaggtataatgttcatttagcaacctcatcaaatccaagtttaagcaaataggtaactctagacccgattgtttaaagcattgatttttcactgaaggaccaagagtctgtcagtagtcttgggaccaaaggcagtgggatgatttggggaatgagtaaaaactggagtgctgtgaggttacaagtacagctaaactgtctctctggtggaagaatataaaatggtcaatataattttttaatgaagttagcattattactagtcctataaacataaacaaagctgccttaatagttttgtgagcacccgtccccaaaaatcataattctcttttcattcccatcaagagtgcattttgatatgacttttctattgaccaccaagaaaaaattatctgaaaaatgaaagatcccatacttgagtcctgaaagatgctatctaaytatgaattaaagcaaccagagtaaaagatccaatacaattgtaaatatctttaaaaatgtgggttgaggaagaagaattttttcatggattggtatccgtgaattttatgaacatgtcataaggtttaaaaatttaaagcattgctttaaactttagaataataactctatatttggtagcataatgtcctgtttacaaaatgaaagaggtgttgttaaaagataagatcctcttaaacatattttaaaagcataaaagtttgctccctttattttcatgctgaataattcattataaaattcattaaaaattcatctttaggaatgaattttgcttaaatttaggctaaagcatattaataatttcccatccttaattgaagagcttcccatgttggtgctttctggtaaattatatttttcaaactttatgttcttttgaatatttcttatgaaaaattacatatttttattgaggccagtgacatccaccagtaaataaaaacataatgaattagtgctgctatagtgaagttactttgtgatatgaatatgaagaaaaaaactcatttaaatggaatatatactttcctgtttaatattgtttacttatttctgattaagtagcagttctctgtcttcacattttaccctcttaaacttaatttttgcaaaaaatttttctattcggttttcattttcctagggaaagggaaaaattgtccctratgaaaagtgtttatagtatttaaaagagttgctcaaagtgtaagactggggaaaaaaagcttatgttgttttttttgtctttatcaaaataatggtataaatctgattatcttacttgatctgattaaagtcaggattacttttatcagaaacttttatattcaaaacatatttagtattttatttttcttaaagaaaatggttctcttggataatacagaaatcttcaggattttgttgtggattcaatgaggttgttgcctagaggtggcaaacagaaaagaaaaaatagaaaagagaaagacagtggctgattattttgcttgtctgtaacgaaattcatctaagagaaataagtcattctcaaaactcaacctctgtttaacctttaaaagagcatttgagaaagaataataagacgtaattctgccaaggtgcggcctgaccctgagtaaatcattcaacttctgttggatgatttcctcatgtgaaagatgaacagtattgtgctggaagctaaggttccctcctactctaaatgtttaaaattctgtatcagtggactgtgaaaggaaaaatagatggataataccagagttggaaagtgtgagagtttatctgtttacattaaaaacaactataatgatgcagcaacctgtgatgatacccaacggaacaatgcaaaaaaatgtcagttttataatatgtatgtatttctttagccacacaaaataaaattttgtttctagtccttattaagaccaagttgttgtatactaactacgtaactatcctaaactttaattttttaaaaggaatatttttaaatattgattatttcccatctccttattatatcaaatatctcattatttggaaggagcattgcttttttctgcatattctgtaatcattttttatattctgcatggcaaaggaattttacagattaatatcacttcctgaaatgccatttttcctaaaataaccatagatcacattgccaaataatactgcagctgtcatggtagtggtccctactgtcttcgattcctttttgttgatcctgtccaatatcctatgctagaaataatgatgtctgacaaagaccatcagaaaggatactgacctgtgaactgtatggttctgttttagaggacttgtaactactagggtatgcaaagattaaacatctaatggtttgggggttttttttagccttaagaaacgtcaaaggatggtgattggaaaagagaagaagcagcacacaagggttttgtcttagaagcatttattttatttatttatttattattacttttttttttttttgagatgcagtctcactctatcgcccaggctggaatgcagagaagcatgtatttaagcaccccagtcctcagctatgcagtgccccgccactgccagtgaagaggcttaaaaaagagtgacatgtttctccctagacctctcttttagtgcctatttgtttatcagagactccatttaagggtaactgaagtgtattttcaagtgcatatgcatgtgtattttgctaatttcaaaagtttctgtgcacataaattccattacggaaacattccatatgataactaatctttgccctggtggtggttcaaaatagcaatttggttggtctgttttcaacaaattctatagaatgaattggctgttgttagaaaatgttttctctcttttctcctccctcttctcaaaatagcagatacattttaaatccttgattgcttctttttcagtggtgtttgaaatctaagtgggatttgagagaatagtttagtttggcagttctttacccttgccattttgtagaaactttcctcagcttcccatcagatattctaagcaactttaccaaaagaagtcacctacgtgccaaaactgccgagcaaaataaaacaacagagccatagaaaatgatgtaggagtaaggataaagatatatacagacacccaaattcacaacattccttatcatttgctaatttacttcagagactgttgtattttatttcttggttcttcaaactagcaatgtggtttattccaatgatttgtcagtctagaatgtcaatagaacaaaatcttttgctgcttagtaaatgttccaaaaagggtatctcatgttataatcagttgtaaaaatagaattctaaaattccattcattataatcctctttccttcttccctcctgtacactgtaccctattggaagtgggtaagggcattaatttctttcactatcacatggacccactccatcctatttatttgttcagaagacaattgaaacataatagagaccagagctgctctttgaaaatctagaaattgccctgtgagcttgatctatagactgtaagaaagaagggttactacttcactgaactgttctccacgctcttgccagatttctatatgacagtttaggatgaatagaaaacagatttgacttgggatgacatgaactgaaaggtcagttcctccagcttttcaatacacagtgcatcttcagaaaatatttttgacgagcatgattgacaggtaatttcagaaatgaatttaggctgggtgtggtggctcatgcctgtaatcccagcactttgggaggccaaggcgggcggatcacttaagttcaggagttcaagaccagcctgaccaacatggttaaactccgtctctactaaaaataccaaaattagccaggcatggtggcacgctcctgtaatcccagctagtcagaaggctgaggcaggagaatcgcttgaacctaggaggcggaggttgcagtgagctgagatggcaccactgcactcctgcctgggcaacggagtgagacgccatctcaaaaaaaaaaaaaaaaagaaagaaatgaatttggtccctagagaagtttcaccatgaccattttaaaagagcaggtggtaagaaaaggaagagtcaattaagatttattagtagtaataactattgcttatggaccacccactgtatactagacatagctgggccccttatagctactattcctaatccttataacaaccctattatccccattttcatatgattttccagaggtttataaactggttcagaatatcagaactaatgtatttgaacccaaatttacaccaaagccaamgattgtgcccgttcagttaggccaaactgcctttcagatttcctatgaagctgatccttccaactctaataaagcacagtctacccccagccgccactatacatctgcctcagcttacttggaattattttatccaaaaccrtcccctatatgtgggactagtctcaccaaagagacacttggcttatatgaggattccattggttaaagttggtgctaataaatacaagttatttgatctttagtttacagataaaacctctaatcttgatcaactatttccaataaactttttaaagggatcataactttttaaagggatcagatcataagaatgtagaagagcttcacagtttcatccctaagggcagagaggagacaaattactattcaccatgggtctacaatttcattttcatgaaccaaaaacaactggttacgttatcttagtttcaaaataaatcttatcaatatttttggaagttttattgatttcttacaactttttcctgccatcttattgatgtctcacaacttttcctgccatactcctccctatatcattccactcattttcatatttaattaccaaatttcctcctctttctcttaattccagtacaataaacagataattctccatttacagatacatatttttccccattactatagggcactaattttcaaacttcagtgtgaatacaaatcatcttgatggtttgttaaaccacagattgctggccccagctcagagtttctgttcagtaggactggtgaggtggggagaagaccaagaatatgcatttctaacagtcctaaggagagtggatgctgtgatctagggggaccgcactttaagaaccacactgctgtcagctgatgagattttaccttagctacagaagatagtgatggaaaaactcggtcaaaacaactagggtatctgggtagaaagaagactgagagctactccttcttctgccttgacaagcttacaaatcttgaaacaagcaactttttaataagttgaccagagttttgtaaaaaattattttcttcccttttgaataacctttctgattccctctcatttttcaacagctatcttgagagaaatctgataggaattaacagttatgaagcctcatgtgaaaagcttagcttttaaatatatggagactgatgcatatttttaatttattttgtaattatagtatataaatcttggtaaagaaaagtgaacaatttctctacctaagaattattaatacaagtttaatgactattaaatattaggacttaaaagaccttggaattaatttaatcccttagttttccattttgtgacatacatcatgtagctcaaattgttcatagttactagaatacgctaagtaaacagaatttaaaggctagagcttaaattgctgattatctcaagatatataaatggtgagaaatatactaatttcttctaaaagcatatcgcatttttaccatcttcctgtatcctctctgtacgtatagaatggaggaactatatactgtactgtgtttatagtacctttttttgtcttcaaactctgcctcccaggttcaagcgattctccagcctcagcctcccgagtagctggaattacaggcgcgtgccaccacgcccagctaatttttgtattcttggtagaaacagggttttgccatgttggccaggctggtctcgaactcctgacctcaggtgatccacccgccttggcctcccaaagtggtgggattataggcatgagccaccacccccagcctacagtacttttctttagatcagcaattgaactcactgctttaaaattagagatattgggccagacatggtggctcacgcctgtactcccagcactttgggaggccgaggcgggtggatcacaaggtcaggtgttcgagaccagcctggctaacatagtgaaaccccatctctactaaaaatacaaaaaattagccaggcatggggatgacagagtgagactccatctcacaaaaaaaaaagaaaaaagagatattggctgggcatggtagctcacacctgtaatcccaacactttgggaggcagaggcaggcagatcatttgaggtcaggagttcaagatcagcttgacctacatagtgaaaccccgtctctactaaaatacaaaaattagccaggcgtgttggcaggctcctgtaatcccagcaacttggaaggctgaggcaggagaatcacttgaacacaggaagtggagattgcagtgagccaagattgagccactagactccagcctgggcaacagagcaagactccctctaaaaaaaaaaaaaaaaaaaaaaaaattagaggtgtttcacctgaacactcattgagcccattttctataactaacatatttttaaataatttattctatgcttgacaaccttgtagatattctgtactataattaatatgttgatcaaaattaaagccatatatatatatatatatatatatatatatatattttttttttttttttttttttttttttttttttttttgaaaaaaaatctccctctgtcacccaagctggagtgcaggggggcgaactcgggtcactggaaactccccctcccgggttcatgccattttcctgcctcaaccccccgagtaggtgggaatacaggggccccccccaacgcctaatttttttttttttttaaaaaaaacgggttttcccctgttagccaaaaagggcttgatctcctgacctcgtgatccgcccgcctcagcctcccaataataaaaccatattttatgtctaaatctatataatatctataactatatataaaccttaatgctgtcattctagtggattacattgtattgaagtattaaattaattcatacatagacatttggcagttctgcaagttcattgacttctcttaacagctactacctttgaatgattagcactccagaacactgaatgagttcctaattgtgaaaatgattaactaactgctgacataacagagatagtcacaaactcaaatggatcattacaggcaatgtaacttttttaaaaattctctattcatttgcattatggctacaagataaattttagatttaaaaaaattaagtgttagaattatactttgagtaggcttcaggcagaataaatttatagtagacttcagctcaacattagggcaaactttaaggattgcatgacttctctgctcctggaattaattatttaggcacgcactgaatgtgggatgcataaagggaattaataaatcagaaaaggtgaattgttatggctcagattcttctccactctgagggattcagaatttattggaaataatcattggaacttttgccttcaggccttctgttaatttactggtttggataaagaagtgtgatttcaaattttctaatattattgtgaaaacatataaagaaaagaaatccttcttcccatcctttgttattgcaaaacaacgtaagaactaggttttaaattttcatgaactttattaattaaatgactagttaaatagaatttatgaaatttattctgtaagattaagtctaccttttataatcttcaaagaaacttttcactttcaatctgttttcaaaaatatgaaggaataaatttagtatttatagtgctatttcaaaagtacctgctgtcggtttatttagaatgacacaagaggcaatagggtaaattggaaaaccaaattattggatattatcaaattttttctttataaaattcacattaaattctgtttaaaagtcgaaacatctataatatctttctccattttttcttgcactgctaattaaggtggaaagaagcaacatcgtttgctaatttcatcttaaattttttgttttagacaacaagtttccaagtaagttcattattgctacaaatgcaatcatatctaaattcaggacctagtgaattcatatgaaactcgattctgcctggtggtgtccacttttttcttgtcacttcttctaatcatctgtgctttcttgtgatactgtaacatttccagatttcaagtgggcaaatagtagcttttatggagagatctgagtgatttaaatgttatcacacaaacatctataaactatattgcacatttctaaatatttggctaagcaaattttattcctccagataaatattacataccctttatatataatagatagatatagatatagatatataatctcttatagagagtatgtgtaatatatattaaacatacatatattgcacatgcatatatatacaattttttacatatatatgtaaaaatttttaaaagagatcccaatcctrttcacctttttcttgtccctggagaagtagtggtaaatgggtttcatctcgcttgtatttgcaattgattggctgccctaaagtgctgtgtttgtatctacagggagagggaaaaaacagtgttcatgccaaatatttgctatttatcattcctgctttagagacataaaagttttcattgtagctctaaaaatttctagcttagccagatagctggcagttgcagcacaaactaccatgtgactcacctggaatgtgtctcttctaatatgtgaaagagattatttgaaatctctttccttttttcttttttcttttgatcatctctcctttaaaagagcagagcatctccactatgcctctgagaaactagaatgatggccatgatgatgtcatcaaagatactcttaagtattaaactctacatttgcttctaatgagttctaacccccattaaaatgacagcagttgcatcctttaaaatttagtccagtgattctcaaacacaagtgtgcaggtgtattaaataaaaatacaggtttggtccccatcctcagagattctgatttgattggttcaagagaggggttcagaaattggcatttttcatcgtcttactcattctgatacaagtggtctggaagccactctttgtcattcacttagactgtggacttgcgttctttctttttttttttttttttttttttttttttggttcttgttagacttgcattctttcttccatatcgtttttccagcacaaattgcttaagttttaaatactgtcagtcatgacaccatggaatgatgatttttttggttacaatattaataagtagtatccagggctcactttattttatttatttatttatctatctatgtatttatttatctatttatttatttatttttgagacagagtctcactctgttgcccaggctggggtgcagtggtgcgatctcagctcactgcaacctccacctcccaggttcaagtgattctcatgcctcggcctcctgagtagctgggactgcaggcatgtgccactgtgcctggctaatttttgtatttttgatagagacagggtttcaccatgttggccaggctggtgtcaaactcctagcctcagctgacctgcccgccttggcctcccaaagtgctggaattacaggtgtgagccactgtgcctggccttggtttgtttgtatgtttttgtcgttgtttgtttgtttgtttttgagacagggtcttgttctgtcacacaagctggagtgcagtgacccaatcacagctcactgcagcctcgacttggcaggcacaagcagtcctcccacctcagcctcccaagtagctgggaccataggtgcatgccaccatgcctggcgaatttttttttattttttgtaatgacagcatctctttatgttgacccagctggtgttaaagtcctgggctcaagcatttctcccacctcagccttccaaagtgctgggattacaggcatgaggcactgcacccggccagggctcactttaaacacagagaggctaaatgcataaatccaggtgtttaagattttgtatgctatcatattggccagctttctgggcagtgattactggaaatgccagtttctcacccgcctcctaaactcaagttctgtctgtctggtcttacttgacatcagtccactggtttcatactccctggatttcacaaccaaacattcagagtcttcagagccaagcgactggtctttcagtctcaaaagttgaccctttacgtctcaaatgacatttctcaacctcttttttttttaaaatatatatgcagtataaacctatcatttatcaggagtagaaaaaaattgccttagtcaatctagttaatctttgaatgcctcacttctggtggtggtgtgtttgtttgtttgtgtgtttgttttcaattgtggttaaaaaaatgcatagcataaaatttaccatcttaagcatttctaagtgttcagtaatgttgtgttcagtagcgttaagtatattcaccttgtcatgcaaccaatctccagaacttttttgtcctgcaaaactgaaaagctatatccattgaacaactccccatcttcctttcccccgcaagcctggcaactaccattacactttcttctcaaccttttctttaaaataagcaatatgttttcttaacctttctcccatccataatgggtttacagttattgctatttagctctccaagtataaagcttatctcctgtattgttagaattctcacatgcaaaaagatttacaattacaaagcaattgtgctaataagatatgcttataatctttgagtgaaggtattttatcctggaagcttttccactgatttacagggggaggtaagcctttattcctcttgagacctatggatctcactttatgcttcctggctggtttggtattttatttgtttgttgaaggtttaagtttagagttaccagggcaattaggcttaaatcctagaatttccttggctttttcctgtctacattctaagactgttttaccataacactttataacgtaagtagtagattggaagtttttctggaatttgacaaattagtgtttactaaatgatttaataatctttgcttattcagtataaaatggtttacctttaaacagctttaatagaaacacaatttgggaggaaataggtaaaaaataaaaatgtatttttctgcaaatgaactgtttcaaatgttattttcaaaatctttggcagtaagaaaatactcaacccgagaaataaattttttaaactcttattctgtaaaagtttttcttttgaaacatttctcttcctctgttattaaaatttttttaagaaatcaataaaagcttaaagtcttataagcaatacacatctaaataaccaaaaatgctataattatgagtatgctgcttatgatcctcccatagggaaaaacatctgtcttttcttggcctaaattatttcagagctagcacaaaaactgattgatcatgactcttggataatgataactaagtcttcgtttcatgaatttaacaatttgtatcagtgctaccttatgagtttttcagaaaaatgctatttgtattgaacyattttaaataattccataatctggaataattcagatttttttaatgatctgctgcaacatattggtattattgaatctcattttttctttgatttccattataaaattagaaatattttctgggagaaaaaatactccttgagttgaaaagatttagtgaaggagttgtgttgcagctgattcagtaatgttccaggcaattaacctttttttgttttcagcgctcctctcactctttaagatctttcctcattgatcatcataccaccccaaaatcacagaagtttatttaattccatgcgttcctcagagcacgtgatgtcagaacttaacctcccctcaattttcagcttctaacctaagctggacactaatattttgccagtaggaaccttttattttttgagacagtttcgctcttgttgcccaggctggagtgcagtggcgcgacctcggctcactgcaacctccgcctcctgggttcaagtgattctcctgcttcagcctcctgaataactgggattacaggcgcccgccaccatgcctggctaattttgtgtttttagtagagacggaagtttcaccatgttggccgggctagtctcgaactcctgcctcaggtaatcctcctgcctcgtgcttccaaagtgctgggattacaggcatgagccgccgcgcccggccaggaacctttatatggtacaatgaattccagcctgaaaattccccaagttctgagcctttacttcatacatatttaccaaatatatcaattattatattaaacttagaatgaagaatgactgtaagatttataatgactaaagttagtttgcattatttttcttcaagcgttattaaaccgtactcctctttaagcaagtttttgggtcactaggtaactatgtgatttggtttgttgatcaccatttattgtttgactcactttttcaaaggcccaaatattatatttaatgacataccaagctctaattcaagcagtgccctctgttaaggtgatttgcatctgacttgaagcatattaaataaaatctacattttatttgatgcaaatgttttatatttatataaaaaattaatcttgggtaaacacaacttgattcttaaattagattcttaataactcaattctaaatgattacttattaaatttgtcacaaaataactataaagtgaacgtgaatgctacattactcagtatatctatgctataattaataaactccaaaaattagttgtgtattatttggactactatttcaatcattcagaaatttgttttaaaaaatccttgcagtcttgctgctgacttcatagygtgcagtagtgtgatatggagatgatgcactgtctttcagaagccttggctctatgccttctagctgggcctggggcaagtcatttagcctctgtggaccccagcttgcttatccataaattgagggaattggatcagagtgatgatctctaagaaccccttcaatttctgtatccctgaagtcagtgaaacttctcttaaagttagtttctactttcttctttggccttttctcattttcttcccactccccttggtttcgtctctcatctgacatttattgaccatcctttccttcttggcatggttcatatttagttatggccactttacagtgttgcagtatgctgcttctctgcctaatttgcccagttcccatttttaccctgccattttaattttacatataaattatcttggaactaacacaaaaactagttgatcatgatatattatatatataatcaataagacttatcttttggccctgtacacaaaagttttaaagaggcaattcttccagttccaagagatttttttagacacacaacctaaaacttgttggagtatattttaaacttaagtttcccatttgaaaaatcctaactccttaacttgcatttaagtttaaaagcagagacagtttcttcctcttttgtattcccctctccaccttgcactgggctgattacttaaatcatctcttttcacttaatcaccagcattcctgttcctgttttgtctttgaaatcttgttgcttcagaatcacggtacttaacagacaaatctaaatggcgacaattgttaatgaaagcgatagttttaaaacctaaccaaaaatgctatgtcatctttatttcaaagatgactcacaattaaaggatgatttgttgcctgcacaccctaaattttatttcagaaatattctttcccttgcttaatggataagtgatgttgttcctctactcattcaatggacattgagtagctactttttgccaggttctgtgctagggtctagggatacaataacttaggaaagacaaatatttcactgccattagctttaagtgtgccatgtccaaagttatttgattcaaagcagcttttggagcctaattacagtatcattttgttcattcaacagatatttatttgattatctgccatgtgctagacagtttgttggtacatatggaagtgtatttaaagctatctagtataaaatgctatgcattatttttcccttatcaatttatcctttaaatatgattatctacatactgtcatagtgctcaaaatatatttcattgatgcagatttagagaaatacaatgatactattttaaacaataattctgtcttcctcattccaaatctgccttgatgtcctagggtgaaaataactattctgtttcatttcatgtgccattgtgttcaagtggtaatgactacctgagtcctaggttggagatgattgtgaagctccattcaggcccatggtaaaagactgcgatgatttctgtatgttgatggggcagttagatgaggaaagcaaggagtagctatatacatgtcacatgttagcccttcctgccccaggcttttgtattcatcatcactaattttatttcactctcattgcatattcagtatattcacaaattctttttctcctcatatgtttggattgacaaaaatccatcagtgttctcagctatgatgactatctcaccaatgtcttagccaaccaaatgagatttactaacacctctgtgtcagtaaatccacagttgtaataattttcactgtagagacattgcaatgaagacaattaatagataaattcagttaatcatgagtaccaaaaatttgtcctgaaagttttccataactggtcattaattatgaaatattttctaattcaattaaatataaaaagaatgtgtaattttaaattataataatttacatatacgttaaaatcattttccaagttcttttttctattatacctcattttaccctgatgaaactcctgatttagattagttcaatatcactgtccccacttaacagatgaagaaaaccaaagcccagcaggtgaaatggtttgctgtaatcacttagctgcctaataaaaataccagggttttaacaagcccactgctcattgaagccttttatattaataataacatagaaatttaaagaggtaaacttgaaatcaaaatttggcaaaattaagcatatatgtttatagctcatttaaagagtttttttgaaatgcattctaggtattttgttgctttcatcacatctttaggctcaattctgcactcagtaaactcttggttttggccctggcagaaggcctagcaactcattggtgctcatgtctgtgcaccagctgcttgccracctcagcctctgcctcaaactctgagcctttgtcctctgtgcttaagactccctgcctgagcttcccaccttagctaaccttccagaacttgacgtttcctcacctgttaacccaagtcttgtcatggcacctgctttgcagaatagccctctaaaagtgatatcgtttagaggatttaagatgtaaaactacatttgcataataagtttggttaattaaacagcgagtaaatcttttccctgcattccattttttattatttttttattttttattttttcaagacagggtcttgctttgtcacccaggccggagtgcagtggtgcagtgayggctcactgcagccttgacttctggggcttaagtgatcctcccgcctcagactcctgagtagctggtactacaggcatgcaccaccatgcccagctatttttcctattttttgtggacacagggtctcactatgttccctagactggttttccctctacatgcttatgaacaagagataaatgaccacatgataagttagaagcagactttttcagaaacctgtttgaaaggaatgatccaggttttatgaaatcaactcaagaacccactgttcttcatctgcatcagtaccatsattacagttgttgacagtgaaggccctagagcactgcagtattctcatttgtgcatgcaaaatttaatcacatttattatgttgtatttattaaagcagaaaatcgaaataatacatgttagaaatatttccatttcaataggattaaaagcatactgttagctaggaattgctgttaagtaaatgacttcgctccctgacattcccagttaaccatggttttgtagcatcactgaggaactggcaggctaaattctgaattcttacatgcagactgaattattctggtggtttttgttgttttgttttgttttgttttgttttgagacagagtcttactctgtcacccaggctagagtgcagtgrmacgatctcagctcactgcaacctccacctcccgggttcaagtacttctcccaccctagccccccgagtagctgggactacaggtgtatgtcaccacgcccagctaatttttgtattctttggaagagwtggggtttcactgtgttggccagactggtcttgaactcctgacctcaagtgatccacccattttgacctcccaaagtgctgggattacaagtgtgagccactgcacctgtccgaattattctgtttstgtatttatggccacagaagtttcatattggctaaatctgcacaaattatcatatagttataaatataaaagtcagatcaatatggctaagattatcacagaggagcttaataggagttccacacttgccttttgccgggagaagaaaacaacaatgactttaatccacttcctctacccccttaagcaatggcagtaatttcagctctatttttaggtattggatcccctaaagttatcaggcaatctcagtggcctagtataaagtgcaaacagaacagaccttggtgtcagccagtcctgggttcaagtccaaattctgtcatttattgtgaaatttggagcagtttatgtaactgtatagagttgtgagaattcattcatcatttattgtatattcatcaatcacctactatgtgctggtcaatctttaaagttcagggaattatattgataacaaaacataaagttccctgccctcacagaacctagagtaaaccagaattctcttaaaaaagttaaatgcaaccaggtgcagtggctcacgcctgtaatcccagcactttgggaggccttggtgggcctcacttgaggtcaggcattcaagaccagcctggccaacatggtgaaaccccatctttactaaaaatacaaaaattaaccaggcgkggtggcacgcagctgtaatcccagctactcgggaggctgagtcaggagaatcgcttgaacccaggaggcggaggttgcagtggcagcgagccgagatcatgccactgcactccaggctgggcaacagagcaagattccatctcaaaaaacagaaagttaaatgccttcaggtacataaggctgttaacgaaatgtcacataatcaaagcatttaacaaatattagttaacatcattattaaktcttcccaacccacgaaatggatggttccctggaaagtataacaacattatgcaaagttcaaagggagcctccttttaccataggaacctttaggtgtagcagctgcaagggaattgggctgcttataatctcataaaactgttttcagtcaaatataaaagtgcacaattgtgcaggcaaaaatttcttgcacaggaaacaaaaagcactaactataagagaaaaaaacaatacattagactccatcaaaattaaaatttcctactcatccaaagacaccattaagaaaatgaataaactatccacagactggaaaataattgaagcatagatttattcctggaggaaatcagaacagctttgtttttttctttttttaaaaaaagagaatcattaggctgtttgcatgattgagggaccaattgctgcagcgctaaaagtattacattcacctacttcctagtacctacagtttttctcatctagatctaccatcgattttgatggttttttgcctgaaggtgtctttgggggtaatatgacaccctcattttacaagagataggaaaaatatttgtatgactttgacatcatttaactagtctttcagaacttgaactatattaagtggtacttccactgttcagtgtctgtttttcttattacactgattttgcttcagaatcagtgagattatatagacgtcattcagaatatttgtttttatccttcaactcgaagagttttctcacctctttattttcaagttgaaaacattattataagaktatgttagcgggtcatttgactctgaaaaaaatagctttttaaaggttgatcacactttaatcttcaatttcaggatagtaaagaaccattataatttaggccccagtgactgtcataaaacagcttttaccagaccaccatcttaatactgatattttcctctttcatatttgaactatatttttttctataatctagctcttagaactctattttcctttgatactaatgattcctcttgccctcagaaatgtttacatgaaacagcacrtgactgtcctttttgttgatcccaaaactttttattgttcattctagagaggcaaataatgtccttcagtgtcactaattgagtttttaaaaggaagatttgatagctaagaatctgttgtcttgtatcaatttatcatttttacaattgggtcaagatatatttatgcaatttttatgttaatagcataatagcagtagcaatataatgtgtggcttgggagtttcagagctttttaaaaaaaactaagtatgtgcctatgcttttcctttttaaccatattgaatgtgtaatgttgagttagaagacactgtgtgaggtaagaaatggcarttcaaggggaacaagaacattcgtttattcagtcaacmaatatggattgagttcctcccataggcccagcattgtactagggaaattgctcactatttttatttttcccctctaacctaaggtggagatgataatgaatagtaaaattacatgttttagatgtctttgtatgttataggtggatttgggacagcaaaagcctttggtgtgtttcacttggaattacaaaaagaagtaaattagagaaataattgtctgacttctgatgatagggtgtttttgtttttgtttttgtttttgttttgagacggagctattctcttgcctcagtctcccgagtagccgggaccacaggcgcccaccaccacgcctygctaatttttatatttytagtagagacrgggtttcaccatgttggccatggctcgtctcaatctcctgaccttgtgatccaccctcctcgccctctcaaagtgctgggattacagccgtgagctaccacacccagccttctgatgacagttttaattttgtagatgaatttggcatgacgtggatgaattctgtcaaggtcattattgttttcttctcaaaaccaatagaattttctcacttayttatttttagaattgtcaggtagtgtaataaagttatttctgtaggaaactgggaattcattggctatttgactctgaatgtaacctctttaaagctgatgaacgagtggccccttakatttgaagtggtaaggtagtcataagttaggctcccagacactggcattcaacgtgattttgaagtgtgatagaccatgtatacacttgattgtgcaccaagaggcataaggtaaaatcttgtttccttcccacctgtaagtgttaagtgcatcagtctcctttctctactggtggtgtcctgttgctccactagtagcccctgatataaaacccgtgtcctccatagataattagtcatgaatccctttccagggcgtgttgttctctatgtggtgatttgaagggagaagttttgaaatgaaaaaaaaaagaaaaaagaaaaatgctaagcaatttctgatgctttagaaggaatgtcgtgtttcattacaatgcattttaacatttttattaagatataatttaataaaatgctcagatcttagcatgtcattcagtcagatttgatgaatatgaagacacatttctgtcaccccagaaagttcccatgtacccctcctcagtcaacactcccccgaccctgacttccaaaagcaaccactgatcagatgtctatcaccacagattagttttgtgtattctggaatcccctgttaattgcatgtatttttcttttcttttcttttcttttctttttttttttgttttggtgacaggatctcactctgttacccaggctggagtgcagtgtcacaatctcagctcgctgcaacccccacctcccagctttaagcaattctcatgcctcagcctcccaagtagctgggactacaggcacatgccaccacgcccagctaacttttgtattttttgtagagatggggtttcaccatgttgcccaggctggtctcaaactcctgagatcaggtgatctgcccatctcagcctcccaaagtgctaggattatgggcataagccactatgcctggtctgcgtgtatttttctctgtttggcttatttcactcaacataataattttgagattgtccatgtttttgagtctgtcagtagagtgtttcttttattgcctgatgatacttttttaaaacaggcaagaaataagcagatcgtcactgaatatcttgattgacacataactactattaaaatcatggcagcaaacctgtagtaagaatgcagggggagaaaataccctcttatattaatattaagtgacagtacttctaacatccaaacaactctcccaccttaattagcgttatatgcatcaagagctactcttttggaagactctaaattactaaaaacagaacctgagttcgcatcaggaattgtaatagccgtaaacctatgactgtttccatcgctttatagttctgctttgacttcagaaactagtttgaaaaataatcccatttaaggatattcttttgttttgtttttttttgagacagagtcttgctctgttgcccagtctggagtgcagtggcacaatcttggctcactgtaactgcaacctctgcctccctggttcaagcaattctcttgcctcagcctccctagtagctggcacctgccaccatgcccagctaatttgggtttcaccatgttagccaggctggtctcgaactcctgacctcaagtgatccacccacctcgggcttccaaagttctgggattacctgcrtgagccactgtgccyagccaaggatatttttcttgtagtatctccattatcaaaacgtgctggaaaggatgttttacttgtttatcaatatggtgatgcctcaggagcttttaagccctcttaaaattatgtaatatagacctgatgaactcagttttattattagaaactcattttgatctgtaattccaagcaaatattatataaatgaaacaagagtagatacagtaagagcagcatccagattgcatttttcttcttttgaaagtcctaattaaattgtttgccatgttatgcaaagattcattgagattctggggagtggcagtaaatttaagcaargattatactgtgattctggggagccatagtaaattgtgtatcaacaaatctaaagggtgaayttttactttctgcttattgtctttttcaagaaaattctatagttaccaaaaaggtggctgaattttgacataataaaggagaaggttgagctggcctttggctagtccacccctattcttaccatctccaccttcaagactgaaataaggagctgcaggagcacaaagagatcccaaaacattgtcacataccaatagccactttcttacttttacaaaaagttagtatggtgttttttttgtttttttgttttttggtttttttttgagatggagtcttgctctgtcacccaggytggattgcagtggggcgatctcgggtcattgcaacctccacttcccaggttcaagcgattcttttgcctcagcctcccaagtacctgggattacaagtgggcaccaccatgcccagctaatttttgtatttttagtagagatagggttttgccatgttggccaggctggtctcaaactcctgatgtcaagtgatctgcccactgtggcctcccaaagtgctgggatgacaggtgtgaggcactgtgcccagccagttttctgtatttgtacaattattcagccagaaaaaaagtagccatatagtactataatgcttatatcacttcagtgggaaaaaaaaaataatggtacccaaaagaaataagaaatatagcctgattagtgagagaacactgataaagtttcagattattcccgttcttgaaatatttctcattcgcttttcttatttctttcacctacgactaaaatacacgtgctttccttttcccctatcatacttacttttttgttcaggttcctaagttgttttaccatcttcatatttcattctgataattccaaaaatactgaaatgaatcctccctttcacatgacctactttagtgtagaatttggcctaagtcatttctcatacaaaagcagttacatttgaattaccaagagaatcttgttggtataatttaacccagaagggcaactcacagtgctgtcatactaagcctcaaggatatatcttctcaagattgataagtgcttttgagcaatcgctcaaaagtatgaattgaagtctctaaacagttcattatcgttttggttgtagtaattaattttaattaaactgccgataatgtttgttccagatgaaaaaatgaggatatggtctttgttcccacttgaatatgaacactgctatccatttaatgttagaaagataaaagagatctcggccgggcacggtggctcacgcctgtaatcctagcactttgggaggccgaggcaagtggatcacctgaggtcatcagttcgagaccagcccggccaacgtggtgaaacaccatctctacgaaaaatacaaaaattagccaggtgtggtggtgagttcctgtaatcccagctacttgggaggctgagccaggagaatcacttgaacccaggagacagaggttgcagtgagccgagatcatgccattgcaccccagcctgggcttcagagagagaccctgtctcaagaaaaataaaaataaagtaaaatattttacatggtatcattgcaaaagaaggagtaatggtggtttaaagaaaacgtttaatacagttattcaagagttccaacacatcaaacttttgggatttaactatccttttttaaaagaaaatatattttgaatactgtacagattcccatcttatcagaggaagaaccagttagcataacatagaattttagggctagaagagactttcaacatcatcaagtcttacctckcggtattcaatagttcaatataattattatctttttacaggtcttagctttcctgccctaatttccaaaacaatgaagaactagtagtccccagatcccctttgtatatatgtataactgccttttcattccctctgatagtctccatattcatgttaatgattgcagctatgaggattatttccttgattcattatgcctgaattagcttaagaaaagaatagtctaccagaagcacaacttttaatttaaatgtttggcaaaggtaaagatgagtaattcagagttttagaagtagttgtagtaatagtcaattgtgtcattggttctctggaaaacacatcatatggattttgccatagcgattcaggcgtgagtaatactaccctattcaagagtaatactacccgattcaagagtaccacttcaagagtgagtaatactaccctattctttaagacaagtaatactacctaccacattgtatgggtgaagcaaaagtggaccagcacagctttttgtgggggttagtggtaggagagtgttatagtgaagttctttgttctgttttctcagtctcatttctcattsattcattaaatcaatagatatttattttgcctgtggtatgagctaaccatttctctgggtctggataatatagcagacaacaagatccagtctttggccccaaagagcatacagtacrggtactcacaacatggacaatgctagataactgcccagagagcagagaagctacatgagatcattataaacctgtgcacctgaaccactgcacaagcaatgcattaactttgccttgctcattgggatatggtgagaaataactgttataattagttgtgaagcactttggaaatgaaaagagctacaaagcaactgaatgaaagaaaacaatattaaattatagggtagaaatgattctcataggtatgttcagtatttatgtcaacgatataggactattaccagggaaaagctattttaggtaaatacaattgcctagcttttacaaagtcaagaaaatacgtgtgtgtattaacaagataaattgtggaatgttgtattattttgggtattatgtgagctaaatatagttggaatatcacacatactatgaagtttctataaatctgcagcttctattaagaatttctgtatttcaatgtttatcggaagtatttctccaatatttaaatgctgaaactatccaagactattattcacaaacaacggattatattttaatactcagaaactgtaggaaggtttgttaaataagatgaatatcctgtgattaacttgccagtatgttgggttcagtgatttattatgcctggtcttttctgattttagttaatgtttttaaagtttgttaattctctcagaagatgaggatgccaatttatatcccattatacaccctcaaaagatgaatttatagaatgggccatgtctttaacatgcttctatatagtcattcttatacctaagattcagatgctcaaggaagggacccatttagacagttatttaatgttctttgactatgaactaatcctaattttaattttagtacttttatgttcttaccagctttcaccctaattaaatggggcactacaccgcagagtttagcctgtggtgtagcagagcccaggtcatctgtcacagagaatcrtaatcttacattctctctctcctctgaacaatagaattttgaggtgggggagaatcttagtttataatgaggcaactctagttttatcacactcagaaacaacaaaaatattcaaaatttaactttctgtgcattccatttatttgcaaatatatatcagtatgattattacatgagtaagagatcttcattttttactgtcatccctgatttgccaaatttgatggagaacctccacagagttgcatattattttatttgttccacatgttggtgctttgttctctactgtccttttgtcattatattatctctgaacatttccatttagtgtttctatttagagtaaagaaatagaagcatgaaaattaataacccatgcatcatattttttgctggactttataggaatgaccagctaaggctagaaacctcagtgtttaatactgttttcaaaatttgattgttacatatattgtcatttcagtgactggagacaagatgtatatgtagacaaatagataaaaacagggtaattaaaccagtgtggtttttttttattttaaaggaaaacacatacgacttatgtacattgcatggcagagtattactaaaattcgcctaaacaaaccrtcacgatgttttcaggttttatggtaatgctttgactatatagtatttggatttgaatcctcataatcacaaagtctcttagttgtttaaaacaaaaaacaaagactatactgattctagaaagtatcatctccttgattatatttgtgctaagtgtatgaatctgtgctataccagtatgaaaaaggtaaaactgtatatatatttacattttgaaaagtagcattgtgcattttagaaaaatatttgtcaacttgtggcactttggcaaaggaatgtgcaattataaaggttaatgccactttatttttttctaattcccagtaattattcttactaggctttagagtcaaaatcaaacccaattttaagactagcacttttttcctactggtaattcctgtttttctaattacacaaaatgtttaacttaaactattctttgcaatgagttttagctttcctcctctatcctaayttcaaaacctttaatttaagaaccatttaaaattaatccagtggtaaccagaagaatattttaggtatcatgaccacttaatcttgtgcctgattttagtaattttctgataaaaataactgaattcctgaaaaagaatattcaaactttttaattagttttcattggtcataaataattgagtagttgatgtccatatagtcataatttatctaaactctggagctgccaagacaactaagtacacagaagtgcttaaaacacacccatatcccctaaagagaaatgacaagacttggaagcatcagaattctgtattattatgagtatcacatatatatatgctattttatatatacatatatacccatacacatacattctgttaggttaccagtattttactgtcatgcacccatgggtagtagaaacaaaataaaaataaatataaatgtttaactttaggtgttggcaccaayatagattatgcataaactgttgcaataaaagatactcattgtgcctgtacctgaaaaatttaccttaggttttctctggccttttttgtttaggcctgcatgatcattttaaatgtaaagatagcaggatatatgaatgaatggataaaatgatggccctgtttgccatgggattaactattctgttgaattttctgaggggcattggctgctgtatattacgccataaactatattgttcagaagcaacatgagtgtatcacagcatttagaaattatacatccttcgctttccccacaaaatgaattcagaatcgacattcaagtttataattttaagctgctaattataaaaatatattaataccttakggattgaagattacatgaaataagaactacaaaagaatgctaattaataacataactccatatgctatcaaacttctgatagcactgagtttcttataaagccttaaaatattttaatgataaattaattacctggaaaagaaggcactttattaccttgaactagctattcgtctgtatagaatatgtcaaaaatcccttaaattattctttatccttttataaatttatcctagttacatgtttttctgaagcctcttatggtataatgtgttaattcaaaaactattgtaacttaacagaaaaattgttaccaatataaccaatgaacaatacagaaataaaactcaagaataacaaaagtatatgtgataacaagactgttagtctaagttagtctacaatcatttgagattttaaaatgttgtaaaatttgaaggctttttcattgaacaatttttggacagtttttatttttaaatctcacttttaattggtactgccttgtcttgaaatgttgatcaaatgtaaaggcaatcataattattaagccagtccattataattcaattttgttttagttgagattttttagtgtaattctaaaacattaaaacatctgtttgtttcttttttgctcaagtcagccatgcctggtgaactatcaaatttaaatcatcaacatggatgtgctgctgtgtatagctgtttcctcttcagaaaattagtgcttgatttatacaaggaatttagttcagcagaaaaagcataggataattttttcaaaagggttcaaccctctcaagtgaaaccttaacatctttctgacattcataaggataggcttttatccaagaaattttttcaacagaaaattatttcaaagtggacaaactccactttcttttttgcttgaggggcagtacacttttacaaaaacacatttttctgtaagtttacttatctttaagtcattctctgtggtggccatttttccatctctaattttaaatgttttactaaatgtacgtgcagtttcatagacagtctgatcattacatgattacagaaaggagtcaagtttatcagaggtctatccttgtgaaggggagaccaaacacaaattccatgtcagttgtttggtttggttctttgttttcttttaaaaacaagatatattaacccaaaggtgtgttaatgtcatggcatgaacaatcttcaatgtagacctattgagtattttgtgatgctgagtaacagacgtttctcaactctctgtgatgctaaatattttccttaggaagttttgtttaatgttagattgttgttctgaaagatgttggtcctagtgggatttttttaaacttggaaaacaaataaacgcatgtattacaaatatagaaatggtgaattgtaaacttaccatatagtactgatttctattttcaaaaatgttttgctgttaaatatatacaacataaaattgctgccgtactgtaattgagtactttttcctaaacgaccctgttatcactattccagaattagaaggtgggcagatacatgattgattcatgtgtctgcatagatgcttcaaggtatattcttctcttggtgagtaaaattatattttccttggcatcaatgcattgagatctgaatatacctgtatctatcaatccttattacacatttcttaygcagtagcttcaaataggccaaaattggcctagacacaactaaaaattgagggtttgttacatgctttctaacagaaaggttttcaacgagattaattatgggtttgtactgtgaaaatagtggaactcccttgaaaacttcatgtttgctaaattcaaattaatattttttctttagctcacaaattaccccaaatccagagagaatatcaacctttttcactgttgtcaaatcaagcataaggaacagccccatgatactacaaaaacagttgaggaataaggaataaatctcttatgttacacctcagaataaaggcattcggtgaaagaaatgaactgaagttcatcatgaatgcaaggcctcagtacttgacattcctccacggaagggaagacaagtatcaacaccactggcatcatttccaaactgatcttatgttgaataatttccaccacattgaagtacctttcgactctatccagtttttgggttttgttttttttaattcatcaagcctttcgttttcaaaccaccatttgtcagccttgaggtagagagacatatagatttgaaaatactttcttaagagatcatgtaactatataactctgaatttaaaaattgaggggggagggataatttcaacccactgcctcttaccagaaacatttttttaaatctgtaactgctttagtgttaacagggtgcaaggtggtttttgtcccgtattgttcttaaaaggttctcatttattgtgattgtattgtactgtatgagaacaaatcataaattgccttgtattgtttataatagaccataccacgtactacttcagtttttatgttccaagtttttcagtgatgcatgttaacagttaggtcctaaaattctgtggtgctaattctcccatacccaatggtgcttttgtggatgctaactgcacacatgctgaacaaagcttgaagtttaaaactttcctcccttcctctgtttatatgaagtaaaatgaaataacttgaatttgtctcaaagtatcactgacaatctaataaacttgtttatatgtgtgattagtttggattcttaattattttaaggaaagcatctcagctctattgggccccaaaagttgattttgtgtttatttcattatgtcatttgtgcccccaaattcgtggtatctttataaatttcaatgcagtttgtctggcttccaaaatcatgtttaggtaggatctatagaaactagacctatcagaactggaaataagtaagttgagaagatcaaaaatgtgccaatccagtctattacagtgcctttattgtaatttattaataaggttttatcacctggttgagccgggagataacacttgcacgaaagcaagtatgccttcaaaacctttattgcaactcacatgacattgaaaaggccatttctatatgctgatattaaaagttccacttctcatatatgaaaatagggacaaaaaaattaattttgaattttccaggacaaactgacatcatatgccagaatgtcatagtagataaactcatggcaatggttttattggatttttatcttctgcatctatattaaatcacaacagaaggccaagtgaacctgctaatatcttcatgagggcagagggctgtttcttccaagccagggataaattcaatataaaggcactatgtaaatttgcattccgaccttggtactttgcctaactcaagggtaatgttaaaatttgaaaagaaaaaatcgaaacaaatgtattaaatctccttgagcaacaatcattgaccataaatagaagatgatcaaacctatatcagtcaaagaatctagcaggtatgatgactgaaatgatattcccataccactatggttctttattatataaagagtttcaggcccagtaaatttttgcctcaaatagctattaaattgtgtctaacttctaacatcagaaaatgaagtttagagaatagtgccagtgtgaaccctaagcttgcttctgtgactatctgaaataaatgcaatatttactaaatcacagcctctcaccaaagatatttctacaatatatttttgtaactaccttaactgtattccattttatgaaaactggtaaataataaatgtactacaaattaattgcacattttcttttggaagaaaaatctgtttaatctacatgaaaatatctctaattttacacccacagtcaaccagatttctgtattaattttcatcattgtcccatcaaaaagattatcctgaaaaatgcatatcagctttcgttggtagtggtgaaattttttaaaaaacttatcagccttaaataacatgaatatattttgtaagttttgttcctctataaaaataatgtagtccctctctaagtgaaaccattttttaaattacgtaattatatccattttcattgcattattagcattatttaggtaagttgtcttttctgttcctaaaacagtaattttcccttagagaccttatgctcaaggtgttttccctaaatccttatgggaaagcattttcaaaaacagacccaaatgttctctttccagtaaggaaaatctttcgtaataaattccatgtacactaaaagcataacagtacttgtattagggaagtaatttttctcatcagaaattgctttgagtttgaaaatggccaataataataaaaagccaatctgcagtctacataatttcagatttgtcttcatgcgatctttttaaaaaactgttgaagtaggtgcatactgacttgcactaggactaaagttatttttcttacctcctactttatcctttatccttggcagggattcaagagaggtgaaaagacttttggaaaataactaaaaagtagtacaacacacacaaaataagggagtggtagttcataggactgaataaatcatgaaattcagtgaattcagcactacacatattatgccaaattgttctcctcttacacttttcgcgaagcaaatttcccatcataaaagacttaacaaaacactggaacatgaagatcaaaaggactgaatgaaaaggctggccctcagttttgtgcatttggaagttcaggtttttttttagctaagaagactttgatgaaggaagaagtaaaaaagaaaaagaaaaaaagaaactcggttttgttagttcattctgagtgaattcacaagagattccttttaaacaaggtcataaagaaaacatcttgaatatcagatattcaatggagaaaccaattaacttacaacaaaaaataaattggtacacccagggagtggattggaaagaagctgtgcatgagaagtgaactttgaagtttgcttttatactttttgaatattatttcatgataagcttgtattattttataatttataaagtacttttttttttaaaggaaagaaatcaaatgctagactgactagaatacctatatcaactggtcagcacattctctttccagtaggaaaatctgccttttctttctttttttgagacagcgtctgactttgtcgctcaggctgcagtgcaatggcaggatcacagctcactgcagcctcaacctcccaggctcaagcaatcctcccacctcaacctcccaagtagctgagaccacaggcacgtgccactatgactggctaattttttattttttgtagagacagcatttccctatattgcccagcctggtcttaaagtcttgggcttgagcaatccttccaaagtactgggattacaggcattgaaccactgcacccagctggaaaatctacttctaaaacctgcttaatgtcagaacattgattggcaagcataaaatcaggtaaaggggaatgactaatattcatgaatggcatcatgttatgatgggcttcatgatacagacctgccaagaaacaggaataaccacatcagcatattggctcagagcacagtcaccccaagtcagggatggaaaccactaacaaatccttatgctttaaatctttttttctagattccatgtgacccaccatctttcagtgtgaaaattattgcttatatgattaagccacatattatcttgcatttagtatcactttaggattttcaatgatagaatactgttttataaatatcattcatcattaagcattaacattaatcatattacataatcatatcattacattaatgtataatcattgttattattttgcttgtttgtttgtttttgagaaatagagtctcagtctatctcccaggctggagtgcagtggcatcatcatggctcaccgcagcctcaaactcctggcctcaggcaatcctcctgccttggcctcccaaagtgctaggattacaggcataagccactgtgcctggcctgttattttttataatcatcattaatcattaagtatcattaatcattcactcttattataaatatcattcatcattaacaaaagttttacatacaatagctctctgaccatgacccttcttaatagagatttagggaacatccaaattcagcagaagtgactaatgaaagatcaagatgttcctcctttaaccctcatggtagaccttgccaataaacgatagcaactgggagcagctcacacctgtaatcccagcattttaggaggccgaagcaggcggattgcttgagcccaggagttagagaccagcctaggcaacatggtgaaaccccatctctagaaaaaatacaaaaattagctgggcttggtggcatgcacctgtagtcccagctactcaggacgctgaggctggaggatcacttgagcccaggaggtcgaggcttcagtgggctgtgatcatgctactgcactccagcctgggcgacagagcaagaccctgtcttaaaaaaaaaaaaataggccatagtatttatttcaaatggccagatacagctctagagtctttctcaactcagcactctcctggcagctgctcccagttgactacacttagcatgcaagattgacatagttgcctttctaccttagacacccaccagcacatatacatgccatctgtgttagtctgggtcctccaagaagcagattccaaggtggaattagatgtgcaagagatttattaaaggaaatgccagtgagggaaaatggagaaggagctggtggaggagacatcagactcagatgcaagtctgcccctgtgaggaagagaggaggaaagaggagggaggtagaaaggaagttacttcttagactgcagcacaattataagcaagtttcagccaggcctagggggagtccttgagccaaagtcactcttcagaagaggccagcatcttgagggttcagcctgcttaatatccctgtcacacccagttattggctgggagcagcctaggagaagcccacctgcagggcaaacgtgacgatagatttcagagcaccacagctggatctgtgggccagttgggtggagacttagagctgttcagtgcccataggagtctgtggtggctatgaaaatgcatctctcaaatttccttctaccgggagcataactgactcacgagctatttctgtattctgtgatgctagtctttggatggtgtggttttcatgttctacttacaccatccacctcctttgctgtgaagtggtcccttagttggatgcctctgtctctgctgccatggccactctattgctgtgcccatcctgccaattctgaggtggccaatggcagtctgattcaggtcaactgtccgagtcactttgtcaacttggttgttcagtgcctctcccatgatggatggcttctggtggacattaacatgtgatacaaaactcttcacagtctgggctgggtgtggtggctcacatctgtaatcatagcactttgggaggccaaggcaggtggatcacttgaggctgggagttggagaccagcctgggcaacatggtaaaaccccatctctactaaaaatacaacaacaaaaattagccaggcgtggtggcgcatgtctgtaatcccagctacttgggaggctgaggcaagagaatcgcttgaatccaagaggcagaggttgcagtgaatcaagattgcaccactgcactccagcctgggttacagagtaagactccatctcaaaaaaaaaaaaaagttttcacagtctgtgcctgctcccatatgtgcacccacaagcttctaccccaggcctcttcgaccctgtcttccagtc

SEQ ID NO: 17816 - DNA, 14804 bp, Homo sapiens
tcaagaccctgggtttgggaagtgaaaggaagtcccaaggtgactcgggaaacaggccagatgtgagtagaagaaatgtccctatttctcaaagccacctccctttatcttcttctaaacccacagattcccaaaagtgccccaaagatgcccaagtagaggttaagggagaagcaaggcaccgggtactactgtttgcagcaaacacggatgctggcctgcccaggggcccctctctcctttcggattttattcaggaatcatcgttggtctcaggtgatcatgacacagctattctcctttgccagtgactgacatgagattcagatctcactaataagatgtaagaggatgtctcctgggagcttttggaaactgtttcatccctgaaaagggaaggcacatgaagaaaaatccaacatccttttgctactgacttcttgcttcctgttttgtatcctgccatgtgaaaatacagcatttggagatgtggcaactttgtgctggccatgaaggaatgcgtcccccacacggcagagtacaaggaccaaagaagccaggccatcgccccaggccggcctccctcactggataaacagcatatgcccttatgctgcatgagctggattttccctttcttgtggctgaaatgcatttggatacagtttgtttatactcatagagtcactgtaagtcaggggcttattgtcaggaactacttaacactttgcttaggatattggatttaaagaaaggaattttggggaatccatgctatagaaataaaagtatcagtaagtaagagggggaaacatacaaatttaaaatgtgcacataagaaacttaatagtaactcctccctgctgggggcatgggaagggagaaatgaaggaacaattatttttcatttggtaccattctctgtatggcttggattttcttgctattatttttatttgttaaaatctgggcagtgcaataatggggcacttctatttcttccgttttctgtattttccatttccctctattttctgtattagaaatacactacttagccggacatggtggctcatgcctgtaatcccagcactttgggaggtcaaggcgggcagatcacctgaggtcagaagttcgagaccagcctggccaacatggtgaaatcctgtctctatttaaaaaaaataaataaattagccaggcatggtggtgggcacctgtaatcccagctactcgggaggctgaggaagaagaatcacttgaactggggaggtggaggttgcagtgagccgagatggcaccaacggactccagcctgggtgacacagtgagattcttcctcaaaaaaaaaaaaaaaaaagaaagaaaagaaaagaaaaagaaatacactacttaaaaataaaaggaaatgttatattggcatgtctagagaattgctcctttctcctcctccagggaggaaaacagaggaccttatatttagcaatccagcatcactctcctgacattccctctagtagagaatcatgcctaactaaagagctcagagctcacagatagatcacctctgaagccatgtccaggcaagggtcaacaagaatgaaaacacagggtaacacacaaagcattcagtccacaaatcacaggcatcagtctgacttctagtcatacttttgcaaaaagaattccaagagttccagtatctagtctaaatcttataaaagatttatgcattcctgagtactgtttaatactataactaaacactgatacagcacactaagacagttactggatacaaaaaacaatttctcacttaggtaattcattttttatttatttatttattttttgagactgagtctcactctatcactgaggctggagtggagtggtgtgatctcggctcactgcaacctctgcctcccagattcaagcgattctcgtgcctcagcctcccaagtaggtgggattacaggcacccaccatcatgtccggctaatttttgtatttttggtagacagggtttctccatgttggccaggcttgtgttgaacttctgacctcaggtgatccacctgtctcggcctcccaaagtgctaggattacaggcgtgagccacctgcgcccagctgcgaaatttttttttttaatcaatccattttcaaatcaaagtatatactgcagattccagcctagttatttcaactcagaactcctcagcttaggcctcttaattgccttatttcataagaagctgactcactcaaaggtcacaaaggcagcgatggcagagccaagatcagaagtgttaaggctgaaaacaggaagagggcaacagaatgtctgtggaggtgctcaaaggttaggcacaattttccttgggcactactcagaagccagccaggaattaccttagttctgtggttctctgcattcagtccctcatatagagatttgttgaaagatatttcaccaaggatctgcagttcagttacatcttttagtaactagaagatggggaaaggaatgagggaaacaaaacatattttagacatgaactcactgtgtttgaacagccttcaccacctttccctttaaaggtattcctgggcttagttaatggccctaacgtacacaacactacataaagttacccaaacaagacatctgcagttattcttcaacttccttttttttttttttgagatggagtttcgctctttcgcccaggctggagtgaagtggtgcgatctcggctcactgcaacctccaccccgtcaggttcaagcgattctcctgccttagcctcccgagtagctggaattatgggcatgtgccaccatgccaggctaatttttgtatttttagtagagatggggttttgccatgttggccaggcttgtctcgaactcctgacctcagatgatctacccacctcggcctcccaaagtgctgggattacaggcgtgagctgccgcgcctggccttttcttcaacttcttttcccttgtgccatccaaagtcagttcttgactgactgacttatttttgagacaggatctcgctctgtcacccatgctggagtgcaatggcatgatcatgggtcactatagcctcaaccttccaggctcaagtgatcctcccacctcagtctcctgagtagctgagaccacaggtgcaccccaccacactgggctaatttttgtattttttgtagagatggggttttaccatgttgcccaggctggtctcaaactcctgggctcaagcaatccacccaccttagcctcccacagtgctgagattacaggcatgagccaccacacccagcttattcattttatttaacgtaagagatttttcctttttttttttttttttttttttttttgagacaaggtctcactctgttacccgggccggaatggagtggctcaatcatagctcactgaagcttcaaattcctgggctcaaacgatactcctgcctcagcctcccaagtagctgggactacaggcatgagccaccatgcgtggctaatttatgtatttatttatttttaagaaatggggtttcactatgctgcccaggctgatcttgaactcctggcctcaagcaatcctcccgcctcagcctcccaaagtgttgggatgacagatgtgagccaccacactcacaattctttttttttaaattatttcttgtatctgtccctttcttttccacccccattgctacttcttcagttgagacctcacaaatgtcacctggatcactgtaaaacattaaacttgatcacttgatcactagttcccactttagaataagtgatcagggaaggcctctctaagaaaataacacgtgtggccgggtgtggtggctcatgcctgtaatcccagcacttcgggaggctgaggtgggtagatcatctgaggtcaggagttcaagaccagcctgaccaacacgatgaaaccccatctctactaaaaatacaaaattagccgggcgtggtggctcacgcctgtaatcccagcactttgggaggccaaggagggcggatcacctgaggtcaggagttcaagaccagcctcaccaacatggagaaaccccatctctactaaaaatacaaaattagccgggtatggtggcgcatacctgtaatcccagctacttgggaggctgaggcaggagaatcgcttgaacccgggaggcggaggttgcagtgagccgagatcgtgccattgcacaacaagagcgaaactccgtcttgaaagaaagaaaagaaaagaaaagaacacctaggtcgggtgcggtggctcacgcctgtaatcccagcactttgggaggctgaggcgggcgatcacctgaggtcaggagttcgagaccagcctggccaacatggtgaaaccccctctctactaaaaatacaaaaattagctgggcgtggtcgccggcgcctgtaatcccagctactcgggaggctgaggcaggagaatcacttgaacccgggaggcggaggttgcagtgagtagagatcgtgccactgcactccagcccgggtgacagagcaagactccatctaaaaaaaaaaaaaaaaaaaagaaaagaacacctgagctaaatttaagaagaaaccacctacgtcaggacctagaggaagagcagtgtcaagcaaaggaacagcaagtacaaagtcttgtggccagaataatgctgtactggcgagctagaagaataggacagaataacccgattataaaaggggcagtgggagagaaaggcgagtactaggagatgaagttgaagaattaagcagagaccagatcaagtactgccttgctctggccatgaaaaaagtatggattttagtctaagtgtgctcaagcatcagttttgtttgtttgttatttttaataagcaggggaatggcacaatctaatgtctgctcttagaagacggatagctgttacgtgggaattatttgtaaagaatgtgggaaaagcagaggcaagaaaggcaggccgaaggttattgcaacagccctggcaagaaagggtagcttgaattacaacggcagtggaaatggagagaagtgaatgggtttaggatatattttggccctgaaatggcagggcttgctgctggaatagacgtggggatgtaggaaagaggagtcacaggtaatccctcgagttccttgtactgtaactggagtatatctccctcctgagggtagctaaggaacgggttgggacagagggttggttttttgcaccaaaagatctattttggacatggacatgttatgcaaagatgctattatctcttctaggggcgatgcccgtgagcaactggataatcaaatctggagcatttcagtctcaaacacctcctcagagtgatcccaggagatctctgcagccacggtgacattttctttatctgaagcgatgacacagctcactgaatgccattcttccacatgctggaaaagcgaggtctagtgaacacaattcctttccgtgcggaaagtctgaaatctttttaacacttcggacacagagcatcgtaaggtcccagaatagagggtgtgagcaatttcagcgctcacctcggcccaagcgaagctccagcgggagcaattgagacccagggacgaagctagggagggcctggcagcccccggcactggccggcaggggtaacccaggaaaaacagtctcctggcctctcgttacccgcttcaggccctccgccctcccctggcctctcgggacggccgcgcttacctgaaccgaactgtacgcacaagcgcgctcctgactccaggtgcacaccgtggaggcctgaaacgagagccatgaccgcgacgcgctgaacaaaccaagccgccagttttccgtcccgtcccggccccggccctggcgaggtgcgcatgcgcagggccgggagctaggaccccgcggcaggcgggcgcgtccgcgtcgcacggaagtctcgcgatgtttgcgtttgaacctcttggcgggtgccggccatggcggcttcgctcccgggacctgggagccggcttttccgcacatatggggctgcggacggcaggagacagcggcggccgggccgggaagccgcgcagtggttcccgccgcaggaccggaggcgtttcttcaacagcagcggcagcagcgacgccagcatcggcgacccctcgcagtccgacgatcctgacgatcccgacgaccccgacttccccggcagcccggwgaggcggcggcggaggtgtcccggcggccgagtgcccaaggaccggcccagcctgaccgtgaccccaaagcgctggaagctgcgagctcgcccaagcctaaccgtgaccccaagacgcctggggctgcgagctcggcccccgcagaagtgcagcacaccctgyggcccgctccgacttccgcccttccccagccgcgactccggccgcctcagcccggacctcagcgtgtgcggccagcccagggacggcgacgagctgggcatcagtgcctccctgttcagctctctggcctcgccctgccccgggtccccaacgccaagggacagtgtcatctcgatcggcacctccgcctgtctggttgcagcctcagccgtcccgagcgrcctccacctcccagaagtctccctggaccgagcatctctcccctgctcccaggaggaagcgacaggaggagccaaggacaccaggatggtccaccaaacccgcgccagcctcaggtcagttctctttggccttatgaactcaggaacccctgaggattctgagtttcgggcagatgggaagaatatgagagagtcctgctgtaaaaggaaactggtggtgggaaatggaccagagggtccaggtctgtcaagcacaggcaagaggagggccacaggccaggactcttgtcaagagagagggcttcaagaggccgtccggagagagcatcaggaggccagtgttcccaagggccgcattgtgccaaggggaayagacaggctggagagaactagatcaagccggaagagcaaacatcaggaggcaacggaaacctctctcctccattcccaccgctttaaaaagggccaaaagctgggaaaagattcgttccccacccaggacctgactcctttacagaatgyctgcttttggaccaaaaccagggcttccttcagtttccacaagaagaaaattgtgactgatgtgtcagaggtctgcagcatctataccactgccacttctctctctggatccctcytatcagaatgttcaaaccggcctgtcatgaacagaacaagtggtgctccgtcctcttggcactcctcctctatgtatttgctaagccccttaaacactctaagtatttcaaacaaaaaggcatctgatgctgaaaaggtttatggggaatgcagtcagaagggtcctgtcccctttagccattgccttcccacagaaaaactgcaackctgtgagaagattggggaaggggtgtttggcgaagtgtttcaaacaattgctgatcacacacccgtagccataaaaatcattgctattgaaggaccagatttagtcaatggatcccatcagaaaacctttgaggaaatcctgccagagatcatcatctccaaagagttgagcctcttatccggtgaagtgtgcaaccgcacagaaggctttatcgggctgaactcagtgcactgtgtccagggatcttaccctcccttgctcctcaaagcctgggatcactataattcaaccaaaggctctgcaaatgaccggcctgatttttttaaagacgaccagctcttcattgtgctggaatttgagtttggagggattgacttagagcaaatgcgaaccaagttgtcttccttggctactgcaaagagcattctacaccagctcacagcctccctcgcagtggcagaggcatcactgcgctttgagcaccgagacttacactgggggaacgtgctcttaaagaaaaccagcctcaaaaaactccactacaccctcaatgggaagagcagcactatccccagctgtgggttgcaagtgagcatcattgactacaccctgtcgcgcttggaacgggatgggattgtggttttctgtgacgtttccatggatgaggacctgtttaccggtgacggtgactaccagtttgacatctacaggctcatgaagaaggagaataacaaccgctggggtgaatatcacccttatagtaatgtgctctggttacattacctgacagacaagatgctgaaacaaatgaccttcaagactaaatgtaacactcctgccatgaagcaaattaagagaaaaatccaggagttccacaggacaatgctgaacttcagctctgccactgacttgctctgccagcacagtctgtttaagtaagctaaatgtatcttactgccccgaaatgagaggagactggtcttgaagcctctggtgctgtttcaacctccrtccccacaggagggtggaactcccattctcacaggtttccagtcagcttttcaaacaagaattttgtttccaaatggaaactgaaatatttgttgaaatgtttaaatttgctgataacaaatgttctgaaagaagtaaactagccgggcrcagtggcgtgcgcctgtartcccagctactcgggaggctgaggcaggaggatcgcttgagcccaagagttcatatctagcctggtcaacatagcaagacccctgtctctatttttttaaataaataaactacatgtgaaaacaaacgtttatatttataaaccctcttttttttttttttaattttattgagacagagtcttgctctgtcacccaggctagagtgcagtggtgcgatctcagctcactgcaacctccgcctcccgggttcaagcaattctcctacctcagcctcccgagtagctgggattgcaggcatacaccaccatgcccggctaattgtttgtatttttttagtagagatgggggtttcaccatgttggccaggctggtctcgaactcctcaccttgtgatccacccacctcggcatcccaaagtgctgggtgattacaggagtgagccatggcacctgacctataagccctctttctaattgtcagcagagtcctttctgtaaattcctttccgttttttgagccttaacacttatgtagtctgagcaaaaaaaaaatgcccaggcttcagcttcatactgagcagagcctgttgcttcaggtatcaaggctagctttgggaaccagactacagatgagacaactgaaagcaaagaggctgaggcaaagcagagaccaaaaaagagtctcaggggagaagaagggaagctagtaagcaacttatagggggcagtgtaagaaatgtcacatgttacatcactcacacagagaagcagaatttatcaattttcaaagggaaaatgtctctgtctactgacaaggttttaatttttgcttttttttttttttgagatggagtctcactctgtctcccaggctggagtgcagtggcaggatctcggctcactgcaagctccgcctcccgggctcacaccattctcctgcctcagcctcccaagtagctgggactacaggcgcccgccaccacgcccggagaattttttgtatttttagtagagacggggtttcaccgtgttagccaggatggtctcgatctgctgaccttgtgatccacccgcctcggcctcccaaagtgctgggattacaggtgtgagccaccgcacctggccaatttttgcttatttttcctcaaagggaggaaaactgacaggttgctttaagagctgagtgattgagagtccttctgaacaggacttcgggaatttactcctaatcttttcccatggttaacttgtcttcactctgtttctagaactctggtttttatacttgagactctgtagtcactgtggaaagaggtgtgactgataaagaactgcctttaaatacctgagtcctcgtcagcttcttcactgctacaacctggagacctcgtaatttggttgggacgcaaatttgcaactggtattctgctccaaagaggttctccccatgtacctgcaaattaaaatcagagtaggaaatcaaagctggtattgctttgccatctacagctttacaataataagtacttacatggaagaggaattctttgtggtgagaaagcccctggcctgtgttcacgtacattatggatggtctgcaattgacaggacatgcgtcagcccttgaggagtctttctcccttttttggagacagggtctcactctgttgcccaggctagagcacagtggaacaatcatggctcagtgtagcctcaacctcccaggctcaagtgatcctccacctcagcctgcgaaagtgttgggatgacaggcatgagccactacactcatccctttttttttttttttttttttgaggtggagtcttgctctgttgcccaggctggagtgcagtggtgcgatctcagctcactgcaacctctgcctcctgggtttaagtgattctcctgcctaagcccccaagtagctgagattacaggcgcctgccaccacacctggctaattttcatattttcagtagagacggggtttcgccatgttagccaggctggtcttgaactcctgacctcaggtgatccacccacctcagcctcccaaagtgctgggatgacaggcgtgagccaccgcacccggccttctctttttgaatgaactcgactgctttcaactgaatacattaggacagagggcaccagacctttaccaggaatgaggccgggtgcagtggttcatgcctatcatcccagcactttgggaggccgaggcaggcggatcacctgaggccaggagttcaagaccagcctggccaacatggtgaaatccctgtctctattaaaaattttttaaaaattagctgggcctggtggtgtccacctgtagtctcaactactcgggaggctgaggcaggagaatcgcttgaacctgggcggcagaggttgcagtgagccgagatggcaccactgcactccagcctgggcgacagagtgagacttcgtctcagtttaaaaaaaaaaaaaaaaggaataaaagctgaatgtcaaaatataaagtggtcgtagcgcagttggggtgaggtggaatatttgaattctgtatcgttgggctggttcattttctaattatccctcaaatggccttactcatcccctccttacttcccagtcccacagctgccttcttccctccacagcgtcatattaattcccttttgtagcacgactagttggcaatacacctcctttgatgaccacagtggggtttttgtgacccaaatgttagcaccctagagatcaatatcagagcctgggttctaagcaggctcctctcagaaggacagtgtccacattcatcctgaccaccagctccatctacgagagagagcccaaagctgccccctgggcgatggagtcacaccgctgctggcctcttgggagtactcacttggacagaactgcaacgaagccatgcctgaattgaagggtgtgggtctcgttggccaaagaccgtctttcattggaactaggaataagagtgttagttcatagcacacctgctttgtacatagcaagtgcttcttaaaaagggcttcgctctgttgcccaggcaggagtgcagtgttgccgtctcagctcactgcaacctccgccccccgggttcaagcaattctcatgcctcagcctcctgagtagctggaattacaggcgtgagccaccatacccagttaatttttgtatttttagtagagatggggtttcaccatgttggccaggctggtctcgaactcctgacctcaagtgatctgcctgccttggcctcccaaagtgctgggattacaggcgtgagccactgcgcctggctatttttttaagttccagggtacatgtgcagatgtgcaggtttgttacataggtgaacgtgtgccatggtgctttgctgcagctgtcaacccagcacctagttactaagcccaacacgcattagctattcttcctgaagctctccccaaccctgcccctcccacaggccccagtgtgtgctgttcccctccctgtgtccatgtgctctcactgcagaacaggtgcttctgcacctggctccccagggtcactgggagtcagataagaaaaggctctcagaggctgggcgcggtggctcatgcctgtaatcccagtgctttgggaggccaaggctggtggatcacgaggtcaggagttcaagaccagcttggccaagatggtgaaaccccatctctactaaaactacaaaaattagctgggcgtggtggcgggcgcctgtaatcccagctactcgggaggctgaggcagagaactgcttgaacctggaggcagaggttgcagtgagccgagatcacgccacagcactccagcctgggcgacagagcgagactcgtctcaaaaaataaataaataaataaaaggctttcagagataagcaattggagttcagaattgtctctagaagaccacacttagaagaatactgattttaaaagggcttctcagcctccacactattgacgttttgggccagttagttcttggttgtgggggctgtcctgtactgctctgcgtgatgtttggcagtattcctggcctctacccaccagatgtcctactgaacacccccctccccaagtcatggcaatcaaaacaggcacagcctctggtgggcagaatcacctccctttgagaactcttcccagcagcgttccccaccttaccccccaacacagaggtcttgcagataacatagctatcccaagctattccaaagctgagtgaacgagaaccagaactccagggctcattccaccaggctgtaccacagttttactttgtgtgtgaacaaaagaacattttcattatctctggtaacaagaagagaaagtcgagtccctgcagggaaacagatgccttctgtgggctcactggggtttcctttctccctgggctgtaagggggccgttcctctcacagcgtgcatgtggcagggagatgtcttccggggtcatagcctgactctgctgtgacccaggcagtacttacttggtgacagtcacagtgatgtctgctgtcctgtttggaaaggcattctcctctagctgccaaacgactgaaacatgagcctattttaaagggggaaaaatggtcagttgattctctctatgccactcacaattcagaccgctagctactcgtggaacagacctaggagacgattcctcagattttcacattcctcacatttttctaacacagcatgtttcctttcccttccttttttttttttttttttttttttgagagggagtctcgctctgtcacccaggatggagtgcaatggtgtgatctcagctcactgcaacctctgcctcccaggttcaagcaattctcctgcctcagcctcccaagtagctgggattacaggcacgcaccaccacgcccagctaatttttgtattcttagtagagacggggtttcaccatgttggccaggctggtctcgaactcctgacctcaaatgatccacccacctcggtctcccaaagtgctgggattacaggcatgagccaccgcgcctggccccgttatttcagttaagcctcaaatacaaatatggagtaagcaaggcaggcggcctcattccccttttacaggtgaagaagccacttcagagatttcccacagcacagagatgacaagggacagatcagggttaataacttttcgtcttggccgggcatggtggctcatgcctgtcatcccagcactttgggaggtcgaggcaggtggatcacttgaggacaggagtttgagaccagcctggccaacatggtgaaaccccatctctaccaaaaatattttaaaaattagccgggtgtagtgctgcacgcctgtaatcccagctactcaggaggctgaggaaggagaatcacttgaacccgggaggcggaggttgcagtgagctgagactgtgccactgcactccagcctgggtgacagaatgaaactccatctcaaaaacaaacaaacaaaaaaactttttgtctgacacgccctccatactacccacaacttcactctgcttcacggaggtgagcaggcagttcacctagggctgtgtactggaaagctctcgtccccatcaccccctactttcagagccagcttagccactgtaagcactgctggggacacactgcagtcaagcgaagcgcaaagctggaaccgagagattgagatgagaccaagatgcagaagacgccaactgcagggtggtgagaagagcgaatcggtccaaaccgactcacagatgacctcttgaggacggggtgaccaatcctgcagttcatgatcaggacagaagcaaccggctgagggtcatcacactgaatgtttggagagggaggctgttaaaagagcagatgacattctcttaaagagccaaacaaaacaaaacaaaaacgtggtttcctcacagcaattcagcaaacattcactaatttttctgcctgtcagacaccctgccaggagctaaagaaataaagtccacttggtccctgtcttcctcacaagccggacaggcagggtcagcagtagatccccgaggaatttaaatacaaggtcgaaggggtgcttctgtgag

SEQ ID NO: 17817 - DNA, 21739 bp, Homo sapiens
actgtttagccattgaacttttgatggccagtgagtatgactggggcccatccaggcagggtgtggagcagagggccctcctttatgggctggactcactagtgggctgcttacctgtgactcacctccaaggctcaagttaatgctaacgtgttgatttgctagaactctgagctgtgcctgtgtctccttgggccctgggagatttttttcttttagcagtattttatggagatattgtctaggtagagtaaaatgtacagatcctggttttctgttgagttttgttttgttatgaggcagggtcttgctctgtcacccaacctggagtgcactggtacaatcatagctcactatggcctcaacctcccaggctgaagcaatcttcctgcctcagtctccctgtagctgggactacaggcatgcaccaccatgccccactaatttttttgatttttagtagggatgatgtctcattatgctgcccaggctggtctcgaactcctgggctcaagcaattctcctgcctcagtctcccaaagtgctcaattacaggtgtcagctgctgcacccagcctcagcctgttgttaatggatgtaaacacctgtgtgaccaccacccagaaccagatccagaacatttccaggctctcgaagactccttcgtgcccgtcccagtcagagacccccaagggtaatgccattctggcctgttgttcaacttgacttgaatggaattttcacagcatgtgtctgtttggatctggcttcttctgctcagttgcgaggcccattgatgtttcctgtggcctagctcctttttattgctgagggccactcagttgtatgaaaaccacaattcattctcccttctcctttggtgaacatttgcactgtttccagcctgggacaatgatgagtaaagctgttaaaaacaggcacatatgttttcctttctcttgggtaattttttagaagtagaaaagccagccaatagaagtagatatttgactgtattaaaactcaccaagcagtttttcttattttttttaatttttaaattttttttagccagagtcttgctctattgcccaggctggagtgcagtgtcgtgcactctcatggacacacatggatccagatgccacagcagccttagctggccaaccttaaaacaacacatttgttcttatagtgttggaggtcagaaggctaaaatcaaagtgtcatggaaggtggccagcaggaccgtggagcctctgaggcagtgggacactttggctaagagccacatactggctctggctggcaggcagtcttggccagccaggctgagctccccactgtcggggcaagcctgggtgtcctctggtgatgctgagtccagaacaaggctgtccacattctggtccgcagggctcagctctgctttctagacttccaaataggaagaagagggaaagttcccagtctctgggcacaaccaagaacagagagcaagttctgactcagcagagggattgattcattccatgcaaagagctgcactgccaaggctgacacgagccagggactcagcacacggcatcacacccagtcctctccagaactctgccacgtagtgttaccatcctgccattcagaggagggaagtggggcacaggcaggtcaagcaacttggccaatgtctgaattgctagtgtacggagctgggaggggagcccatggggccataaatccagtgcaaaaatccgtcctcctgaaccctacggagcaaaagtgagtccagttgttttcctgggtttcctggacacacagatctgaatttcacagcagccttggctggccaatcttaaaacaacaaatttatactcttaatgattctggaggtcagatgttaaaaggtcaatgtgtcagcaagtttgtttccttctggaggctccaggggagaatctgtttcctttccttttgcagcttctagaagctacatgcatgccttggcttatgggccctcctgccatctttaaaactgtcagctttgtccaggcacattgactcatgcctgtaatccaagcactttgggaagccaagacaggaggatctctttagtccaggagttggagaccagtctgggcaagaaagtgagaccgtgtctctacaaaaaaatagaaaaaaattagacgagcatagtggtgcatgcctgtagtcccagctacttgggaggctgaggtggggggaatcacgtgagcctggggaagtggaggctgcagagagctgagatcacaccactgcactccagcttgggtgacagagtgagatcctgtctcaaaaaaaaaaaaaaaaaaaaacacaaaacaaacaaacaaaaaaccaaaaccagcttcttcttgcttctgttgtcacatctgcaggactcattctcccgcctcccttttataggatccttgtgatcacattgggaccacctgtataatccaggacaatctccccatgccaaaattattgatttaatcacatctacaaagtcccttctacaacgtattcacagtttctggggatttgaatgtggatgtttctggggggtggcccactgataaccagtgttataagtttcttgaaaatccttccagagatattttatctataaataaataaatgcaagtccatagcctccccccacccactttttatacaagtggcatcattccatatcagtgctcagttccatcttcctctttttcttttctttttaaggctacacagaacctattatatggaaataccctaatttatttcacttttttcctgttggaagacttttaagctctttccaatgctttgctttataatcttttgtattataatgctgcaacctatataatcctataaccttgtttgtaggataactttctatttaaaatctcatttttcaggccaggcatggtggttcatacctgaaatcctagccctttgggaggctgagacagaaggatcacttcagcccaggtgttcatgaccagctctggcaacatatcaagaacctgtcttttcaaaaaacttaaaaattagtgaggcatggtggcatgtacctatttggtcccagctattcgggaggctgacgtgggaggatcacttgagcccaggaggtggtggctgcaatgaaccaggatcacacccctcactgcactgcagcctgggcaacagagtgagaaccaatctcaaactaaaataaaataatcttgtttttcagaatttgagggtgccatttaagacattttgacacttcacagaacttttttggggaacttgttgccttggagattagcctgtcctgtcccacccccatgatctgtacttcctgtttctccctcctggcttccttaattaagccttgtgtgtacttgcgagcccatgtccatcacgctctgccttcaattctggatgctgtgctgtgaatacgcttgagtggaggccgcatgctttccaggagggtgtgtattttcagtgttgtctctcatgatagtatgaaaggctctggagggaatcacaggcctccacaaacaggcaagcggaaaaatgttccacagacatgtttcagggacaacaggcttcccaatcctaggtcgtgctggtccataactggatcaggctgactctccctccccgacaccgctggtgtagacagggacaagaaagagaagtcagagacacaaagaagctgtgatttgcttgaggtcactaaagtacttaatggcagagttcagacctgacctgaggggcaacaaaagacacccccctcaaatccatggggagcagagtctatctgaatcagatcccagattttctggggctttcacgatgccaggtgtgtacactgagctaggatgggtttcccagggttctttgtggtcacacaactcaacaatacagaccagaaagcagtggcgagtaggctgaatttggctggtgggtgttttctgtttggtctgcacagtgtttaacttgttattataggaaattcaaacatgcagagagaattgtaccatcaacaacacacacccatcactctgctccaacaatgatcaattcaggcctatcttgcttcatcctataccctccctcgcttgcttcccttcccaccctcaaatatgtggaagcaaatccagagataccattccattgcaaatatttcattttgtatctctataatatgggaatttggggaatttcatttgagacaggatctcacttggttgcccaggctggagtgcagtggcgtgattgtggcctcaacctcccaggctcaagtgatcctcccacctcagcctcccaaatagctgggattaaaggtgtgtgccacatctggctaatttttttatttttttgtagagatgggggtcccactatgttgcccaggctggctggcctcaaactcctggtctcaagtgattgttttgcctcggcctcccaatgtcctgcaattatagatgtgagccactgtgcccagccaggaactttaacataatcctttttgacaaaaattttcctctaagaaattagaaaattttacagaaaaataaaaatccagacttctgtcttctcttaaaaatttggaagctctgccaatactgggcccagatggcaatcactgattagcactgagtagatgttgacttttcagatgaggggtgtgacgtctactttgccacagtccccaccactcccccacctggccatctcacccatacacatcacctgcctggctcctttaggcatttaatttgtgtaggaaattgacctaaaggagatattagagaagacattaaaaacttgaagaatgtgaaaatcagccaggagatagaactgtgctttaatgagggttatagaaccacactggatatgaggcattttgggaataaactttgaaaattggaagtaccagtttgtgaattttgctcagagagatgaaggtggggggtgggtgacagtggtgaagcatctcctatgtgccagtctcttttaccacaggctgtttctcacaaaatcatcaatcatatgcagtaggagaaacacctttgtattttacggatgagaaaactgaggcacagagaggtgaaataggcttcccgaggtcactcaggtcatatgagcagcagagctaggattcagacctggagttggcctgactctaaaacgatgcatgcctcaccatggcgcattgctcctttaaagagcaccagaagagagaatttgacaaagtggttgcccgtggggcctgggatgggtggggaaactatgctagggctctgggctgctgagggcctgagggaaggaatggggagcccgggcgcagaagtagaggagggggctgccccacggctacagaaggcatctgggaagacactttgctgaaggtggccaggagggcaaaggtcacagtggccattgttatatggtggtggtggggagagggggatggcttcttcttaaccttctcgggtgagtcgaaggtttaccctccagacccttgatgggtcccttatgtcccttggacatcctgagtccccagccagggccctgggcgctttgctgggagcttgacataaggtccagcagcccccattgctacctaattccttagcagcccagggtgtctgcctgctacttccctgcctggaaggaaggccttctgcctggtgcgttcctgctgcagcctccactgcctcttagactctcacacaagctcagctccctgtcgcgtcctctcagggccaggcttctccttatcacaagcttagactgtctgagtaactaattggatttgtgtttgcctccacacaggaccctaagacccgtggggctgcgactccctctgtactggtcacagccgcaccctagccccttgcatggcgctgtcaaacccaggctggccactgactagcgctggaggggagcaaacgggaggccggccacctgactgatggtcccacaccttctccctgcaggctgtccccttttctgggactattcaaggaggtctccaggacggacttcagatcactgtcaatgggaccgttctcagctccagtggaaccaggtgtgtgtgtatatggatggaaacgtttcactccagcctcgtcccttagtaaaccactgtgcctgtgagcctgggttagttcaaacagcaacatccaagctcacgtgcctggctcaggggaggcccaatgcgtccctaacccatgccacagggcagcactccacaggcacaacctgcacccaggggtgccattaacctggactccaggatgaatggggccctgggagctgacggtctaaggagggcgtgggatggtcagagttggatgattatgttctgggttgaaccttgcacactgtgactaagagttgcaaaaatcaaacttcctctatttcccgtaactgctctcatccactctgaagctctccttctgctgatgtgaaaatattgaaaattgacattcaaagtaatttggtctctttcagtttcaaggccttttctggaaactactaagtcaattcaacatactaacattgtatcagggctgtttcccaccccctcctccctcccaaggtgggctgtctgggaacagagaagagctcacatggcttctcagtggctgggagggctctagaccctcacgcaggcctggctgacccctgccgaggcaccctgattgggtgacacagaggtgtgcagctctctcctggttgggtgggagaccacagggtggcttgctgaagtctgcggggcccacagaagagcctctggactcatggttctcccacagaagcctctctgcctcagtcccaggggtcctctccttaagaccttctgggccttgcagatcccaactcaacatcagttcggccactagattcttgctgacctcccccaggagatgccaagggcagggcggccctgatccccctgaaccctccaaccaggggaatcaggaccacacccctgatcttcctccccttcctctcttcctctcccttggcctcccctacctcccagcaccaggaaggcttccgactcccatcctgtcgaatagagacagatcctacctcagagggccctctcctctcgggagctttctgtctctcccttccttggggcaggaatttccaaaggactacagggatgaagctgaagggctccaaaagaaaaaaatacattcagaggtatttcaaatgtamtcatctccatttattcatttattcatttaattaattattttttttcttttgagacagggacttttttctttgacccaggctggagtgcagtggtacgatcatagctcactgcagcctccaattcctrggctcgagcaatcctcccatctcagcctctggagcagttgggactacaggagtgcactgtgatgccmagctaattaatttttttttaaagtagagatgagatctcgctgttgctcaggctggtcttcaactyctgggctcaagtgacccacctgccttggcgtcccaaggtgctgtgattacaggcgtgagccactgygcccggccccaatttcacatgctctttacatttgttctcttctttcccacttaatcaggcttgtgctagcctccaacaagtgtccactggcatggaaggctctctcttctaggtgtgcttaacaacttccatctttggtaacaattggtaatcactttccaagacctatgcttcttgtttgctaatatcagcacttttccttaagcattttctacttatttttagaaaatcatactgtaaaggcaaaatccaataattgcacaaaaacacattagrtccaaattagagaaacaaaaagatgccaaccaagcagtctctgcgacgcaagttgtatgcaagatcccagacaaatgcraggcagaggcaccgaagccctcctgtgcctgtcactggcaataacccatgccacagaagactatttgctttccctgggcctaggtttgctgtgcgctttcagaccggcttcagtggaaatggcattgccttccacttcaaccttctgtttgaagagggagggtacatggtgtacaacacgaggcagaaaggaagatgggggcctgaggaaaggaagatgcacattccctccagcaggggatgccctttgacctctgcttcctgctacagagctcagatttcaaggtgagcaggaaacccctccccacctctcacccccgggtcycccagctctatcaggcgaatgggctttaagtaatcaccttgattgacattcagccagagtgatgctactatacagataacacaatcatttccttgtaaggtgttaytcatggctgcctagtcatcttatrcacctttatctgaatctacaggtgcacctgctgcttcttttactctgaaaataagaactagaggagtcatcacgttgctgtttggtggtgtgtgtctttgaattccaagctcatgccattcctctgctatcaccacacctcctctccaggtgtctggtaacatttattattcagcgacattgttccagccttcatccagggtctattaagggtatagttttgtaagcaaattgcaaattacctttgcaagcagagtaggtctctgggcttgagaagcctgtgggtaagtcagtccgagtatgcttatctgagataaggatgtccccatccactcagtatgcaacstgaggtcacctctcctctgctccccatgagcattttatgcatatataaataatacccctgcagccataaaaaggaacgagatcatgtcctttgcaggaacatggatggagctggaagcctttatcctcaacaaacacaggagcagaaaaccaaacaccacatgttctcacttataagtaggagctgaacgatgagaacacatggacacaaggggggaaacaacacacccttgggcctggtgggggagggagagcatcacgaagattagctaacagatgctgggcttgataccaaggtgatgggttgatctctgcagcaaaccaccatggcacccgtttacctcgttaacaaacctgcacatcctgtactcataccctggaacttaaaatcaaagttgaaggggatgggcacagtgggtcatgcctataatcccagcactttgggaggctgaggagggcagatgacttcaggtcaggagttcaagaccagcctggccaacatggtgaaaccccatctctactaaaaatacaaaaattagctgagtgtggtggtgggcacctgtaatcccagctactcaggaggctgaggcataagaatcacttgaaccactgcactccagcctgggcgacagactgacattccatctcaaaaaaaaattgttcaaggaaaaataaataataaataaatgaaaccccaggtgagctaagactagaaagacaaacctactgcaggaaacaaccagaagaatgaaaagtcyaactggagccccgtagagactcgggttgatgcacttcrggtcacacacacgttcctgtaactggccccacactgaagaccagactcaggtcttcattttctagaaagagggtccaggagctcaggggtggtccccatcccagcctgggatgcctcccccggaacacgtgctctcctctggcaggtgatggtgaacgggatcctcttcgtgcagtacttccaccgcgtgcccttccaccgtgtggacaccatctccgtcaatggctctgtgcagctgtcctacatcagcttccaggtcagactgtscacctggcaccggtcccaggggctgggatgcagggcccagcrtagctgtgtctaggcccwgctgggtgggcccaagccaatctcctacccaggtcactctggggacaacctctgcttccctgtcccagtacctgcccgccccttctcctctgtcactctgcccctccttctgtgttactgtccctgtccggaacacctgccttggtctcccagactcctcagctgcccctttctcctcaccccttgatttccaccctggttaggaggccatattgttctagaaagaacacaggctaaggaaccaaactgaatccagttcaaattccaagctctgccattcatcctctgtgggatcttagacaagcaacttcacctctctcagcctwggtttcttcatctgtagaatggtcattgcctgccccccatgggtggttgtgtggttcagtgaggagacagatatcagaggtcacacagtggcccccctgggcccacaccagggtctgtttgacctctgtgttttaacaactttgaatgtgttgccaacatctaaaaggtcaggagagtcaggtatggtggtggaggtctgcagtcctggctactcaagaggctgaggcgggagaattgcttgagcccaggaattagagttctgcctgggcaacatagcaagaccctgtctccaaaaaactttgtttaaataataaaataaaataaaacaaataaaactaaagaaggtcaggagataccaataccacgtgaaaaatgggaagattagggtatgctgggcccacattcccacagggcaccagcagctgggtgggagctactattacccttttggcattcgaggctgctccctgagatcagcgaagcacacagtaggccctcagcaaatctgggcttctcgccctttggtcctcatctctgactttggtccctctttccctgactccctcccctgtgggtgaatggggagggaagagctggagggagaccgcacccctgcactgctcaccagagcctggctctttcccatcccatcttggcatggccctaacccccttgcctcatccccctgcctgcctggtctctccctcttgcccttgcctctgcctttcggcttctccttggctctattaatgcttctcctcactgcccggtgccttttgttttaacagaaccccygcacagtccctgttcagcctgccttctccacggtgccattctcccagtctgtctgtttcccacccaggcccagggggygcagacaaaaagtgagttcaacacagaggccctgggtggccgagcagacagtaggaaggaccragggtctgagaggctggccccagccagcaggccactcagggcctacaggccccatcttgcccactcaagagttccctgtctgtctgccgggcacccagagctggggacctgggggtctccctgaattcttcattcycccttctttacgtctctccaaggcaccaagaggcccgaagccaccgacatggcccaggcctccgggattcctcaccatgacgacaggggtccagttccccaccccccacacccaaccactgtcacagtggttcttataagcacttaagttcttataagtgcttcttataagcaaatctgatcacaccctctccctgcttaaaaatcttcacagcccccagcccttcaaataaagcccaaattccccagcagggcatacaaattcctcccagtctgaccccaatcaacctcgctgcctcaccccyaaaccacaaagctcacgcagcctctgcagctcactcaaggccctctcgggccaccatgtttttgcatatgctgtccctggtcccggaagcatcctctgccagcctgcccccagcacacgcctaattgcccttccatgctctgcctaaatgtcgctcctctgggagtcctccccgcctggaatattgttggacgctcccccatgaccccacrgagtctgtacgtatctgtgccatgccagttcaaagcacyccattgtaactgtgtttgcgttgtctgtccccgtcactccacccccatctccctatgcccatgaggcttcagagggccgggactgtgccttgttcatttgcactcagtgaatgaatgtggaatgtggttcacacagccagggagaatgggataccagccagggcaagaacagtctactgggtggggcaggatccaggacaaggaggtgagcagcccttcctctggccactccagtagtggggactgggaggaggggcgctttgtctatgcagtcttcttacggctcatcacggtacagacagggcacctgcctcctgccacgctgacttcaggactggtcgagccccagggaacatttgcagcgcagcccaaatttggccctggccctggggaggatagaaagtgtgctggatacagtcagacagaactggctgccactttggatttgatgccttccacctgggcgagcttgggcaagttgcttaatctttctaagcctcattacctcaccagggacacaggagctgaggctgcttccctcattggaaagcactgaaacccaggaatcagcccacagtaggccttcaacaaataccacttctcaccttagtggtaaaatatggcactggaagtaatgctcttggctgtgggagctacagagagcaatgaggtctctatcaaacccagcctcctctctctcaagaggaaccaatggggataccctaccccccaaccccaaagccctgtgcacctgggggtaaaaatctgggtgccacgggctcaggaaggcttgcttgggagcaagagggaggtgggtgtgtccggggaggcatttctgagcacaagagcctccctggagttttgccaccatctcctcccattctgtggtgcccgcgataaccaccattctgactctcctcacccctccagcctcccggcgtgtggcctgccaacccggctcccattgtaagtctcttgctttctttttggatcgtcctcattttggcttttctgggctcatggaggaggcagggccaggcattgggcctctcccattgggagtrgggagggcacaggccaggcccttgaccatctgcccggcctggtgaggttgggggttggatgtggttggctggccgtgatgaaacaayctgagttgccaccccgtgggcagccacggaagaccatgccccacattcacttctgtcacctgcaaagggaggctaggctgagagacgtttccccgagaggaaagatgggccagagccaccagcgtccccatctgtcttctccagggttctaacctttgcccctcgctcatccccttgagagaagagacacctgggcccaccctctgtggggtctgtggggccattgggcttgttacgccccctggagggtgcctgccgtgtggcgccctctggtgggagctggtggttttcacacgtgagagcctgggtgagacctggtttctttcttccagacccagacagtcatccacacagtgcagagcgcccctggacagatgttctctgtaagtctacaagttctggtcagttcacagctgcacagtgtcctccttcaccaagaactaaattccctagagcgctagagttgggaagaaagcggtttagcaaggaggatggggacactaggggctgagtgcttggctcaggtgacatgtggctaaagctgtccttgggacagcagagattctggaagaagcaggatttatccagtggtggaagaggcaagccccctagagaccgggagggaaactggtctgtctgtcaccaagtggggagtgcagtggccccagcacccggatgtgaggttcctggccctgcatcctgggtccccaggatgtcactaccgatcataggcttaagctcttctcctgctggtgcaaatcaggccggaagtttagcgttagtggggctgcctgcagaggggttgagggrcaggtgaccgtggtggagtccgggaacacggcaggaagttccaggaaggctaacatgaaaagggaggtggatgggggagtccaagggccaaaggctcatgaggtcagcctcacagtggagcccctctagaatgcatgggtgcgcgtgggtgagtgctcgcgcacacatgcgctctcccattgaatttcctggtttcttttcagcagactcccgccaacccacctatgatgtacccccaccccacctatgtaagtgrtttctcagggagggcggaggttctgtttgtggtgggcaggctgggggtgaagggccacttcgggggtatccactagccttgcaaaatgaaaagcgaagggctttcaaaatggtaagctgaagggcttcaaagcttcccagcgaattagaagactgtggagaggagctttcaaccttaaaactgtcgtgtcaatacgagcgcattgcatggctctcccttttcaccccacgagatgagtctttttgtgtttggccaaagttcctttcatgacactaatctaagcccattaatatgaggagcactggaaagttttcctttggcttttatggaaccaagtacagatatcgttggtttcttcttagctgacagcccaaattcatgggacctggtacaatcttcccttttgtgtggtgggctgccctggctgccactggctgacccatgcctctccttctgaaagccgacgccttttgtcaccatcattccgggagggctgtacccatccaagtccatcatcctgttgggcactgtcctgcccagtgctcagaggtaagctaagggctccagttgacctctgggaagagagagcccttcaaggtgattccagccattcccctggctttgggcaggctgtggatgacggggaggaaataaggcccagaactcagtggacaaaggtccaggtgggctgcccaccccaggttccacatcaacccgcactctgggaaccacatcgccttccacctcaatccccgttttgatgagaacgctgtggtccacaacacccagatcaacaactcttgggggtctgatgagaggggcacagctggggagaggtggggagtgggcagtgaagatgaagccccatgctcagtcccctcccatcccccacgcagctccaccccagtctcaagccaccagctgtccactcctggtgggaggtgacgtcctcagtccctcccctctgacctttaacctaactctcaccttgcaccctgcatcaacccttcaccccctcctggaaagccagcctgatggcatcccactggcctccaccaactgaccagagtgttctcttcaggggactggctcctttcccagtgtccttaaaataaagaaatgaaaatgcttgttggcacattcatgtgggttgaccgtggcttctttaattcatttggagacattttggagtctgtggaatcgggcggcggtgctgctgagaggagtgggatgggaaagcatggactccctttgggcagggggtcctgacctcacacctcctcccagagggtccctcacaaatcccacgagggtgttggagaaagcaggctggggctctagccttttgggcaggagtctcggacacaggaaggtggtaatggggtacmccaggaaacagccccatgcctccgagatgggagaggggctggggcagagcctgtgagggccacagcagggtcagagctgcctcctcagacctggcgtcccagtgggaggaggtggcttggggaggggggtcaggagaagccaacccgaagcaccgtctgggtgtgtgttccattgtgggtctctccggcattaggggttagggcttgcataggaaaagtggctcagtgttcatgtgtkgggttctgccagccactgggccactgccaggaagcccgactctgcatccaggtgatgccaacacatcctgctcagcccagtaagaatccagttcctcaggccccatagtagtcctcagagcagtggcaccagctgcatccgggagtttgttggaaacgcagcatcccgcgccccacccgacctgcgaggtcagagtctctgttttcacaggaccccagacgaggtgcgcacattaaagctggaaagccctggtccgggagcggactcctggccttgttgctgagatgcacggctgtcgcgcagggcatggagctttcctggagcctgaggttggcactgccccttctcctgcccctgagatgctactgctagaaggggaaggtggcgggcaagggggtgaagtcggccagggcacccaggaggcagaggccaaacctaagctgggagccgtgtgttgccaggaccccagtggccgccgctgagctccttttttggttctgaccaggagaaggaaacggggcccactctcctaagaaggcttccttggcctgctccaaacccaagagggtccccagtccctcaggcgaggatgctgtggcccacactcgcctcgacacgctgccttcccagggaccacatccgtactggccaaggcacagtctcgcatgagactggtggccccagagcaaaacgctttctaagacagtgtccaagaagaagctcaaggccttcctcgaaacactggccttatgcgacaatcccaccctcaccagaccccgtttcagatactttgtgtgggaggcaggcctgcgccccctgccctaccacaggtctttggaccagcacgaagctccatctgctgctggcacacctggcagccatttcagaggagccatggactggctggggtgtccctctgtcggggatctgtccaggctgtgacacccaccagctccccactctgagaagagctttccctacaaaacacccacacacgcatacagtgtgattaaagtaaaatgcaattcatgtaaatatctccatcaaggaatcatacagggaagacccaagtggccatggggaacagactgggtgttagttttttaaatacagaggcataaataactgtacacaaggcagttaaatacacagtggtgcgatagcacctcctggtggtcacttgaagtggtgcactcagcagcaagttccatctttcacccacttgccaggcctggcatttaagattttgtctccaagggaccagggaggccccagtttgagagaggaggctccgatcaatccagggtgctacttgttaggaggtcaagtaaagggcttgatggggagcaacgttgaggaaataagacttgaggctgggggatatcactttcctccatctccccaggccctgtgacctcagataatgcagagctggctccatccttaagttctgtgccggcagctttaacccctcctgtaggccctcagagcgctgacatctccaggctgctgggctgcaccgccaccctgtccttcttcgcctcgtaaggaaatacagcaccaaagatatcttcgtgatagcgcttctggctcttttaggtaaaaacagagagcaacgtgtcaagtccaggctgggatgagcccctggggttgcccagcttccctatcacatggaccttcatgagccatctgtcttcccaactgttatacttagattgtgcttgaatctggtttagaccctaaccctgctcagcacctgctctggtgcgggccctctaaccatctccaaagctttacttagcatacccatttcctgcccagcgttcatcccccacccaagatactccaggaagtgtgagctctgagataaatatgtttgggaaatgctacgtcctttctttccttccagccttgaagggtcctgatgaacagcagcatactgaaggctcccagaagtcttgtagtaaagcaacgtgtttgccttgccttaactaagcatgtcccaggctattcgaccttggaatctttttgatgccaactgtctaccgacccactgaacacatttggggaaatgcctgttatctcctcactgttcttcaaacacgccagcttaactcccacccccggggcctttgtacctgctgcccctccagaacagcccagagtgtttccttcagtatccacagggctcctcctcaccatctcaggtttattctcagatgccaccttccagctctgccttccctggccaccctatttaaaattacactccccagcgttccctgggctgtttcctgctgtttttctctgaagcactacacctctttcttgtctgggtttgtcagccccagtagaatgtaaagaatttttgcctgattcatttactgctctatccctagcacatagtaggtgctcaataaatgttcagttgaacgtatgaatgtgtcttagggagagtatggaagtgacaatcacaggctttggaaccagagagaggcagactgaactctaggctctcacatttactgctgtggtccccgtaggcccccttccctctgtaaaagggggtgcctccctcataaagtcctcggcaggactgaatgaaatgtcacatgagaatccttggcaagcagtatgcccagtgtaagcccttgataaatatcactattatcttcatcaataaaatgcaagcccttcctgctggggggatgagggtgagcagacaccagcctgggtgtaaataagaagtgtgaggttcacacgaggctgacggggggcagccttgctctcccctgtgttcacagccttgctttggccacacagatactttctgaaaggggggtttggggagaggccagggagactctcctgcccccattctacagatggaaaaatggaacacattcacccgacttctcaaagctgccaactggtccaggatgtgcagtagggccatctgacagcccacccagctcagatctcagccactgctaagattctcttggggtccagaacctttctgggcctgattcccctgggtctacctgccacccctggtcctggctccaacggcctgtgcccttggccggcaccttcagcccacacacccactactataccttgagctgaaagaaatagtcctcgacctgctcctcattcaatttcagcttggcagccaccagctgcttcagggtgtgggccacgtcccgggccatgcgcacatccccgcaaacatagaggtggcctggctccttgtggagcacacggagcacctcgctggccagctgctgccgcaggatgtcctgaacatagacctgaaaccagaggaaacagtgggttcagtcctcagctgctcaggacaaggcttgcaggcaggcctgctggcctcaaggaggcggggagaggggcactaaggggtgaggagtgagtccccttccagccaggaccttgcaaggggccaggctcaggatgaggtgcatggatgcccctggggctcggctgggattagagagataaatgctggacacagtcctgccctcgaggggctgaccatccagtggggatcccagactgtctctgaatttgccatgcttcaaaaaggcatcaatgaaggcagtccccctgcccagggctctgcctacaccccagaaaagggagcctctcaatgcagtctacccattaggtctctgcagggtatggatcccgggctccccagatacaaggtccaggagtcagtcagggactctctgctcctgctccacacaggatgcccagtggccccagcactgggcacagagcactgggcccaagaggtgccctgatgggacaaatgtgtgaaggccgagagtctattctgacaccccaggctcagggggtaacgcggccctggggacagaagagcccctctgatggccgtggtggaagcatcggccgccctccagccttgcaaggcttgagcgtagccagcctggaccacctctccccgggcagtcgcgtgtcccagggggcctgctggggaccttcagcaggctgggctctggggttaacccgcgtgtgacctaggttagtcctgaacctctccaggtctgtcgcttctgctgtatgagagggtgtaatgctcttcacagcatcactctgatggttgtgaattaccagcattttcgagctcaggaggtgaaggctcggggaggcgaggggcctgtggggacccagggctcacagtggagcttgtgtgtgtaatgcttcacctgctttgaggctgcatttaccttgggcttgccaggcaggcgggaataggctgtgtgcaccgcatgcagcacccccttctgggccatctccagcatctcctcctggtagatgtggtcctcatctgggcggcggcacccaaacaccaaggtcatgcggcctccccgcactcctgcaggagtcccgggctgttgttaccatgttggccaccagagggcgccagggctccaagcccaactggaattctcacttcactcccactagctatttaatagcattatccccactttacagatgaggaaactgaggcccagcgcattcagatcactcatccatagtcacagaactgaaagtgcggatgcagaattccctcagccaatcggagatcaaaagcagggactttcctgttacctccactcccaggagagggagccctggctactatgcgggagacggaaaggcagccattctaacccgcagaggcccgcacagggaagcaaacttgggaggccttccctcgagagaggtcaggaaccgtttgtggggctgcagttctgctcctaggcaggcgctggccccctggtgcccctcccacctgggaagcctccagccttacccttgtgctgggagtcatggagccgttgctgccagaaactgcggaagggcgcgatgcctgtgccaggcccgatgaggatgcaaggatgggagggatcctcggggaggtggaagccgctggcactgaagaggacaggagaagagggggccagtcctcagacaccccaggcccacgcacacacaggatggctggggagctgggcctgtgggaggcggtcgtgagggggtggagaggacaagaagctcctatttgatttcccacgtcctgcaggctgcttcacttctgtccaggcaccagcacctcccccaggtccttctgaaaaagggccaagctcactggactcttgagacccacctgtcatcgctgtccctgctacaggcagccacaccagtgtgaccccagtgccttctttatgggccaaggggctccgagcgtctcctaaaccccagatccctccctttcctcccggaactcccaggggtcggcggccccacaggggacagagtggaaggggtgcttacttccgcacaaagcagggcactgggtcttggggcttcaggctgttgagccatgtgctgcagacgccgtggtgcaggggaccctggccatctgcaacgataccacaaagtgaccaacgtccccccactgcccatgcgcaaactgtaccagctgctccgcccacaccacggcctccttggacgcccccactcaggcactctcaggactcaatgagcagctgtttgtcctcctggttctgagatccaccctctgtaagcgcggagctgaggaacgttgaaagggacttagagaggctgcaagttgctccttctgcccaagcagaaactgagacggggagaggaaaagtgacttgaaaaaggtcactcaggtcgtggtggaatcaggtggacagctcagcttccctgactcctactccagtgctccttccaaagactttctccgggaacactcccagctcaccactgagctccactgacagcagcatgaagtggcccctcagggtggctactgctgtgcgtgctcatgagcgtggcccttgctggtagcaaccctgggtggtggatgagctccgcgcatttcagcctgctctggcaccttgctttcctcctcagtgggccctcctgggcttgtagaaacccaggaggtctctctgggttgtgttccctttacaatggcccagcacttgaagaaggcctccaaccaactgcagaggtccccctggtt

SEQ ID NO: 17818 - DNA, 43623 bp, Homo sapiens
gctgcttctcctcttgttcttgtccaaaccagtctccacagtggctacagtgattttttttttttcaatagatacgaggtctcactatattgcctatgctggtcttgaactcctgggctcaagtagtcttgctgcagcctcccaaagcgctaggattacaggtgtgagccaccgtgcccggccccagtgatcttaaaatacaaatttgaggcccaacctgggcgacagagcgaggctccgtctcaaaaataataataataataatataataataatacaaatttgagtgtcatatttttctcttaggagtttgcatgaagccccaaatcctcaaggcgcatatgccaacgcaggagcccaggcataaactatcctgccgaccttttcacctcatcatcaaccaatcctaactctgcttccagccacgtgggctctttctgggtggtgggggtgacccaagctccacctcttgttcatcttacctcccaggactgtatgtcaatgtccctcctctaggatttccttcgttttctagatcatcacctccccactctcagctctcatcacagccgtagttggtcgtctacctcccctatagactggaagcttcgttcgggccgtgggcttggctgtcctgctcaccacggtgtccatgacttgggctcagatgtttcacaagagtttgttgaatgaatgtggggaaaggatggacaggggatagacgggtgtggagggcaggcagacacggatcctgaaaggtacacacagaccgaacctgcagtgggaggggtcgccaacaggaccgactggccggggcggagggcagggccgcggctggcgcgcggcaggtggtcggagcagtcgggcgagggagagctgggcgctctccaggctgcgcctccgcagggggcgcccgtggcccggggcgtggcctcgcgcagccccgccctcctcgccggcgccagggcaggcgggcggctggcagctgtggcgccgacatggctgcgctggtggagccgctggggctggagcggggtaagcgtgcgccagggggccctgcccacccgggccgcggcctacatacccagcccccggtccccgcccttcccgggtcaggccagtgcgggtgggccagcggacccggagggggtgggcggggcgggcgccggggccgggcggtcgctaggtgtgggaggctccctgggcgcgggccgggacgctgggcgcccgccttacaacccggcctgtggaggggtcccggggccgcagggccgctggtggcagtctctcctgcgccaccctggactctgcggggtgtccgactaggcttcggccgtcctccccggactgtgcgctcggcctcactccgccgctctccttgcttctctgcgtctcggggtctctgacactcggggtttctgcgccccgcccccgccccgcagacgtgtcccgggcggttgagctcctcgagcggctccagcgcagcggggagctgccgccgcagaagctgcaggccctccagcgagttctgcagagccgcttctgctccgctatccgagaggtgaggggcgcgcggcgcaggggcgcgagctggtggccgtcgtcctcctcctcctcctcctgcttgtcccgagcccggagactacgcctcccggcagctcccgaggcggcccgccttggggtgccaacgcttcagctcaggggttcttcgggagttgtagttttctcggccttctgttgcgggggcggggcggatccttgcgtggtagcgggagagggtctagaggcctgaactcctgcgtctagggctggaggagctggcgactccctgatgccgctgcctcctcacccaggtgtatgagcagctttatgacacgctggacatcaccggcagcgccgagatccgagcccatgccacagccaaggtgggccccgcaccccattgctcctggtgtctatttaactgcctagtcgaactcaatatctccttcatgccagtcatttctgtttcctccctcatgatttttgctaaatctatgtgccaccttactattagtaaataatcgcacatttttaacttaaatgtcatactaaggcatctttagcaactgcaaatggaaacagtatggcatggttggtagaagataaccttcaacatctgtacagtgcaaaccaggaaactcatggcgctctgacctctcactgcacaatagttagatgctgctacctcttgctgctgtccggaggctcagatctccctccaggcctggctttcctctgtttaaaagtaagattgaggccaggcacggtggctcacgcctgtaatcccaacactttgggaggccgaggcaggtggatcagttgaggtcaggagttcgagaccagcctggccaacatggtgaaaccccgtctccacagaaatacaaaaaaaaaaaaaaaaaagaaaaagccgagcgtggtggcgagtgcctgtaatcccagctggattacaactccggaggctgagacaggagaatcgcttgaacccaggaggccgaggttgcagtgagccgagatcatgccattgcactccagcctgggcaacagagtgagacttcatctcaaaaaaaaaaaaaaagtaagattggcaagtatggggtattcaagacacacaccaaatggacactttctcttgcaagtgaacagaaagagacgcacagtcattacagggggatcgtgcattgtgccatgacaagtgtcccatgcttggggatagtaacccaggctaaatcgctgtcctcggtccacatcccccaccccagctttcatgcctacctggaaggggccctcatcttcagtcgctttctctctcccaggccacagtggctgccttcacagccagcgagggccacgcacatcccagggtagtggagctacccaagacggatgagggcctaggcttcaacatcatgggtggcaaagagcaaaactcgcccatctacatctcccgggtcatcccagggggtgtggctgaccgccatggaggcctcaagcgtggggatcaactgttgtcggtgaacggtgtggtgagtggagggctgaggcaggactgggggacacagtctgtctaacgtagcatagcccctgcttttgacattcactcaacacacactgagtgttgtctgtatggctagccctgtgctgggcaatgttacagactctgagagatgttggcctcagctccctacactcaaccttctctctctggggagggcagtaggccccggctgaaatagtcctaatccagagacataataatgaggaagtgcaaagtattgtgacagcccagatgtggcaccaggccagcatagatacaggaaggttttgcagagtaaggaacatttgggttgggtgttaaaggatgagtaggagttctccaggcaaacaaggtacagggtgttcctgctgagggtactgtagataaggatactgacttggcatacctctgagctgaaaagaaagggcttagttctgatggaggtctggggcatgcaggtaattaaaatcactgtggttaggctgggtgcggtggctcacacctgtaatcccagcactttgggaggctgaggcacgtggatcacttgaggtcaggagttcaagaccagcctggccaacatggtgaaaccccatctctactaaaaatacaaaaattagccaggtgtggtggcaggcacctgtaatcccagctacttgggagggtgaggcaggagaatcgcttgaacctgggaggcagaggttgcagtgagctgagatagcactactgcactccagcgtgggtgacagagtgagactccctctcaaaaaaaaaaaaaaaaaaaaaactcactgtggttagagttgagggaagcataactggagagatggctggggtcagccatacaggacctgagtgccagcctgagaagctgggactttgtcccatgggtgctggggagctatgggaggggtgagccagggataaactcagcttgcaggtgcagaaggaccactctgggactctatgggagatgaactgaggggagagattagaagccaggccagggaggaggctggggtaagagtccagagaaaagaggacaaggcctgagctggcccagggctgtggggacaaaaaagagggagtcaaggcgggcggacattagtgggctgtgggcagggaggccacaaagatgggtctggacgtttggccagggactgagggaacacggggctgtccctgacatgggaatcctgggaggttttggaggaggacactgaaccaggagttaatgactcccacgaggaggacatgaggcattgacatctcagggctggcaccaggctcactagcagtgggtcccatctcccagtgggggctggacgagggcagcgggccccaggctcagctgtctgtgttgggccctgcagagcgttgagggtgagcagcatgagaaggcggtggagctgctgaaggcggcccagggctcggtgaagctggttgtccgttacacaccgcgagtgctggaggagatggaggcccggttcgagaagatgcgctctgcccgccggcgccaacagcatcagagctactcgtgagcccctgggtcaccacacccctggggcctccacgggctccctttaaccccaggctcccaaaccaggccagtgcttcctggatcttccagccctggcccctcctctgggatcctgacccttgacccttggcccaggctctcaccccaggctagtttggccaaatcccctggggagcccttagcttccttccatcccaagatacggaacctactgtggctgggatccctcagcccacttacctgggcccttgcctctgcaaccccagtcctgcccctcttgtctacccggagcctccctgatcccgggtcccttgtccaccccccttgcaggtccttggagtctcgaggttgaaaccacagatctggacgttcacgtgcactctcttcctgtacagtatttattgttcctggcactttatttaaagatatttgaccctcactgagtgtctgtgtgtctgtcctgcatccctgggttggtgtcttgagatgtggagggaatgcgaggagctgaggtcaggccaagccgttgagaagccttttccagagtctgagaacagaggttaagacctctccctaggtctgaaggcggagacaggccggcttccaagagactagtccgagggcggagggcggaggcagggacccagtctgggtctgagtgctggggcagaactgaggacaacgccgcctacccttaagagcgtctgagggcgaaggccaagtcccttcctccagagtcctgaaacgcagccggagccagtgggcggcctctgtgtgggcggggcggagcgaaccattagcctcgtccgccgggggaaccctgcaggccgcactactgtctgcgtgggagtcgcgggtgggggtgccgcgtgcagttcccgaggcgggcgcaggggtgcagaatgaggtgccctcgcccaccgggcgctcactccaccttccaaacacagcgcgtctttccggaagcagcccccgccttgaaatccaacctttagcctcatcccgctgcccgcccagccctcgtgtcccgtgcggcgcgagggctagtgcgcgccactgccgggagccggggtcgcgactcgcgttccacgccgcgcgctactcgctccaggtgacatcatccccctgccgggctccgcctcccgccccagccgcctcacgccgcgtgcctattggtcgacgcgccttatgccccgcctctcgctctccgcccgcgcgacccctcccggccggtgtggaggcggggtctagtcgccggccggcgccgacgctctctcccattggccgctcttcgccgtctgtcagtctcctgttaaaggggccacgaccgcccgggagccgtggggggggagggggagggaggaggaatttttttggggggaaggtgggatttgggggscgctggtgggcacccctggatctggcggctgcggcctcgcggggggaggctgatcggtgacaggggcagggggctattttgggggtagaaggcagtgagagcgtgagggggaggggggtccccagcgcccaagccggagccagagacgcggagcccgcgcgagcgtcggagacagggctccagggctccgaagcgacagagccgggccccggccgctgccaggggccccgcccggcccccccactccaccccacgtccctcctgcagcccagctccgcccgcagccgccgcggaccaggcaggtaagagcccggcccggccctcctggcagcgcccaccctggggaccccttggcgagcctcccccgcctccccgagatcccggattcccttcctcatcccaggggacccccgagcccagatttcacaccccaaccccggggactcaggcgtgcccctcccggcgcccagagtccccgaccgaaccctagaatcccgggcgcaccgccgcctcgcgcctcctccagggcccaggagcttggatttcccggtccggccccgggacccctcctagagcctagatcccccttcctgaccctgtcctgggagctccagacacccgccgcggcggtgccagactccccagacgcgtccgcatcgtccccgcttcgcgcactccgtctcccgtcgccagcctcgggcttgcacagccggctgcgtcccacggtccaggcaggctcggcggccgccctggacacaggcccgctctggagctgtccatggtcagcgcgctcggcagcctcgcctccccccacctcctgccgccgccaccagggagggggcgcaggcggcgcggggatccccccgccgcgcctttgacccgggaatacccgggccctccccgaccagggcgccccagcctctgggttctgccggccaggctcgtggccccgtcctcggcaccccaggttcctgggactccagctgctccctgaggatccagggcttctgaattttcctattctggtcgccgtggggaccatggcacccggggatgcagctcccaccccgttcgggaagcctgtccgtgtctacacctctgctggccccaggtggtagccctcaccccgtcagcacctaggaatcctgttccccagcgtttgctctgcttagaaccccgctgtgccctgcagacacacagacttagcctcctggcacccagcatctgctccccgagggactcaggcgccatgactcctttcctttgggggacccggaatgtgattctcaatgcagttctctgacttctgttcacactcccacttggggacctaaatgtcttggtcccagtctcctatcccctcagggacccaggagttcagaccccagcttccgtactgcccaccagcttttactgaggctgtctgcctcaaccctctctccaaacaagacctcaggctctcaccttccaatcccccatcatttacctccacaaggattcaggagtccaggctcccagctctgtccactgccctccccagcaggtatctagtttctcaggtctcacttttaggaaccaggtcttcacagcctcatcactctgccccatcaacttcacatctcctgtggccctaccaaacccctgtctcatcctcatgtcaccccaggtggcgggcttcaggactctctactctttcccctaagatgcagcttgttgagatgtttctagcactccattgcccyctgaggctcagatgagttccccttctccaagtacactctcccaggccaatgagccgaacacacatcacctcctccagatgtattctgtggcctgggctcataaggagatctagaagctacctgctgccatacaaatttctttctttctatttatttatttatttattttgagacaaggtctctgttgcccaggctggagtgcactggcacaatcacagctcactgcagcctccacctcctaggctcaggtcatcttcccaccttagcckcctgagtagctgggaccacaagcactcaccaccaggcctggctaattaaaaaaaaatttttttggccaggcgcggtggctcatgccggtaatcccagcactttgggaggctgaagcgggcggatcacctgaggtcaggattttgagaccagcctggccaacatggagaaaccctgtctctactaaaaatacaaaattagccaggcgtggtggcacatgcctgtaatcccagctactcaggaggctgaggcaggagagtcgtttgaaccccggaggcggaggttgcattgagctgagatcgtgccactgcactccagcctgaacgacaagagcgaaactctgtctcaaaaaaaaattttatttatttatttatttatttattttttgtagagatgggggtttcgccatgttgcccagactggtctgaaactcctaggctcaagggatccttctctgttggctcccaaaagtgctgggattacaggcatggccatcgcgcctggccgggccacatttcttgtcgcacatgtgctcttgcattgctccatgttctagattccttctaaacaccagaacactcccagctgatgtctgttctgtgttccattttcattccaggcatggtctgagttctaggccagatgccaatttttttttttttttttttgagacggagtttcactcttgttgcycaggctggagtgcaatgctgcgatcttggctcaccacaacctctgcctcccgcgttcaagcgattctcctgcctcagcctcctgagtagctgggattacaggcrcctaccaccatgcccggctaattttttgtatttttagtagagatgggggtttctccatgttggtcagactagtctcgagttcccgacctcaggtgatcacctgcctcggcctcccaaagtgctgggattataggcgtgagccactgtgcacagcctttgtttttttcatatatttagataagacccctgagccagattctgatcccaccatatcctcagacatgttccaaagttctaacaacaagtccttccttctttgctaaatgttcatttcaagtgtgttccaggtttcagccacgttgttctagattccattctcttcccaggagcaatctaacttctaagatgtgtgtgttccaagtatgtgctctaggcttcctaattcgtgccattgattctagaatgcccttccctgtttccctgttttaggttctaaggaagttctatctaattgcacattcttttttgttgttgttgttgtttagttggtttttttttttttttttttggcgggggatggagtctcactctgtctcccaggctggagtgcagtggcgcaatctcagctcactgcaagctccgccttctgggttcacaccattttcctgcctcagcctcccaagtagctgggacaacaggcgcccaccaccacgcccggctaatwttttgtatttttggtagagacggggtatcaccgtgttagccaggatggtctctatctgttaacctcgtgatccacctgcctctgcctcccaaagtgttgggattacaggcaggagccaccacgcccggcctgttgtttagtttttattttatttttgagacggagtctcactctgtcacccaggctggagtgcagtggtatgatctcagctcactgcaacctctgcctcccgggttcaarcaattctcctgcctcagcctcccaaatagctgggactacaggcacatgccaccacgcctggctaattttttttgtatttttaatagagacagggttttgccatgttggccaggctggtctcgaactcctgacctcaagtgatccccctcctgcctcccaaagtgctgggattacaggtgtgagccaccacgcccggcctgttatcgttgtttagacattggatctcattatgttactgaggcgatcctctcaccttggccttccaaagtgctggaattacaagcatgagccactgtgcctggccctaatttcacattcttttttttttgagatcgagtctcactctgttgcccaggccagagtgcagtgacgcaatcccggctcactgcaacctccgcctcccgtgttcaagcaaattctcctgcctcagcccctcgaggagctgggattacaggtgtgtaccaccatgcctggctaatttttgtgtttttagtagagatggggtttcaccatgttggctaggctggtctcgaaatcctgacctcaaatgatcccccgggctcagcctcccaaaatgctgggattacaggcgtgaaccaccgcacctggcctcatgttcttaaatgtaaaagattcccagtgaagtgttctacataatgttttccttcccccggttctaggttctaggcccattcattttctgtcattttttccccagtgcagccttagtttagaacttgtcccctggtggatcgtgggttttctcctccatctgccactttggcattctaagcttgttctaggctctctcttcttctggagccttcagcctagaaatgtccttatttccagaacagcccccctcctttgccagcctcagtctttattccaggaaatgctcaattctcaacatgcatccttttgatccctccccctccccgccctatagacacttgtaagttccaagcaaactcttagacacatgataaaaccaaggatgtgactcctgctatattcttttttaaaaatgtaattaaatttttaaaaaatctatttatttatttattttgagaccaggttatgagactggttaatttttgtatttttttgtagagacagggtttcaccatgtttcccaggctggtctcaaacccctgggctcgagtgatcctcccaccttggcctcccatagtgctgggattacaggcatgagccaccgcgcctggccccctgctatattctgtgttataccttcatccctagcaggctctgagttctagattttatctgctgactatgtttgttatgtgttgcattaggtatattaatgggtgtcattatgtatgtggggttctggggtgacctggacactaagttattgggttgctcttggctggttctagattataggcttcagaacttagttctagattacttaggcctatgagcggttcttaccccaagccattgaaagcgtggaagcatacgtctattccccaccctgtactgtgtgtagtaaccttctaggttctatgtccagccttgctgtgttttttatttccttctcggtcaatttaaggctctggaacagsctccccaaaacatctgtgttgcatcgtcagagtgggttgctggttttagatatcatgttggggctgggcgcggtggctcatgcctataatctcagcactttgggaggccgaggcgggtggatcacgaggtcaggagattgagctcatcctggctaacatggtgaaacccgtctctactaaacatacaaaaaataattagccgggcgtggcggcacgagcctgtagtcgcagttacttgggaagctgaggcaggagaatcgcttgaacccgggaggcagaggttgcagtgagccgagatcacgccagcgcactccagcctgggcgatagagtgagactccgtctcaaaaaaaaaaaatagagatcatgttggttttttgcctatggctggcttgccctcttagaatcgttttcctgaatctttcctctgagtgctgggattcgcctgcctagattctcagatgcaccacttcaaacacccaaggggacaggaacccagctgcctcctctcccagggcccacggccctcaggccctcctctcctcacagaagtccaaggccccattcccaggctttggacacagtccgcatattgggcggggctgggaattatccacgctcagaccggttatgcgttgcccgcagggagagaaggaaaagaaggaactgagtgaaagtccctcctgctttccgccgggccagctggacccgtcggacctgatgtgtgtggagggagcggttcagggggcctggcttcatctccgccctgcccctggctctagggacccaagtccaggcttcccgccccagaaaccccgccccttccttgtcccccgcccttgggtatagcttcaagagggctggggctggggttggtgggagcgtcccagaactcctgggtcctggaggaggagctgtgcacccaggggcctgggggaggaggagcctgaagcctgggacttctgggtctaagcgaggaagctgagagcccagactgttgtctcttaggggaggagaggggtgcggtctccgactcctgggaatggggaggtgggggctggaggcgcaggctcctggggtctgagagacgaaagggactgggtcttagactcctgtgacctgagggaggcgggagctagttcttggacttctgggtcgtgaagagggtgaagaagtgacaagcatggtcctggccatactggtattttttttgttttttttttgtttgtttgtttgttttgtttttttttgagactgggtctctctatatcgccaagctggagtgcagtggcacgatcttggctcaccgcaacctctgcctcccgggttcaagcgattctcctgcctcagcctcccgagtagctgggactacaggtgcgtgccaccacgcaagctaatttttgtatttttagtagagatggggtttcaccatgttggccaggctgggctcaatctcttgacctcgtgatccaacagcctcagcctcccaaagtgctgggattacatgagygggccaccttgcccggccgttactgtgttttttttttgaaatggaatctcacactgttgcccaggctggagttcagtggtgctatctcggctcactctaacctccacctcccgggttcaagcgattcttgtgcctcagcctccccagtggctgggactacaggcgcatgccaccatgcccggctaattttttttgtatttttagtagagacgggggtcaccatgttgcacagcctggtcttgaactcctgacctcaagtgatctgcccatctcggcctcccaaagtgctgggattacaggcatgagccactgcgcccagtcctggccttgcttttttttttttttttttttcttttcccgaatggagtaggtctttagattcttagggagccggggtccagatttctgggaaattgaaggaggcaggagttgggctggctagtaggtgagaccaaccctgtgacattatacaggtaaccacatcctagtgacctaatcctgggtcccttggccctgtggccttcttaaggcatggttctggtctgggcctcagttttcctacccatgcagtgggttgagggggattctcagtagagccagaataggtagacactgattttctccacattcactcatacgataccagggtcggccagctttggttcctttgagtgggctaggcttaggtttgctgccactgtctgttggagtctgacctcagttttcccaaatcctctcacccaggtagccaggactgttttcctaagagcaatggcacaggcacagtggcatactttgggatgctgaggcaggaggatcccttgagtccaggagtgagacctcatctccacaaaaaaaaaaaaaaaaaaaaaggtcaggcgcggtggctcacgtctgtaatcccagcactttgggaggccgaggcgggcagatcacgaggtcaggagttcgagaccagcctggccaacatggtgaaaccttgtctctactaaaaatacaaaaattagctgggcatggtggcgggttcctgtaatcccagctactcgggaggctgagggaggagaattgcttgaaccgggacccgggaggtggaggctgcagtgagccgagatcgcatcactgcactccagcctgggtgacagatcactccagctaaaaaaaaaaaaaaaaaaaaaaaagaaagtagggaaaggaaaagaaaagaaaagaaaagaaaaaaattagccaggtatgctggtgtgtgcctgtagtcgcagctactcaggaggctgagttgggaggactgctcgagtctgggtcgttcaggctgcagtgggccgtgatcgcgccactgaactccagcctgggtgacagagtgagaccctgttaaaaaaaaaaaataataataataggcctcagtttcccctggcagcacctggtggccaatctttggtttccccggtggagtgacagggtggcggtgcctgtttccctgtgtcatgatcacagtgcctgggcctcagtttcttctgtgcagtgcttggtttgcccccaactatttcccctacgtggtatccgagtggctgtgcctcagtttctctgttgtgccttgacaaggccggtctgttccttgccctccccgccccgcaggcccgcaccgccgccatgatgtgcgaggtgatgcccaccatcagcgaggatggccggcggggctcggcgctgggcccggacgaggcgggcggggagctggagcgcctcatggtcacgatgctcacggagcgcgagcgcctgctggagacgctgcgcgaggcacaggacgggttggctacagcgcagctgcggctgcgcgagctcggccacgagaaggactcgctgcagcgccagctcagcatcgcgctgccccaggtctgggcgggacaggggcggggcatgagggggcggggcctcggggggaagaaggcggtccggaaggggccgggcttggcgcctggaagggaggagtctgggcgaggcttgccgttaatgggcggggcctgagtggcaagggacagcgggacttagcagggagggcgggaccttcaaacttccagtcccagtgaatgaaggagacagggaaaggattgagccgaatgtccagatcctgccaatgtctggacaggagtttgcagctctgacgaaggagctgaacttatgtcgggagcagctgctggagagggaggaagagattgcagagctgaaggcggaacggaacaacacgcgggtgaggggtgttgagggcggggcctaagtgggggcggggcctcgtggtgttgaagtggggggcggggcctctcagtgttgcagcgtgacctatttttttcccccatctcgcctttctgtcttctcctcttccctgctcccacttcctggctggtctcccactctggtgccactccttcctccctgtctccataacttttctcttttctgtaccaccggttccttgaccccgacctcctctcttttcctgacctgtctcggtgctcctttatatggctccatcttttcctccatgtgtccgccctacctgtcaccctttttctcacatctgccccttttcccttgcctcttttcmttgaccccatgccgtgtgcttgcagctgctcctggaacacctggagtgcctggtgtccaggcacgagaggtcactgcgcatgaccgtggtgaagcgccaggcccagtccccgggtggggtctcctcggaggtagaagtgctcaaagctctraagtctctcttcgagcaccacaaggccctggatgagaaggtatgagaattagaagagcaggggtggagaatggaaaccyatagttgactggggctgttctgagtgggagagattctggccgtgattggttggggatgttctgagttggaagaatgttgactgtgattgattgggacaggatacatagactgggacctgactggttgatagyagaaaaataaacyaggatgggggctaacagtggatggggcagattggatagctggttgyggctgcatacccgttatggagacaggagccccaacgctgccctatcggatccgtcccaggggtgttctggaccaggggcaactgtcctaaactggatcttgtctccagctgactgttgccctgccccgatccccaggtccgggagcggctgcggatggcgctggagcgcgtggcagtgctcgaggaggagctggaactgagcaatcaggaggtgtgggtgtggccaagacagggaatttgaatccaaggggaggggctaaggggctgcccayggggcggagccggttgggtgggttccagagagaatctattggggcaggactagggcagacaagctatggggttggactatggagagaaaccagtggggttcctaagtgggcacgcattgcgcagggctacggggagaatctcccagtgagagtgagattaagggtagaaccaggggctggggctcaggctgggactaaggaggaagtgattgaatggggaaaagcggggctaaagcggaaactttgtccaggaggctaaggggaagagtaagggtagacgccctccgtggtggcagctaaggagggatataaggagggagggagcctaagggtaaaccgtggggtaggcatggccccagcacgaccggaggcatctcatatggggccgcctatccccttagagggccaatgccagtgagaactagagctgggggttcagggagcccctgtgctctgattcccctttcacacttccagactctgaaccttcgagaacagctgtctaggcggcggtcagggctggaagagccgggcaaggatggggatgggcaggtgagacatggaagtcccctctccgtgagctccattcaactccctgactttgtgatagtgtttgtaacgtttggtatcatcctcactggccctaagacggctgcacctgtaagagtgtcacagagcttggacctctgattcaggtcacctagcgaacttctgtgacctccttcactgacccccgtggactctgaccagcatgatccttattgatctttgatctactttcagctgattgactttctccttggatttcctctgtgtctccggagacactctgggatcttgtcccctccttccctcactccagactcttgccaatggcctgggtcctggcggggattccaaccggcgcacagcagagctggaggaggccctggagcggcagcgcgccgaggtgtgccagctgcgggagcgcctggcggtgctgtgccgtcagatgagccagctggaggaggagttgggcaccgcgcaccgtgagctgggcaaggcagaggaagccaactccaagctgcagcgcgacctcaaggaggtgaggcccccagggaggcgggctgccctgggtccctcgcctttccgtagagctctccctcgcgcattgctcatgaatggcggaacctcgattcagtccacaggctgggtgactcctctttgagattcagttttcccacctgtgaaaggaaatgtatgattctcatcagagggtgagcctgtggcgcagagtaggcgctccataactgctcgtaattactttgttacctaactttgggttcttctctggtgcctctaaatggattttttttttcttttgtgaggcagagtctggctgtgtcgcccaggctggagtgcagtggcgtgatcttggcttactgccacctctgcctcccgggttcaagagattctcctgcctcagcctcccaagtagctagaactacaggcacctgccaccatgcaccgctaattttttttttttttttttgtatttttagtagagatggggtttcactatgttggccaggctagtcttgaactcttgatccgcccacctcggcctcccaaagtgttgggattacagtagtgagccaccgcacccagcctctttttttttttttttttttttgagatggagtctagctgtgtcgcccaggctggagtgcagtgtcgggatcttggctcactgcaacctctgcctcccaggttcaagcgattctcctgcctcagcctccctagtagctgggactacaggtgtgcaccaccacacctggctaattttttttttttttttttgtatcttcagtagaaatggggtttcactatattggccaggctggtctcgaactcctgacctcaagtgatcagctcgcctcggcccaaagtgctgggattacaggtgtgagccactgcgtccagcctctaaatggaatgttttgtgggtatttcacccctttctggcttaggccgctttatcctaatcccagtgaccccagggagctgctgggaaatgtggacctggattcttgaaggcagtggatgagaaagaagagtgagcactaggactagcctgggcaacatagcgagaccccgtcactacttaaaaaaaaaattagccgggcgtggtggtgggtgcctttagtcccagccactagagaggctgaggcatgccaggtgcggtggttcacgcctgtaatcccagcactttgggaggccgaggcgggcggatcacgaggtcaggagatcaagaccatcctggctaactcagtgaaaccccgtctccactaaaaatacaaaaaattagccgggcgtgatgtcgggcgcccgtagtcccagctactcgggaggctgaggcaggagaatggcgtgaacccgggaggcagagcttgcagtgagccgagatagtgccactgcactccagcccgggcaacagagcgagactccgtctcaaaaaaaaaaaaaaaaaaaaagttgaggcataagaatcacttgagcttgggaggtggaagttgcagtaagccgagatccgtaccactgcactccagccagagtgctggttgctcatgcctgtaatcccagcacyttgggagaccaaggcaggcacatcacctgaggtcaggagttcaagactagcctggccaacatcgtgaaacccccgtctctactgaaaatacaaaaattagccaggcatggcagcgggtgcctgtaatcccagctacttgagaggttgaggcaggagaatcgtttgaacccaggaggtggaggttgcagtgagccgagatcgcaccactgcactctagcctgggtgacrgagcaagactctytctctcaaaaaaaaaaaaaaaaaaaaaaaaaaaaagaaagagagagagagaaccttcatctgggattttaagcctggatagccgcaggggctattgggaaatgtagccccaccacgtgggctaccagatgagggtccatctcccataagaagttgaagcacttcttttggggttctaggcctctggtaccctggtagctcttgagaggtgttgccttctaggtagaagggatccttatttcccatgagaccccaggacacttgctgtttgattctaagtctgctctatgccagaaattagtgagaaatccaaggcctgggttttgaggagagggctggagtggagacttcacatcccacaggcctcagatcctctgaacctggaggatctgagcctgcagtgtcctagaagctcatgggaggtgtagcatcaccattttaactcgcaggtaggtggcagggacttaagatgggctagtcctgggagctcttagcgggtgtgacaccaccattctgactcccatgtcagggcactttgtttcccagggaacaagggggttccccgtcctctcccccaggggctcgcagtccacggggccctttgctacctccgcaggcgctggcgcagcgggaagatatggaggagcggattacaacactggagaagcgctacctgagcgcccagcgggaggccacgtctctgcacgacgccaacgacaaactggagaacgagttagctagcaaggagtcgttgtatcggcaggtgggggcgcggccgggaggggcgatgggggcggtgccggggcccaagtgacccagcccgtcccctccccctgcctctccctcccccagagtgaagagaagagccgtcagctggccgagtggttggacgacgccaagcagaagctgcagcagacgctgcagaaagcggagaccttgcccgagatagaggcgcagctggcgcagcgcgtggcggcgctcaacaaggtgcsgggaggactcgggtcggggccttgcgtggggaaggggtggggcctagaggaggcggggccgtgaatctggaggggtaggagcgaggtcagaaccccggatttgggggaaagggtggggcctaggggctgggaaagggacaggacttggaatggggagggcctggaggtttgcgcgggggacggatgggagcggggttctctagcctggactgaaaggaccggtggcctggaacctgagagggaaggaacaggtcctgaaaaagtggactaggcgcaggggcggggcctgactcaaaggtgcaggggaggagcctggcgctgtgggggcggagcctggcgctcagccttggaggaggtggggctgggagcctgactgatcctggaagggtaagtcacacgccatgggttccatctcctaggccgaggaacgtcatgggaattttgaggagcggcttcggcagctggaggcccagctggaagagaagaatcaagagctgcagcgggtgagggggcggaagactgcacagagggtggggcttcgaggctggggcggagcttaataaggaggctgggctgggcccgggggtggggcttagaggaagggccgtggtctgggcagggtgggcttaacaacccgccccgctctgctttgcgcaggcccggcagcgggagaagatgaacgatgaccacaataagcggctgtccgagacggtggacaagctgctgagcgagtccaacgagcgcttacagcttcacctcaaggagcgcatgggggcgctggaggagaaggtgcgccccccatacaggactgcgggacgcggaattccgggactacctcttgctggaatcctggggccccaggcctttccctcagatctgttatcggaggcctccctaaaccccggcatcctgagttgggcagccttctctgctctattgcccagaccgctttttcacctattctagacgttccaagagccgaattctggggcacccatgcctcgagtccttgacttttcccaaagcctccaaccccatgggtctccaaaccctgaaccctctgagattgcacaggacgtcgcatcccggggcttctctccccagaaacatcgttgcccctgctcccccgaaactcaccacttgtgtccatctcattcctcctgggtcccctcaggcctgtctgtgtgcactgggagctgcctgcagccccacgggcgtggcccctcaggcctcactccctcacttcacctctgtctccacagaactccctgagcgaggagatagccaacatgaagaagcttcaggatgagttgctgctaaacaaggtagggggccctgaggggacaggaggaggatgttggggcagtggttgctgaggctagggtctgcaagtctggcaggggctgttcctcctgggcggagcagattctaacccgacacctccaacaccggcccccaggagcagctcttggccgaaatggagcggatgcagatggagatcgaccagctgcgggggaggccaccatcctcctactccaggtgacagcagcccttctgccctgcccccaccatggagccccgttggccaagcgccaagctcctcccttctgatccccacttcctgtcctcctgagacttctgacccctctgtttttgttttttgtttgtttgtttgtttgtttgttttgagacagagtctcactctgtcgcccaggctggaatgcagtggcacgattccggctcactgcaacctccacctcctgagttcaagcgattctcgtgcctcagcctcccaagtagctgggactacaggcgtgcaccaccacagccggctaatttttgtagttttagtagacacggggttttgccatgttggccaggctggtctggaaccccaggcctcaagtgatcctcccccctcggcctcccaaagtgctgggattacaggtgtgagccactgtgctcagcccactctggttttttaccctgactttatttatttattttttctttcttttgagacagagtctcactctgctgcctgggctagagtgcagtggcatgatctcagctcactgcaacctccgcctccccggttcaagtgattctcctgcctcagcctctagagtggcagggattacaggagcccaccaccacatccagctaattttttttatttttagtagagacagggcttcaccaggttggcctggtctcaaactcctgacctcaagttatctgcccacctcagcctcccaaagtgctgggattgcaggcttgagccaccaggcctggccccttgaccttgacttcaggacccctggccstaggtctgtctctgtgacccttacctctgtgctcttttcctgaccccttggtctctgactgctttcctcatgcccacaggtctctccctggcagtgccctggagctccgttactctcaggcacccactttaccttctggtgcccacctggatccctatgtggctggcagtggtcgggcaggcaagaggggccgctggtcaggggtcaaggaggagccctccaaggtcagcagctgcctctgggtcctggactgagcagggcttgggcgggcagctgtaggaagtggaactaaatctgtggggctccgggaggaagctgggttgagaggcaggatctcttggactcatccactcaccctttcttctctccttccctgcaaccctcttgcctggatgtctcctcctgtggatgtcctgccacctggtgagaacctgagagtaatsatgggacagggaggggtgtgtagaatcccagagtaggtggggttaggtgaggaacaggagccagctgagtcatgggaatcaggggcgggggtggagtcatgggtgtgggcgtggcttggagaggatttggggagggatcaagaacagggacctgtcaagagaggaagttggaggccgggcagggtggcccatgcctgtaatcccaacacttgctggcgccgaggcaggcagatcacttgaggtcaggagttcgacagcagccttgccaaaatggcatcgctactaaaaatgcaaaaattagccgggcgtggtagcgggcgcctgtaatcccagctactcaggagactgaggcagaagaatcgttcgaacctgggaggcgtaacccgagattgcgccactgcactccagcctgggcgacagaatgagactctgtctcaagaaaaaataaataaaataaaaaaaataaagctgggctgggaaaagcatcagtgaggtcgggcaagtcaggatcatgagccaagacccagcgccaacctcggcccccagccrcctaatgtccctctgtcccsacacagggataggattgggagcggtctgcccctkcgggctccataccacccccattccctggggaactggacggctccgatgaggaggaggcagaggggatgtttggggccgagctgctgtcccccagtgggcaggctgacgtgcagacgctggccatcatgcttcaggagcagctggaggccatcaacaaggagatcaagtgagccctggccccgccccggcctgccctgccctgccggagctgactccacagcccttctggctctggaggcctgaaagcctgagtccgtctcctcttacaccatccacaaggaattcttccagyccaacactcactccgctgtccaggcatcccctaggatacactcagaagtcttctatgtgctacctacacatataccccccagccagtactcaccattccccaacacaccaaagcctgcatccccaaatagcccagttcctcttgatgcatcaagaatcttccattacgccatcgattttgtggtttcacataaccagtgcccagagtctcccactaccctaggaatctcaagacaacacaaggttcccaacctcaaacaccaagaatctcatcctaacatgctaatcaaaaacttcaactccaggctgggcacagtggctcaygcctgtaatcccagcactttgggaggctgaggccagcggatcatgaggtcatgaggtcaggagatagagaccatcctggctaacatggtgaaaacctgtctctactaaaaatgcaaaaaattagccaggcatggtggcaggcgcccgtagtcccagctactcaggaggctgaggcaggagaatggcatgaacccgggaggcggagcttgcagtgagcygagatagtgccatgcactccagcctgggctacagagcgagactccgtgtcaaaaaaaaaaaaaaaaaaaaaaaaaagtccccaacttattaaraagcccccagtgatgtaaagtctaccctgattcaccagcaatggccatattcagcaattctcttataatgtactccccatgagccttcggcaaatataccatgaccaccactttccataccaaatgagtccatgcccttcccagatcctagattggcctgagtccctgatctcacaatgctcctattatgaccttgctcttacaggccaccttgaacttgaccttttgtccatagtaatcccttcatgattttccaaaccccttgactatcatcagggccaccctgatacaaaccccratcaccttgatagccctaatcctgcaatgacttcctgagactctcaggaccccttgactctccttgagcctggaaggccttcagaaacccaccaaagtcctctgacgtcattgcaccgtccccagaattcccattgccccaccaggcctttctggcccattgtgctcccagattccctctcccgctgtctgctgcggcccctcacccagtttcccctatttccctcctcaggctgatccaagaggagaaggagacaacagaacagagggcagaggagctggagagtcgggtgtccagctctggcttggactcgttgggccgctaccgcagcagctgctccctgcccccctccctcaccacctctacccttgccagcccctcccctcccagctctggccactcaacaccccgcctggcaccccctagccctgcccgtgagggcaccgacaaggctgtgagtgctctgaagtctccccagcctagtagggggatggggagaggtcagaggcagggctccccagtgtacagcaacaataacccctcacaccagtggttttccaaagcaacctcagctttccctaaaggttcaaactcagggcaaaggggaggctgagtcactgggatcttgaaccctaactttcactttagtcagatctggtctacttttatttctcatgcgtcaagtttctgcataggattttaaaaagtttctggctgggtgyggtggctcacgcctgtaatcccagcacttcgggaggccaaggtgggcagatcacttgaggtcaggagttcgagacccacctggccaacatggtgaaacccccacctctactaaaaatacaaaaattagcctggcctggtggcacgtgcctgtaattccagttactcgggaggctgatgcaggagaatcaattgaacccaagaggcagagtttgcagtgagttgaaattgtgccactgcactccaacctgggagacagagtgaaactgtgtctcaaaaaaaaaaaaagtttctgtgacaacatgcattggagaactacaaattagatcctcagaattgacctttgagggagacaaagagatattggccctattttactcccttaaattcagctttcctgcttccagaacctgtaactcattagctttctttgaggcctgaccaacatggtgaaaccccatctctactaaaaatacaaaattatccgtgtatggtggtgtgggcctgtagtcccagcttcttgggaggctgaggctaaagaatcacttaaacccgggaggcagaggttgcagtgagctgagatcatgccactgcactccagcctggcgacagagctagactctgtctcaaaaaaaaaaaaaaaattacccgggcatggtggcacatgcctttaatctcagctacttgggaggctgaggcaggagaatctcttgaacctgggaggcagaggttgcagtgagccgagattgtgccattgcactccagcctgggccacaagagtgaaactccatctcaaaaaaaaaaaaaaaaaaaagtttctgcaactcaccctgacttgagctagactaccttcgtatactgtgttctaaaccagggtcaccccacacacaccttagtagacatctcagttaataaggagcccccgacatgactctttgaactcaatccagcatctrtgccctctgtcctcagaatcatgtccctaaggaggaagctggagctccacgaggggaggggccggccatcccaggagacaccccaccacccactccccgctctgcccgtcttgagagaatgacccaggccttggcactgcaggcggggtccctggaagatgggggacccccacggggaaggtcagcakggacaagggatagggacagggagaagctggcttgggaagatgagaagggggtggacaaggacttgggaggagagggggcatctcagcaagcatatgctctcattctctcctgctttcccagtgagggcaccccagattctctgcacaaagcccccaagaagaagagcatcaagtcatccataggccgtctctttggcaagaaagagaagggacgaatgggacccccaggccgggacagctcttctctgggtgagtacctcactctaacccttccctcctttgttccttcctcccttcctccctccctytctttcttctttgtatgttcatttgacatccattcatgtcttcattcatttggtgatttatttagaatttggaaggaacacagcytgccaaggtaggcgggaggaggagggaaaaggaaagggcactctgggrcctgcttgggtgactgggtaggtaaaggaatttatttcctttacttatttttttgttgttttttggtttttgttgttgttgttttgagatggagtttcactctgtcacccaggctggagtgcagtggcaacgatcttggctcactggaacctctacctcctgggttcaagcgattctcctgcctcggcctcttgagcagctgggactataggcgcccgccactatgcctggctaatttttttgtatttttagtagagatagggtttcctcatgttggccaggctggtcttgaactcctgacctcagatgatccacccacctcggcctcccaaagtgctgggattacagactcatttacctttttttttttttttttttttttttttgtttggagacggagtcttgctctgtcgcccaggctggagtgcagtggtgctatctcggctcactgcaagctccgcctcccaggttcaygccattctcctgcctcagcctccccagtagctgggactacaggcgcccaccaccacgcccggctaactttttgtattttcagtagagatggggtttcaccgtgttagccaggatggtcttgatctcctgaccttgtgatctgcctgcctcagcctcccaaagtgctgggattacaggtgtgagccaccgtgcccagccacctattttttaaacagaggaagagggtggggcatcctcaaagcagggcaccttcctgtggtgtgctggagcccgctggcactggctcaggagatccgctatttcaggaattggctgacatcacactggtagcttgaaattggccatggtgggattatttacaccatggaaatgggcaaatgctacaaatcagggattcccttctgcctccccaaggagccggttgttaggcatttaccagcatacaactgccaccttaccaagggcatmccagtgcatccagccgtattttggggatgactccaattcatgggcgcttgtctgcctttatcacttcctcgatgtgccctcactcactactccctcagggcctctgcctttcyggcattttcctcatcacctccagcatgaaagattctgcctcccccttgagattttccaaatttcgacccctccctgcctccagctggaacaccctcagatgagacactggccactgaccctctggggctagccaagctgacaggcccaggagacaaggaccgaaggaacaagaggaagtgagtgtgtgtgagtgtgagcgtgtgtgtgtgtatgtgaatgtgagagtgtgtgagggtgtgtgtgtgcgtgtgtgtatgtgtgtgtatgagtgtgtgtgtgtgtgtgagagggtgtgtgagtgtgtgtgtgcagcggtggtggtggtgaacagaaatgggaattcaatgctgggaggaggtgtccgtgatcctgaacttgcttgcctggaaacccaggagctcctagagtttttattttttctttctttttttaaawtttttttttgtattttttacatttatattatattttttgtttcttttgtttttcttattttgttctctcttttgataggggttggggggagaggatttacagattcacatgtattttttgaccttctgccgtgttttgtacattcataaaagstgcgtgtgcgtatgtgcatrtgtgtgtgtgtgtgtatgtgtgctgatrggggccatccacagagcagggggtctccatccctgacagcttctatcctggccccttcacccttacaggcatgaactcctggaggaggcctgccgccagggcctaccttttgctgcctgggacgggcccaccgtggtgtcctggctggaggtactggggcccagaaatgccctgactgttggtccccaacccctctgacagccccactggtaggggctgcctggtcctcctggcgcaccctgcttctagcccagaggtgggggtggccatgggcctggcaggtgaggacccaggagggctcgggcttcctgttcacctaaacagtttctttctccttctccttctgcccctgccactctggccttgcccacctgggtcatggtctcctgtcgttctctctactctctctttctggattctctgtctctatttttcggcaccattcccatctctgaccacgcttttgtcattccccatatttctcctcatgtctccgatcgccctgccgatgtctccctgtctccggcttcctgtctctccccaccctctatttctctctctctatttctttctctctctctctctttctctctccctctccctcttcccccacccgccccccgccccccgtttctctccctatttgtctccctcggactctccctcatctcgtccacgtctcttttccytgtcctgtttcttctccttgcgaactttcccacgtctctgtttcgctccccacccccttgcctttccccacctccctgttcccccatctctccgrttttctcctcctctgtccctctgtcccctctgtccctctgtccctccgctgcagctgtgggtgggcatgcctgcctggtatgtggccgcctgccgggccaatgtcaagagcggtgccatcatggccaacctgtcagacacggagatccagcgcgagatcggcatcagcaacccgctgcaccgactcaagctacgcctcgccatccaggagatggtctcgctcacctcgccctcagcccccgcctcctcccgcactgtgagtgtccggcggccaattccagccttcgyttcctcagagccccgcctcttgccctcagtctagccaatcctgggcctgctcactcccctgtcccacgaccctgcttctcattggcttttacccccctcagcctcccctccactcctaacttggcctgtggtccgtccctgtggtactccaggaggggcccaggccacctccttccctgactctctccctctcctcggcatttgctgtcccactcaaatgtcaccacctctaagaagctttctttgtcagctaaacgagtttccccatcattccggcatatcagcaccttctaattttccccatagcatttattgccttctaattattttatcttttctttcctttttttttggagacagagtttcgctcttgttgtccaggctggagtgcaatggcgctatctccgctcactgcaacccctgcctcccgggttcaagccattctcctgtctcagcctcctgagtagctgggattacaggcgcccgccaccacgcccagttaatttttgtatttttagtagagacagggttttgacatgttggccagactggtcttgaactcccgacctcaggtgatccgcccgcctcggcctcccaaagtgttgagattacaggcgtgagcccctacgcctggccctcgttccaacttttgattacgagacatttcaaacatacagaaaatcatgtgtacccagttcagcgattctcaaacttttgctgtacttgctctgttgtgtgtgtggggtggaggcggggagtggggaatacaggttgagtgtcccttacttgaaatacgtgggaccagaagtgtttagaatttctgattttaaaaagttttttttgaatatttgcatataaatgaaatatcttggggatgggagccaagcctaaacatgaaattcatttatgtttcatatgcatctcatacacatgcctaaaaagaattttatacaatattttattttttatttttattttattttttcgagatggagtcttgctttgtcgccaaggctggagtgcaatggtgcgacctcgactcactgcaacctctgcctcctgggtgcaagcaattccaatcctctgcctcaaccttccgagtagctgggattataggcgcccaccaccacgccctgctaatttttgtattcttagtagagatggggtttcaccatcttggccaggctggtcttgaactcctgacctcgtgatccacctgcctcagcctcccaaagtgctgggattacaggcgtgagccaccgtgcccggcctacaatattttaaatagctttgtgcatgaaacaaagttttgactgcattttgwttgtgacttgtcacatgaggtcaggtgggggattttcctcttgtggcttcgtgtcagcacgtaagtttagggccaagcactgtggctcacacctgtaattccagcattttgggaggctttggatggccgatctcttgaacccgggagttcgagaccagcctgggcaacatggcaaaaccccatctctactaaaaatacaaaaattagtcgggtgtggtggcgtatacctgtagtcctagctactcaggaggctgaggtgggaggatcctttgagcccaggaggtcgaggctgcagtgagctgtgattgtcccactgtactgcagcctgggtgacagagaaagagtgcatccaaaaaaaaaaaagtttagaattttggagcattttggattttggattttcaggttggggatgctcagagacctgtacttgaatgtaattggagaargtcataacatcttagcccccaaaattactttagtgggtctttttcttccttgtaaacaccacatcctttatcacacctaagggcattcacattgttgttaatttctttttcttttcttttctttcttttttttttttttttgagatggagtttcactctgtcgcccaggctggagtgcagtggtgcgatcttggctcactgcaacctccgtctccctggttcaagtgattctcctgcctcagcctcctgagtagctgggattaaaggcacacgccaccatgcccagctaatttttgtatttttagtagagatagggtttcaccaacgttggccaggctggtcttgaactcctgacctcaggtgatccacccgcctctgcctcccgaagtgctagaccactctcagcctaatttttgtatttttagtagagatggggtttctccaggttggccaggctagtcttcartctccaaaagtgatgtgcccgcctcagcctcccaaagtgctggcactacaggtgtgagccaccacgcctggccacagttgttaatttcatttactattcactctgtattcaaatttccccaacatacttaaaatatgttyattgtttctcccccactaggacgaaaagtgtctgtcgtgtcccttgccatatcccacaccctatgacggtgactggtgcctgacactcaccagaagtacataaatgtttttatccttgtatggattcctaactcgtgaggttgttgggagcagaagctcaataaatgtgaaccccccccgccatactccctaaacatttgcaccatggctgtgtctgtcccccacttctgaatcctcattctgtacctctgtgtgaggtcagcgaggtgacgtcatttgcacagggccacacagcaaaatgcatggcagggtcccaattccaacctgaatttgttcaactccaaagtcacattgcctggtacatggcaggtgccctataakaagaatcattccttttctctgttactgcttgccccagaaagcaggagggacataaacgtgtggcccagggccttcaggaggacaccctccttcctctcccccacgcgaagccctctcccaccatccattaacactccctgcccctcagtccacaggaaacgtgtggatgacacacgaggagatggagtcccttacggccacgaccaagcccgtgagtgccccctgccggccgccttgggggtggcactaaccttctttgggggtgggggcggggaccgagtctgtggccatccctaagtccgctccttgcgtcctcctctgcctgccccttaactcaccccttctctcccctcttcctactaacgggtcaggagaccaaggagatcagctgggagcaggtagggggcgcggggcggggcgtgagcgcatgaacaggctgtgcacgaygcatggatgcccctcctccgagccctgcccctgccttcaccagaacatgccatcatccccatgggggggcgctgcgccaagcttggctctggactgttccattatggcttggcggtggggagggtagaggggatgcgatgtggaagcccagactgttgcatagtcagccttatgcatggaccatttcatcatcgtgggttgtgggggctctaaggggcttcaattctgtagctcaggagagactgagcagccggtgtccctatagtggagggggcgggggctacagtggactgctcagtgtaccagggccaaggaggacacactggctgtggtggtggtgaggcagccaggctgaatgagaagttggggaggaggagctacactttgttctcaagaaacaagaggcggccgggcgcagtggctcacgcctgtaattccagcactttaggaggctgaggtgggcagatcacctgaggtcaggagtttgagaccagtctggccaacatggtgaaaccctgtgtctactaaaaatacaaaaattagccgggtgcagtggctagcgtatgtaatcccagctacttgggaggctgaggcaggagaatcgcttgaacccaggaggtagaggttgcactgagccgagattgcaccattgtactccagcctgggtgayagagccagattccatctcataaaaaccaaacaaataaactaacaaaaaaacccaagaggcatgaactcactgtccacggaggaattatgtttgactgtggtcatagatcacatatttccagccagggggaggcgtggattttgtgctgatrctgaaaggagtgagggacttgggactcatctggaatattgtcctgggccagatataacattagacaagtattttcaggacattgcaagagtgatggccctttcttagtgggagagctgccttgaaagagtccattgtcctgacttgggggtktagtgacgttggactgcagtgagacagagttaaagcagtgcttccccaaatttaatgtgtagtggggtggcacrcacctgtagtctcagctacttggaagactgaggcaggaggaccgcttgagcccacgaagctgaggtcaacctgggcaacatagtaagaccctgtctctaaaaaataaacaaatacagccaggcgcggtggctcatgcctgtaatcccakcacgttgggaggctgaggtgggcggatcccttgaggtcaggagtttgagaccagcctggccaacatggtgaaacgccgtctctactaaaaaatacaaaaattagccgggcgtggtggctcgtacctgtaatcccagctactcgaaggctgaggcaagagaattgcttgaacctgggaykgggaggttgcagtgagacgagatcgtgccaccgcgctccagcctgggtgacatagcagactctttcagaaagrgagagagagagagagagagagagaaagagagaaagaaagaaatttaaaaataaatataatgtatatttcgaatcacctgagggtcttgtgaaaatgcmgataccgacttcagtaggtctggagtaaggtctgagattctgcaattccagcaagtccacaggtgatggtgacgctctaggtctcaggacaactgtttgagtagccaagagtatatgctgtcatgaagggctaggagacaactctggattggtccattatcctgagcagagattggtcattgtcctaccatggggtgggaaaaaaccttggattgggaggttggactgtacccctctcatgcacagtgggaaggggccagagggcctgactcttccctcacctgcccatggccccagatcctggcatatggcgacatgaaccacgagtgggtggggaacgactggctgcccagcctggggctgccccartaccgcagctacttcatggagtcgctggtggacgctcgaatgttagatcaccttaacaagaaggagctccggggccaactcaagatggtggacagctttcacaggtgggggctgcctggccagtggggacagtccaaagggaagccccaccccagagagtctttggccaataggattggccatgggagattcccaggcttatcttggcccttttagcctgagttctcaggaaatcctgactctgtgctcctttcaccaatgagatggtccacaggaaaagttcagatcctgaaatggcttggctagttaaccctggaccccttccaggctggccagtaggaagtgcctattattgaaaatgcctcacctcctgaggggrtcaacagtcaatagaacttatcagctccccaccctttccaagaagagcgcagccagtggggagggacccgtaggagcagcagtctaggggactggaaagctcatccgtgactccacttcccctgctgctcagggtgagtctacattatgggattatgtgcctgaaacggctcaactatgaccggaaggacctggagcggaggcgggaagaaagtcagacccagatccgaggtgagtagagcctaagggtccctttgggagccaggtggagggcgtggagctggatggggaggagagggggtagggggagaccggagaagcaaattggcaccataaccgwrggggtggagccagcgtggggggcgtggcccgaagagaccaaatggaggtggaggtatgggctaaactgaactctccaggccacgggaggggcacggctgagggtcccttccgtccccagacgtgatggtgtggtccaatgagcgggtcatgggttgggtgtccgggctgggcctgaaggaatttgccacgaacctcacggagagcggggtacacggggcactgctcgccctggacgagaccttcgactactccgacctggccttgctcctgcagatccccacgcagaatgcacaggtgagctgccgctgggcccggagcatgctgggcgtccccacctcgcagactgcacgctccaaccgccccctccacctcctctttccaggcccggcagcttctggagaaggaattcagcaaccttatctccttaggcacagacaggcggctggacgaggtgggcgcggcaacagctcagagggctctgctcccagcggctcctcgagaggctgagctgagggggcggggcctgactattaatggtcacggttggaggcggggccagragaggggcggggttaaaggagargtgagacccggagaggggtggagtcaaaggaaggggcggagtcagacaaggcaggagtccctcaccggctgtccggctcctatacctaggacagcgccaagtctttcagccgctccccatcctggcggaagatgttccgggagaaggacctccgaggcgtaactcccgactcagctgagatgttgccccccaactttcgttcggctgcagcgggagccctgggctctccggggctccctctccgcaagctgcagccagaaggtggggggctcccaaatgcgacagcccttcctcgcttccctagggtggggcatggaccacctcagtagtccgggttctggaatggcctagtcctttctcgcccacccctgaggaatggactgctccaacgttccggactcccccgtcaggatgaaatggataaatcccactcccccttcccagggcgggagtgaactcgcccaatgcgagtttgagtccttggctgyggggaagggagggaaacccatgtggagcccggcgatcgttgtgacatcgggaagggaagtccaaagggaggaatcctggagaggaacagggaggagkgtgctccaggctgaaccgctgctcgctctccctccaggccagacttctgggagttcccgggcagacggcgtttcggtccggacctattcctgctagtgcaggcctccaggtgaggaccgtgctgggcgaccttgggggtgcggggcggcacggtggatcttcactgctccacgcgctgcccggcgtcatgcaggtgacctcactcggacggaagaatcttcccgaggctgggctgttccctctcctgcccggactgtggcctcgccggggagagcgggcgggggagctcgcgccgaggactggaccatctgtacagaccagcgggagtgcgcgcgcccgcctcgcacagggccggggcctggaccaaaccacatgaactggactgagagggggaagaagcggggaggaagaaatcccgccccaaacgtccgctttccttttctctactttgtaatttattgatcagtttctgttgggagacgggtgtcctttacccgcgggaagggggcggggcttccctcccgggccgcatgcggggagaggctgctccctcccctttttcctgcscagtcgcggggcccaagtcttccttcttcgtccgaaaggaggggaggggggactcgctgctacaagcctcgccccctgtgccactcagctccgccccgccgcgtccggtcgccggtcccccgggtcatctgcgggcgggktcccctctccctcccccgtgtctcgtgtccccggggcctcaccgccccccgtgctgtggccgtgtccgtgccccgggggtagggggcgcagaatggcgcttccccttctcctctggctccggggtttgcatgggagaatcctctttccacgatkccgctgggcgacgtggcgtgggggcagggggacggtgggggagccctcgcccccgactctcggtcggcctccccgccccaggcgtcactcagtgatcacgggtaaagagaactgtttcaaaaagcttccttgttgactgattttttttttgcggggggggggggggctgttcaaccaaccacctcgagccaggagtccaggcccctcatccctcaagtctaggtccaggtctctagaccctacccgcattccccgatgccctgagattcccagaccccacgtctgacaatgaggtttcggggagcacgtttattcggagaaataaatatagctcgtggaaaggggttggaaggcagggggaggtacacctgcgtcgcagtcgagcgactgggtcagggttccggcgtttccagcatgtctgccagggccctggagacgagaacgccagaagttagacagctggtgttcaaagcccaccccaggacgcttagagatcattaacctgcccatttcatggacggggaaatggagtcccagagtcatctgataactcatagcgagacaagcacttctctaaacggggcttttacacgctccccttttacacacttactgataaagggacgaggagaaatagtcaacgtagcttcctgtgggacagcagagaaaagaggcttgaggggtactgcacgagcaaaattaggcagccactcagtatagcgtgcgagattagtgctagctccacctccttttccctaattccttcttccaactgaatcccttctaccggacccctttttcgttctgggtgattccgttctccagtagccccgccccttcgattcctacttgagttggcctcgcccattaggctctaagcccgcatctcaaccctccactcatttctgtcccttggctccagcaactccacctggtgttcctcgagccaggccccggcccacgtgctcagagccttggccacgcctcccctcttagccccgccccaccagccttccgggccaggctccgcccccaccaggattcaccacgctgggcccggcaccttcctcaggtttttccagggccccgcccatgctcacctggagcgcagaccgtttcgcagaccagcgggcagagatagcagaactgacagtgctggaggcggggacggggagagagagtgagcgtggggcgtggccgggggcggagttaggatggggccgggaccagacccggaccagaggctaggtctaggttaaggttggagtcaggatcgcttgtggagtcaaggttgcatcaggggtaaggggttgggtcagaggccaggatttagggctgggggtcctcagagggtcccggtgcatcctgaggcccagtggagccttgagtgtgaggtgaggtctcacctggcactggtcgcagtgctcacccatgttctcctcatcacagtgacagctctcacattcagtgcatcgctggggaccgggggagcctggttagatggaaactctaacgccacttgggaggtacccgcccctggcccacccctgcaccctggacgcttccccagactctaccctctttatctctaacactgagctctgtatctgccccccaaaccagcctcccctcccctcccctgcccctggtttccttcctttccctttttttccttttttttcttgaggcggagtctctctctgtcgcccaggctggagtgcagtggcgcaacctcagctcactgcaacctccgtctcccgggttcaagcgattctcctgcctcggcctcctgagtagctgggattacaggtgcgtgccaccatgcccggctaatttttttgtattttttagtagaaatggggtttcaccgtgttagccaggatggtctcgatctcctgacctcgtgttccgcccaccctggcctcttaaagtgctgagattacaggcgtgagccaccacacccggccctgcccctggttttctatctcagggcgaccccatgtctccctgtcagggtgggctcaggtgctctctccacccgctctctgcctattctccccctagcctatcagcccctgtgccatccctccttcccccgactctctttgccacagacccctgtctctgtccccacaccccaagatgcagcttgggtcttgtcctctccttcctggaccactgccccagcctcccagccttcatcagtctgtcctcacctcacatgcctgcagaaggatctcttttctttcagaactgaccctggcctgcccttgctctgagccctcccacagcaccaccccagggcccctgggacagattctggggacaccttggtgggtggatctgggctggggacatacattgcagaaggagcagtagccacacagggaccctggctggtagttcccatactcctgagcatcctgtggacctgcggggacaggagggcagcagtgacccaggctgactcggttccttcccacccacaccagcccaggccacttacctgtgtcctcaccgctttcctcctcgctggaggcacctccagcctcctctctcctgtccagtgggttggggatgatggtgaagcggggctcatcttcctccagcccctcctcctcctcctcttcctcctcgctgtggtctgggctcagtggggccccaacctcagccctctcttccctcctctcctcgtcttcttcctcctcctcctcctccttgtcttcctcttcttcctcctcctggttcaggctgaggccatgaccttcctcctcatcctcctcatcttcctggtcccggctgccatgatgggtgcctttctctccctgctctgaactttcatcgtcttcctcatgggagccggggtcctcttccttctccttttcctcctcagaatcatccttcctcaaatggcttctatccttgaccactgtgtgtcctggggggtgatggctcatctctttgatggaccctctttgaccatggccagtttcttcatcttggtggctttgcctgtggctgggggcctggtggccaagctcagcagagacctcctcatcttcctccctggggactctgtggtggtgatggtgagggacttctgttttatactcatcttggaagtcctcttcatcactcttgtggcctcgaggttggtggcttgcaacatagtggccgaactggactgtgatctcctcttcttcctcttcctcatctacaaggccatggtggacatgttggggaccctggtgccaacgttcagtggacacatcctcatcttcttcctcgtctctgtggccttggtgcctgtggtcagggacatgatggtggtgttcacctgagacagcctcaacctcttcctttctgtggtcttggtgcctgtgggcctggtgtccatactcagtggagacatcatcatcatcattgtcatcttcttcatggcttcggtgcctgtggctggggtcgcgatgatggtgtccatctgagacatcttcatcctcttcaatcccgtggccttggtgcctgtgagcctggtgtctatattcaatggagacatcatcatcatcatcatcatcatcatcatcatcatcatcgtcatcttcttcatggccttggtgcctgtggctggggccatgatgatggtgtccatctgagacatcctcatcctcttcactcccatggcctcggtgcctgtgggcctggtgtccatactcagtggaggcctcctcttcctcctcctcctcctcctcctcctcctcttctccttcatcatcttccccatcatggcctcggtgtccatgcctgaggatatgatggtgatgctcactggacacaacttcatcctcatcctcgtcttgatggctgtggctcctgtggctggggaggtggtgcctgtgctcagctgagtcttccgtgtcttcactcccgtggcctctgtgcccacgggcctgcccaccatgctctgcaaagacctcctcacctgagacaccctcatctccgactttgtggtcttgggacctgtggcctgggagtaggtgcccatattccttggcgacatcttcatcctccttttcacggtctgggtggctccagaaatgatgcccattctctgtggaaacatccttgttctcatctggatggtctctagggctgtggaggtggtggcgaagctctgctgatgcctcctcggagagcccggcgactccagtgttgttgttccggtttctgaagcccagcccatcccctctgagctgctgggtcatggccggggggaggagcaggctggccaccccagcccagaggacagaagcgtgcagccatggcctatggtggcccatggggacggacaggcagcactggctccagctgcctctgcggcaatgtggacaaacgttggggtctttgtccctttggggttggtctctttttttctctgtgtctctcctttgtcctttcggtctctgtccaccttcctctggtccttgctgcctggctctggacacccctctgaggctgtctccggagccccctgacccccctctggggccctccctccccattccccagccaatagggtccttcccctcccctctctccagctaaatttactctcagccctgagttattctgggtcagtccccgcctgcctgcctcctgctcctcctcctcccagctggggaggggaccagtgaggggtctctccctggccaggagacggtggccaagggacttgactttgaactaccaacaagctcacgtttggcagctgcaaagacaaaggctagacttttagcaggtttttgggggagcctggggcacctgggggaggcagaagagacttatcagaggggagagactcctgggacggaaggactgggggttcgattgcggggtgtttccagctggaatgatacgtgctggtgagagagtgatgtcagtattgaggccctagaatggggggaaaggaacatggcccccaacacacgtgcccatgacctcctgtccctggaactcagatctgggggcagggactgggctaggccagggctataaatacagctgggaggggtagggggactcaggttacggaggccacagctgtccccatcacagagggctggcaggagacaagtggccttgcccgtctctgtgtgtcagtatttcctactcctcacccttcatgactgcccccactagggtctcctttcctgttcacgggtcctcctctctcttcaattctgtcatctgctctctcagggtccctgtccctcctccatgggattgcctctccctctcactctgggcttctgtcccactcttatcttagtgtcagtcctcccccaagtctgtgtccctctctctcccctaaatctctggcccctcctttctgagttcctgcccttcccccaattctttggtttttgcatccccctctgccccttgcctcagtcaaggtgtctcctccccatctctggcatccacctctctgggtctctgtccccactctctctcagagtctctgtccccctctgtctcagagtctctgtccacctctccctgggtctctgtccccctctctctgggtctctgtccccctctccctgggtctctgtccccctctctctgggatctctgtccccctctctctgggtctctgtcccctctctctgtgggtctctgtccccctctctctctgggtctctgttcccctctctctgggtctctgtccccctctctctgggtctctgtccccgtctctctgggtctctgtccccctctctctgggtctctgtcctcctctctctctgggtctctgttcccctctctctgggtctctgtccccctctctctgggtctctgtccccgtctctctgggtctctgtccccctctctctgggtctctgtccccctctctctgggtctctgtcccctctccctgggtctctgtccccctctccgtgggtctctgtcccctctccctgggtctctgtccccccctccctgggtctctgtccccccctctctgggtctctgtccccccctctctgggtctctgtcctcctctccctgggtctctgtccccctctctctgtgggtctctgtcccactctctctgggtctctgt

SEQ ID NO: 17819 - DNA, 14785 bp, Homo sapiens
  misc_feature (1)...(14785): n = A,T,C or G, or insertion/deletion polymorphism (see Tables 1-2)
gaatacaacaatctagtaactctggataccatattctttccactccccagagtttcttgttgccacttgaggatggagttgtttcttagtgacttttctaaactattgttaagctgttctatgtcatgtgtggtcactaaaatctattctgttagcttcatggtcagctagtgatttgacagaggtttccttaaacagctggagccaaaaaaataaataattaatgccctcccaggttttgcagatggactctgagttgggacacttcttcaacacttaaccaggcagtttagacgtccaccttaaccttcactggctgcttacttggaggctaaagatcacccagaggtaaaagcctaaggtcatctcaggtctttttaaagagtgtgggcatccagggctaaatatccagtgtttagccctggccatgtatgtgacattctgatttcctcagtatatgcgggatattttgaaagccatattgccttatgtatctccatctccagcctctacctccctaggcttttcagtctgtctgctgttaacccatccatcattccatgccccaggcatctgtgactagtatttgcctttaaatgcttttgacaaacattgctatggagacctctccaatcttaataaagttccaagaggagtgaagcaaagaccagcctctaagctgatctttttgggggctatcatacatgtcaaaggacacaaacacaattctttgaaaagaaagttcattttgccttttctggcatcaggaaactacaccaggaatgtgggacaccgtccccatggctgcctcatagctgagggtgtgggggtgggagtgagtaggtggctaaggaatagtggcacatgctctcctaccaaaatctagagctcctttttcattaagcactactttggttgttgtaaaaaaaaaaaaaaaattcatagactccagagtacagaaaaacttaattttgatagtttttttccaggttaatagttgctttagttggggaatgtgttgttggagttctctaccatttttggtgaaggcattacagttgtcttttaataagattttaaaattatgaaaaaatcttatgtatctacccatgtgcttaccatttctggtgctcttcattacatatttgcttttggtataattttctttttgcctgaaggactgaaacacttattacagttcgtgtctgctggttatgtattttttcactccctataagtctaaaatccctttttttatagatatctttagagtctgttaagtagcttgatgcaatcattacacatggtatacatatatcagtacatcacacagtacctcatgaatgtattattatatgtcaattaaaattatacatatatatatgtttttaaaaggttttttttctggaaatagaatctagtttgacagcagttgtctttcagaactttagcgatgttggtcatctgtccctcatttgcattgtttccaatgaaataactgctgtcatctttattattcttcttatgtgttgtgttttgtgtttttcatttttgctttctgctttttcaattttctctccttctctggttttgaacaaatacatgttactctcactcacaactataaagcgaacttaggaaacaatctatagggagagtttgttgatgattggttatacattttcagaaacagttgtttattccttcctttacaaaggctaatttccttagaatattattgtattgaagaatgtcataaataattttatttgtcacctggacctggtgccaagatacgtggtcaagcattattctggatgatctttttaggatgtttcttggatatgattaacatataaattgctatactttgagtaaagtagattgacctctataatgtggacaggcttcattcaattcattgaaggtgtaaattgaatgaaacactgaccttccccaagcaagatggaattctgtcctgggatttgaactgcagtatcagtcacctgacccataaagagctggttggtttgtgtacagcatttgcaagatgaatggacaacaccctgtttggaagtctacccctttgatcaaagaagataaaaacagaacagctcttgtgggctgaattgcagggtgttttcttagcagtgatggaagaattgaacaatgataaaagctcctatgttttagttttactgacttatgggcagtgactgatggcctggccatataattaattaagaaagcagtggaaaactggcctatgaaaagaatgcccatatgagacacagtcctatggaaatcactatggtaatttgaggggtgcattaacgtaagacatgttgatgcctgatatagattggatgttgtccccacccaaatctcatgtcgagatgtaattcccagtgttggagttggggtctggtgggaggtgactcaatcatggggtggtttctcatgaatggtttagtaccatcccctcagtgctgttcaatacccatcagaataactcccttccaggtttggaaggtgattgaaatcaacaagcatttatctctaagtgcttgccaggtgcacctgtagtcccagctatgagagtgtctgaggcagaaggatatcttgagtacaggcatttgggtttagcctgagaaatatttgagtctagcctgggaaacatatcaagaccacatctcaaaaaaatttacatttgcttgtgaagatcaccggggtctacgaaataagtagacactgaggctgtagcaatgcagagatgggctgaatcaagacatactccccttgcatcccccacctctaataagcacaaaatactcagtaaaactgttctttttaacaagactgggcacagtggctcacacctgtaatcccagcactttggcaggccaaggtgggtagatcacttgagatcaggagtttgagaccagcctggccaacatggcgaaaccctgtctcaactaaaactacatcaattagccaggcatggtggtgcacgcctgtaattccagctactcaggaaactgaggcaggacaatggcttgaacctgggaggcagaggctgcagtgagccgagatggcgccactatactgcacccagggcaacagagcaagactgtgtctcaaaagaagaaaaaaaaagaagtattctctttaacaagaaaagagacagagacagagaccaaaaaaaaaaaaaaaaaaacgtgaatgggaggtattgccaccatgtggaccactgagccacattacactaggaaacacacttgcccagaatgtccaacaatggtcagagaaatttgttcctcagaagaagagtttcagagagaattaaaatagtcatttgaaacattgagtgtataaatcaggagcggggagacataagcatgaagggcgggcctatacaccttcatgagtgtgctcgctcttgacatgagtgtggacaaaggaatgtccccactagagagtgtcctctttttccctgctggatcagggaaaggtgctggtgtgattctacatacaattcttccctaaaaaataaataaataaataaataaataaataaataaaaacaatccttcccaaggccagaagacactagaattatgactatactttacctcaacttgcttttctcatacctgatgcagtggtctcaggactagggatgcaaataaaagtccaggcacaggaattattcctgagcaagaaaccgttaacatatttaaaaaccattatgcaagactgcctaagggcctggagtagatgtgccttcactgcatctggcaaagttggagctaacattgaatgcagctgtattgcctggaagccagatagccaaccagttctctgcctgaataaccctaacctctatgaactggaatggactgatgggagacactcgctgttactagcatggtatagctccctgcataggccagcacagcaggaaaacctaatgtcccttccaaaatgagaaatatttggtataaatgcagaagaggaagaatagtagctgaggtgaaatgaatgaataaatggggtatgtaatgaggaaaatccaatataacatgatctcctcaaaagaggtataaacgaatgatgatattgtcttttatctcatttttaccagatgtctgaaaggttgaagccatatgttgctgagaccattgctatttttggactgcaatgggcgaattgataatgactaaacaggactctggtaatgggccagtatctttttactgctatgattcttctgctataggagatctgtggttggccaagcaaaggggctcacatttataatttcaccactttgagaggccatggtgggaagattgcttttgaggccaacagttgcagaacagcctggggcacataatgagactgcatttctacaaaatatttaaaaattagtcagccatggtggtgtgcacctatagtgccagctgctcaggagacttgaggcggaaggatcacttgagtccaagaatttgaggttacagtgagctatgattgtgccactgcattctaccctgggcaacagagcaagacattgtctctaaaataaaataataaataaataaatagaaattataagaagaaataatgtggttaaagaccaggaagtgatctgtgatccaataaatatatttggtctttgcccctagtccctgacaggcaggtcctaaaacgcttgcagtccctcagtgataagcatgattttaatatggcaatgagatgactatggggtgaggggctcctagatagtttcaggatggaggctgcttgccagaaacaccagctgtgattagaggattggaactttcactgccatccccatcctctggggaagaaaagggggctggaagttgagctcagtcatcaatggccaatgatttcaccaatcttgcctacacaatgaaacttccatagacacctctagacagtgagttttggagaacttcccagttggtgagcacatccgcatgtccacgtgctgggaggacggcacacctcatctccatagagacagaggcttctgcgcttatatctttctgtaaggcagacacccttgtttctaggagggacctagggtggactgtggattctttctctggggcaaataaaaatgtagaatcagaaaattcaggcactttgcactcctcatgggacactccagcagcactcacgtgaccatcctgagaatggacaggacacctgaggtggggaagggagcacagaacccagacaccagcctggacacaggcacctgggataatctcctattccttggaaagttccagtatctgagggaggaacagtgacttctggtcctgacctgagtggagaccgagggactcagaagagctggaatcagacccccacacacactgagtatgagtcagagaacaaggcctgagagaaaaagtcacagtgcccaagactgctgcaggggtcaaaggggactgctgatcagtgttccagggatttgctccagattaatctgagtcatggaaaaactgcctttcttttgtttctaaacaaatacctgcaaagacaaaagaccacataaatccccaggtgcacaactttttcagatttaaagaaaaaacaacccccgtctttccctccattcccaggagaagctcactctgtggcatcaagctgcctgggtgagctctcttctagaagagtccagggggacaggcaaggaatgggaggcaggaagtccagttcagggagggggattctgggatgaaaagtgaagggagagggactgagcccatgctgagggtttttctctggtttctcagacagctccggggccaagattcggggagacattgagacagagcgtttgatataaaagaagggggtaagagccaagtcccagggcccggagcttggctctctgggcttcaggccccgagggcggtgcctgggatgggccggctcagctttggggtttcccgagctccgctctctctcttccacctttcccaacctgtgtcaggtccttttacctggatactcatgatgcggcctcagttctcacttccattgggtgttgggttcctagatcagccaatcagtgtcgccgcggttcctggttctaaagtcctcgccggcccaccgggactcagattctccccagacgccaaggttgcgggtcatggagtcccgaaccstcctcctgctgttctcgggagccgtggccctgatccagacctgggcaggtgagtrcggggtcgggagggaaaargcctctgcgggaaggagcgaggggcccgcccggaggagtaaatctgcacatatatttaattacagattacaattacaatcaaggcagaaatgatctcatttttacattacaactctggaaaaggcaatagactgagatgcaagtgtgcccccaagtgatgggcagaaggagagaaggtgttttggatgcattctagaacacaggtaatctaaggagagttgatcaaggccgtggaagagtcctccagccactattggccatcaaaggagtcctctgtgtcccaggaatggtcctgctttggtgtccctggtgtgacccatyacccgctgggaacagcctgagagaagtagggcctctgcaccaatgctgctgaggatgtcagagcacaggaacgaggccttgggaaattacctggaaatgcgactgaaatcttccttcctgaggggtctgggctcttggaaatcaaaccctctcaggttgggtggctggacgattctcctcacacttacaatgggacaaggggaaccaggaggcccccaaggggatccctgggttccacacgaactcctcctaccctcattgtgtgacagcagccatgcctcctcctgkggatcaggatctattacctgtgcctggagagraggggactcctcttctcacccgctggtctctggacacatactgtccaattcccctgkggcagctgtaatgtgtagttcaatgggcactcrtttgtcyccttttaagggtaccctcctttagaatccaggaccttctaccctgcagagtgtkgttttgggagagaagtgcaaaatcccacgacaggtgagttgaaggaatgggatatggagccacatccacttccaccccttggtatctggacccacgtgttcttcctactgagattacagaactgtagagatrtctttgatttttaaaatgcaccatgtcctgaaagatggcaccctcccacccgcagagtgcttcctgcaagctggcgttgagctgtgcctatagaagctcttttcaacattctttatggycagsagcccttggttggtgcagatggtgataggaccagtgggtcccacagcatggccacactgcacctccttcgctgtcaagtgggtcccccacgaagatactgcacggagagcagtgccaagcctgtggatcaggaatatcaacagcccccagagagtggtgctggctgagggtctgagagcaggacaggaaaacccacctatggaataggtgcctatccctgtgaagatgaacctctggcccttccaggatggaaggagtgcaatgtagtcaactcctcacttagggtctggttggtcacctaaagaaatagagccctaccagggaagatcattgggttcaaatgctgatgagtaggacatttagaggtggcagtgtctggatctaccttggtaggagggagtcagtactgttggacccataggtagcctcatccctgccactgtgtttgctccatttatgtacccatcctacccggcctgggctgacccatggggaaggctggctaatttcagtgcttstgcttggttgttcagggccatttcaggtttgggtgttttctggggatgttaacatgggattcaggctcaactcacaagaaacttttccatctcatgatggatgctgttgggcatgtccaatgtatgacttcatgagttayacagatgctaattcktaggggcacttggaatcacatggttgttttgtgtcccatggtcaagcattctatcttaycagggcctacagtaacatgccaaaagttgcttccaacatatttctctgctttggatggggcatatttctgtgctgtggatgacatggccttactccagaatcccaggccctccactgtgactctcctactggtgcttggttcagctccaccccaaatcttaccccaccactggcactttcagcaccagggggtctgaaggatggtgactgcrccatggcctggatctgctgcagtgtcctttcctgtggaggctccactcaaagctggcatcctcctatgtcacctagagtgtgggtcaaagcaatacacctacatgtagaatgtgatgtcagaactcaaacaggctcaccaggcagtgtgcttccttccttgcatgaggatgcaagatgcaacagtttgtctttcacattggaagggacacccctggatgcccctaaccactagacctgtaaaacttcactgcagtggccacttctgaatctctgtaaggtttatttatcttcaccctctggagagaagatgttttaccaaagcctctagtgtaccttcctcctcttactcatccatcccagtcaacatgatgttgtcaatgaaataaaggaatttaatattctatagtatatccaggttctccagatctcttaagactgtactatagaggcctggggaattataatagccctgaggcaaactatgaattaaagtgttgtggatcccacatgaatcactttatatccacttttgtgtgtgtgtgtgtgaggcagagtcttactctgtcacccaggctggattacaggtgcacaccaccatgcctggctaatgttttgtttttggttttggttttgtttttgttttgtttttggacagagtttcactctttttgcccaggctggagtgcgatggcatgatctcagctcaccgcaatgtccgcctcccaggttcaagttattctccttcctcagtctcccaagtagctgagattagaggcatgtgccaccacgcccggctaatttggtatttttagtagagagaggttttctccatgttggtcaggctggtctcgaactcccagcctcaggtgatccgccctcctctgcctcccaaagtgctgggattacaggcatgagccaccacacccgggctatatccacttctaattggaatggaagggaatgcactcaccacatccacagctgcacactgtgtgcctgaggccttattaatctgctctaccagatatatccagccagcatgctagctgcaatcaggactcctacttggtcacatctggagtaatcccattcattccttagtaatcccattcattccttaggctccatcaggcttatttgctaaattacatggagataataggcaaccccaacaccaccccacatcctccagctctctaatggtggtgctacccccacagcacttgcagtgccttccacaagattcaccctgggacatacgatcatttttgatttggccagaatggaggcagtttcagaggtttccctttggccttcagcacaatgagagcccttactccacagactagggatgcagtgtgggggtgactccagctgccagggcatcagtgtcaattatgcactaggagaatggggagataaccagggctgggtctgtggactcagtgaccccatggtgagccgtgatgtgtccaggtttatttcgtggtctccgtaatccccaatgtgagggggtcatgatgatgctgtgggcctctgggcatcaatgtcatctcacacccaaagtcagtactcccccaagttctccctatttccctttcccagggtacagtctctaaagtaaatggctgtaggtccctttgcacaatggctcagggaattgacccagcatacacttgccacagggttgcagggtccttcctcctaggaatatggacacctcctccgtcactgggttctgaatctgaagcttggctgagatctaggcactgagaatggatcatgattttgtattggttcaaacaccctcagcctcctgctcctcaattcttgctttcttatcatagataccaagcagtgctcttgctggctgcccttctgttctgaccctggaacaccaccctctattaaccttacccacaactgcaggcaggtcaagccccctcggctgctcctctggggttgccatggtaaccgtgtcctctggcttttgcaggtcactgccaccacttgttctctatctcttcagggccacaccctctccgtggatattaatgagcccaactctgggacatcttttcctaccatcaccctcagccttcagagaacaatacaatgaaacttcttagtgatgcaggtccctgttgccagcacgttcctgaggctctggtggaaggtgggccccctgggtcctcttataaagcacggttccggtgggctttccggcctcacgtaatgtctccatcccacaggccaaattcccccagcctcattattccctcttctacatgttccggggcaactaagtcaggtctagcttgtgagataccggcatcattttttcccagtctacatggatcaccccagcagtgggtttgccccatgccctggggtctttgaaaaacccatgtgatacggttggctgtgtccccaaccaaatctcgtcttgaatttccacgtgttgtgggagggaccaggagggaagcaattaaatcatgggggcaggtctttcccatgctgttctcatgatagtgaataagtctcatgagatctgatggttttaaaaggagaaatccctttcgcttggttctcattcttctcttatctgctgccacgtgagacatggctttcaccttctgccgtgattctgaggcctccctagccacatggaactgtgagtccattaaacctcttttggtaaattgcccattctggggtatgtctttatcagcaacatgaaatggactaatacatcatgccttgagaaagtgttcccaagtcaaaggatttttatctatctagcttgaaattctgtccctttgatcaaatgccctcaaattccaatcccagaagtgttccccaggatcctatgtggacatgccagctagttcctgcaaagctcctgagtggaattcccgctgcattataagggtgaggcttctgcagcatcttccagcgtaggaagtgggaaccattactggaaaaggcgagccttctctgcatgcccagagggtactggagggcacccatctgataatgctgtcctagtttgcagaatctcatgtttccccaccagggccctgattttccacaacaggcctgccttggctgaatgtcaaacatctctggaggtctgtaaccctcacaatgatatcttcagctaccattccacactatctaccctttcgctacaggaaataagggcctctccatgagacactgcagaggcctcacacgtagccagtgacagctgttagaatccctcagattctcattctccttttatagggcatcaacacagctgagcagtaaccagccagcttccctgttgtaggttttccctcccaccctgtcattattgtgtagaggcttctatcacaccacctgccatagcacccgggaaccagggcatcttctcaggtccgtgctggggatatccacagcagctcagctgcaccttgtgccatggactttctctgtccccaaccaacgtggatggcattctcggcctgccaggcagtgggcaagctcagccccaatccccgtttttgtctgtgtctatggaccactcctgaagccacttgtgttggttagcatcccctgaggagcagactgcaatacagaattaaatgtgccaggatttattaggggaaatagccatgaaagaaattggggagcaagacagaaaagactgggaaagccataagactgtgacgcaagtggcttttttatttttattttttgagcaatctcagctcactgcaacctccacctcccaggtgcaagtgattctcatgcctcagcctcccaagtagctgggattacatgcatgcaccaccaaacctggcaaatttttgtctttgtagtagaggcgggttttcaccatgttagctaggccggtctcaaactcctgacctcatgtgatctgcccaccttggcctcccaaagtgctgggattacaggcgtgagccactgtgcccaaccagactgcaatgcaagtttaaaccccagtgaaggagagagggaaggaagtttggctgaaagtatcctagacccagtgcaggttaagagaagttcagtaagggtgagccctggagcctcagtgggcctttaaaggagggacaatcctgtctttgtttctcctcttctctcaattattgaatcgaagaagccaatggcaagtatggtctgagagcaaacgtagcaatagatttcaggcggcaacagctggagcatcatcagttgtgcttcctctagctgaggggctgggatgtgcattctcaagactgccacaacaatccagtggggagaaaggacaaagggtaatgatcaaagagaaaaaaaggtatgaactgatgaactgatacctttaagtagatgagaaggatgatgtttgggacaccagtagagggactggctctggctgggagcgggaaggttaacccacaacaaccatccatgtggtagaagacccagcatgcagtgcagctgcaaatgcatgagcagatggaatctgtgaaattgtcttctagtgtgttcagttttctcagtgaagtaggaagcaaggtcatcagctgaagtaagaatgcagatagaaggttggatgtgtgagcagagagaaggtgtgtgagagtcacccagaccagtaggaggctgagggtgagccatgcttggagagggtgattgctggtcgtggtggggggtccccatgaggtttgggtcatgaagttagagagagaagtcagcatgctgtgtgctgctttccagcctccttcagctcatgggggcaggtgcagtgtaggcagaggtggattccaccagctgtgtagttttgccaaacaagtatggcaacgcaagggaggggcaagggagggatggaaattatttacaatagaattcaaaatggctgaagagggaggagaggacatcaagggtgagggacagtgagtagatggcaggatcactggattgggaatcccagagtgggtggaaggattgttggaattgatgtactacagggcagactccaagcctggaaagcaggcacataggcaatgagtggttcactgatattacgtcacagcatatgataaaatgatagtataagtatcctcagagcctgtggcctccgtgcaaggggatgagtggaaagatggtcagagaatggaaagtgtgagatagagagtatggaagggctggggttcttggccatgatgagacctaggactctttaggggagaacaacaacaaagcaacaggatcctggtgtcagggacagaccatggccatggcgggatgatagcagctctcctacgaaataatgcttatatgacaagggcatgagattcaggcagagagaggagaaggtcatggaggagaggagtcccagcatctgagaagccagagggcgatgcatcctctctgctctatgggtgtttattgctgccataaaaattaacacaaaacaagtggctttaaacagcatctctttatcatgtcacagtcatgtgtgttacaatttcaacagtctcatggggctaaaatcaaggtaaggggaggtctgtgttccttctgactctgaggaaaaatctactgtcaagctcattcaggttcttgtctgaattcacttccttgcagataggactgagatccccacttccttgctggctcctgtccaggggccacccttagctcctagagccctctctcagttcctcatacatatcccatgcaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17820 - DNA, 16105 bp, Homo sapiens
atatcagagagaatatgcaagagatgcagggcactgcagagagatggggaaagcagggcaaagtgaggctaagatggaacaagcactgacactaaatgacactccctatttgcacactgttctgaatgcctcatttaagtctccctactttgctctggtttgttttgggggcttttgtttcttttttctttcctttttttttttttttttgagacagagtctcgctctgtcacccaggctggagtgcagtggtgcgatcttggctcactgcaacctccgcctccctggttcacgtgattctcctgcctcagcctcctgagtagctgggactacaggcgtgcgccaccacgcccggctaattttttgtatttttagtagaaacaagagtttcaccctgttagccaggatggtctcaatctcctgaccttgtgatccgcccacctcagcctcccaaagtgctggaattagaggcgtgagccaccggcaaccgcacctaccctgtttatttcttttatagccagggtctccctcttgttgcccaggctggagtgcaatggcacaattcaaggctcactgcaaccttgaacttctgggttcaactgatcctcctgcttctgcttcagatcaccaaatagctgggactacagtcaccgtgcctggctaacttttttttttttaatctttagtagagacagggtcttgcaatgttgcctaggctggtcttgaactcctgacctaaagcgatcctcccacctcatccccccaaagcactgggattacaggcatgagccaccacacctggccacaaagcagtattaccacatttttacagatgagcaaactgaggctcagagaggtgaagtgagttgcccaagatcacacagaaacaggcagagctggtatctaaattcagactctgaggctacagacactgcacttctttttcttcttcttcctcttcttttttttttttcctttttttagagacaagctctcactctgtctctcaggctgggatgcaatggcataatcacatctcactgcagtttcagcctcccaggctcaagcgatcctcccaccttagcctcctgagtagctgggactacagggtgcaccacaaccacacctggctaatttacttttatttttattttttgagacagagtcttgctctgtcacccaggctggagtgcagtggctcgatctcagctcactgcaacctccacctcctgggttcaagcaattttcgtgcctcagcctcccgagcagctgggattacaggcgcccgctaccacacccagctaattttttttttttttttttttttagtagagacagggtttcaccatgttggccaggctggtcttgaactcttggcctcaggtgatctgcctacctcagcttcccaaagtgctgggattacaggcataagccactgcactcagccactaatttttttatttttattttttgtagaggcagtctcactatattgcccaggctggtctcgaactcctgacctcaagtgatcctccagcctcagcctcccaaagttctggacaacctgtgcacactaccatgccctactcagacactgcacttctaactactaccttttaattcacaagtcagagaccaagaaagaggcagacacccttaaatacagagaaaagcagagaaataccgacactaagaaatgggaggcaggggaattgagagagaaaatggaaagaaacagagaaatgaccagagaaagacagatgagcaatgacaatgggagttctgaggactgaggctctctccctcaatcccgagcccctcttttctttttctttctttttttttctttttttttttggagggttggggggacagagtctcactctgttgcccaggctggagtgcagtggcatgatctcagctcactgcaacctccaccttcagcgctcaagtgattctcgtgcctcagcctccctagagtagctgggattacaggcatgcaccaccatgcccggctaatttttgtatttttagtagagatggggtttcaccatgttggccaggcttgtcttgaactactggcctcaagtgatctgcccacctcagcctcccaaagtgctgggattacaggcatgaaccactgcactcggccctcccaccctctcactgaaattctctgaaattctcccctttgggatgaggatggcaaccccaggcatgtaccctcccaacctgggacccgacctaataccctaacatcctgctgacagtggctgttctcgctgggcaggcgtcccaaagcacatcgagccagattcaggcagagtggaactggcccctcagccatcagtggaggtggcctgggaggctctaccctgaacggggtctccccaaagtgatgcagaaactgggacatgctctgctgagcatggggctgactggagtgaggcttataggcagtgcccacatggggattaagatgtcagctctttaatccccacactgttcccatcacaggctgaccagagtctgccccaggacccagccagggacacagaggtcgggggagagagggagaagagagggagagacagagagactcagaggtcctgagaaagacaggcagagagagatgatggagaaaaacacgtgaagacactgagaagagatggagaggaaaaggaagagacagatacgcagggatggcaaagagatcctggaaaacagagaccgggaggagaaagagagccactgagaaaagggaaagacagtgatgtccagagagaggaaagacaaagagaccctaaagcaaagataaataaagagaacagaaatgaagagagatagagagacctgagagaaaaagaaaaagggaggaaaagaaagagagaaacagagaaatccagtctaattacaaagagatagaaacaccaaggcgggaggatcacttgagcccaggagttcgagaccagcctgggcaacatagtgagacctggtctctataaatatttttaaaattagctaggcatggtggcacgcacctctagtcccagctacttgggaggctcaggtgggaggatcacttgagcccaggcagtcatggctgcagtgagctgtgatggtgccactgcactccagcctgggcgacagaacaagacagacagaagggaagggaagagaagaagaaagggaaaagaggggaggggagggaagaaagaggctgggcatggtggcttatgcctgtgatcctagcactttaggaggctgaggcaggaggactgcttgagaccaagagttgaagaccaacctggccaacctaacaagaccctgtctctataaaaaaaaaaaaaaaaaacaaagagaagtagcgaggaagaaaaattgggcattcattcaacaaacatttactaagtgcctactgctgtgctgggcactactttaagtgctgggatacagaagcgaacaagacaaaatccctgctctagaagagctgacattccagaggacagcccacccgagcaaaacggaggaagagtcaggagctggggagaaaccagaagccataataaacaggatccattaaagcctgtcacagagggtggggtagggctgggggaggatgcagcttactgtgccccaccacactcccgctgtcagtggagtcagcagctctgagcaggggtcctgccccacaacccctgtcagtcaccaggttccagaaaggctgacaggtaggaagacccaggataggggaggacagaatatggaggtacaagggggtaaacatgcggaaaggcacgctgaagaaataaggagaggcacagaagtgccaggctgagacaaagggaagcacagactaggggagatacagggaggggaagacacagacatactgaaaagagagacagaaaacagacacaaacagaggcagagactgagagaaaagagagagagatgggaagagacagaaagaggagagagagagatgaacacagaaacacagagactgagagtgagggaggctgggcgcgctggttcacaactatactcccagcagtttgggagaccaaggcagaaagattgcttgagcccaggagttggagaccagcctgggcaacacagtgacatcctgtctccttaaaaaatacaaaaattggccggacgtggtggtgtgtacctatggtcccagctacttgggaggccaaggtgggaggcttgtttgatcccaggaggttgaggctgcagtgagccatgatcgtaccactgcactccagcctgggggacagaagccaggctctgtctcaaaaaaaaaaaagaaaaaaggaagggagggagggagggagggagggagggagggagggagggagggacggacagagggagggagggagggagcaagcaagactgagagatgaaacaaagatacacagagaccctcccagagacaatgccagtcctaggctctgcacagtccaccccccgcccaccatctccccaggtctgggccctgtgccaggcacttggaggaaggctggatttggccaagcagggacaggcaggagggtggaccacattcctgaacagtctgttccaaatacagccccaacctcactgctcccaccaccgcagccctggcccatccaggccagagtctgccccctctagcccatgccctaggatgggggttgggggggatagatgagagaatgagggataagtttgtctgtcgtcatggcctggcctcagacagggacttgggggactggataccagggggttcagcagcatgggcacagaacatttgggggcatctgggagccagtgccttggggatagagatggtagattcagggcaggacataatatggaggtacaaggggatcaacatgcagaaaggcaccctgaagaactaaggagaggcacagaagtgccagactgatggacacccagaagccagggaaattgaaggcagatctggggaacaagcatagtacacagggtcctaagagtaatggaagtgacaagggctcaggtgtgagctcctaggaatcacaggcacagagcacaggaatgccaggggtgtctttagaagtgtatttgagccaggcgcagtggcctgtagtctcaacacctcgggaggccgaggcaggcggatcacctgaggtcagtagcttgagatctgcctggccaacacggtgaaactccgtctctactaaaaatacaaaaattagccaggcctagtggtgcatgcctgtaatcccagctactcaggaggctgaaacaggagaatcttgaacctgggaggtggaggttgcagtgagccgagatcccactgctgcactccagcctgggcaacaagagtgaaactctaagaagggaaaaaaaaaaaacagaagtggtgtatttgagagtcggtgtgtatttaggaatcagaggtacagggtacagcgttcaggggacccagaggtggcccggagattgaggaatacacacttacaggccaagtaaattggactcaaaggtgctaggggctcaggagggtgcacctgttgtccaggtgtgttgccatgaaaatgctggtgcacgaaagttgctaagtaagacaggctgaggcagacacacaaaaaaagccagggggagccagggcacagctccactagggctgggggcggggtggagacgtcgggttggggaatccacggaatgagcagcccggagacgcccactcctcccacatcgggtctccgccccgctccacccctaagaccccttggaaatcaaatagaggtgaaggggtgcaggcgtggagaattgcaggcatgtcgcgggtatcgctgcgctgctgttgtggcttctggtgctggcgccggcgtggtgggggtagggtgggtgccgcgctcagatgcgggggtccctacctccccggcccaggccgctcccattgctggggaacttgcagctgcagtccggaggcctggaccgcgcactccattcccgacaggaatgggggaacggaattctggattcgtgaaggtggggctggggactagaactcctcctgaatgaagacagctgagggtttgtactctatgatcctgaggaaggacaggaaggatgagtgctccggactgctgagtactaggaaaggagaatagggagtggagagcctggggccgggacactgggtcgtaacgaaggagcccagagcaggaaatcaggttgtgggaagaggggagcagggggtctgttctggttcagggtgggcaggctgagtactgagggcccaggagacgactctgagggtgcaggaggctgggaagctggacttccaggtcctaagggaagaaggaagtgggggcctggactcctggatctcagggaggaaggagctggggatttgaattcctgggcctgaggaatgagggtctgagacgaggactcctgggtctgaaggaagagggagctgggggcaatggctccgatgaggaaccctatgggcacccgctgagcaccggctacccgtagctctccggccgctggggccgggtgttcacagtgcggctgggcccgcgccctgcggtggggctgtgcggctacgcagcgctgcgggacgcgttagtgctacaggcggatgcggtctctggccgcgggtccatggcagtcttcgaacgcttcacacgcggaaacagtgaggccccggcgctggacttgccggyccggacgctccaggctgggcgggtaaatggtagaggcgggcaaatgggggcggggcctaatagagactccagctaatgaggtgcaaacggccgagagagggcggggcggcgctaaagcgtaaggttagaatggaggttcatcctgcagccaacaggagaaaagagcctaagagtcaaagcccgagagccagcctaggtcagggatgragcccagcaaaggcggggccaatgtgtggatagggcacttggaggtctggtaaagaagcaaagggaacgaagccggccgcaggagtcggaggcccctaaagggatgtagccagtgacccggcgcttcctggatagggcgtggccggctcccsggcccgcctcctttcccgtccccaccacaggaatcttgttttctaaccggccgtgctggtggacactgcgcaattttgcacttggagcgcttaagaagttcgggttggrtacgcggaccgtcgaggcgcgcgtcctggaggaggcggcttgtctgctagacgaatttcaagccaccattgcttcggcctggccgggagagcggaagggcctggtgtgggagagtcccttgcactgccaagacggggccactggaaggtatttgggtggaagaaagccagtaagcccatggggctggctgrgggcaggaccamgcgttatgaccaccgtcctgttcctacccccaggrgccccrtttgaccccgtgcggctactggrtaatgctgtatccartgttayctgttcttgtcttcgggaaccgctatcgctatggggacccggagttcctgaggctcctgaacctcttcagtgacaacttctgcatcattagttccagatggggcgaggtgagagggccggccacaatctttccttggtgcgtccagccttatgccaaatcccgagtacacagacctacctacaatggatcattagaatgggacagattcctggaagagttctagaacatccagtatcaaagtcctagtccaatctccctgtagggaaactaaggcctagtggccttgtgcagggcccatgttgagacagaccctgtctctccagatgtacatttgcctgtccctcatggactggctcccgggcccgcaycaccgaatcttccgaaacttttcggagctgcgggtcatctctgagcaaattcaacgacactggcagatgcggcagccagcggagccccgcgatttcattgattgcttgaccagatgggtaaggcatgggtcccagctctctaaactctatccatgccgcccaccaacaggtgcctggcacgcggcagcmcatctcctctgcccacagtaacagcaggacccggasagccatttccaggagtagacgtcggtaatgacgacgcattttttttttggcgtcaccgaaaccacgagcaccaccctgtgctaygggctcctcattctgcttaagtacctagaggtggcaggtgtgcaacccggagagacccagaatgggaggctgcagtctggggatggctggagggtcctggaagtgcgcagctcacagcctcccccggcctgagccaaggtgcaggagctggaccctgtggtagggtggaggcccgccccaagcctggactatcgcgtgtgcctgccctacgccaacgcagtgctgctcgagatccagtgcttcatcagcgtggtgcccctggggctgccgcgcaccctcaccctcgacacccacctgcacagccactgtctgcccaaaggtacccactgagtctggggatcccgtgcgggacscgggtgcatgagatcagccagaatcagcaggtktgcgctgtgcagaccaaaacacaatcagttacccctggagcaggaaggcasctctgccttcccttaggctttttgttgttgttgtttgagacggagtctggctctgtcattcaggctagaatgcagtggcatgatcttggctcactgcaacctccacttcctgggttcaagcgattgtcctgcctcagcctcctgagtacctggtattacaggcacccaccaccacgcctggctaatttttgtatttttagtagagacaggtttcgccatgttggccaggctggtctcgaacttctgacctcaagtgatctgtcctcagcctcccagagtgctgggattacaggcgtgagctacttgcccggcctattcccttgggcttttaaaaagcgtcttggatggaggtggtgcaggtgctcaccaagcccgcaggtaacccaagttgcatgtatccccagggcacttttgtgattcccctgcttgtgactgcacaccgggaccccactcaattcaaagacccagactgcttcaaccctaccaacttcctggacaagggcaagttccagggcaatgatgctttcatgccctttgcctcaggtgcaggcagaggaggaaggggaccagcctggactggctctggggtacctggtgctcactgtgcacctgtgtacccggcaaagcagatgtgcctgggcacaggcctggcccactcgggtatcttcctattccttayggccaccttacagaggttctgcctgctccctgtggtacgccctggcaccatcaacctcacctgcagtgcactggcctgggcagtgtccccccagacttccagctccagccagtggcctgctgaggtcaggctccactatggtgggctcactggccctcaaacctccataccctcctcggtcaataaaggccctaaattgcagatggagtcagatgtgtgcagctctgaggtaaacttttatttcttggctgacaggacttccacacccatgctcctcctggcaccttttactctgcccaagcagtggcagcccagtccaaaaggtgcctgccatggccaaaggggttggggagtcacttcacattccaggctggaggagtgagaggacttgggggtactcctcccaccccattgccagcaagaggccatgactcacctcaaccccaagtcctgcatcctggtgggaagtgacaatgcctcctcccagctctccatacctaatggggtcatgaccagacagggtaggacccaggcccccagcttcagttggtaacggtggcctccacggctgccccctgtccaggtgacaaccccagcccccatgatggggcagcaaaggtctcttctcctccttggtcctcagcaacagacagagccctccacaccaggcaggacagaggcaaagtcagaagcagcagcggtggcagggaaggagcagccagcacaggcccagggctctcctgaagtcatttaagctgtctgccatgcggctctgggactggccactaggtgggcgtaggcggctgtgatacaggtacttggacacctttctgtcctgatgctgggggtgagaggggacaggagacagtgagtcatcagaaggacaaagaagccaagggaaacctggggagatggggagaggaccaggaagaaatggggctcctgttggggtaccaggagagtgggctaaggaaggtgggcagagatgaagaaaaatgagtggtgggatttaacaagaggctgatgagggggatggggtggcatcaggcccaagagggcccacagaataggaaggactgaagggagggaagcaggtacctagctgatacttgtctttggctgctgcccgctccttggcatcaaaataccagacagtgatggcgtacctggagaccagggtggttggacattagttttctgcaattccagctaccatatccacacacactaggcggccatccttttgagccacccggttctgctcccacctaggccccctctcaatacttcgtcgctccctagtcactctgaggctctgacaggacattgtcacagggggagcacctgggtgcgtctccagaagtacaggtcatacctggtggcataggctggcttcacctcgtgggggttccgccggtcagaccagaaaatgagcaaccggtcaaagagtggctcgatgttggctaccacgggccggccctcagggaagatctgcagcaggccgccatgcacctgggggcaggccaaaggatgaggctagctggtacggccaggagccgctgcctcccacggtgccccgggagcccactaggaggcgcagcgtctgcctgcatcactccctcccacccctcgggctctcaaagtgaatgacaacccagagactgcatcaccatggagatgggcaggaagctactaaagacaggaaaagggggaaagtgttcattacaaggccgggtggggctgggcagacagcaccattcccggaaagaggggagttcccaccacacagtccgctagagaggaggaggtgccatttcccaggaagagccggcagatcgcactgcccgctgtgtgttgagaagagaaacaggagaatgccagaatctgggctgagagtggaaaatggagtggacgcacgccacccccgccccagccctagccccagcgccaccctcaccctcaccctcacccctaccttaacgtcccagttctgattcaggtaatagatacaggtgatgcagcgcccatcgccgtggggattgtcaacgtgccttacgtacccgagcccgttgcctgggtaacacgccaccatggcctggcagggatggagggaggtaggtttactggggctaggcaggcacatcttagagaagcagccatgaattacctattttcccacccctccttgccccatcttccccatgactccttgggtcaagggttccaagctcctgccccaaaagactttctttttcagccaaaatcccatccccaagtctatcagaaacctcagctcctgggcctcaagagcccactccctcccaacacacatacctggggcctggcacccagctagggctcaattagtaacagagtttgatttgtttcaagataccccaaaccccacctcagccatttcagtagaataataccaatttaaacattttcaggtgtgcaaggaggtggcctcacagccctagaccaggaattcttacccttggctgtggagtggagccccctggggagctctgaggttctgaagtacctggcctaaggaagggcctgaaattggtaaagcttcccaggtaattctaccatgcagcaatgttaagaactgctgccctggactacaaagaatccccactaaattatctgtcccatagacctccgaacaggagccaaaagctacagtctgaatagaaagacctaattccaactccaaggataatttgctgggtaaccctagccagttccaacacctgaatgggcctcaactgcctgatgtgtacagcaggggtaataaacactgctgtttacagcggtagcaattaatctctctgagaacataacttgggaggttctggagccccaactcctggagatctaacaggactcattgcagggcttggtttctctgtctacagggttctttcctctgcctgacagttgccactcccctgacccagccctacaatgctgtggccagggccccgggatgtttgtcatcagggagctggcagaaaggtggctgagaggtaaaggaaatggcccagccacttctgcagacacaattccctggttcaagtctcagtgctgccacatgagctgtggcatcaggcaggtgacttcctggtctcaggttcctcatccatggatccaatggagctcacagctatttcacaggttgttgtggaacaagtgaacaagataacaagtgtctgggaagacagccagcacagtgcctgccacatggagaactggagcacaggctgaaatgccatttaaaaattttaaaaggtccctgtcccaccctctgcccaaagtcactgcagtggcaagatgaggtagcacacaaaaaggggaggactggcacaaggacccttcaacttctccccagcccggaccatctgtcttgacctctctgccctgacctctctgccctggtacaactctgctggcgtccattccccacgaatgctcagctacacctatgggcccggcccagcaagacagtcccaagataaacattcacgatcaaacatcagtggccactgccacaacaggatgcttgccaagcacgcacgccacagcagactgggctgcttcaatcctcaccctccccaggacgcctcccaacacattatcccagggctcaccctctgtggtggatgttaagctgctctgcattaaccatgtgcacctcatccaccagaccttgccctggaaagagagggctgccaccatctactgccacctagcagtgggaagctgacaaccttctctctggcagcaccagagtacaattagtgagaaggccccccagggaaaaccctaatggctacacttcaaggttcaggagggggcaccttctttgcactgctcactccctatggaagggtcggcactctgagcaaccacctcactgggagaagaattgggccatggtccaggaggcttagaaacagtgagttactgactagagatgggcaagacctccccaattaggaatccaatcagagattacactgatgatgcacgtggatgggtggcagggaaggggtccagtgctgcaccctcttcccacaattcatccccacacagcagccagagcccctcctctccaggtcttcactccatcctgagaaaatacaaattcccaaccacagcctcaaaggcccccaacctcatgtgcctctcccatcactctgctccatgcctcaacaggctgagctcatcgccaccacaaggcctcagcactggcctgggacactcttccttctgaccctctttgttattcaggattcagagaccaagggtcaccttgagtactccggctgattgtccgttccactcctagcaacatggcatcagcacaggcacctgtttacctagtactgccctggaaggcagccacagggaagcccctggggccaggttggtctccccagtgcccagtgcagtacctgcagactggagtgcactgctctgggcctcctctgcaccccagccctgctatgtttcctcctgccctgtacattctcacacagcgcctcccaccaagcacatgggactcacacagaaacaggaacctgctctttagggccccacccttcccccacatatacacaccttgggggtgaaagcatcctctggccccaaggaaagtatctacttcctgccctcacaggggaaggcctcaggaaacttgctctccacccctcccacctaggggagggacaggtgggaccagggccaggagaccaaagacttaaaggctattggtgacaatctgcctgccaagagccccacccccactacacacacaccccagtcagaagcctgtgactgtcccacctccaagctgctcttcaaggagcaaaccaagcaagctggactctccctggggtcccctctggtagcccttgctgccagtgggagtcaactctctcccacctacaggtcaacggagcacctgtccccaaccagggagttgggggaaggaaggatgacacaggagctccactcagaacgactaagaagcacgtttctactggctctagccacactggtgatccatgtccccacggcaactgctgcagcccacctgagcaccccacagccttactctggagtacaggagagagtccagatggggcccatctaaaagcgggaaagcctggagttgctgtctcactggggaggggagggctcctcccctatgttctcagtccagcctggcctgtccttacttccctaggacaatcaaggtcacctagggctaaaaaagtccaaacacgccccttccccaatcctcgctggggccctgtccccaaccacatagaaggtgggcaccagaggcaccaaaacacaagagatcttctcctactctcccctccccaaactgccagactcactggggatgtaacctggttttcgtattccgtggatcagcaaattgaggctcagagcagtgtcccatctgggccactcagcccttctggtctccccctgacgaggacgacagccaacctggggtgaagatgctgagccagggaggccactgatcccgcccgcacaggagccaagcccagggaggggccggctctggctcagctatcaagtaacgggagggagagggaagtagaacaagttccagctggggtggggaggaaacaggccttggccccgggggagccctggtccctgagccagctccagcctgagaggaaagccacacagaagcagaacccaagatgggatctgcaggaggaggcagaggacatcaggagctcagcctcacgcctgcagggcacaacactgcccgtgccatcagccagccaggcatcactgtgttgagcagtgggcactccccacagggccttgtccaaaggacaccaagccttggactcaaggccaggcccccacaccacccatgaagacaatgatcctgtcagcagcccggaaaggccctatggaccactgtcctgtgctgggctcctgaccccaggttcctgaacaggcagctggaggccatgaggccttgacaactgcccggaaactccaagcaaatgagcatttgtcttaagagaggatctgtggcctctgacagattctcaaaaagacccaggctccaaaataccattaagaactattgttctaaagcaaaaagaaaaagggactaagaacaaacacataaaggcagaggaagagacagacatgggtagggaggaagtgacacacaggacagggggaatggagggcagggactgggacagtgaagggtgggagacatggggatgagctccacctgggccaacaggcagccacccagtaccacccccaggagactgtcctcgatgcagatgccacagtggggacccagggcacaatgcagtccagggccaagcactcggcccagcgggcagcacccctttccttccctcagcccagggctcactcatcacagccaccctcccccttctgcttctcctgccttggagacaggatggatggactagaaacatgggccagcaaacagggatggacgacaggagcacagggaaggatgtggacagggacagacagcaacagagaacggccaggtgaactgtgtgcctatctacatccccgtgcttggtctggggccacagactgacaccaggaggccatgaaccccaccaaggtccacgctgtgaatgtcagcagctctcatgagtttaagagggttcctggcaaagtcaagaaccactgtggcgatgcttgaaggcagcatgctcgttaagagtcatcaccactccctaatctcaagtacccagggacacaaacacgcagaaggccgc

SEQ ID NO: 17821 - DNA, 41853 bp, Homo sapiens
  misc_feature (1)...(41853): n = A,T,C or G, or insertion/deletion polymorphism (see Tables 1-2)
atagcaagcagctcattggagagccacacagtcaccaggacagagagaatgcccagcagcagaagccaaaaaaagaaactttccctttctgtctcctctgtctgtggcgtgcaacccagctatgaggacgtggggttgaagccatttcctttttcagtttcagcttctgaccctcctcaggattagaagtggcgattcagaggctgggagggtgaaagcatgacttctcaagaaccagctcgtgctgaagtcactgctcaccttcctgtctcagggatgctcctgatgctaatgacgtcgtgtgaatcatgctctacgtgtctgcatgcctgagccgagcttatcctcatggcaccctgtgaggcaggctgctgctcctactcccactcaccagaagaggaagccgaggctcagagactgagtaactcttgaggttacacagccaccgagcagggtcattagggccctatgagatttccttccgactccgctctgaactcactctcgtaggcccaagctgggcgcctcccccagggaacaccgtagtggcccggaaaacagagagcacaggttacatttggctcacattcttggtgtgtccactgtaggttgctgtgaagtaaattttaaatttttatataaaaacaaacagataatttcttgagtgggacataaaagcatgaatttgaaagttaaaatgtaagatattgaccttttacttaataataatgtaacaatattgctttattaactgtgacaaatgtaccattgtaaaataagataatcataatgaaaactgggtgtggagtgtgcaggaactctgtattatctttgtaataatatggtaaatctaaaattgttctaaaataaaaatttttctctttaaaaaagtaagatatcaaataaattttagaatctcagtttccttcaggggtacctggtcatgattatcttttgttagaggcatatcagaggccatgttgctcgctgagtagaaggacattctacagtgtacgcttacagcctcttgaaaagcctgtattcattaagagaagaaaaagagggtgggacagtgaagattctttcacttcctctccccagcctctgtccccttcttagcactgtgcgaagagtgagaggtaataaccacttcaccctccccaggtttccaccagagtggaaggggttccatcacagacagactatttgagcatttcaccccattccagcctccaccacaatcctacaaattcaactggcccttctaacccctgcagtggggtaaaagtccagcctcttccagagacaggagaatcacttgaactcaggaggcagaggctgcagtgaaccaagataattccactgcactccagcctgggcgacagagcgaaactccgtctcaaaaaaaaaataaataaataaaaaataataaataaataaataaataaataaataaagtggggggtaattcagggcagggcagaaccagaatgtggggaagtcaaggaagccacagaggcaagagatttatgaaggacaaatggacaggattcagtgaccaagaagatgggaggaaggggaggaagagaaaagagggaaagaaaaaagaaaaatgcccagggtgtctccctggtttccaacttgagtgacagagaatgatcacattcccagcagaatttttcttctttctcaacaagattcttcctgttcttttgtttctggttgtccctcagaactaaggagaaacagcctttgggatagttgtccccctaccccatcccagctggtcctaagagtaagaacataggattctcatcccccttttatataaagagaacctgagggtatgtaatgtgtacaagactgtacaatgaggcagaagctcactggcactgggacctacaagatctactgattcacaattgaattctaaacatcacagcccaagggaaccaacacaattacttagtggacccatttctctttccagagaaggaaactgagacctctgaataaagagtaattttcccaatgtcacatgctgctgactagcaagctaggactagagcctggcttgctgagttttaataatccagtgctccttgcattttcgctagttgctttgtcacatctgtatgcacgtgtgtgtgcaaacacatacacacacacatacacatgcttgcttgcttgagaaacagggcattttattcgcatgatattttctttatggacttatcacaaagcatatcctcagactgctcacagaataacaatagcaattcaagattgttttttgtttaaaatcctgtgtttctttatttgtggcttaagtgggaattggtttattgccccatctctaccctgagcaactcaggatttattcagactgtcttgctccattgaggtctatccccttccccagccctatgcctacattaccctgccaaggcagggaacagatctgacagcttttttgcttaagcaaacttattaaaattcataatttgtcaactaattaggaagagagaggattaggagtaagaaaaaaccagaagcacatactattaggtgctcagtgaatatttaagaggaacagggaaagagggaggaaaggaaagacaacactgaggggaaatggttgaatggcattaactgaaaaaaaaaaaaaaaaagatttgccattaatgaagagaaggaagagacagtattctgcccacccaccaggtcggttcccagggaagcccttcagtctcagcatgctgtggctaagtggaaaaattcattgatcataggtttgccagttggaacccttgtgttatgccaatctcagaagctaccaagcatcagatcaattctcccactaaaaaatactaggaggccgggctcagtggctcatgcctgtaatcctagcactttgggaagccaaggcaggaggatcacttgagcccaggagttcgagactagtctgggtaacatagggaaaccctgtctctacaaaaaattaaaaactagtagggaatggtggtgcatacctgtagtcccagctacttgggaggctgaggtgggaggatggcgtgagcccttgcactgactggtggttgcaccactgcactctagcctgggaggcagagtgagaccttgtctcagaaaaaaaaaaaagttgctaggagaagataacagagcctcctcctgtctgctagagagacatacaacccatcccaaatatttctttttctcatctataaatccctcctctctctccaaagggggctgcctggcaatgtccccatcccttccaacagctcatgccgccctgggacaccattcagagaagctctgccatctgcacacccctccagaggccagggacagcttaagccagagtgcctgggttcctcccttctctggggtagaactagtggatgaatcccaaaaggggtaaacatgggcatatagagccacccttgggacaagaagtctgtttgtttggtgttctaggaaaccaacaaaaggaaatgcattttagccaggaaagaaaagaaaaaaaacaaccctgcccagctatgaatgacagccaagccagcagacaaaggtgaaaacagacagctaaggaagggactagctatgcgcccatgggagagagcacctgacatgggcccagtgtgagagctacaatcaccttacacaaatagaatggtcactgtgttaccaaccatgagtatcctttggatcaaccaaaggttgtgtatgcagcatgcagcattctaattctagaaggcgacagaggtgagccagctatgtccaaaatcagtctcatttataaactgtgtgttcctgggaagtatgtgtgcatgtttgtgtgtgtgtgtgggtgtgtgtactgtcatgtgccagcgatagaccttatcttcattgggtactccctgctgctgctgcttttgctaaaatatcttggactctgcactgacatatgagaagctattggcctttttagctttctcctgaactttctgccttccactctccatttctcaggccaatttgccattcccacatgggaagacatctacctgtgctacagatttgactagactgagataaacccatgaaaacatgtcatcacatgtcagcaaagctctcaaataaaaattagctatagaacaataggcatgtcactgtcagattgactgcctccaggtgtgcttcacggccaatatcaaggaaggtccttactgggctggagctgacactgccccatcctatttgacccattacagaaagaccaaagctaggacatatcatatcatgtcataacatgataaaacccgggaataatcagacctgtattttgctgttaccctgaccaataagtcactatattttgtacataggaagcaatgttatcccatagggtcttctaaaaggaagttccatcttcagattattcagaaccaactaggtcaagatctgcctaacaacacagcttcctgaacatattaagcataaaactcagaggcaagaaccttgagaaacatgtgccaaagttcagggaatggtcagacacagaaaaacaatgcttggctaaggagctgaagtgtgtttcaaagaaaacaagaagagcctgatgtctcattcacctctcctggacagctgccttcttccgagatgcccagcttatttgcctggattcatcacgagagaagtagtttttagatatattccaccatctagagaaaggaaatatcacttttttgaaggcgaaccaagaagtctgttttggggttgataaatttctgacagttgctcccagagtattttcaactcaaagtataatttcataaagaggcttattatgttttaaattgtctgtctgtaaaatatactttcatgaaattttgttttctcggaatcttcctttttccttcttgtatgaatctaatgaacttgaatttccaaagtcattgaggtaggaaaggtatgtaacattatgcttgagctttaggtcaataatttatacgatagtggtggttttgttttgtttcgttttgttgagacagagtctcgtcctgtcacccaggctggagtgcaatggcatgatcttggctcactgcaacccctgcctcccaggttcaagtgattctcccacctcagcctcccaggtagctgggattacaggtatgcacctccatgcctggttaatttttgtgtttttagtagagacagggtttcaccatgttggctgggctggtctccaactcctgacctcaagtgatccacccaccttggcctcccagattctggagttttttaaatgggtcaccctatagaaggcatgaagtcatagaatcataataatcaccaaaaccaaccattgatttcaatactagaaaatttgagacaccagaaggtgaagtgacttgcctagagccatacaatggcagaggcagggactgcaacccactatgaaagcttagggctcttctcaccctttggtggccaaaagtattttgaaattttgaccaaaaaaattaatgtttattgatcactttaaatccaaaagatgaatccactggattccacagtaaattgggtggaatgtaagggagggatcaaagggcagtgaatatatgaatggggaggagaaccatttagctaggtgcaaaagtaattgcggtttttgcaatacttttgcaccaacctaataattgttcataattctaagagctattcggatcccattaggagcttaaaagggacaaatgtgctcagggcatgcagtttttgccttccggaactagatcaggatcatgcatttaagctagaaaatggaaagaggagttgcttcacccacagtcagtgctattgcatcaaccaatccctgccattctgcagtttcctggtgtatctgcccggagtcacacagtctttcctgctaagcctcagcgtctcctccaagccacatcaaaatctttccttctgggcctttcccagaagtgaattcttgctggaaggtataaaagaccagctcctccaagcagagcaactccctggctgccgtgaaaagacaaggcactgggcaggtaagactcgtcaactttcatctttcctggtttctgcaaagttgatgatgaaatttcctaacgtcttctcagaaagcttaacactggatttagacttgtctctatcaggcactttctggtgccagctttagccaccccatggcacactcctcttgtttggtataagagagaatgtaattaagcctccccccaccactgtgggggaaaaaggcttttctgtgtctgaaaactatgtcagagaatcataaactcttagggctggaaggtaccatagacctctcttatccaccttgtttaggaactgagacytaagcaatttaatgtgtccagagtcacacaggaatttgggggaaaacagtgacagaatggtgctccctgtgctgttcttgagacagtgtgatgaaatctggcctctccactatagtggagattttgcagtgttttaaggggttccctaagccggagctgtcaggtcttcatctcatttccagcatctcatgcctgccatctgcagcagatccgaccatctagtttgccctcaatgtctagtcctagctgtcttaagtgccctgtggacacctggctctcaagcaggtgtgtgacctgtatgcagcggtagtaggcaggcttcattttgggggaatggggtggttaaattatatttgttttttatgcaattgtgtgcctcaaatctttcagttgaagtagattatttccgctctagagggcttgataagagctatctcttcattctcatcctgatcttggagtcactcaaaagatcaagagagtgttcctgcaggtgatggggcaagaattatggctttcctattggctcactccaccaccctccacagggctctttacaatcatggaagagaatctcactgacttcatcccttctcaggccttccccctatctccttggtgactgctcagcgacattgagaaccaaagtctggaaggccttggtactcagagtgtggtctgcagaccagcaacatcatcatcacctggagcttactggaaatgcagactttcaggccccttctatgaccttctgagtcagaatctgcatttaccaaaatccctaggtgatagtaggcacattacagtgtgagaggcttgccgagggactatctctgccctctccctctgcaacctccagatgctgaayttctctgctctaggagttttattcattcagcatgcacccaacacctattatgtattgacatgcttaggtcctgggaaaacaaataaataagatggagcccttgaggagttcatggtctgataggggaaacagatgtgaagacagtaatatgagatatggatgaaatactgtgggaggacagaaaaaggaacgatctaacttttcctggagaaaactggtaaacttcacagaggaggtgaaatttggtctgggttttgaagaatgaataggagtttattagccagagagggtattgtatagggaagagcatgagtagaggcatgggattgtggaccagcctggcatttgaggggcaaaggctgtggctctgtctccagatagtgcttcatgtcccagggaaggctccaggctttgctgcaaatcaaagggcttgggaaatggtttctgcactcagcatgttgataagaatatggataaatatctacacatcacaggagcctcttgttggcctcttacactctaaagccccaggccctcttgccctgtgtggttctggctgaagacagtgtccctctagaatctttctgcacacccccttttcagtgacatgaccttgtattcacctggctctgatttttgttcatacccgtccctcacacccaccaggaacattgcccaagacatgggaaaataatttctctctggccttgaagtccccctcctccactttccagtgaggagagcatgaagggggtcctaaagaagaggagaggagaattgaatatttaagtattgtttcctgttcaaatttctcaactttcatgtcttcttctatgattttgtcttcctcaggctgtctcagatgatgtctttttaaaaaatggactaattttttactttgtgtttgtcatttattaggaaacgcattagtcattcaaagaacaatataatgaatgtttgtgcccacagccctctttaaaaaaatcagtgatatggtggttgccaggagctagggggaaggggaaatagggagttggtgttcaatgggtatagggtttcagtttttacaggatgaaaatgttctagagatccattgtgcaacatgtgaatatacctaacattacagtactgtagagtttaaatgactaggatgctaaattttatgctatgtggatttttgttgttgttgttcttttcttttcttttttctttttttttttttttttttttttgagccaggctggagtgcagtggcgcaatcttggctcactgcagcctccacctcccaggttcaagggattctcctgcctcagtctcccgagtagctggaattgccggtgtctgccaccacgcctggctaattcttgtatttctagtagagacagggttttaccacattgaccaggctggtctccaacccctgacctcaagtgatccgcctgcctcagcctcccaaaattctgggattacaggcatgagccaccacacctggccatgttttttaccatagtttgttttttaaagtcaatgataccttttcctccaaaaccatcatctctgtttgtctgaagggcagatttctgctaactcaatgaaccctgcaatgggtcccctgaagttgcaaaatatggtgacagagggataggaggtcacagaatctcttcctccttggggccatacaactataaggacaagagcccactgagaggtcaagctgtttgagaactcatcttggggtggggggaagtaacagagagaatcttggccagagaggtatttattcatgccttgccccttctctagagttagctggcaaaaagtacaacaagatayaaattattagggggaccacgaaagggcagagggaaaaattggaggcaggcaggggtgaaggaggctgaaatgacctgatccatatacagaggtctcctggtctggcctattccaaagggagatgatttggagagggtctgcaagacatacggggaagtctgtcaggcaaagctccagaactatgatttctctctgggagctgagccctggggagacatggctggggggcaacctgaggctgctctccttagtgtgcttctggattccaccagtgaacgccgtgctgcagggagagcacaggcgcccttgtgaaagctgaggagcctctcaggaccatggtctaaacacacaatcattccatctgcacgctgtggctgccaccccgggctggagccagaatctcctcagaagatgtatggggtctgctccactaagcccagtgaagaccctcatcagaaaacaaagcttcacaaatttcagtctaaagatttgcattcagagttaaagctcatggcaaagaggttaatccatgagctggaatctttccaggcagcctggggcacagctgtgggctcaggggagctctgagctttgtcataactttctttcagtattgccatcaagttggcactttgagggaaggggaagcccctgccaggtttccgaagggaggcgctgagtgtctgcctctcaggcattctctcctggggctgggccagaggaaactggcttgcagggagcaatgcatcctgcagggaaggagggaggggaactcaaaggcaggctccagccttggtaacagcgtttctcacacctgtgmcaagacaggtacagcatctcccgaccacaggctgtcagggcagaattgaacattctggatcacttggtcccacctcctcccatagcaagccaggaccccagagatgttaagtaacctgcccaaggtcacagagctattggagcaaatgcagaatgataactcagggccttagatcctgaagcctgagttctttcccttccaccatgtcttctcctctttccatctctcccagtacctagcacaggcctgtgtgtatggtagatgcttcattcgttaatgtggtttctcctttcctgttccaatattagggtgtctggtgctcctttggctttctctgctttctgtggttcaaaccctcccacttggtctctagagaggctcacagtgtgatcctgcatctcgtttcagtgatgagggtccttctccatctcccagccctcctggcttccctcatcttgcttcaggctgcagcatctaccacaagaggtgagtgtctccctttacgggttttctggggctgctgtcacaaagcacaccaactggatggcctaagacaacagaaatgtattctctcacagtacgggaggatagaagtccaaaatcaaggtgttggcagggctgtgctccctctgaaggctctagggaagaatgcttcctttcttcttccagcttctggtggccctggtatccttggtgttccctggcttgtagctgcaacactccaatctctgcctcagtctttgcgtggcctttttcactgggtgtcctctcctcttctcataaaaccaccatttattggatttagggccgatgctaaggcagtatgacctcattttaattcataacatctacaaagaccctacttccaaataaggtcacattctgaggttccatgcagatgtgaattttgggagggccattatttaacccactacactctccttgttgagaaaacagatcctgtcctccatgctccagaccccaatacaagagggaacagggaatcccaccattactctcatgccatccccttctgtacgtcagggtcctggtgatcagtgggtcctctttgatgaacttgagatagtccacaagaccatctcaccaggaaccagagaaatccccacagtccagtagcccaagccaccctgagtggccacactccctcttcatcccatctctgggcattctagtgagatctcaaagagcaattttgacatcttgttgaagatccaagagtattcttcccattctgtgctttttccccttaaggactcttatgaaactttcctaatcttgatctcctgcctacccagatttgaggggtgggggtaatggccgagaaagagggagacaaaagcagaagacatcgcaaaggagtggtgtctgacaccctacttcctgctccccactccaaccccaagcgcagactaccagaacctctgccatctccgatactgtgagtcaggccaaggtccaagtcaacaaggccttcctggactcccgaaccaggtacgtgagacacacacacacacacacacacacacacacacacacacacacttcccttcacaggcttcctgttcatgacaagcacatctaggccagcccggatgagccaatgaggtgaacaatgataaaacttacccttccatcctcctagccctccaagtacatgacaagtaggagcaatagcccacaattcctaaagtcctcagcctgtacatcacctgaaagaggacatctaatctaaccctagaaggactttcttccacgtggcccaatgtttccttgggccatgcattccagagtcccagaaagcctctcagtaaaagttcttcattcatccagctgatattgactgattcagccaggtccaccagaagccgaatccgagccctgcattcaggtgcaggtgacatattaggggaatgctcacaaggaagctgtgatggggtgaagaagcagaagtgaagggggaggttagacaaataaagtggcttcaagtctatcctcagcctgaccccacagggagacctggagcagaagttgctcctcagagcctgtcccatcttggagcgagggagcagagccctcatctgcccacatcagtcagacatggctgcaggcttgcaggtggctgagaggtgttgtggcacacctgtggaattcccgggcacccccagccaggccactccagtggctcagaagcaggcgcccaacaaggttactggagtgagcctgtagcagatgcacccatggcagcaaggggaagagcccagggcccacagggcaccagtagagtcaactgccctccgatccygtacaggggcaacgtgggcgccttccctcaggaaacgcacactctagggagagggcagacattgagaaaaaaagtaaccttattctttcctctcgctgtccctttacactggacctgggcttccactcactcctcctcagcccttgaatgaactttcaagccgtcagataacttttttggtgacttagatgataaaacacgctctggacgcttctagtccccagaccaggattatctcaggaattaaagtgtcagcataagaagataaagccagacctgctctattccttcagctcagaactgcttgaggcctctggcgggagaagagagtgcagtctccttctccctctttctggggctcctccttcccagcttgggtttctgctccttgggggttaagctgaaggaggagggaaaaaggggtggtgagtctacatcccctgaacagttcagtcctcaaggggccggaagctctctctctctctctccccttgggtgctttcctggtttcagagagagattctgctgccaactctgtgatctggaaaattctctggccagtggctcccagctctaaccctctctgcctgggagcatcgggcccactccttcacccctccccaccctgtcttggggcaggtcccttttaagcagcctccagaagactagcagcttcgccctactgttgaggcggtgcagattccagattccgcccctctctccgtgctctcaggacactgctcttcaggcaggtgtcaaaccccagccatgactccaggacacacagttaagccctcctcctaagacctttctccctagaattaaactagcaaaggaggagccccatggtgttgggagggacgtgcccagtatttctgcaaatgtctccaaaggaaaattctctctcgctcctcaaattcaatccctttatagcctcaagatgggggacagcataaaagccacaaaaccggtgttcatacacctcctttgcaagtcctgcacaggccaaccagcgccctgctttgaaatgtggaggagcccttccctgctggttagtccttggactcaggggcctcacagagacagaacgagtcacatttaaacattctgttacccaagtacatacacagtgcagtgactcacaatttatgataaggaaaatgaaggaaataaacagggcaagggatgccactctaggcacagggatcagggaagcctgttggagaataggaaggagccacccaggcagagggcatgggggtggcattccaggcactgcaacagcatagggtctgaggcaggaaagaccgtgggtgctcaggaaaaggaaggccagtggaggcaggaggcaaggaggatcacgcataaggtgagagcagagaggtgtgtcgccccagggtaagccattagaacatttgaatcagcggtggcatggtctgatttttatgctaaaaagatcactccagcagccctgtggagaacgaatgggaagaggacagcagtggaagtaagagctgtctagatgggagaggatgatggctaggaccgcggtggagactgtggagatggcaaagaggtccttccaagaccctgcctacccccaacagagcccagccccagggcagagcaggaggtgagtccctggtgaatctgtgttcaggcagaggaagcatgcagagcccagggccgggcgggaaaggaaggaacatctggaaccttggatgggaccttacaggctaagcccagggaggcccagcgcggcctgcctgcctttgttcacggtgtgaggtggggactctaaaataccttgcagcagcccctctgggacccggctgatggagacagtgatgctcacacacgtgagtgtgtgctctgtgcagatgcagctctgggggccctacattcattcctccccaaaatcctaggaagtactgaatcgaactgtagaaaacagctgttttcaaggtcaaaaatgatgaaacaacatggttcaacctaagattaccatcattattttcattataccaataaggaaactgagtacaaagagcttaagtaatttgcctcaagggcacacaactagaaagtggcagtcaggagccaatcccagtcagtctatcccaaagtccatacagaagtctctgatgggaggaaattgtgatttccagttcataaatgaggggaagtcactcagaggtcatataattaaaccaatcctggtggaacccagatccacccctgtgtctgtccagctctaagcccactttaggctagcagtgtccaagataactttctaggatgatgaaatgttctatatctgcactgtccaacacagtcatcactaaccacacctggctattgagcacttgaggtgtgcctagtgctgctgaggaactgaatttttaattttaattttaatgagtttcaatttaaatagccacatgtggttagtggctactgtattggacagtgcagcagctgggttatgaggccatgttgtacacacacccctcccacccctccagcggcccccagcccccttcctacagggtccaggccatgatccccatctccctccactgtaggctgaagaccgccatgagctctgagactcccaccagccgacagctctcagaatacctcaagcatgccaaaggccggacgcgcacagccatccgcaatggacaggtgtgggaggagtctttaaagagactgaggcagaaggcatccttgaccaatgtcacaggtacagaaaacccaccagccctctgtggcaggaaggggtcatctccccacaggagaaagcagaggccacccaaagctgcacttcctgttgagagctatctactcagaggaacactcctgtctctcccttcttagacccgtagacgagactggcagagcaaggaaggtcttagaggacagctagggcaatgctgtttttgcagaggaagaaactgagacctagcaagctcacatggccgactccaagtgaggggacattggtgctctttgtataacaccgtctgtaaggcctctgcccaaaggaagtgctaaagtcaataaacatgggttccttgtcctaagccacagtgtcaccacttcctctagtagaagagacatttaagccacatgtgtcagggggatttacttgggataatgtcacaggagctaagatttccatcgtgttctgggtaagatggagctatcagtaagtgaacttaactgatggcttggtcatggcctcctccatcccctccactctcacccccaaccaaatgccacagcccacagagggtcatgaggaaggggtttggtcctgacaggaggaaaaggctgcaggttctccctgggaaaacatcaagtgaggggggatacctggcccaggagttgggcaaattccaaagctccaaaagaaggaaactgggacaaggtaagaagtaggaagcactttgacctctgaaatacaaaaggttcggagagctgaaatcctgccacctttcagagatggccccccggaagaagcccccatgagccagattccctcacctccctgcccttgcagacgccagggtggatgagggtatgcgttcagaagtgggcatctctctccactctgtgcccacactgaacactctgatgcctaaagcccccctactctgtcactcctcccacaacccttgcccctcactgaaaaattacctgtcccttcccaacctctatcctagctatgtccctgcttgcttggtacttcagatgtgaacgaagctttagaagaaagcagtcttatcacactaactcatactaacatatgcttaacctcccggggtatttccattctaaaagaaagatctgtcaattcaaatgaatctggacctggtataccaggaattactagcaattctggggacattcccagttactctgtgtggccttgggcaagtctcttgaacattgtgttctcattttcttccctgtaaaatgggaataaaatgtattaccttaatgtgctgtcagattaattgagaaaccacttgagaaacgcttacttagaatggaatgcattccaaaacatgcaggttcacctctggtctccatttcctgcctcccacgggtgcctgtgaatggagaaagaactcagtccctttggggtcccttctgtttcagatcccagcctggacttgacttcactgtctctggaggtgggctgtggtgctcctgctcccgtggtgagatgcgacccgtgcagcccttaccgcaccattacsggagactgcaataacaggtggcggggcttggggtgtgggggccgaccattccagccactccgncccgccctgccaaggcctttgtcccttgggcactctaggcagatctgccactgccttgcccacctgggctggcgttcccaccttccccaccttctcaagatcgcgcgtctccagccctctccctccagcccactgtgtgtctctggaagcggcacctttccccggggcgggggagccccgcgccttcagggggtgggcgcagttcagagaccccaaatttgagaggcccccttmtctgcgtcccctccgcctcgagcagaggctccttcccycatggggtcctgggctttggagccccggagccggcctgccgaagctcagcgaggatcgtgctggtttcaggaggaagcctgcgctgggcgccgccaacagggctctggcgcgctggctgcccgcggagtacgaggacgggctctccctgcccttcggctggacgccggggaagacgcgcaacggcttccctctcccgctggtgagggcaggccgggccggggtgaaggatgggagccagaggggacgggatgcactacccaaacacgcwgtgaaaggaggaggagggatcggtgggggcagcaggggtgcgcgatggagatctgcacagacccccaccttccgctagagggcagcagagctcggagcccggagcccggccacgtggcggtcacgttctggccgccgcaggccagataccctggggtctcccgggcagatggcctccctgccccatcccgctcgcacttaccccagcccccgcccctggagtgcatcagctgttgtttgcctggaggtcctatttgttggccttatcgagctggcagcccctacccagagcccctctcctattcctggacacctggcacctccgtagctcgcatttcagaggcagcctgtctttgttttccctctcttagtggaaagggcaccggcttggcaaatcatcaagtcatacggatctgggttcaatcccatccctgtccctttgtagcggcaggaccttggagaactgacttcacctgtccaggattcaatctccccctctacagaataggctaatgccacccacctcacaaactccttgtagggattaagtgcacttgtaacatggtaggtagttaataagctgtagttgcatctgaatcctcaaagcactttttcctctaatctgccctccccttctctctccatctgtaggcccgggaggtatctaacaagattgttggctatctgaatgaggagggtgttctggaccaaaacaggtccctgctcttcatgcagtggggtcagattgtggatcatgacctggactttgcccctgacaccgagctggggagtagcgagtactccaaagcccagtgtgatgagtactgtatccagggagacaactgcttccccatcatggtacggccctgcagctrggcatctctgactagccccttgcccaccctgatgtagcagacattcccagctcatcagctaggatctctggatagatctgggatactgatttggtagtttcccatgcctcacgtgtccattcgttcactcatccgtttattcagtaaatagacattgaccaccccataccaggcagtgcactaagcgctgaggattccaaagtgaacaggacaccgctcctgctctcaagaacaaagggccagtgtgggaattggacaagtaaactactgatagcagaatgggaacactggagaaggttgtctacattcccgacccagcagcattggtaaaacctgcttattagaaatgtaaaatctcagttgggcgaggcggctcatgcctataatcccagcacttggggaggctgaggtggacagatcacctgaggtcaagagtttgagaccagcctggccaacatggtgaaaccccgtctctactaaaaatacaaaaattagcctggcgaggtggcacatgcatgtggtcccagctactcaggaggttgaggcaggagaaccgcttgaacctgggaggcggaggttgcagtgagccgagatcacgccactgcactccagcctgggcaacagagcaagattccaactcaaaaaagaaaaaagaaaaagaaaaaaaaaatgcaaaatctcaagtctcacccaagatgttaggaaatagattctacatttttaccaagatcaacagagattcattttatacatgataaagtttatactgctgtacatcatcgtggaggatgacttcaactccactcagaaggacttgaaacctggatgaatccgagtgagcagcagggatttgtagggatttccatccggaagggagaggagcttgcagcaatgcatcttttcttattattcatgggtattacagttggagagtcatttcttcactcaaagaataaatcgaggctatgtgctgtggtataaagagcataaactgtggaatgaagccaatgatctgaatcctacatctttcccttccagtgtataagttcttaggcaacttacttaacttttctgagccccagttttctcatctataaaatggaactgaattgtccaccttacagggtttttttgaggactgagatgagttaaagtatgcataattcctggcacatggtaagtccaaaataaatacatggcagctgttgttagtagtaattattaacaaacctgttcccacctcgtgtcctgctttcctgtccagggagctcaatactccctcctcaccagaaatttggagccctcactgtgaggactgaatgattaccctcagttctttcacacaacaggatgtaatgaacttcaggatattatgagcccagggtgtgtaatgtcagcaagaagtgtctggggtcagtgtctggtaccagggtcctaggagggtgccatcagcatctttgcatccagacttgccctggggagaggttgccaggacccagctgttccacccctgcccagtcacttatgcccactctctctgcagttcccacccaatgaccccaaggcggggactcaagggaaatgcatgcctttcttccgagctgggttcgtctgccccactccaccctacaagtccctggcccgagagcagatcaacgctctgacctccttcctggatgccagctttgtgtacagctccgagccaagcctggccagccgcctccgcaacctcagcagccccctgggcctcatggctgtcaaccaggaggtctcagaccatggactaccctacctgccctatgacagcaagaagccaagcccctgtgagttcatcaacaccactgcccgtgtgccctgcttcctggcaggtgagtctagcctgggaacagaagggcccaaggacaaggggattatccagggaagctttaccactgcccccttcttgtcatctttctggaaaaatgcacactgagccattgctgtccctagcagtggtccaggactagcagaagggcccagatgaataaagaattccagaacatatgttcactgtaaaacaaaatcaggaagtccagaaaagtaacaaagaaaataaaaagaaagtgccaggcttggtggctcacgcctgtaatcccagcactttgggaggccgaggcaggcagatcatgaggtcacgagatcgagaccatcctggctaacatggtgaaaccccgtctcttctaaaaacacaaaaaattagccgggcgtggtggcacacccctgtagtcccagctactctggaggctgaggtagaagaatcacctgaacccaggaggcggaggttgcagtgagccgagatcacgccactgcactccagcctgggcaacaaagcaagactccatctcaaaaaaaaaaaaaaaaaaaaaaaaaagaaagaaagaaagaaaagaaaagaaaaagaaaattcacacaatcccactacccaccaataatcatcgttaacattttcatgcttattttccagtattttttctatcacagatacagttctacattgttttacataatcgggtcttactataaataatgctccaaaacctgatgtcttcacttaatttactccatgccattaactgttcttctatgacgtgatttttaatggctgcctggtatttcatgacacatattaccatcatttattttctcaatcctacttgggggaatttagttatttcaagttttcctgtgttttgttgctgttgtttaggtaatgaacatcttcattgataaatctttgttctcatttttaatacatttattaagctaatttcccagaagaggaagttctagatgaagaggaatgtatatttttaaagctttttataacctggggacaaaatccccattccattcagcctgtgcacgaccaaagccctgctaattctgttcattccaggtgccctcctggtcctctctgtctccggcttctagaggccatcccaccctcaaacatcctctctctttggacaaaccccctggccaccctgacattgcagaaggccagctcttaggccaagatacctttatagatcttttggattttgtgttcacatatatcccacakcaatccagacacaaaaccgagttctttcttgtttttcataaaaatatgcactcacaccaagaatttacaattttaaatagatttcctggcctggtgcagtggctcaygcctgtaatcccaacactttgggaggcttaggtgggaggattgcttgaggccacaagttcgagaacagcctgggcaacatagcaagacccctgtctctacaaaaaatttaaaaactagcaacacatggtggcacatgcctgtagtcccagctactctggaggctgaaacaggaggatcacttgagyccacgaggttgaggcttcagttagccaagataatgccattgcactccagcctgggcaacagagcaagactgtccagatagatagatagatgatgatagatatatagatatatagatatatagatagatagatagatagatagatagatagatagatagatagatagdctctcctaaagattagagggcacagggagaagtcctttatccccttatgagacacctggtctttggccatttaactgttcccccatcgttactcctctctccctcccactacagacccccatctccagattattctccctttattacccagaggaactcagccttacccaagctcctcacctcaaacccgcattcctaaaaccttcaaatttgctctgtgaagtaaaaagctcctcattcattcgaagctccccttcctagaaggcggttgggttataattagcaaaatgttactgtgtagtttgtcaccactagcctttgtcacagtgctgtgataggctttattctcattttcataggtaaggagaccgaggctcagaagtgttaagtaacttgtccaaggtcacacagctaaaaagtgtgtatatagaactgagagtcaaacctatgattcagtaccccctccccatccctattcacctgacgggaagtagggcttgttgacggggcggggggggcggggcgcggtcctgtggggcaccatcatttctttgtgcaggttactgggtcctggggctgttagggagaatctaccttcctgccttctgggctttcaggagattctcgagcctcagagcatattctgctggccacatcccacaccctctttctccgcgagcataaccggctggccagagaactaaagagactcaaccctcagtgggatggagagaagctctaccaggaagcccggaaaatcctgggagccttcrtgcaggtagggagtcccaggagcactgtcacctggtcccacctggctcccactcctggctctgccctctgctggctgctgtgcctcaggctctctcctctgttcccacacctccgtttcccccggcccctctgctgcttctctcttgttgtctcattctttgaaatccccttcctttcatwtcttcagcttctctgtctcaaaatgaatctctggatttggagtgttggaaagtcacttgtgcgttggtcccttcagtgtgcctgcctgggtgccattactgggactgtaggctccttcactcccgggactgctacatcgcagtgatttgggttattttgatttgattctcttcctttttaattgtctacatctacgcccatctcatgggcatactcagcggatactgttgattggctgatcaactaactagaagagatttacaaaggttgatgtgttgatattaaccatgcacatattttttaaacattttattttgaaataattatagattctaatatattgcaataggaggggggtttcaaaggatgagacaacaggagagaagcagcagagaggccgggggaagcagaggtttgggaacagagaaggtagctggaggcgcagcascgagcagagggcagagccaggagtgggagccaggcgggccccagtggcagggctcttgggcctccctccctgcagattattagattctaagaattgtacaggaaatttttaaaaatgtacaaggaggtcccatgcacccctcacccagtctcctccttacattagcatgtaagtgctaatgtcttacataaccaagatacactggcaaaaccaggaagttaacaatgatataaaccatagagcttactcagatctcaccagttataaatgcaatcaactgtgtgtgtgtatgtgtctgcatagctctatgcagttttatcacagatgtagcttcaagtactaccacaataaagactcttaaccgtactgtcccctaaaactccctcatgctatctcttcatagccacatccaccctcacccctatatccctaacccctgacaagccctgatcagttctccatctctatgttatttcacagatgttatatacatggaattatgcaacatgtatccgagatgggcttttttcattaagcataatatctttgaggctcatccatgctgttgtgtatataaatatttcattcctttttgttgctgagtagtattccatggtatgaatgaactacaatttgtttaaccattcaacttttgaagggcatttggatagtttccagttttagattattatgaataaagctactacaatcattcaaacataagtttctgcatgaaaagaaatgtttatttgtttgagatacatgcctaagagtgcaattgctaggtcacatggtaagtccatttttaggtgtttttttttttttaattttttaattttgtgggtacatagtaggcgcctatatgtatggggtacattagatggcttgataagggcatacaatgtgaaataagcacatcgtgaagaatgaggtatcctgctgggcacagtggctcatgcctgtaatcccagcactttgggaggctgaggtgagcagatcataaggtcaagagatcgagaccatcccggccaacatggtgaaaccttgtctctactaaaaatacaaaaattagctgggtgtggtggcatgcgcctgtagtcccagctactcgggaggatgaggcaggagaatcgcttgaacccaggaggtggaggtaggaggcggaggttgcagtgagccaggatcacaccactgcactccagcctgggcaacagagtgagactccctttcaaaaaaaaaaaaaaaaagaatgaggtatccatcctctcaagcatttatacattgagttgcaaacaatccagttacactcttaagttatttgaaaatgcacaattaagttaaattattattaactatagtcaccctgttgtgctatcaaatagtaggtcttactctttttttttttttttttttttttttgagatagagtcttgctctgttgcccaggcttcctcagcctcctgagtagctggggtttcaggcacctgccaccacgtcctgctgatttttgtatttttagtagagatagggtttcaccgtgttggccaggctggtctcaaactcctgaccttaagcgktccacccaccttggcctcccaaaatgctgagattacagacatgagccaccgcgcctggccatcattctattttttggtacccaccaaccatctccacctccgccccccacagcccctcattacccttccagggatctggtaaccatctttctactttctatgtccatgagttcaattgttttgatatttaaatcccacaaataagtgagaacatgccatgtttgtctttctctgcctggcatatttcacgtaacataatgatttccacttccatccatgttgttacaattgactagatttcattcttttttatggctgaatagtacaccattgtgtatatgtatcacattttctttatccattcatctgttgatggacacaagttgctttcaaatcttagctattgtaaacagtgctgtaacaaatgtaagagtgcggatatctctttgatatactgattttatttcttttgggtatacacccagtagtgagattgctggatcatatggcagctcaatttttagttttctgaggaatctccaaactgttctccatagtggttgtactaatttacattcctgccaacagtgccaaatgtgttctccacattcttgccagcatttgttattgcctgtcttttttatataagttattttaactggggtgacataatatctcattgtagttttgatctgcatttctctgatgatcaatgatgttgagcaccttttcatatgcctgtttgccatttgtatgtcttcttttgagaaatgtctattcaaatcttttgcctatcttttgattggattattagatttttttcctatagagttgtttaagcttcatatatattctggttgttaatcccttgtcagaagggtagtttgcaaaattaatattttctcccattccgtgggttatctcttcactttgttgattgtatcctttgttgtgcagaagctttttaatttgatgtgatcccatttgtccatttttgctttggtggcctatgcttgtgggatagtgctcaagacatttttgcccagaccaatgtcctggagattttccccaatgttttcttgcagtagtttcacagtttgaggtcttagatttgtctttaatccattttgatttgatttttatatatgggtaaaagataggggtctagttttattctccggcatatggatatccagttttcccagcaccatttattgaagagactgtcttttccccagtatatgttcttggcatctttgttgaaaacgagttaactgtagatgtgtggatttgtttctgggttctctattctgttacattggtctttgtgtctgtttctatgccagtaccatgctgtttggttgctatagctctgtactataacttgaagtcaggtaatgtgattcttctggttttgttctttttgcttaggataactttggctactctgagtcttctacttttagttttaaaaggaactgccaaactattttttagaatggctgtaccatttacattcctatcagcaatgtatgcatgatccaatttcttagcatcctgacggtgtcaccaccattttttgttttatcctttctgataggtgtgtagtaatagctcattgttttaatttgcatttctctaatggctggtaatgttgaacatcttttcctgtgctcatttgccacttgtgcatcctcttcaataaaatacttgttcatatattttgcctattttcaaattggactatttgacttgtaatgttgagttttgagagttctttacgtattctagacacaagtcctttgtcagatatgtgatttgcagtgattttctcccagtctataatttggtgggggttttttttttcatcctcttaagaaggtcttttgtagagcaaaagcttttaattttaatgaagttcttttaatcaaattttcctttcctggattgtgcatgtgatgtcaagtctcagaacttttttcctagtcctaggtcccaaagactttctcctgctttttccttctagaagttttatagttttatgttttacatttaagtctatgatccattttgggtaaatttttgcataaagtgtgaggtttaggtcaagatgcttttttaaattttttctggctatggatgtcaaattgctccagcaccacttattgaaaggctattgtttctccattgaattgcttttgtttctttggtaaaaaatatttgggcatatttacatggatctatttctgggttgtctattctcttccattggtttgtatgtatgtctattcctctcataccacagtgctcaattactatagctatacagtaagccttaaaacactttattcttctttttcaaaattgttttggatattctaggatctttccctttccatacatattattaaataagtttgtgtatgtctatcaaaaaaccttatggaaattttgatagaaattgcattaaaattatatatacatttagggagagttgacatctttacaatgttgagttttccaatccataaactaagtatgtctccccaatctttagattttttatttctttaatcaacattttgtagttttatcacacagattctgtacatgttttgttagatttatacctcagtatttaattttcattttgttttgttttgttttgagacggagtcttgctctgtcaccaggctggagtgcagtggcacgatctcggctcactgcaacctcccgggttcaagtgattctcctgcctcagtctcctgagtagctgggattacaggcgcccgccaccatgcccggctaatttctgtattttagtagagacagagtttcaccatgttggccagaatggtctcaatctcttgacctcgtgatccgcccacctcagcctcctgaagtgctgggattacaggcgtgagccaccatgcccagcccagtatttcattttctttggaggaattataaatggtattacagctttattgcagtttctacttattttatcagtgtatgaaaatataattgatttttttatgtgttgattttgtatcctgtgaccttgctaaattcaattagttctaggcattctgctgtagattacttggattttctaaacaggtaatcatgtaatatgccaataaagacagttgtgtttcttcttttctaatccatatgatttttctttctttttcttgccttattacgtggcaattcctggaacttcctagtggctcaaacttccaatactatattaaatgcgcatggtaagaaagcaggcatccttgtcttcccaatcgagaaagtattcaatctttcaccattaagtataagattagttataaatgttttgtagttgccctttatgaggttgaggaagttctgcttcattcctagtgtaatgagagtttttatcatgaacaggtgtagaactttgtcaaacggtttttctgcatcaattgataggatcatatgatttttatcctttaaactatactgcttgctttggatttattttgctcttatttttcaagtttcttgaagtagaaacttagatgactgatttgcaatcttttctattttctaatgtatttagtactataaatttccctcttagcactgagttgactgcctcccacaaattttgatatattgtgtttttattttcattcagtaggtattttttaagtttcctttcggacttcatctttaacctatgtataatttagaagagtgttatttaatttccaagcgtttgtagattttcctgttgccttcctgatttctagtttgattccatcatgatcagaaactatactctgtatgatttcaattttaaatttgttaagatttgttttataaccctgctgtggactatcttgttgaatattctgtgagttcctaaaaagaatgtgtattctgctgttgttgaatgcaatgttctgtaaatgtcagttggatctgttggttgatggtgctattcagtctgtactccagctaattttctgtctagtaattctcccacttactgagagtcaggtgttgaaatccctagctataaatgagaatttgcctatttcttcttccagtcctgtcaggttttgcttcatgtattttaaagctttaaagttctgttgtttgatccatatcatttaggattgcttcatcttcttgatggatagatccttttatcattatgtaatttccacttttgtcctctgaagtcaactttatctgatattaatatagtcacccctgcttttaaaaatttatgtctgcatgatctttcttattccatcaatttcaacctacctatgtcattatgtttgaagcgagtttcttttagacatcatatagttgggtcacttaaaaaaaaaaaggaaaagaaatatactctgccaatctctgacctttagtaattagtacttttaaattatctttaaaataattattaacatgttagggattaaatctcccatatctctcattttattacttgttttctgtttgttccttctgtttcttcttcctctaatattgtttttcttgccttcctgtgggttaattgaacattttttagaggtccatttgatcacatattgctttgtataattttcttagtggttgttctccggatagataggtagatagatatagaaataaagatagagagagagatagagatatggatttacaacgtatcacaacctattggtgtcagtgctttatcatttcaagtgacatgtagaaaactcatttccatttggtcccttcaccttccccacttttgaaatataattgtctgaagcatttcttctatatatgttttatagcacatcagatggtgcttcaaccataaaatataatgaaaaaattcatgaggtggaaaagaattgatgtttacttctatttttacccattacattgttcttctttcctttctgaaggtcctgtccttcttctattaccattcttcatgtttagagagtttcctttagccattgtttaaggataggtctgtgtgcagcaaattctctgagtcttcctttgtgtgagaatgtctttatttctcctttattcctgaagaatcgttccaccagctattggattcagggttggtagttcttgtctttcggcacatgaaaaatgtggcgacacttcccctggcttctgtggtttcagatgagagcttcaccgatattttgtttgtttgtttatttctttgtttctttgagacagagtcttgctctgttgcccaggctggagtgcagtggcaacatctcgactcacggcaacctccgcctcccgggctcaagcgattctcttgcctcagcctcccgagtagctgggattaccgatgctcaccaccacacctggataattctttttgtatttttagtagagacaggatttcaccatgttggccaggctagtctcaaactcctgacctcagatgatccacccgcctcagcctcccaaagtgctgggattgcaggcgtgagccaccacacccagccctttaccattacttgaattggtgtttctttataggtaatgtgtcatttctctttgactattttaatactttatgtttagttttcagaaatttaattatgatatgccttggagtgaatttcgctgtttatcctgtttgggattcattcatcttcttgaatctgtaaatgtgtgcctctcaccaattttgagaaattttcaggcattatttattcaaatcctttttcagtttcaccccctttctcctctgtttctggaactccattgatatgaatgccagatcttttgttatggtctcacagaacccagaggctctggtttgtttgagcaatttttaaagtctattttctttctgttgttcagattgagtaaattctattgatctgtctccaattctatcctctgtcactcccactctgttattgagtctattcaagcttttttaaaatttcagctagtgtattttcagttctgtaattttgatttgtttcttttttataatttctacttctttgctatgatactgtatttgtttcaggagaatctgtaattgattattgaagcatttttataatggctgcttttaaaatttttatcagataattatagcatctgattcatgtcatccttggcatcagttgattgtctgtttactcaaaacgtggcatttctggctcttggtattatgagtgattttcagttgtatcttagacattttggttgctatattaggagacccttgatcctatttaaattttctattttaggccaggcacagtggctcacgcctgtaattccagcaatttgggaggccgaggcgggtggatcacctgaggtcgggagttcaagaccagcttggctaacatggtgaaaccccatctctactaaaaatagaaaaactagccgggcttggtggcatgcacctgtggtctcagctacttgggggtgctgaggcaagaggatcacttaaatcagggaggtcaaggctacagtgagccaagatggcatcactgcattccagcctgggtgacaaagtgagaccctgtcaaaaaaaaaaagcacttcattttagcacatagttaccttgtttaggtttagcatgtaggttctggactacttttgtgggctttaggtccaccaaagcttagtttcctgagccttgcaatgctattctggtctacttcactcttctggtgtttgggggsttcccactcaatccctgctggtgctgtctgcaaggcaggaaagtacttccctggctgcctgctgttgctgagcaaccttctaggggaacaggaaccactgcacctgagctccttatggcactgggttaagagcaaagagacacagagcctcactgtgaaagctagatagaaatgtggaaaatgtgaagcaaaaaagcagaatgcacaggtatgcattctgtaggattataactatgtaaaagtcggtaacatatagacaaagactacaagaataaaaattaatataattattaggttatgtggaggcatttttcttttctgaaaattttttatttgtgttagttcattgtgtttttatgtaaaagaaaaccagaaaccagtctttccattcttctgtatttctttcagaactggagattggatgaactttcctcagttgcccctgaatcattcctgtggtttatcattcctcttgcyctgacattgttacattaaagtgacacacaaagactgtcactttagcatcaaggtcataaacttagcacaaagatgacaaagatagtacgtttcatatgccaaattcaaatgactgattagtagagcctatgttgagacaaatcgtaagagatcagcagaaaaaaatgtcatgattgattagcaatgtctgctatgctcataggaatgggaactgggcacatatgctatccatttgccatccttggttttcaacagctcatcactcttggctgcagctctttcacagcctccctctgcagaggtttaaaccttcttacaccctttcctcttgattttattctccctccagattatcacctttagggactacctacccattttgytaggtgaccacatgcagaagtggatacccccatatcaaggctacagtgaatctgtggatcccagaatttccaatgtcttcaccttcgccttccgctttggccacttggaggtcccctctagtatgttccgcctggatgagarttatcagccatgggggccagaaccagaactccccctccacaccctcttcttcaacacttggaggatggtcaaagatggtatgccctttcagggaagtgctgtcacctgggtctcccactccgcagcctattgtagggaaacttgggttggaagtcagattccaagcacttttacatgaccttgggcaaatgaattcacctcactgagcctcagtttcctcatttataaaatggggacaataatagtacccatctcacgaggctatccaaaacattaaatgagatatacatgtggagcaccctacaatggttcctgacacacaggaggtgatcaataaatataagctattctttctttcctcttggcttctaagatgactgggatttccctacctcctttccccgccctaggcttctctgacttctacagggtttggtaaataaattgctcttttctgatctcttctagagtttttcacttcatagaggtgccagaggttggacccaactttcctttatccctaggctatgttgtgttgaaattaactttacttaaagcctagcaagtcaaggacatttccttgagatttatgcaacctcttcccattatgcaacgttcctcagcagaacatatggaagaaaaagctgactccatgaactagagctttaaaaataccttttttttttttttttttttttttttgagacagggtcttactctgtcacccaggctggagtgcaagggcgcaatctcagctcactgcggccttgacctcctgggctcacatgatcctcctacctcagcctcccttgtagctgggattacaaggcacacacccccatacctggctaatttttttgcctttttttcagaggcggggttttgccatgttgtccaggctggtcccaaactcctgggctcaagcagtcttcccaccttggcctcccaaagtgttaggattacaggcatgagccaccatgcatggccaaaaaatatctcaatgtttatattcatgccatcatcccatgactgcccctttctgcccacccccagagcagacaatctggatgcccctgtctccctgagcacacccttcaggctgcactgtgctcttctctccctccttccagcctgggatgtccaggtgacccacattcaactaagagaaaatgtctggtggaggcagaggcaagccatgaatgatgwtcccactcttcccccaacctaagcatggcttctgggtctcccttggcaggtggaattgatcctctggtgcggggcctgctggccaagaaatccaagctgatgaaacagaataaaatgatgactggagagctgcgcaacaagcttttccagccaactcacaggatccatggctttgacctggctgccatcaacacacagcgttgccgggaccatgggcaacctggtgagtgtctgaagtctggcctgcactggggaaattttagctaactttctagggctcctggagactctcttctataaccctgaggatctgatcatctgatcaattctgaaacaaaagtcaggccagttttttttgtttgaggttttttttttgagacagggtcttgctctgttgcccaggctagagtacagcggtgcgatcacagctcacagcagcctcaaactcctagcttcaagtaatcctcctgcttaagcctaccaagtaggtgggactacaggtgtgccacatgcccagcttatttttttttttaaatatagacatagtcttgctatgttgcccaggctggtctcgaactcctgggctcaagcaatctcccaccttggcctcccaaagcactggcattacaggtgcaagccaccatgtccagccccaggccattcttaaaacccactttgttcatctatgaaacagaatgtcccatttcccctaatgcagagaaaagagcatatatctggtactatcttggcattccttaaatgaaaaagaggtcaccaactaactttaaaaacagtttaaaagccctgaaaacattaagaaaacaatagagagaaaccaatgactgttggacctttcttttgtccccatgaaaggcaatttaattaagaaccagactgcctgagttcaaatcccgcctatgccatttactagttataagactttgggcaaattacttaacatttctattcttcatttacttatttgcacagtgcttagaatagtgcctggactcatagtacataccacataactttcatgattgcttagtggttacataggacttaaccaactagcccccttaagattgaagtgcagataaaaaacaatggattccctccttccccatcccaaaggctgtaagcccagactttctagggctgatagagctggagtggacatggccccaaaggrggctgtgaacaggaagtccccgggatgagacagcctcagtctctccaccctagggtacaattcctggagagccttctgtgacctctcacagccgcagacactagaggagttgaacacagtgctgaagagcaagatgctggccaagaagttactgggtctctacgggacccctgacaacatcgacatctggataggggccattgctgagccrctggtggaaaggggtcgggtggggcctctcctggcctgcctcttgggcaagcagttccagcagatccgtgatggagacaggcaagtgcgycctcagccagggagggaagggcagggcccttctccaagaggggtgtcccaaggtcctgcgtgagcgctgactccggatctcagtgtgagtagggcttttcatggtccctgtgaccctttccttcccctgtgacagagtggggaggggccagcggccagactgtggagtgactctacttctgtctctgcaggttctggtgggaaaaccctggggtcttcacgaacgagcagaaggactctctacagaaaatgtccttctcacgccttgtctgtgacaacacccgcatcaccaaggtcccacgggacccattytgggccaacagctacccctatgacttcgtggattgctcagccatcgacaagctggacctgtcaccctgggcctcagtgaagaattaggggcccgcgctgcacaggaaagttccctttggtccacagggccatttcaagcaagttcaatgacctggtcccttagagctccatatcccagtcccagcccttctttgcagctgggcctctctatayccctggatgaacagcttgctcaggccccagggtggctgcctcggccctcccagctcttacactcagctccagtggcttctcctttctgtcaagacttagccccgctgagatgcccttctgctccagcttgctggatgttacctgtcctcttccctccacaagtcttggcccttaacctttatctttcttcctgtcctctcacctagattgtaagctccctgggccaggacttcagcctgcctccgagggtcccctgtggcacctagcatggtgcacagcacattagaagtgctcaaaaacatctgatgactgactaaagatgctaggcgtgacaccgttccctccaaaagcagacctcggaatcactgccaaataagtaactagacgtttacaggccatacatgtcttaccactgagatggcgcgtgcgtgggtcttgaggtggaaggggatggtttggtgggatttctaagagttctcagagaaaggggaggggcagggggctcctggggaaaacaagcactggccgtggagtagcaagagagaggacacgggggggacggtaggcggtggtgccaagggataaaacaggaagggaaaccaagcctgggtctcccgcagctgaagctaataccccttccagtggcccttctgagaaataccctcttctagagtggtccttagatcctgtgatgcctctgaaggggcacttccagaacattccttgagtttctgcccaatacatattcatatgttcttcttttaaaatgaccccctgggaaagattagcccaaccagggcctccagatcccccaactggtggggtgggagtgggagacacccagtcatcctgtgggaagagcccaggagccagatgacctcggctgcagcctggcactgccacccacttctttaaggcctcagacgagtcgcttcacccctctgagcagccctctcctcatcacagaaatgaggacaagcagtatttttgctgcttcttaccatggtgaggtcctaacgttaccaggggccccatgagtacattagaccccaccgtcctacaccacttccagccccctccccatatttgagaaggaagaggagagggagggagtccaccagtcagacgcagggttcaagctccaggcaagactactagggaaatacactccttcccctccctcagtgctggccctgtcctctgggcccagccatctgctctcccttctccaggagccatgtgcaacatgaatgagaaggagtccactgtcttgagggcctctgaacccctgtgccaggctgctgggatgcaggatgcagaggcccctcttgttggggaagggcctgcctcctcaccaggtctctgtactttctctcctaccacacagcattttgtcccctccacttcctagcccctggcacaggcctgacacagagtgaacacatagcaaacgtttgctagagcaatgaacaaacatgagggcttggtgaccacagttccctgcagggtggcaggggtggaaggtgagggaggagggtctgcaccgcatgccccggcccccaggcttccaagagatggctgccctccacgtacggatctcaaaggaaaactccccaacatcctcaccctcggttcagaaacacagggccctgagcacagaccacactggttcaagctcagagcccagagtaagcctctgcaaaagcgccagttcctcctcagacacagacagagtggaggtccccatcagcggtgcctttattatcataaacattgggagcaaataaatggtacagaaagggcaacaggcccagttcctcttcaggagaacttcagtgaataagcaagaaatcagggtgaggaagaaaaaggggagccatggcctgagcctggctggctgggcccataagtcaaccacacagcccagctgcagctggcttatccctccaaggcaccactggtccagctctgctaaccaggacacagatggcatcttggtatctctttcttgcctctatatgcttctcacgcctagtacagtgccttgcatgtagtaggtgctcaataaatgaagaaccagaggatacaagtgggccctccaagaaaccatgacagatgtaatttacaaggaagaaaactcttgtttaaggagggtaatttgctcaaggtcacatagctagcaagccacagagccaggattggaacccaggcagtctagttcctgagctgtgctcctcaccagtccgctctgctgccttccacatactcagtattctcatcagcacaaacacacactcacataaatggcacatacacataacccatgaaacactccccatgttcagacaacacacacgcatgaaaagccaatttatatacttcgcacatacatgagcacacaaatgaacgtctagtcactcattttctcagctgcacccagaacagggctgggctcatctagggcaaggagatctccgtggttccaactggccagcccagatatacccctcactgctgcacccccttacctggcctctaggaggcttccctccaggaagccaggttcaatgcaggaagtgtactgcagttgacaaagtcccggggatatgagttggacatgaagatgttgttcttagacacggtggtgatgcctgtgttgtcgcagatgatccggggcaatgagatctgggccagggcctgtcgctgctgcatgctgaacacaccctcgttctcccaccaaaacctgcatggggaacacccatggacactgtgcccaaggatattctgggctggcagggcatcgatgggcttgtgctgctcccaggatataacaaagccacaacaaatgccacctggaagcacaggagggccccaggcccttgggcagcccaggggctttcacacaagtgatgctccactcatcgtgcagagtaaagcacagctgcccagtggcctttcccttacccctagcccggcggcctccagggcaccatgctggagggggacccgggcccacacacactcctgaagccctgtgccctggccaggagctgcatccacaggagtggaagagaatcttgggggtggtttataattcgcccacccagagaggggcacctttttctaattttcccaaaggtgcagtacaggctaagcaagaactagacatgaagacatcaggaccacgaggaaatgacactaaggggagctgtgggaaagctgggaggggactgcccactggtgactgacacccacatggtggcacagtgaaacccatgggaagaagtagctaagggtggcacttttctatcttccaccctttacaaccaggggtccaggtctttccttgctgcacccccaacaggttcagggcacattaggggcactccagggcatctggaggattcctggaacacactggaaaattactgactccctccagtccttcaactgacaggaggaaatttgggctccaagagagtcaaggatgggcccacagccacccagcggcccacgacgcctgcccctcctcaccgatcaccatcccggagcttcctgaactgggtaccgatgatgcaggcgaggagtgggcccacgcggcctttgcgcttcagaggctcggacacgccgcccatccagatgtcgatgttgttgggcgtgccatactgctccatcagtttcctcgccaatttcaggttcctcagcaccgtgcccagctggcccacagtttcaggctgcgggagcccacagaagcgcctccaggcattgtatcctgcatgggggaggggacaggtggctatgggcaggtctctctgcttcaaggtggggaggtcactggagacagcagggaagattcacatatcgccagcagcccagaaaacccaccttcccaacacaaccaaggtcatagagggagggaaggacctcacctcaaggaaccctgtacctttggcttagaccaaggggcacaactgggcctctctgggaccctctctgtctttctcttgccctcctaccataaggcaaaccctaaactgccacagttcctgctgggtccaagaatagggacatctccttgtccccctccagagcagcccgatgtgtctgtctctgacccatgagaggtgaaatgtgtctagaagcctcagccacatgggctaccccataacataggcacaggctttgaggttaggctaatctggcttcaaatttcagctttgccactgacttggctagagaacctggccaggttctgaatctcatcaagcctcagtttcctcatcagtaaaatgaaggcaataataatctcttcccccagagttaacgtacaatgaagcaaaatggaatgatgacagagacagattttcagactgtgggttatcattatgatgacgatgcccctaatatgagaattacagcatgcaaaggaggttgagaggagctggaaatttatcaggtgggtccgggaaaaggcaggggcctggcctcaggctacttcctgagagcaaagtgcctctaatatgctttggagagggcagggaccctagagtgggaaggggggtgatgggctacctaggaggcagctcaggggaggtgagcatcaggggagactcctgcagcccctcacctgggaggccgtggtccctgctgcgctgcatgttcagagcaggcaggtccagcccaatcctcatgacctgctcaaacaatcgctcccggatctcatccactgcaatttggttctgacgattcagcttggcaggggtggccatgaggccccggaggatggggtcaatgccacctggggaccagaggagccaggtcaggggaagtatctggctcagtatcagagctcagattggagtcagggacaagtccaggtagggtcaggaggattcgagaagagggctgggcacaagcagtgcctggtgccaaggtggtggccccagtgagcaggtcctcaccggtcactacatgaccccagggacatataggtctcaggagattatgccattcagacttgcaagattgggatgctcccaggccctggcttcctgggtcacagcgagccacaacacataggaagtagccagttccctctgagggccatccccaccccactgtttattatcagatatggaagcagagtcagaggaactgaggctagagagtcagaccagatctccaagatgggaggaaagcagactgctccccaccctagctccctagagccaaggtgatccctaccccacctttagctgtcagcccactcgctcctggcctaggtcctgcttaccttccagcacgaccctccaggaggcaaaaaagaccctgctgagggggacacgggggttgggttccatgggctggtaccgattgtccaggcggaacatgaagggttggatgagggtgtggccgtagcggaaggcattggtgaagacgttggcgatgcgtgggtccactgagtcattgtaggaacggtacgtgggcaggtacttcctcatggccgttggccccagcaccaggggcaggtagtcccggtaagtgatgatctaaagacaagtcatttggaatggcctctccacccactcctccacagcaaatgccgcctggcagcacaggagggccagagtctctgcctgctcttggcttcggggaccccttccatccctctatggtcagggaatagcctcccacaataccggacctgggcctaacagagtggcactgagaggcataaatagagttctactgcttgctggctgggtgaccttggaccaattattaacctctctgagcctgagttcctcaaatgtacattaaggataattatattgccctctgccttagaggactaaatagcaaatcacttttttagtcattgtgataacttccttgtcctcaagttattaatgtctcatttctgcaactatcttataaagtccttgagagcaagggaaattgaagttgttgaaattcttcacagtgcccaccaagtgcctgcccacagtaaggctcagtttaggtttgtggaaagcagggaggcaggaaggaacgaagggccattctggcatgattttccctgtgaaaagtgaagacatggaatagtctcactctacattctagagtctagaagttattttggagtgtaaatgaatttcacttgagttcttagtgcaaatcaaaaactcacccttagcaccgaaaactctctcctccagaatctaggagtgtgtgtgtgtgtgtgtgtgtgtgtgtgagtgtgtgtatgtctgcctctgcctctgagggagagggtgggggcaatgaagcaccagatgttgagagacggaaccaggaacattgccccaggggtaaatgaggctaaggacattgggtggattatgac

SEQ ID NO: 17822 - DNA, 61864 bp, Homo sapiens
cccagcaagtggctcaacagtcccggtagcaaagccttctggggtttcagtactctctagaggtctctcattggttacaccatacgtaaatgaagggctagctcaccgccaattagaggccaaagtgaaatgggctgcagccaatccacgaatgctatgattggcaccctatgcaaatgaaagtcctagaatggaccactcataggccagagtgcaggtttggcccgtagccaatcagatgctggcatggactggtgccttatgcaaataaaggtcctagaatggaccaacagtaggtcagagtgcaggttcttccttttaatttagttccaggaaatttgcgtgaattggccttatgttccctgccttcagaccctattctccctcctcaatagtgttgttttaggattaaatatatgtaaagcacctggcactattcaggagtataaaatattttagctattgtcatgcgtagaaagcaaagtaagaagtcaggccagaagtgcgcactggagggtaaaaataactgtgtgctcttggtgcttctataactgattgtttcaagcccctagggaagacaaatatctaaagtaaagagaaaataagaatattagtacttttctttcaccagaatgtgactttttgggacagaggtgcacgtgatcttgcacctctggcaattaatctgaagtatgggaattatgagggcaagttcttggtcttaactagaaatgaaaaaaaaaacacaggacacggtatcaggacaaggtttcctgggggcacctccagtgaagcaatgggcctccccacacaacctaggggttaggccactggaagagcagtggttgctgctacacattcttagataaagcaattcatctcttttgacttaaatgtcttcatctgtaaactgtggatggtgatacctatcactgggagtccttttgaggattaaatgatatcagacatgtatcacacttagccagtgccttggcacactgttggtgtttgataaatattaactctttttatagctaggacagtggagactagcttgcctgggacgggctgtttggcttctaacttagtaaagaagaaacttcttagaggaggcactggggaaaggaagacaagcagaaagaaggagaaggagccccatcaaggatttaaatgtggttttccctcctgctgagagggcccctggactcaataaactggaatgaccctagctgaacttccaggcttgaaagtatagttgtcttttaaaaggagttcttcttttccaagatcaattgttcaacagaactgaaaagcttgccttcagaagaggctgactcctaaaacctgcagggtaaaccattaaaagaaagaatgtgccattactcaataaggagcagggagcaccatgcatacactgtctgaatgctgcaactctgctgcctcttctattcgaaattaaccagaaatccgagaacctgaaagctgagtcctagctaacattatttaaatgaactggctgttacacgaaccttaaaccacatgtcatttggttgtggggctgccatgggccaagagacattaatactgatggttcccagctcacaaatgaactgtgttcgtgtgtttggaaggctgtggtttgaaaggcagaatgcactttcccatagaagcaatgttataaatggcaattagggctacaagccagctcacaaaaagccatgtaaccataatatagctaaacaccatacattttagcccaacagagtggaaatcaatagtgttacaatactaataattaaaggatgagataaaaaagtactagtgcttaggcaaaaacagatttaattaaaggaagatgaaaatgtctatccagttaggcagagggaccaaggaaaactgggactgttaagtcaggaaccccgacagttgggaatcagaccaacttgcaggatttctgtcaattctaaggaactagtgtctgcatgtgaagaccaacctagcacccagaaaggagtttggggagggggtggaatggagggttaggacgactgaaaagaagttagcctagtcattcctatgcagctatttcatcagccaagatgggacctggcttcagcgttcctcccctcttgggtgattattcctatttataacaaagccaaccctggccccaagaaccactggagtccagaaagtttggtgtctttttcatactgatttctgagatcagacaagctcttggatattcacacagcctggatggatttttacctccctgccctgccctcatgtagatgaacctgctcttgctatccccttcacagaggagaagttctgccagttgcctggagtctccctctgccatcctattccacatgtgaccagcactgcacctggctggagacattctgaatcatttattctagcttaatgctagggatcaaatacacattttatctgggaatatgaaaaagacatgagatatctgtatatggtatatgaaatatgaaaagatgagaaatgaggaaaggagtaaattgaaaatggaagttacttgaaaaagatcatttgtaaagcaatacaatggcattctgcaagatctaaccattaggtggcaccactggcccaaggaagtttggtggccccaagaaagtggaggagaaatggggaaaattgctgagtggtctagggtaggaaggctggagggagccactgcggaacaagtaactgaacatatacaagcattcctgtgaagtgtgtactctgaattaatccacatattaataaattcaatcattaattcccttaaaattatttttaaagtctcataattttatttatacaaattgatttatatcccttgcccatttctattgatctacgctttttaaaaattaatctctagcagttctacttattctgagtactagtcctttgtcaatgagttatatacaaatatattctggttcatggcttgcctcttttttaaccgcaagtttctgttgtacagaaatttttcattttaatacaggcaaacttttttctttgccatttgttctttgtgagtcttgtttaatatatcttttcttatcttgagaccataaaaacattcttttagataaactattgctttctaaccaccagttttgtgctggtatggtataatttttttttcttatggataaaccgattactaaataatctatttttttctgctgatttgctactcctctcatgaaactagttttccataaatgtatgtgcccattctgttccttgagtctgttgattcctgcaccaaatatgacaatcaactgactagtgattcttgaccccaccttgtttctcaaacacatttaccacattagctaatttcttccattacatcattacaaccacctcaggactctacattgcgggacatgaaggaggatgcacagactacagctaaaatgctgaagagattagtgttaagcagcagaatacagttcatctattccaggacagaagacagagtcagccgccaaccatttgatttggaaaacaaaatttcaaattaattaaccttgtttcagtgaactactccagagagcattgcctaactgactgggaaattaaatattcattctgaatatctgcaatttgatcatagaagaaaccaggtataagaggaggatagattagagcaaagccatcgttactgatggggaagaaatgcactttttgagttttattctgatatgattgctgagctgaagccagaaggaagatgatacctttgtgcatacatgggtctccagtgaagtatgtgggtctttttggtgccaatcaatcaggagagagagtttcaaatctgggacctaagacttatataacaataacaggtcagaattttatagaaagggaacatctatctccatatggactattttcattttattattttgctgccttgggagaatctagatgaatgtgaggatatcctgggctggagagaaaaaatggctcttgccacatgaaggcaggccacaagataggtagagaagtaacatgtccaaatgaacccactatttttgtgtccccaaatctgctgctctttcaatgttcccattctcagcaatggcagcactgtctgcccaaatgctagactgcccaagccacatgcctgggcaccatccttggagatgagtcaagtacagtagattctattacctagatctcccatccccaaacacatctctccatctcccctccactctgtccccgcacacactctcaccaccaaggccactgtcatccttagagctgaaactacagcaatagctttctggctggtctctctgtcttgagtcatagtcatagccctcttccccactcttgaagccaaaaggcaagtctggtaatgtcattttcttgcttaaaactcggtaatggcttctcattctcctgaggctacagtccaaactgtttaatatgatttatgtggatctggcccttgctgaccttcgcagctacttccttgagagattaagaacccagaccatgaagtcagttttgtctgggttcaaattcccactgccccacctattagcttcaaaacttgaacaaacttctggacctctctgtgcttcagtgttctcccgtgtaaaacacggacagtcacaatgcccacctcacaggattgtcaggaagactgaatgagctaacacaggtagagtgctcaggacggcacctggcacacggtaagcattctatcaatgttaaccatgatttttatttctccaattcattatgccttctccagcattccggcccttgcatccgctgttctctccatctcagacactctttccaacacactctgatcatgctacaaggtagtcttcagatgtaggtaacagccccagcggcacctgaaaacttgttcaaaagacaaatgctcaggctccaccctagacctactatattaaaaactctagggctcaactccagcaatctgaagatttttgttttgttttttgatagagtctcgctctgttgtccaggcagaagtgcagtggttccatcacggcttactgcagcctgaacctcccgggctccggcgatcctccagcctcaacctcctgagtagctggggctacaggtgtaccacgcccagctcacttttgtatattttatagagatggggcttcaccatgttgcctaggctggtctcaaactcctaggttcaagcaatccgcccgccctgtcctcccaaagtgctgggattaaaggcatcagccactgtgcttggccagcactctgagttttaacaaactcagcattcctacgtaggattctgatgcccagttaaggctggaaaaccaaggcaccatccgtgataaattgtacttagatgcttatttttctctatcccctgttaggctctacgttccacaatggcagagaaatgtccatcttggtccgttcacctcctttgtaggtgttgacaaatacgagccatcacaaactggaaaggggtaagctgtatttcgtaggacacatcatctaattctgtgctcctcttttctgtttccccaaatcaacacccaggtatttctaaaggcttgcctaaacgttccagcttgttctcaaccttgaagccaggcttaggcctaagttgtaaaggcgggaggggagaccctggaggtagaggggcaaaggcaagatgcttgcgtcgcaggggccctgcatggcctggagcagcataggggccaagatggtctgcgctctccctagattggagtttctctccttcatcatctttggagaaagcacagataactgaggaaagtctgtatctgcacagccacccgaactcctgcctcctaataaacacctctgagggagaggaaactctctctctctcttctcttcctccccagcacccctcgcccccccaccgccatttctcactcctctactcccctctctctccctacccacctctgacccctcctccagtcctgccgcccggtaacaaaaccggggttcccgccacacgcacccggtagggctcaggacgctttatcggcgacaatggctggctgaatgggaggcctgaggtcctgaaggaaccgggggtgctggcgaccgggacctcgaggccgctgctggggaggacgctggccagcgtgcagggggcggaggcggggcgtgccgggaggctcccatctcccgccccgcacaacccgggcagggccgccgctccgccgccgccgcagatccggctctcaccctcggctcccgaggccccgcggcgcctccttctgcggactctgcgggaccctccccggcaggcgctgtgccctggagaaggcacagtggctcaggcatggccgcggggacggcggcgcggaaggcagcgccggtgctggaggcccccccgcagcaggagcaggtactggcgcgggggcgcgggcgtgggggacgccaggccggggtcccggggctcacgctggtgccgggcaggctgcacagactggtctccaagaccccgggccccaccggggagaaccggccctggaaagacgtggggacggacgcatgaccttctggaagatgccaccgtgcggggtgccagtccctcctccactccctccctccccacttctgtgccctccccgctaccttcctttcctccttctgatcctcttccttcgctccatccctcttctcgcatcctcgcactttctcttccaggctcaccccttccactcccgccctcctttgtgaccgcctgtgccctcctccctcctcggcggaagcccccagagcccagggtcaaggtcgtaagctgcgagagaggggaaggggtgtactgcaggcttttggctagaccgccctggttctcaaactcgagtgtcatcagaatcactcggagggcctgttaccacgcagactgctggtctgtgcccagggtttctgattcaagatgtgtaccctgatcgtcagcttgtcttgcctggtgctcaacctagcccatttctgcttctgctggcgtcaattgcaaacccaatcttaatttattcttcgttcataggacaattcttcttaggctacatccaggtaccaggaggmtttgggggtggaggagggtaggtcttacctggaggaacccaaatcccatccgtaaaacgaggacaaaaataactcttaagggcaaagataactcttaaacaacaacaaaaatcactcacagagcgggtaggaagagattaatgtcccaaaataggttcaggcaaagaactgtaggatttctgagaagggcttgctcctgactaacccccttctcctccaaccsgtgagggcgtggcattcgagctgggtgttggggaatggrcaggatctgacctcatgggccagagwattctagatggagggaacaacagtaccaaatggcttggagatttttttttttttaatattgggatggatggccatgggacaaggcagagagaggggactgtccactctgactgccggaaacctaggggtcaggaatgcttatagcaaaaaataagggtgggctaggctgtggaggggcttgtgtaccacaaaatggggaaacttaaaatgaaactccatgactttcttgctggtttcaaacccagattatcgaaagggaggttctgaattgatgaatgcatgccaggagtgtcagaggatctagtactggtggatttgctgctgatctttgctcttccttaaggctggcatcactgcctagtctgctgccctcaggaggtatggcctctctgttgaggctgccctaggagggactcacagcttttcccttaatcccatatggcaagacagtgtggtccaggaaccagcagccaaggcattacctgggagcctgttaaaaatgcagtctcagttcccacgccagacccactgaattgaaatccgcattttaaccagatcccagggtgattcatttgcacatcaaagttcaagaagtgctggtttcttgactttactagagctagggataagaaagtgaaaacagagatagttactgaccagcctattatctgatagcttccctttggtttgaacctcaccctattttattttccttcatcacccttatcactacctgaagtatgtctatgtgtgtatttgattgtctaagaacctccttcagcatgaaagctccagcagaaaagccatgtggtctgccttgctcgctcctgtatttccaggacctaraacagtctcagcaaacggcagggcctcaataaatatttattgaatgaataaatgaacagtaacgtacaatcttatgatgtaagaccctaactccagcataccttactggacaaacaccatctccctattccccatcctccacctccccagctacaacccctggggtcttttgagcctgcaactggttaggtatgtttgaaactcctaaaatttggagtgtgagagcagagaccatgggtttaggagttccctcttctgcttgtctaaggcttgctttccaggctcggatttctcctgagagctgagaggacccaccacttccccaaaactgctctctgcctgggggcaggccatacacagcccctcctctccacccacaggcatgcagccttgccttgtgacatgaattccttaccaatgaatacagccctctaaacctaacattcctacctggcactcacatgtggtccagggtcatcactagtttctgagttcattgttctggctttgcyacttggtttagaaagatttttctaacaggtgggttttgtgagggaagagttgaaagtgacaaaatcagtttggaggcagcagttcaggtgagagataatgaaagccaatcggggtggcagtctccaaacacattgagtgtgccatgcaccagacatgaggattcagtggggggatgaggccagcgctggccacctacagattcaggtaagtaaataagtcatcaacaatgcagtctggtaacaatgttcaaggtcagtagatatcctggtaggggcctcaccgaaagggtgtcctggagtaagtgggatccaagggtgagcagaaatgaggcaacccagcatggaggctgggagtggagggagagcattcagggacaggaaagctctgcttggctggagcagagggtgtgcaggggcagtggagagaggggaggctgaaatgggatacaaggccttgtgagccatgttggatttcaggcaggaagacaataggatcagtctacctttaatgggaacactcttactgtttgaagagggaagagagcgaaggcaagggcctcagaggagggggacaccctgcatgctggcctccatctcatcttcccctagccaccctatctaaagagtgacagcccttgccctctgctggtaattctttatcacacattttattttcttcatataatttacttcattaggcagttgttttgtttgcttgtttattgtgcatcatttcctctagaacacaaggtcctattcatgagaamagacaccttgtttgtctttctaacccttgaatgccagctcttaacccagtggctggcacatgggaggcaccactccatatttgctgaatgaatgacaaaatgaatggcatagaagccataggggtggagagaagggggcatgtttgtgaggcatttataggtagggtcaacaggagagtagtgggttggaggtacagggttggttaggggcaaggatgatgscccaggcttttctgctttgagcarttggatagataggacaggatgctattaactgagatgggggatggrggacactgaagtgggagcagcttggggggaaacaagtatgttcactttagggcaggttaattcacatatctgagagagagagtcccaagtggggctatgtaggaggcattcagaagcatctggagctcacacaaatttagckagccaaaagaaagatataagagattgatagaaatgtggtgctggaacagggataaaaaggacatggctactgatcagacaaggaaagggataaaaaagaggacagaggcaagcttacttttgtattgttcttttcagtgacatatgttcatgtagaatacacttaatgtaaagaagtataaaaaagaaagtaaatgcccaggatgtatcaccacccatggagcattcctgttaatgtcttgggagccactcttctgggcttttttattacagatgtctctttatgtaactatacatttacataaataggctcagattatacacaactgctttgaagcatgctttttctgttcagaatatgtcatgaaaatatttctatgtcagtaaatatgaatctgtgttatcattttgtagatcttacagattcttttatgtagatatataaaaatatgggtctttttcatccatcgggctgggtacttggtgagcatttcatttttaaaacaggtatctttcagtccttggaaattttcttgtgtaatttcttttaaacttcctgccatctgttatcttcttctctggttctagaactcatttttttggggggggtgggggatgtgaggagatttcctagcccaattcactaatattcttatattttctcttctgttttccatgtctttgaggtttttttttttaaattctttctcagttcttcaatttatcttcgattcttcatttgagtttttatttctgtcttcctgtttttaatttctaagagcttttggttgtttttctatattctttaaagcagtgttcttgtcattatgggtgcagaactctttcctgtctcaaacgtcttgtgatctttgactgttcacttgtgtctgaggtgagacagtacagcactgttaagctcttgctagcagggaaagcctgttgacaggcaggcttcagtggagggtgacctggctgggccttttcgtagggagaacaaggactgtccatctataggtcttttctcttggcttaaattgattcattccctgtgtaaggggcatgtctggctgccagccaagtgggcaagcccatgtctaacatgcctaggccaagagcacaaatggaggccctcgtgccacgtgtctaagtatcatcaactgatctgctcttacagccctgcctgcaggtccacttgtggcccgtgtagccacattctccctacctgcagtgctggctgcaggcttgagtggtagcaaggatctgctgggacagggaagatggaagtttcaatgtacctgtactagtttcctaggtcytccataacaacaaaaaaatgtattatctcacagttctggaggccaggagttcaaaatctaggtgtcaacagggtcatgctccctccaaagactctaggggagacttcttacttgccccttccagtctctggtgactccaggtgttcctggcttgtggctgcatccctccggttcctgcttctgtcttcacacggccatctactctgccttgctattctgtgtctgtgtctctggatgtcaaatcttccrctcctttctcttgcaaggacactaggcattggatttaggacctgccccaaatccagatggtcttattctgaggtcctcaattacatctgcaaataccctattgccagataagatcacattcacaggtactgggggttaggactcaaacatatcttttgggaggacacaattcaactcactacggtgcctaaaccagggatgtggactgaccccactgactcccaaggaagctgtggtagataggatctcccaccacacatctcacttttcagactcgggatttccaagcagttccaagctgctcccagactacctcactgcagttaattgaggagcctggtcagccaagatcccacttagatggtttgggatggccaaatttcaaaactttatctccagtttcccagagcacaggctattctttttcttctccccaacctgccagtcccctggggtgtcagccctacatcatctctctccaatcaaggtctactcactcaatcagttaccagactttcataattttcttttttttttttgagacggagtcttgctctgtcacccaggctggagtgcgtggcgcgatctcagctcactgcaagttccacctcctgggttcacaccattctcctaccgcatcctcctgagtagctgggactacaggcgcctacaaccatgccaggctaattttttgtatttttagtagagacgggatttcaccatgttagccaggatggtctctatctcctgacctcgtgatacgcccgcctcggcctcccaaagtgctgggattacaggtgtgagccaccacgcccagcctcaaaatattttcttaagagacagaaaagacaccaggcacagtggctcacgcctgtaatcccagcactttgagaggtcgaggtgggcggatcacctgaggtcaggagttggagaccagcctggccaacatggcgaaaccccgtctctactaaaaatagaaaaatttagctgggcatggtggcgagtgcctgtagtcccagctactcaagaggctaaggcaggagaatcgcttgaacccgggaggcagaggttgcagtgagctgagatcgcaccattgcactctagcctgggcracaaaagcaagactccacctcgggaaaaaaaaaaagagagagagagagagagaaaagataaaaacacagttattttgtgtttcagggtttgagatgtccagggtcctctaaagcaaggcagggcccctgcagccggatctagaggtratgctgccagggaggatggtgctagggctctctagactcagatgagggctgccagtgtcctctactctccctccacatgcctggtgcctcttggcctgtgcctccggtttagccactagtattctgctagtgtgggggccaccaaaccttaaactgactttcagtgaaccttctgttactaaccccggttgcatcccccacttctagacgccctaggagcccgcaatccacagccctcctgagggtcttagcacacacattctgctctgcactgcccgcatgctggtgggcttcggtgtcttttgccctgtggtgtcccagtrtccctttccgctggcccatctgctggtcagtttcagaattggctgctctggactcctctctcattctccttggacttrgaggtttwtgtccttttgctattgttctagtggtgtttggggagggagaggaggtaagtgcactttttttatttaccgtgtttcaatagaagtcctcatttttamtttttttttaaacayagttattactagtgagtttgaacacctttccataaatttatttgtcatttgtatatctcaattcgtgaatttctcattcatgtactttgcccttttggactgtctctttttgattaaattataaaaaccctttttacatatgcttattagttttttgcccctcacatatgttatgctttccccagttcaatttgtctttcaaatattgaggactataatgtattttattttaaatgtcctcaaaatctgtcattttttaactttataatttctgggctctacattatacttaaaaatgccttttccactgcagaattataaacatgtttacccatgttttcttctagtacttttaaggttttctttctcacatttaagagagaacaaggctttggatgaaatagaaaagtgtaagtttaggcaatatttgcacaatgccaggacctttctgggtgatgccaggaaagaagtgggtggcacagggggtaatactggcaacttctccatggctccctgcccccaggtgatcccaccaggtgggtccctaatattcaaatggaggtcacaacatctgggctcaagtgttgagttccaggagtgaagcaagcctcaggtagtcaaggtgcatgagtctcctcctttgttccacaggtccctttctgctaacttctgctttgggggcaaaaacattggttgtctatgctcttctgtgctctccaccaaagttacacgattacgtctttccaatgattggccttaaaggtttcaaatgaccaaatgtagtgggttagcaataatctagaaaaggtagtccatgggtggactctgcaggtcatccaaaaagcatggttctggagacgatgtctgtgctttccagctcaatttgtaagggcacaagcccagattactcccttccctggggtcagtaatgatgccttcttaacaagagagtacaagaatgctccaaatcaacggagcctctgctcagctctgtctctgaaactttgaacttggaaatgatatttactcactgacattggagatatttactcactgcaatcatttaagataccagcaaaacagatggtttttagggatgctcagactcacacttcatatcctagaagccagagtagcatggcctattgggagaccactctctgtaactttgactgatttgccaaaacaaaaccacagaaatggagcctcatctgattctctgatccaggaacaggatcaaatatttattaatagtgacctgattactctttttttgtttgtgttgttttagttctgtaagcaaattattttactaggacttttatcccaaattattcaaatactatgtgacattgttatttttcatggtctgggtttcccatatattgctttcacagaaaaaccaagaaaataaggacattttttgataagggccctttttatgtttttcagctctctcatacaaagctttctgcagaagacacatggaagtaagtaattagtattttttaagagttgttttgctaaaaattagatttttatcttaacagttgagaaaatgaatgaagtcatcattttatttgtaaattttccaggatagagaagatggggtaggatacacaaatactacagaccaaaatgcatggatttcatctgttttctacagcatgatctgtagaaaaagatcatgcagtcccacaaaggtggattaatatatccttcaaaatatggctgtgtcaagttactatttattttaggcacaagatacactggttttgttcctataccattgcccctgtgttctggtgcatactgtagggccattgggccctgtgagcaccacatgaagtgaaataagaatgaaaagctcctccttttttgtattacaggagtcaattttggatatattcctactcaaaaaggaaaatacttactacatttgtacaccaatatatacttttcaaagtacttcaacataggctaaccaatttgagatgcatttttattatagattaatctcatataacagattaatagattaatctcataaagcatattttattttatatctatgcaaatcctattttagactgatgatgaagtcactcttttatctatatgccgtaagttcaaagtctgttaattatatagaatattaaacagctattttagatttggagctgtataaaccacaactaagcacttgtattcttttcatttttcttcccatatcttcaggggaacaagtttgtttttttgcttgtttgtttaaatgagcttctagaaatcattcctgtctcctgagctcagcttccaatagagagactaagagccacgtaattttattcaagttgcttacctgatatggatttcatcttcgtcatttgataaatgagggagattcattccatctatggtaacttccagcactgacattctgagaatccctctcaaagaaactgaacttgagcagtatttactgggctctgtgggctgatttctacaccttttccagcagggggcacccttgggatttggatgagacccttttctgaggcattcactgctctttggagtagctgtagaaatgctggcagagggagagaacccawcccacatacccatcaagtgcctttaaaaggtcactatctcacggcacagactgttaccctgtggtgttttctgggtggtacattagctaactgcatattgtaactagacgtaagtggaaacttaagagattttgtgactgatggtgccacactagggatgaaagataatgataaccagtatttagaaagtaactgacagcattcatgatttttccccatgttcactcatcttgaccctgggcctctttctcttctgctaggcttgtggttctcaatcttggctgccccttaaaatcacatgggatgcctgaaaaattcctgatgtcacatcccattctgcaaatctgtattaatttgctaggaataccataacaaaataccacagaataggtggcttaaaaatcagaaatttattttctcacagttctggaggctgaaagtccaagattaaggtgctggcaggttttggttggcatgttgaagtacaggggattaggacatcagtgtatgaattttgagagggtgaaattcagcccccaacacccagaaatggtcatctaattgatctggatatggggggttaagatttttttaaagcttcccagtgtttcctaacttacagacaaggtcaagaacgactgctctaggttttcatcgaggctaccccagracgttaaaagagatgacaaactattttgttgattttctctacaattgtgcaaaactaagcatccagctaaaatgggaacattcagccatcatgggaatgtctgtgcatgtctaagataatacttaagcctattctttctctctattatagtcctgtaacaatttatacaactcattcagaagctttccattgccccctggataatattctctcctctggcataagcaccatctgcagggtttccttttacttgaaatagtagcaaatgatttaaaattaccaacgtttgactgtttttgactttcaaaaattgaagtttcatatgatgcagctcaataataattattccttatatagacacaaataaaataacatgtgctttatagtcttacaacaaccttgtcagttacagaaggatggttatttgaaatttgcaaatgaggaaactgaggctcagagaggataaatgacttccccaaggttgtgaggcaatgaagtggcagatcagggactggaccccaggtcttcctggggctcattastttttttagccccatcacttaacttaaaagacaaggctgaggccaaccacatgggaaagcaaaggaactggttttgctaagaaagtcaggctcctcctcccagctgctccttctccagatctagggaaagggaagaaaccaagaaaaacttagaaaaactttacaatcaaagcttaccaacccttatatttgaaatcccctgttgctttttgtaagccaaacctgttttttgtttttttgttttttgttttttgktttttttgctaaatgcgcaaggttgagggctttttcagatgacctcattttgctgrttccagcctgcagcaggagaggatgtacaagatgcaccggggccacgattccatgcacstggaaatgatcttgatcttcctctgcgttctggtcattgcccagatagtgctggttcagtggagacagaggcatggccgatcctacaatgtgagtcatccccgtggctgctgggagcctgctccagcttgtatcagcttgactgtttttttccaggacatgttctcccttggttagcactttgaaggaactgccttggtttaagtcagtggttctcaaccaagtgcaatttcactcccaggagacatttggcaatgtctggaaacatttttgactgtcaagacttgtggggggtgaaaagggggaggggagttgcaactggcacctggtggatagaggccagggatgctggtaaacatcctccaatgcagaacagctccccacaacaaaaattatctggcctaaaatgtcaatgrtgccaagactgaaaaaccctggtttaagtaaaccagttttcccttcatgcatgaacaacttctgccaacagtccaggaaaaggaggattagaatagccaaaagaaatggtttagggtgtctgctatggtttgaatgtatcccccaaagttcttgtgttggagatttaatccccaatgcaacagtgctgggaggtggggcctaataagaggcgatttggccataagggctctgcccttgtgaatggattaatgccattaattattgtgggagtgggtttattataaaaacatgaatgtggacccattttctctctcattctctcttgccctctcaccttctgccatgagatgacacagcaagaaggcccttgcaagatgcaaatccctctgtcttgtactttctagcctccagaccatgaggcaatacattgctgtttattatttattacccagtctgtggtattctgttataacagcagaaaacagactaagaaagaaaattgatacgaagaagtgggtctgttactataacaaatgcctgaaaatggggaagcagctttggaactgtgtaattgggcagaggctggaagagtttgaaggaacaggctagaaatagctggtcttgctgtaatggagtattaaaggcaagtctggtgagggctcagaagaagaaaagaactatagagaaaggctgaaactttttagcgatcacttaagtggtcatggtcagaatgttggtagaaatatgaacaatagaagccattatcctgaggtcttagacagaaaatgaggaacaaggtatcggaagctggagtaacggccatcctcattataaagtcacaaagaacttggcttaactgtgtccatgctggagggctttatggaaggcagagttaagagcaatgaaccaggatatctggtgaaagaaatttctaagcaatatattgaaggacctgcatggcttcttttaactgcatatagtaaaatgaaagaagagataaatgatttaaagatggaatttataagtaaaagagaaacaatrtaaaatttggaaaactcacagcctggctacgtaaagaataaaaagacttgcagtacagccaagtgaccctttgataaaggggattaacacagctagaaggaagccaggtgcaagtaatcaagacaacaggaaaatgaccctgaaggcattgcagtgaccttcaaggatgcccctcccatcacaagcccagagctctaggagagtagaatggtttggggtgactccccattgtaccctacacaggaccagtgagcagggccacctcaggactctgctccttgaattccagcatcgttctccttggctgcttcagctgtggctccagggagcccaggtgcagctcaacctgtggctctggaaggtacaagctataaacgttggtggtgctaattctgtaggcacatgctgtgaggccatggcagcctccacttagatttcaaaggatgttgcagacaaccagagggcctaagcaaaaacttgtcttggggcagagctgccacagagagtgcctaggaggacaacgccaagcagaagtgtggagtcacagccatagcagagagtcctcactaggcctaggggagcccttcggggtggggatgcccccaagtcccagaactacacaactaccagcatgcaactccagcctaggagagctatgggcatgcagcatgcaactccagcctcggagagctatgggcatgcagcatgcaactccagcctaggagagctatgggcatgcagcatgcaactccagcctaggagagctatgggcatgcagcatgcaactccagcctaggagagctatgggcatgcagcatgcaactccagcctaggagagctayggacatgagattctaacctgtgagagttgtgtgggctaagcctagcaaagccatgggggggcaaggctgttcctgaggcctcaaggttccaaaccctacctcactatgcccagaaagtaggacatggagtcaaagaagagtatcctcaagtcttaggatttagtattgtttaccttgttaagttttagactggcttggggcctgytactcctttcttcttgcctatttctcccttttggaatgggaatatctatcctctgcctgacctgtcattgtattttggaagaagagaacttgttaatttcacaggctcacagctagagggaatttgcctcaggatgaattgtgccttgagtctcatccatacctgatttagatgagacactggacttttaccagaacaagttaagacctaggggcaattgggatgaaatgaatatattttatgtgtgagaaaaacatgaatttggagccagagcagaatgctgtggtttgagagtgttccccaaagttcatgtgttggaaacataatactcaatgcaacagtgttgggaggtggggcctaatgagaagcaattaggtcatgagggctctgccttcatgaatggactaatgcctttattgcaggagtaggttccttataaaaggatgagtttctctctctcattttctctggccctcttgtcttatgccatgaaatgatgcagcaagatggccctcaccagatgccagccattcaatcttggacttctgagcctccagaactgtgagaaataaatttcttttcattgtaaattacccaaactgtcatattctagtatagcagcacaaaatggactaagacactgtctaatgttgtttcattagtagtaaactatcttggcattaatggtttgcatatccatggaaatgtgttcatgcacacactgcactgacttcagcaacatggagcaagatttcgttttcacagaccaatctcattcaagcatgttcaccaccagagccagagagtcatactgtgggccttgttgggcctgagaccttgccatcacaatgtttagagtagtatttctcaatggttagagcagggtgcatcagaatcatctagagagcttgttaaatcaagttcccgggtcctgtccatagagtttccgattcaatagggacccaagaatttgcatgtctaacaagttccctcatggtgctggtaatgttgaagctgccggtcctggaaccacactttaaaatcctctggtttagattcaaatatggactaaatggagaagtgttgcaaagggaaaaggtcctcagttaacactacatggttctgggtcttggaatggccattatagagcctgagggactcaacttgcctgcaacatatgaagtgttgacttagaccaatatattattttactattacctgtcatagaatttatttcctatatagtacagggtctaaaggaattcttttgagttctgtattatatttaagtttaggcaattttgaacattttctttagaaaggggaatctcattttattgttataaagcaaatgtatccattttctgccatgtcaccgttgtcttatcaattataataaacactctttatattgcacttggataatgtctttaagtgaatgaaactagaatcaaacctcactagttcttcactcatatcaaagaaaagttctttaaacatatcttaactatggtttccttatctgcaaaatgaaagtatctaagataaaatttctagagtcctcatgtaggaagaaacctggattcataaggaatcagttcatagccttatgcattctttctttaaaattaatcattatctctaaattkatgtagaaaaaaatgttctttttccatagtaatacaggtgtggattttgcataggaagcccccgaccttgaaaggaaacaatgctccaggagcccttgactcgcactgtgtcgcaccactcctgcaacattttcatttgatgatttttttttttctttgagatggagttttgctcttgttgcccaggctgaagtgcaatggcgcgatctcggctcactgcaacctccacctcccgggttcaagtgattctccagcctcagcctcccgagtagctgagattacaggcgcccaccaccacacccggctaattttgtattttttagtagagatggggtttcaccatgttggccaggctggtctgaaactcctaacctcaggtgatccacccgccttggcctcccaaagtgctgggattacaggtatgagccactgcgcctggccagatttgatgatytttgaggtggcatatgcacaaagaccatccttgtcctatatttgaagcagctgctcttgtgtcagstcttggagggtgtgtgtcactgcaccagtaagtgtaagtgtggcacttacacactggctctacctggccaaagacagacctgcctatgcctcagaatcccctttaaggacttgtggccatttgaagggtctgaccttagatgactcaggctacactggactaggtggacaccctggaccctgacctctgttrgttagctggagtcatctgagttgtttcctgttgctaactgcacaagctgtgctacctgcagtgcctctccagggacttgcttttgactgccacctccccctgactcctttagtcaccccacttttgctctctaagtttgctatgtctatgtccctctgtcacacagctcctatgttttatggctacccagtggggctctgtagtcctaaggatcaccttggaggtgaccaggygcctgttatcctgcctctcatgatgataatgatcatggtgatcctgtctagcactttgacaaagccaggagcctgcataaagttgcccccmccatagtcaaggacagattcaggtctcatggtgccttgagactctgctgggttagctcatagactttgttggtctctggaatatattctacttctttgcacatcaatccatctaattattggtattgycccaaaggaacaggttgagtagccccatccccctgcatgtctctaytgaggggctactcaatctgtggctcaagatgagaggccaggctttcccatgctgcagccttgactttgccccatgctttgcattccttcttggggattcacctccagagtggtcatcagagcacagccatttcagccactcttggtgatgtctgcaaccatttgagcttgaaattgttcctagagtaccactagcttattctaacactggtttccagctttcttatacttgggtgaacaatatcaaaaaaaactacggcctgatacactactgaatttaaagtctttgggatggaatttgacagacatgtgtccataaatgctgacctaaattgccctatcatccagagagaagctagcttttaattgttgttcttggcatgtataagactagctaytgagagctttgaacatgtttataagattcacaacattgctggctcttttctacaaggggctacatagtgaaatttatctccatgacttgatattgtaacctctatcaatattaggaacatattaatatatattataattactataatactcataataattatacataaaattactatatataaattactattattattacagctatgataagtgctttctgtacattacctcaggtaccttgagaggtaattattttttatcccctttgtgaaatatagttcagagaaattaaaaaccttggccaagggcatataactaattagttgcagagaggctagaatccaacctcactagttatttgctctcakatcaagaacaagctcattaaatatctctgaatttctagtacagtggctgatccatagtaagtgttcagtactattagttgactccgaaagcatccaatagatactgtttgtttataacgtttgtgcaaacgtaatcatatgctgtaaaagcagtttgctaataaaagaatccttttctggacacttttgtaaagctagagagaatgctcaaccattgatttacatcctctatgaggagataatgaattgttttttttcaaagcagtacatctgcttatactgccttgccacccccttctattctgcctgaattttttttttttttttttttttggaacagaagctcactctgtcacccaggtggagtgcagtggcatgatctcggctcactgcaacctctgcctcccaggttcaagagattctcctgcctcagcctcctgagtagctgggattacaggtgcctgacactgctcctagctaatttttttattttagtagagacggggtttcactatgttggccaggctggtttcaaactcctgacctcaggtgatccgcctgcctcggctggcctcccaaggtgctgggattacaggcgtgagccaccatgcccagctattcagtctcatgctttttctgaggacattttcctgggctgattttgtgagatatagtaggttggtgcaaaagtgattgtggtttttcccattacttttaatagcaaaaacagcaattacttttgcaccaaccgaatgtggcaggatggtgaaaggaaagagtactggcttagaagtgggaagattctatctactcatttaaccacaaggagcctttgtttcctaatatttaaaatgatgaaattttaaaaaataggaaggacttctggtttcagctccaacatataaaaagcttggaagtcagcacttttatcttacaacaagaaaaaaacggaccaaactgattatcaatggcttttcttggacctgtcagagaattgaggtcacagggaaaaccaccacctcaaaatctagagagacagatgaatgcaggaaatcacagctgagatctccttcctgaaagcagaagcgacaatgccatatcaaatgtagtaactctgaaggattgctggaagcagtgcatagagtagtgtgagagtgagaaactcctgggagccacagtcagggaccccacattttgtttaggttttacctccagctaccccaccggggtctgacaatgaaaacccaagaagtgctctcatgcttccagcaggggaggggaaaagtgaccactctgaagcagatccagaatgttctccataataagrcctaccacagcaagggaaaagattgatcagagcctcatccaatatgaggggagagaaataacccaactccagctccctctagccttcctgtgtcacctaaggggaaacaaaatagttgagaaacacttgtaaaggccaccccaggtacacaggcctaaaagagacttaaccatatgataacagaatgctcccactatccttacgccctgccaccacatcaacaggtgtccagcgtaatagccaaaagttagagctgaaagagctgcaaggcttagactctatataagaaggaatgtttagggaaacccaaagacaacagcagagacagaaacaaggacactagtggaaattgaagcctttgacacctacaactacagcaaacattaaacacagcccaactcctagccaaattaatacaaaacctcacactaaaggcctgtttatctcagcttctattactcaatacatcatgtctgcttttcaaccaaatattacaagtcatgctagaaggaggaaaaaaacacagtctgaagagacaaagaaccagactcagatatgggagagattttggaattatcagaccaggaatttaaaataattatgattaaaaagtcaaactcacagaagtagagtagaatggtggctaccagaggccatagaggggtgggtagatggggaaagaggagatattggtaaacaagtacaaagtttcagttagatatgaggaataaattctggtattctattgcacagcatggtgactgtagttaacataaacgtattgaatgtcccaaaatagctaagagaggatttttaaatgttctcactgcaaaaaaatgataaatatttgaggtgatagatatgctaattagcctgatttgatcatttcacaatgtatacatgtacagaaacatcacattgtacttcataaatatatacaattattatttttcaattaaaaataaaataaaacttaaaataattatggctaatatgcttagatctctaatggaaaaagtagacaacatccaagtatagatgggtaatgtaatcagagaagtggaaacttacaaagaaccttttaaaatgctaaaaataaaacaaaaaaaaaatggtaccagaaaggaagaatgtcttgaatggcctcatcaatagattggacaaagctgaggaaggaattagtgagcttgaagataatgtcagtagaaacttcccaaaatgagatgcaaagagaaaaaaagagtgaaaagaaaatagaacaggatatctaaactatggaacattttcaaaaaatataacatacacatactggaataccaaaaggagaagaaagagataatggaactgaaaaaatatttgaaataataatgaccaataatttttcaagattaaggagacaccaaaccacaaatccaagaaactcagagaacaccaagtagggtaaataccaagaaatctatacctgggtatgtcaaattcacactacrgaaagccaaagatgaaggaaaaccttaaaagcagccagagaggggaaaaacaaactatgcaaacaagaagaaagtgaagtaaaatatttaaagtattgaaagaaaaaatcccagcagtctaggattctatatccagagaaattcacttcaaagtgaaagagaaataaagactttatcaggcaaacaaaaaatgaggaattcattaccagtagttctgacctgtaagaagtgttttttaaaagttcttcagaaagaagtaaagtgatttaggccagaaactcagataatctacataaagaaagaaagaatgtcagagaaagaataaatagagataaaataaaactttttctttctttctttcttttattttttattttgagacagagtctcgctctgtcgctggagtacaatggtgtgatctcggctcactgtacccgtcgcctcctgggttcaagcaattctcctgcctcagcctcccgagtagctgggattacaggtgcctgccccaacacccagctaatttttgtatttttagtagagacgaggtttcaccatgttggtcaggctggtctcaaactcctgacctcatgatccgcccacctcagtctcccaaagtgctgggattactggcatgagccacctcacccggccctatttctttttcttaattcctctaatagattaattgttcaaagtaaacataggaacagtgtattgggtgattatgttatatggataactgaaatgaatgatagcagtattataagaaatgggagggaggaattgggatttctgttataaggtacctataataccaacaaagctgtaagtgttatttgagaacggacttggattagttatggatgtattttgcaactctggagaaaccactagaaataattgtaaaggagtataattgatatactaatagaggagagaaaatggaatctcataaaatacccakttaaaacmagagaaggcagagagagagggagaaagatgcaaggaacaagtgcaacaaatagaaaatagttacatacatggtagatattaatccaactatatcaataatcacttcaaatgtgaatggtctaaatataaaaattaaaatacaaagattttcagagtggattaatttacaaaaacaagatgcaattatatgttgttacagatatatcaacagtaaagatttggaaaaagatattccatactaacactaatcaaaagaaagctggaccagctatattaatttcagacaaagtggacttcagaacaaggaaaattatcagggataagaaagggcatttggcttggcacagtggctcatgcctgtaattccagcactttgagagcccaaggtaggaggactgcttgagccaagagctcgagaccagcttgggcaacaaagtgacaccytatctctaccaaaaaaaaaaaaaaattagccagatgtagcggcaggcacctgtagttccagctacttggaggctgaggagggaggatcgcttgagcctaggagttcaaaaccagcttgggtaacatgatgaaaccccatctctataaataatttaaaaattagccaggcatagtggcatgctcctgtagtcccagctactccagaggctgagatgggaaaatggcttgagcccaggaggtcaatgctgcaatgagccatgatctctccactgcactccagcctgggcagcggagtgagactctgcctcaaaaaaagaaagaaagaaagggcattacataatgataaaggggtcagttattcaagaagaaattcttaatatgtatgcatctaacaaaagagcatcaaaatatgtgagacaaaaactgatagaactgcaaagagaaatcaacaaattgaccattatagttaaagattttaatacatcttttagtagttgatrgatcaagcaggcataaaattagtaaggacataattgactgaacagttccattcatcagcttgctctaaatgatatttatagaatacttcatccaacaacaacagagtatatattcttcttgacatcacatggaacattcaccaaaatacaccacattctgagccataaaacactccaaaataaatttaaaagaatagaaattatacaatctatgctctcaaaccacaatgaattaaactagaaattaataacagaaagcatggaaaattccaaaatattttcagattaaataacataatactaaataacacatgggtcaaagaagraactccagagaaattttaaaataatttaaatgaaaatgaaaatgcaacttatcaaaatttctgggatgcagcaaaagcagtgcttagaggaaaatttataccattgaatgcatatattagaaaagaagaaaagtctaaaatcaataatctaaaaatccacctgaggaaactagaaaaggaagagtaatttatgcctacaacaaacagaaaataaataatataaattttggcaaaaattgatgaaattaaaaataggaaatcagtagaggaaacacaatgaaaccaaaagctggttctttgaaaagatcaayaaatctgataaacctctagccagactaaccaagaaaaaaaaaagagaaaacrcaaattactaatattataaaagaaaaytgggctaggcttagtgactcacacctgtcatcccagcacttgggaggytgaggtgggaggatcacttgaggccaagwgttcaagaccagcctgggcaacataatgagaccccatctctacaaaaaatttgaaaattagccaggcatcatggcacgtgcctgtagtcctagctactcaggaggctgaggcaggaggattgcttaagcccaggagttggaggtacagtgagctatggttgtgccactgcattccagcctgggtcacagagagaggccctgtctccctgaaaaaagagaaaagaaaatgagatcatcattactaatcccatggacataaaaagaaaaggctacaaacaattctgtgcacacaaatttggataaattagatgaggtgggctaattctttgaaagacacaaactataccaaaactcgcacaaggagaaatagatgaactgaataggcctatatcaatttaaaatttcaatcaataattaataaccttccaaaaaagaaagcaccaagcccaggtwgtttcactggtaaattctaccaaacatttaaagaagaaatgataccagttctctacaatctctcccagaaaatagaaacagagggagtacttgcaaattcattcattgaggccagcattaccctcataaaaaaaccagaaagacaaagttggaggactgacactgcccaatttcaagacttaccatatgaagacattacaagraaaggaaactgtagaccaaaatctctcaaaaacataaawccaaaaatcttcatcaaaatattagcagagcaaatccaacaatgtataaaatgaattatacaccacaatcaagtgagatttattccagatatgaaaggctgactcaacaattaaaaatcaatttatgtaaataatcacatcaagaggctaaagaagaaagtcctgtgatcatatcaatagatgtagcagaagcatttggcaaggtctagcatgcattcatgtaaaactctcagcaaactaggaataaaagggaatttcccaacttgataaagagtgcctacagaaagcctacaactgacatacttaatggtgagaaactggatgatttccctctaagataaggaagaaggaaagaatgtcctgtctcaccactcctattcaacattgtrcaggaagtccttgctagtgcagcaagataggaaataaaaggtatgcagattagaaagaaaaattaaaaccatcttacatgattgtctatatggaaaatctcaaagaatcaacataaactcatggaaataataagtgattatagcaaggttggaagatacaaagtaaatatacaaaagtcaattgttaccagtaatgaaccattagaatttgaaattaaaacacaataccatttacagttgcaccaaaaaaaataaatacttagtcataaatctatcaaaatatgtacaggatctatacagagaaargagatataaattaatggaaagattattccatattcatagattggaagattcartatcaatatgtccagtcttcctgacttgatctatagatctatagattaaacacaatctcaactaaaatctcagcaaggtactttgtgtatgtcaacaaactgattctacagttcatgtggaaaagcaaaggacccacaatagacaacacaacactgaaagacaaagttggaggactgacactgcccaatttcaagacttactgtaaagctacagtaataaatatagcatggtactggtgaaagaatagacacatargtcaatggaacagaatagagagcccacaaatagaccaccaaacaaatacagtcactgatccatgacaaaggacaaaggcaattcaatagagaaagatagtctttccaacaaatggttgtggaacarctggattttcacaygccaaaaaaaaaaaaatagacacagacacagaacatacaatacaccttttagaaaaattaattcgaaatgaatcttgggcctaaatgaaaaatgcaaaactgtaagactttgagaagataacataggaaaaaaatataggtttacttgtatttgatgatgggtttttagatatggtaccaaaagcatgatccataagagaaaatataaataagatagattttattgaaattaaaaactgctatggaaaagatactgttaagagaatgaggccaggcatggtggctcaagcctgtaatccctgcactttgggaggccgaggtgggcagatyactaggtcaggagatcgagaccatcctggctaacacgattaaaccccgtctctactaaaaaatacaaaaaattagctgggtgtggtggcgggtgcctgtagtcccaggtactygggaggctgaggcaggagaatggcgtgaacccaggaggaggagcttgcagtgagccgagatcacgccactgcgctccagcctgggcgacagagcgggacaacatctcaaaaaaaaaaaaaaaaaaaaaaaaaaagaataaaaaaacaagccagacttggagaaaatatttgcaaacacatatatctgataaaggacttgtatccaaaatatacttaaaactcaaccacgagaaaacaactcattaaaaatggcaaaagatctggattaacttatgtaattaattacacatgtaattaattaattcctactaaggaaaacttacagatggcaaatatgcatatgaaaaggagctcatcatctcatcgtgtcattagagaattaaggcaataataagataacactacacacctattagaatagctaaaattcaaaaaactgacaataccaaatactgatgacaatgtggagtagcaggaactctcgttgttgggaatgcaaataatggtaaagctatttttgaaggctgtttggcagtctcccacaaagctaaacataggcttactatataatcactctacygggtatttacccagttaaattgaaaacctacattcacacaaaaacctgcatgcaaatatttacagcacctttattcataattgcccaaaactggtagcaaccaagatatcctttaaaagctggataaataaactgtggtacattcatgcaatggaatactattcaataataaaaagaaataagctattgtgtcatgaaaaracatggatgaactttggtgaaacaagtcatagtgaaacaaaccaatgtgaaaaagctacatactgtatggtttcaattatatgacattctgaaaaccacaaaactatagagacagcaaaacaatcagtggtttgaggggaagagaggaaaataaataggtcaggaattctggagtagtaaaattaatttgtgtaatattgtatttgtgggtacaatatattatgcatttgtcaaatgtcatagagctgtacagcacaaaaaccggacttcaaaataggaacatttttaagaatcatttaggaggttgggggattccagggagaaatgcagactgtgcaaggggatctaactgcattaaaaatatggaaaacaacctcactgaagggtagagaggggaaaagtatcgycccctctttaagtaactttggaaatgagcagagtctgtaagatgaaggcaataggaactgcaaaaaagtactgtattccacttgataaaattgttcccygtggggatacaaattaacaatkatcatactgctgtgtatgtacacaggaattgaacaattaagtaaatagcagctagtgggagccaggttacttactgttggaatgcgagtttacagaaaagcaagggatggaagttagaaaaaaagtaggaagtgcacttatagtaatatgtgtaaaagctttgtatactgcatgtattattatttatgcatattatttttaccctgaaggtattattcattataaaggattattattttcacattcttttatgcataattcagatcatgtacttaaagaggacacagactaattcaaaaagctcagaatattttcagatrcaactttttaacaagtatgcccgtcttctgaggtggtcttttaaatttgtctagatagattatgttctgcggtctgtaggagctgtgtacatcagagcagcttattataaatacctaaagcaaaagaaatggtttatttagaaaataaagtatagaaatataatgttaactgctcctrtgtgatgtcaaaagtggaaagaaggtgggaaattcttatttcatgtgrgatactactaaatacctggakgttttcaartagtcgcatttttagcacagcatagtccaagcatccgggtatttgaatttttccctttccagctggtaatcttgatatgttatagatgtaggcaaagcctcaaagttaaatcatttccaaatgctttgaacagcatttaactagaaataaaatttcattcaacatcaccctctccaccttcttttatgtgcagttactttccrtatctgcagcaagtagacagaagagtgccaaaaaagaatccttctctgacttcacaaatcagtagaaggcctgatgactacatgcccagaacttgggtttcagacacactattaacttgcctcaatacagtgcaaataattttccagattgaagcattgctctatttaaatcaaccttcctgcctattaatagctgtgaaatactagaaaatattactgggccaataaagcattrtgtctgctcaaatctttttaaaatgaggcaagacacaaatacatacatacttaaatacatatgtatataacattgcagaacctcctttaaaagtttaaataacaaaatcagccatctagattgatgtggagattaaaaaaagtgaaccaactgaatttctaaggaacctttgtatgccaatattccatttccatattttcttcttcttctttgttttttgttttttgtttttgtttttgttttttgagacagagtcttgctctgttacccaggctgtagtacagtggcaggatgtcggctcactgcaacctccgcttcccaggttcaaacaactctcacgcttcagccacccaagtagctgggattccaggcgtgtgccacctcgcccagctaatttttgtatttttagtagagatggggtttcaccatgttgcccaggctggtctcaaacttctggcctcaagggatccacccatctcggcctcccaaagtcctcagattacaggcatgagtcaccacgtgccaacccatactttcttcctacttgctttatattcacactctccttcattgtcttttactaatagcagcattgtttcctgggtatttttttatgataattttctgcttacctctgagcacaccactgccctccctccaccatcccaccaccctccacacacaaatgattgcagatagtttgggatttgcagtgcagaggaaatgaacacacataatttatttatttttttctttttttccttgtttccttccttccttccttccttcctycctccctcyctctctctctttctttctctttccttctttcttttaatattgcatggcccattcatcattctgtacaattagccaaatgaaaggtatctttgttttagcttgatctgtaattcttttcagattcattatgtgcatggcaacacaaaraaaccatggtacttttgggcagcatctgattcmtcaggaaattcctcctgctatgatatgtggttggggagaacgtgagtgatgtgatccagatgcatgagccacccgttgccagtagtgcagatgtgttttatacacacatgcccagatggtgacccctgtggcattattaatgagttccagatgccaggcttccttctttgcatgtatgtgcctcgatttcatatatttcaygtgtttatttatgagggacagcattcctacatttcatatatggcagttactatttaaaatgagaaattttaactgctctggaaattgataaagaatcttttaaattgatatgaaatgtgtctctcatttcaaaatgactagccatgcaatcaytgaattcacagagcaaattactgaactttcccttcatatattgagaaaatatggtgctgrgttacattttaaagatagttaagaaataaaatatttgcacacataatacattctaatgattttttgctttcttttcctttttgatctccaaagcctatttttaaaagtacaatgtctgtacattgaacattgttactcactattaattaaatctaggcatcaagagaaatttgacatcttctagaaattgttcatacttatggatytacaggaagagaactggttttattaaaatatagtccagctgtrgctccaaactatcatggattgtaactccatggattagaagaaattgattagtcttatattttggcttagatctaaagtataaaatataagagcatagtagttccactgaattaaaatgaaccaactcaagtttttattttaaaaaactccagtattttatggggaaataaaaaaatgaaacaaattcttaaaatagaaagaggaaaaatgcaaacgacagatgatcagactttgaaagatgaagttcatgtccatttccttctttactaccagaagtaatgatcttttaagtcagcaaatgtataatttatgataaagaactatctccaaaatcagctacagaaaataaatgaccaatatgctgataagatttttgttaaggtgctacccacttttttttttttaagacagggtctaactctgtcacccggtgcagtgtcatgatctcaactcactgcagccttgacctcaagggctcaggtggtcctcccacctcagccttctgagtagctgggactacaggcacataccaccacgtctggctaatttttgtagagacagggtttggccatgttgcccaggctggtctcaagctcctgagctcaagaaattcatccacccccgcctcccraactgctgggattacaggcatgagccaccacaccaggccatggtgctgcatacttttactgtcaatagcagagggtcaaagttgctgaatgcttaagtaagcacatcttgagtcttggttacttagcatatggtttcgggtcctcttgaaaactattctacttccttaagtaaagcttgtttttcctatttgtgtatgtgtatttatctcaattacataaaggtgctaactcattcattttccacacccacaaagtaggatggaaatttaaagcagttatctgataaatggaggcaagattaaagagtggatttttttccctgaaagtattccttgaagttaaaaaacaaaaattgaagttataggatttgttcccgaactcctcagatactcacctcagacttgctccgtgtgtgtttttgtttaagtgcatatctatgataacaactctagggttctctgaaagaagattcagagcaattctaagaagacttcagatcatttatgaggatggagcaatcaaaggagaatggtgagcctgggaaatgtcttcttatctgacattgaaagaagaatggctgtggtcttgcctttctcatttctatcttgaagtcctgtccaagagctttggttattgaccttagactattatcaccaagacctgtttaaaggatccaacaatatatccatagactcttttgttctaagcctcccttttctattgcaaagattgagaaggtaaagaaaacaaatggcagcagcctttttaatactcaggatgatgaatatgcgataagcaagctctaaccactcttcccacattgctggcagacttcattaactgattataagactctaccactraaccaggatccaggctcagaatcctcaacagagygctgcaggctaccactaaaaattagttaacgtacacccttgagacaaaaccctctttgccgttccccttatgttcattctgagcaaataataggtgtttagtctgaatgcgagaaaacataaaagaccaaaggatattgctattgattaaagctgtctgcttttcccaagaggggtgactagctggtactaggcctgcttcgaggagtaggagtatagctatggtaaccatatcacatcagtgacccacagacagtcagttcactctgccctgctccctgacctatgggaatgggaccagattaaaggaccctctgaaggctacttggactcaggtcaatggcacagatcacaraaggtttatgcaccaaacgaacaggaaaccttgcagagtgccctgggactgcaggcagaagacatcccaggggcttctctgaaactctgacctccacttcctcctttgacattgctgtcactttcgtatggatacatgacagtaacaaagcccctgggctctgtgtagtgcagtatggttttcagagtgctttccattcctgatctcgtttgatccccgcctcagtgagtgcagggaagcagtgcaagcatctgtacccccaattatacaactaaagtgaggctcccttgtccaaaatcacatctctatggaggccccaaaggcctttaatctaaaattgtcagatgaaaggaagtgacagagggcgggtattttggattgtttcccattggaattttcagataattgtgcccatactccccatagcctggcctgtctagggaagcttacagtttgatggtgaaccagttgcatggtacagacatgatggtgaaggtggttctcccagcaatgcttcagactcatttaatagtggagatgccattcaggcacttggtcattgaaagatacttcctgttcatttctctgacagctggtgaccttgttgcagatgtgggttgtccccttatatttcacgataaaattatactggtggcggtttctgtctatgtgggggatgttctccgttattaccagttacatcctcttcagagctacccgaaaacccctctcaggaaggacaccacggtatgtattccatacattccttccccaggagcccctttattttaaatattacaaagcatattttattgccattttcctgggttggggagtgggggggttacatttcttttacgtgtcttttacctttggtagcaaaacaattgagaaattagctacactggtcttagtttgccttcattatttaatagcaattcagatatgcatgtaaaatttattacttcaaatattagctagtgaaatgcagaagaaagaagtgaaactattgtttaaaatttctagagcattatttgcaagtttatttttacctcagcatttttctttattccactataagttgtgtcacacattttaaaatagagcaagagttgaaagttgtgtttcaacctgaaaacatgtaataaatcataagtcatggacaacttattactctaataacaaatgatggtttaatattccaatggtcactttaattaccattgtcagcttccaaagatttgtataactccgttgtatcattcacaaatccttccaaagtgcttatcatcacatactgygcccacaggcttgcttttgccctccctgttctgtggataaaatccatatcctcatcatgataaaactggaatgagataaagtgtgtaaaatgtaaaatagtgataaaacaatgctaaatttgaccttttggaagaataaatcataagcttcagtgaaatacttttatgattatttagacatttgtcttcatcctctaaaaaagtaggaaacatgtatatcaacttttccttcaagttaggagaaggaaaaatatccaatgagaaatcagataaataaatgtgatgataaaaatggatatccaaatacatgaattcatgttatgagtattttagttcagttccactaaactaaagaggaagaggtctgggtggtggtaggagaccttataaactggccaatttgggatcttggacagcccttgtagtgtctggcttatcaatcagtaaagtgaatgtatggtacctttctccttagaaaatattctaagttatttaagatttgtgaaagtgctctgagtttgggatgaatcaaaatgtgcttgttttcatcccctggatataatctatgttgtatttccatgagaatggttcgcctatccactgtagaatgaattaccccatctaaaggcagtgtctttgtgcacatcagttcgtgcaatgcagaggaactttattacaagaaatacccaaatgctgcctcattaccctttatggcttgcatatgtccgctctctttcccatgcccaaagcatgtcctctcagcttcttcctgcctgcacaactccaagccctagaggatagtctgagagtcaagaggctccactgactttataaagcaaactcagctgccatttgaagagacatcactgagcaaggtgaagtagggcctcttctagaagagcagtcaggatggagctcctgtacataagaggcaataggccccagaattaccatggatctttgcttaattattgtattacaggtgagtcacattttaactatcttccatttggaagcagaggatttcattacaggctaggggagctggatgaagaaatcagcattgctgtagaaggcagacccatgagcagtggtctccagcaccagcagttcaaagcctactatttctctttgagagcacatcaagctcttgtttcaggatggggtgcccaaagaaggggaagtgagtttcctctcaactacagttggtttgtctggcaagcagtgaagttcagggtcagaaataagccacacatgcaatggctcacgcctgtaatcccagcactttgggaggccgaggtgggtggatcgcctgaggtcaggagtttgagaccagcctggcaaacatggtgaagtcctgtctcaactaaaaatacaaaaagtagctgggtgtggtggcaggtgcttgtaatcccagctactcgggaggctgaggcaggagaatcacttgaacccagaggcaaaggttgcagtgagccagggtcacgccactgcactccagcctgggcaacagagcaagactccacctcaaaaacaaaacaaaacaaaaacaaaacacacacacacacacacacacacatacacacactagccacaaagagctgggcttgatcacattgaatccagcccaaggccaagctttccttttggaggctgctctgaagcagttaaacaatctcctatctggcttatctgccttacagtgtaagtctgggtagcaaggaaattctggactctactgttcctgaaaataggtacccgcaataagcaggaaaatggcaggagaagtggggcttgagatttggaaaacygaacacatccataacagtgatatgacatattgagcatttagtgtgccaagtcaataaacatcaatacattagctcacacaaccttcagaacaactttaggagctagtgttatcctcatgttataaattaggcaatcataggaaggaatgccaagtaaattgaccaaagtcccatgggcagtaagcagcaaagccttggatcagaccaaagaactacttggctgcaaagctcctgctcccaamagcatgctatggcttcattaattcaacaaaccgctttgcacagagaaaccctgcagtttaaaggttattagtcctaraacatctctaatgctggcggaagtttgagagaggccccttaaggcagggaaatgggtcaccagtgtgtgcggagttcaaggaaccatattctggtactggcaggtgttgggggcctagtagaggggaccctctcagagcttgcctgtttctccaccatcaccacttttagcaacataaacttccgccttgatctggctgccctgagcaatgatctmaactgctcagtactgacaaatgaaaagaacccatggctcmagagtcactgtggcagaaagacgccaaaagccttctctggcttcctttygaggccacacagcctcacagtaatttcagccaacttctgcagcccatgcaagtttctgtctccacttaactcacccctgcccactcccccacgcagttcacccctgcccactcccccacgcagctcacccctgcccgctcccccacgcagctcacccctgcccgctcccccacgcagcctacccctgcccgctcccccacgcagctcacccctgcccgctcccccacacagctcacccctgcccgctcccccacgtagctcacccctgcccactcccccacgtagctcacctctgcctggtcccccacgtagctcacccctgcctactcccccctggggcaggatcacacctggtggagtaggtggcagcacagacagcccttgaatatcagttgcttcaagtgcagaaggtggttcaccatagaagtgatgtaaatgacaacwcatttcaggagctagcccacaacccatttaaaccatgatgttcagraggtcccttctgactggaactcagtgaaatagagcacctattaaaatcatattgaaaccttatgctagtratatcatagatcttaagtatttggtgcaatggctccaacagggagtgagctggggaaggtgaragagtcagagacagggctcaggacttggggrtgagagggtggggctaaayatctggagcaagactcttaatgcagtttggagtgaaaagcaggaaagagactccaagaggatgtgcagggaaagggatgtgaggcaaacagggccttctgccattgcacacccttgtaagcagctttctagccacctcttcattttctttgagcaacaaagataagcccccagcttttccatccactacctcttgtaccaatgggcatagcccctctgctgtggccctccaagaatggaactgggctcccaacctcttcccccatcctcctagacatgaagctggtcacatggtccttcttgtagtttttttctaagggcctttactgccaatgaagaaggaaaccagcagaggggagggcttccttctagattctctccactcgccctccatcctcatccttttccttctccacttagaccctttgggaacaaggaaaggccttggaaggtcacagagggtgctggggtacacgcaggacccttccacacagcagaaggaaatagcctggggctstcatcatttcatcccctgggctaggggagggctctttgggtggaggggacatgggatgagggctgggcccactactggtgatatctgcactggggctgggggaaaaggggcaacagaacaagagggaagaaaaactcctggggaagaagttctggactcccctttgacttctcatcccactttttgttcacctccaaggcactcctgctgaaaccactcaaggttaaccctaggaccaaatgagaagggggygctgtggggaggcagggtcccaggaagagtaaccattcctgaaggctatttttaagtgaagcacatgagggacgtagacaaatttaaaaagaattcacatacgcatatacacagaaacacakgagcatgatagttctattcatataatgcttattgctatatacatctgtgttctgtgtgttataaatttacttttagaaactaaaaactgatttataagtctttgaaaaagacaaaatattttataatattactgtgtttctccccatttttctgtgtttctgtgttctgtgtttctccccatttttcactccacagattggtctacaaatggtttcttttgatctacaaactcagctatgcatttggtgttgtgggttacttggcgatcrtgtttacaatgtgtggattcaatctgtttttcaagtaagtatctccaattaagacattaatatctccaagcacttgcttggcrcactcacctggtcatgttctcttaatccagaagcatctggccctacaattttccatgcacacatgttttatagtagatatccacacgtagtcttctctggggaaaaccaatagaaagggaagaaagaagcaccctacaaaataattttttaaaattaggagctttaaggagaatttatatttggtctgcaaatttaaaagattrctattaacagtggacctacaattgtgctagagtaattcttactgaactaatttctcttctacaaaattctcaagtacctagatctccttttatatatatcttcttatctaaaacctctagaattatgttgtccagtatagtagccactagctcatgtgactactgaacacctaaaatatgaaataagatgtactctaagtgtaaaatacatactgaatttcaaagacttacacaaaaaacattttcatatcaattacattttgaaatgatagtatttaaatatattggtgagattaatttcacctgttttttgttgtgtttttttttttgacttattaaatgcacctaccagaaaatttaaaattatatttgtggttgtatttacattggacagcacttctctcttgaatttggtttctgatagtcatgaaatgccttgtgttggggatacttggaaaaggaggaaaaagtgagtgcttcgaaattgtaagaggctgggcgccgtggctcatgcctgtaatcccagctacttgggaggcagaggtgggaggattgcttgaggccaggagttcaagaccagcctggtcaacatggccagacctcgtctcaaaaataattttaattggaaaaaaataaagctgggaaaccaaataaataaaaaagatttgaaggatagaaaacatgtcaatatctattgtttaatagatggggagttttaaaaaagcaattgaaagacaagtaaaggyataaaacagcaagaaagtctagggagagataaaggaagtagggataaccacatctttgaccaacagctgtgctcccacttaaggtggttgctgagacatgctgtggatggcattctcagggacacgactgaggctgagtaaccagcctgtgtcctggaaaggggactgaagacataccacacagctatggaaagcagctcaaatacaaatcccccagaatagctctcacatcaaagttactctaaacttctgggaccataacagaaattgaaaaggagagmtcatcaaccctttactcagaaaacagggaaggcaatcagatggagagtcagccctgggtgaaagggcttttcctatggcagcatagcaatctgattttataagcatttcataaaacttttggagcaggagcacctaacattttctagcaggaaagcggtagaaagtaattgtacaaatctattattgctaggttaggatatagaaagacactgtaatgtcttttttaacatactgtctatactggtttattttagtgaacataaaaatactcataaggatttttttgaaatcactgggaacgatagctgttcccagattattacctcataagatttcaagatccttattcatgaattttcctacagtaaggcataccaaaaacttaaccctttagaaaaggaactattttttttcactacttgatgattatcattgtattaagcttttttcctagggagccacaagtgtgttactgtactttttatcaataaaattattgatacatatttccctggacatggargaaagatactcttcacttcccccactgtcctaattctcagatatacccagacaaatcttgaaaggatgaagctaccacctgtgttggaagcctcagttcatatcacccaaaaatctgtaccttctaaatctacaaagctgtctgccttcaccatttcttcctgcaatgaacagaaaacagaaataggttttagagagagactacccaactcttgttcacattttcctcccttccctgaatcaatcagaaccaccaagggtcaccactgatatttgagattgttttatagatagagcaaaccaaatgtgcaattatttagattcataaattaaatttatggcaaattattcacttttaaaagagatctttcccttaagaaaaaaaaaaactggctggggggatgatcacaaagaatcctggtataaytgaaatatgatttaacttacaaaaagtttttttcagttaatacatagcaactctggcatggtaatcaagggcttcaagatgtgagcttgatttgtggctttgtgatgtaccaatttttgtgtcaagcaaataatgttttctaagtctccatgttttcacatgtaaagtggtggtgataatatctatctcaagcacttgttaggaaagatcattagaaagtattttataaaaatctaaattctacagcagacatactcaatccttgctgtgttaaagaatcaatcacttaacaagctctttaaaaatactgctgtccagaccccaacccggattaactaaactccagtccttggtggtgggcccatatgttaatgtgcttttaaatcttcccaggtgattctaatatatgtttagggctaagaactattgctctagtggttcttaatgttagctgcccattggagttacctggggtgtggcctggagatggaaactgttacaagctgctgaggcctacgtatagctgagcctgaaaccactggtcagagtcagcttgtctaggcactgcagtcctaagaagcwcttgaaggctatctcaagaattcctttgtccagttggcactgagtgctacartttgagggaaattcagaggattttaaattatttcatttaaaaaagaaaaatcaaacacataaatgaaaaaaaaaatacccacaaggttctcttagataccatcaacaggaaatattttccaaactccagctgtttggaaatatgccacrttcttatttccttatactgttgttttcaatagaatcaaagctagagattccatggattttggcattgtgtctttgttctacggcctctactatggagtaatggggagagactttgccgagatctgctcagactacatggcttccactataggggtaagtgttgctttcattttctgaaaccatgtatgacacaaagaraaatggtctcatcttacatgtctgcatccattttcagaaacaaataagtctttctccatatactgattattgtttcctttggaactcttttggttcacctagaccaattgctccctggattctcctttcatcaaaaaattmtttgttaattaattggaaaatacatgtcttatgtatatagaatacttgtgcaataaggcatcttttaaaataaaataygcaaattatttatgttattgtatctagcatactccaattgccaacatttaaggattagtaaaacattaacaataactaaaacctttcagctctgtctgaaaccctgcctaatgcaaataaaaactatakytgatgatgyataaaacagttcagaatcaacagtgcatctgggtaatacttrttataaataccagtcacattatatagcatctgaagaagwagaagatataaaaagtatgctagatgtattctgactctatactgttacctagaatttttttaatccctaacagttgtttttcttttctttttttgaactcttttaagactaaaattcagaatggacatactttggagttagatgtattcctgattcagatatcaggggcatttatctatgtctgactcttgcatatcttaaaaacttacaaactaaaggctctagggatgacttagtagtttcaagaattccacatctctgtcctctacatgtgtctcctggtacacagccagatgtgaagtagaaaaatcagtgtaaagyaaagacatggaaacaacccatcaatgatagactggaaaaagaaagtgtggtacgtatacaccatggaatactatgcagccataataaagaatgagataatgtcctttgcagggacttggatggagctggaagccattatcctcagcaaactaacacaggaacagaaaacygaagactgcctattctcacttgtacatgggagctgaacaatgagaacacatggacacagagaggggaacaacacacactggggcctatcgggagygggagggagagcatcaggaaaaatagctaatgcatgtgggtcttagtacctagctgatgggttgacaggtgcagcaaaccaccatggtacatgtttacctatgcaacaaacctgcatgtgtatcctggaattttaaattaaatttaatttttttaaaaaaagaaaaaaacagtgtaagtagcaagaaaagggtgaacttctggactgctccctccatttctggagcaggacctaagtggctatgaccttgacttcctccccacagcaattgtccatcccctccaccataggctctatcttactcttttcctaaagcctgcagcccaaattctgtggtgaaatgctggtacaatacaactgcctttcttataaggtttaatgtgagcacaggaaggagtatttttattcccagtttctccaagaaaaaacagaagttataccccttggaaaattcccaaaacctcttgtgtttatggacagaaaaggaagattagaattatatgtggctgttctcaagtggaccaagaagaagagactttacctggcaagacaaccaagtctttaagcaccagcttttgggaaacttctcacctgatccaacccgaccagttcttaacattttgtcatcctgtctgtttattccagcgaccaaatctataaaaaccactgcctcaagccattggtacagccaccagtgatttggattaataaggggtgtgtgtgtgtgtgtccacagacacttgtgcatgtgcttgtgactgaggtaaggacatacagtctccattcccgtatcagtgcctaagccccacaccaaagcaagtaaatcagaatctctgggagtagatccagtgcatctgcttcaaaaaaaaaaaaaaaaaaaaaaaaaacaaacaaaaaaaactccttaggaaaggaatgagctattaagccatccaaaaccatggggtgaatcttaaatgcatgttgctgagtgtgagaagccagtctgaaaagactccatcctgtatgactgcatttatctgacattttagaaaaggcgcaactatagagttgctaaacagatccatggttgccaaggctttagggaaggagcgtggttgaataggtgaagcacaggaaatgtagagtggtgaaactcttctgtgtgatacgataamggtggatatataacactatacatttctcaaaatccatagaaagtgtgaaccttaaatttatgcaaattttaaaaataatttaggaagtcagagaatccaagggtagaattcagatcatgccaaaagaatctaaccatattacaaatgtatgaaataatgtcattgaaaggggtgggaaaaaaggtgctgacctaagtaactttgaaatgaatggagatcataagactaaaaacaaaagaaactgtgtcataagcactgtactctagttgataaagttattgctgtcaagtctatgggttaacaattttgataccaccatacatgtattctgtaattgtaattgtttagcttaatatagatatacatggatagatatagaaatatttacagatatgtatgtgtgtgtgtgtgtgtgtgtgtttgtgtgtgtatctgtgtgtgtgtgttagtatatacagatgaattccttgttctgtcagctaagaggtcctaggggcaatgacaccccagcaacaatgaacatacatagtgtccagatcttgttttctaatatcattctacaataaaaggaactggcactccttgaagaaatggctcattataggtctgggcaaagaatacacaatataagcctggagcatctcgtagtgaccaaaagcaagaaaatgctaaaaacaaaacaaaagaactccacagtgattggggatatgtcaaagagacacaggagccaactgaaagagctcccaatggccaaagctggaatttgagcaacaaaatagtaatagtagtagtattgggttataacccaaagcataaatatccatgagtccacattgatatcaaataaatgattgaataaataaataagtggaagagaatagtcaaatctgtgcaaaagaattccacataatttatataaattctcctcccttaacgaggttgtgatgattacattttagagtcagtttgcctaggctatgatacccacttgtttggcaaaatcactagtctacatgttgatgcaaaggtattttgcagatatgattaatatctataatcaattgactttacctgaaggagattatccttaatattctacatagacctcagccaatcagtcgaaggccttaaaagcaaaaactgaggcttcctagagaaaaaggagttctacctcaagactgcaacatcaatcttgccagagtttccagcctgctggcctgccaacctgctctgcaaatttctgacttgcccacaaatgtgtgggccaattcctttaaatcaatctaataataatatagggaaactagatatgtggtatatagccaatctctgtaatatttttgtatcttttctttaaatctaaaactattataaaataattttctttggaaaaaaaaaagcttcctagggattctaatatgctgccaatgttgagaaccactccttatccacagtacgggaagatgcagatatcccaaagtaaagttctaaatgcattgccttctaatggtgattgctcagcatgcacccaataaaaacatggggatttaaatgacggagagatgcctcggtttactccagagatctgaatcagaatctccaggacaataaagggaagggccaatctatggattaaactcaaaggcttcctctgaagcttcctcttaactccagccctggataaaaacgattcctgtgaaaggattcctcaatgtggaggttagatgagaagttataattggcaatgtgctttgggtccctttggaattcaatgagtttttgcctggaaaccttaacccctctgtagcattcttcttacaggaaacggtgtctcacattctaaactatcttagaagcagtggagattctttttttttttttttttttttttgagacagtcttgctctgtcacccaggctagagtgcagtggcgcaatctcagctcactgcaacctccacctcccgggttcaaccgattctcctgcctcagcctcccgagtagctgggattacaggcacccaccaccgcacctggctaatttttttgtatttttagtagagacagggtttcaccccgttggccacgctggtctcgaactcctgaccttgtgatccacctgcctcagcctcccaaagtgctgggattacaggcatgagccaccatgcccggccgcagtggagattctatgtgccaagggctgcctgtcccagtgcctggcagtggcttcctgcattcagagagtggcatgtgctctcctttctgactgtgctctgtycatttcctctgatagttctacagtgtcagccggttgcctacaaggagcttatcggacaatatctgtgcagtctgtgggcagaagatcattgtggagcttgatgaagaagggctcattgaaaacacctaccagctttcctgtaatcatgtgtatccttttcaaaggaaattgtttgggcttcatcaagcctccttctttcctccttctcctcctcctcctcctgtccccatctcctccatcttgcttaccttccatgcccaaaccccagtcctttatcctccagcccagtcgagtcttcctgtttgtccctgctgaataatgaactgctaattaaggtgaacctcctcctccagtaatttcctttctaaagaggactgttaatgccacatagacaggaaggcagtatctgagcagggtgctggcaggggaaattggttgaagtcataagtgagcagatagccaacaaagatcagggaaagaaggggtttggaggtgagaaaaagagtgaagyatcaggtgcaggggggaacttaagactatccaagtggagcccaaggtctgaatcttagcagatcaagaaatacaaagagtgctttgcctagaaataatcctaggaacctacctgtggcaacagtagtcttgggggcagccaagggaggaaaccaagccttcttctcagcttcagtctttagaagaagatacagccacaggcagcaagacaccttggattacaaaagcagggaccaaaatttggacatttgttcttggaccatgggctcctccaccaatgggttctatcccaaatagctatccattggctgagggatcttcatatgataggtaccagacagcctgagcctggaaaccagcattctatgtgaactccagtaaccattaaggaaagcctcaatgtgctgaaaaatgctggcatcgagacccctgaacaaatcaacctgtgttgcctgaacatgtatggacactacttttgctatggataccaaagttaggcttaggttggccaatcatcagtattttaattcttcctaaatacaaaaaagggtatcatttatctttattttatagtacagtatcaatttaataatgtcatcgctatgtacccagttagttcaaagctctggcattatgagatggttaaaccatctgtcttttgcctaaagcccacttaatttagtcagtcatacctcggtgtccagtacctatgattcaattctgtttaatctggacagtttccacttattcaatcctgaaagtaaaaccaggaccaaatgcatctcaaaagtaataggagcctttactccaatacataagccttaaaatcttaagggaagaaacacaaagataccccatatggatttctgtagtggttttttcagtgtgatacctttcccaaaaaactcattctttgtagcaattttccaagtctggccctagttttaaatatgatttatttttcaaatgttggaacagagccccttctgccatttgcaaatggaaatgttttctctctccacctttaaaagcccttagggattgttgtacatgtgtgcatatataatctaaaatgtagtcacctttaaatttgcttttcagggagtattattaatggcccattttagcatgagtcatattagtgagaaatgggcaaatatgagtcatattaacaaggatgggttatctgagtcttgctctgcagmagttctgccagtgtgcaagtttttcagcattgagattttgaaaatgaaaaagaacattagagagaatgtggacatttctgtgctggctcaatggcccctgaattctatacctctgtagaagatggggctgtattccagcccttttgaatgaaaggctgtttgagttttggttcaaaatcttcgttataatacaccactttattttaaagcatattgcaaaaatgaccccaattccaagaacataaaataatggaaactcctggttacattgaaatttaatactgaggagttatatacatggccttgacttgctacacctccaagctcctccatttgttagggagggaacttctacatcgttgctgttcacctgggtgtgtagcaggccagtcagaagatcatgtgatcttggcccagaaagtcacattgggagcagcgattgtagaaataaacaaatcagtaggatggatttcattatagttcattttgcccaaatccatagtatcagggaacatggaaatatatattcccaaaaataatcagttttgaaagagtcattcaaatgttcattcaataaatatttcttaggcatggcttaaggtgctgaggacactgaaatgaatgagacatagtcctacaggtaacacatggtctaggagaaacatgtaagtaccaaaagtcctgctacactagagtaagtccctggtgctgtgagaacacatagggttcactcaagtttggggacaaagggtcagactttctggaccaggagacgtatacaaatggatctgtaaatgcctagagtttgagaagttaagtttagtaggtatatattctattaaaaataattggctccttatcagtacttttaaaagtcaagaaaaaaaattatgaagttaatggaaatatttgtaactttatgaccacaaataattttaacttgtctaagtgcctaagacaagtctgattacatgaagctaaagaataatgcacaaaaagtagaacagagaaatgctacggtaaatgcctgagaaacgcacaataacaaggtggggaaatataacaatacacttatggaagacatcactgtaaaggaaaaaaaaaaaaaaggactcatattctttatctaatctaattcttaccagaatcaagtgaggcaagaaggccaagaagctaagtaaattcctcagggtcataaagcgaaggcagctgtgactccaggctcactgtcattgtcaggtcccttacagaacctcccgaaaaaagcgatgtgcctcatcaagtcatgactccaccactagaccctgaagatgggaccattccatgccatcatgaaccagacattgccttttcatatctagaagcctccctaacaagatgsttcagctttcatgaattctgcatccgaggttggtgtatcgttgggaaaaagcagacttgcccttactgcaaagagaaagttgatttgaagaggatgatcagtaatccatatcctttaaaacaaaaaggttataagagattatcttgaatgttctggggatatattcttcaatgaaaagtttcagtgtttttgtatagttccagcagaaaattttttgttttccctaaccacctatttcaaaatgacttatggtctcttttctcctctgtgcctatattactattctggttagaaagttaaatgccagaaaacattccactctttatgttctatattttccacattaagggctgtagtggaaatgtgatgagacactgcaaaaaataggtaaaatatatggaagaatattcaggatggatggatggatgaataaatgagtgaactggatgggtgggtagataggtgcataaatagaaaaattggaattgaaattttaaaagccgaaatgtgaactagagtacagaaaactatttttaaaatatgttagggtgtaccaaattttattattcccagaaatgagtaggtatttccccgtctggattttggctttttaaattccatgccatgcatcatctcttcttaggccaaacactagtgataacaatattgaaaataaataaagatttacagagttgatcagcttctggcagccactgagatttgtatagacatcagagatgtgcaacagaataaattcaagtcacattaaggtcgcaggaaggtaatggcccccatcaggagctaactagaaagactttgtcttcaacctcactatctcaagaccatagtatatctcattcaggaagcagggtgggaatggaattaaaacatatcctcccttaagcagaagagtcctgaaaggttggcatcaacctgccaagtaccatctcttctctaagagacagcctttctgtactttctaagtaatagctaaattttacaatgctaaaggaatcaccttccttgcttcctgctcccctgttcctcaccaaccctatacgtatggtttaacaatggctactggcagcaatgccctcatctctgggcactgcagatcagggagggattcaaggagggcatcagagaaggaggcaacatcagtggatctttgggtctcaaggcccataccattgcaagagaccaccctctgcagtgcccactccatccacagacctggcctttctcggtgagtcagtgccactcaagcccaactcaaggctaaaagtgtgtgatgatccttccaccttcctgttcatccactgtcctggaattcctcttctaaaatgaggataccaagtccagaacagtttttggttattaacctataaaacctcaatgcataaatctttgttataaaattggtgataatatgatcataaatgtcacctcaagtgatactttaacaaagggtcattcatttctttatgtagtcttgagaaaataaactgttgaataaaacatatactactcttttattgagactcaatataagaaaaaactacatgtgaaaaagctgtcattttgtttgtaaaattgttgtcggagacactatgcattcattaagctccctagcacagtttatcaaagacagcagaaaaaggtctctcttacctgatgaaccagtgttattctttgtaatatacaatgggttcattctaatgtatgactacaggaaagcccagagctgtttttgctcatttagagcagtttccactatccttggttttccaatatagtcattcccctcttcttccttcttttagcatatacccttgcctttgattcttgttttctagtttgggattttattgtaaagaacttcaatttattttcaggaattgggtgtggtgtaagtaacaatgacaaccataatgctataaaactcacataaggggcttttaattgagcacatagaattaacaagaaaggaaatacccattcattacattgtttattatatttgcaaatgacatttatgaatatttctgctacttggctgtatatagaacaacctccttaactgagatttagctgggagcgcacacattttctgtatggacaaatcctggattggcttcgttatttsgtggcctggcaacctgtggtgatrggaatagttcaaggcattawctattcactagggctggaataggacagcagaccccagaagcaacatactgcatggttgaaatccttggtccaacatttaatattaatttttttaattttagagatgatcccaagtgtttagaaaactaagtaaactttgttgtcaagcaatttgtccatgtggaaagaatttaaagagaagctgaacaatggaataaacaaataaagcatgttttttcatctttcccattacagctgtttcttaactcatgcacatgtcacatttgttacactgcactgtggacattctacttccggtttgactgataacaatatctgtaaagtgtttcagaggtttgcaaagtacttctcacacacaacatttagccatagctaatactttctcatcagttcaacatctttaaagtaggtggagtcgttaagtaatctatggtcaaggacattgtgcttgtcttctgctccatgtgcttgttaccatgtggcagcttctgcaccacagagctcttctgtagaaagtgggttactcccaaagcctctggcagcaggtgccacaccttctcaatgggccacaggtactttgggtttcctggagctgccaaaagtgctcaaacccatgcaacagctgtactaaagcaagaagaatcacttttcttttgttccactctgcgtgcgcgtgcacacatacacgtgcacagtcattccattgtggcactctgcttttattttcttcatagtacttctcaatacccgaaatcctatcataaatttattgtcttctcctccatgaagacaaggaattttatgttttgttccctaccatatcccctgcactttgagcactgcctagcacataagaggcactcaaaaaatatttgctgaaagagtaaattaatctggcagaagggaacaaaattaactgaatagagaagaccagtcagaaagaattaacccatgaatgatatgttggactctcaaaattaatttgttttgaattactggtcatttttaaaatagtcaacactgtatacatttaacaccagacatctactctgcaatacttgaagccattacaattgtatgaagtagaaaggaaatacaatgattattttccttgttcagatattggcactatacttaatgctattcaaaggtccatcattaagataactcacactacaatttcttactgttgagaactttcctctttcaaactgcccaatgcttcagtattattgaaataggtcagggtccattgtctcattgtctaaggtgttatttgaacttattgtgtcatgactgagaaaattaaggagcatgaatgcaaagggtgaggttggagcaaaagtttagtaagtgaaagaagaaagctctccacagtggagaggagagcccaagtggggtgccattttacagctgaatgcaaaagcttttataagaaactcctctcatctctgtagctgtttgagtaacttctcttatttgaaaacctgtctgcacaactccacctacctatacagctgtgagatgtctctaggtaagcacaaagcatagttttttcttgtttgagtaattgtgggtttcttttaggtaaaccccctctgtttccagtgcaatctcccatggatccccccgtgttcatatctgaaaaggggagaaaacattttcctgggagcctgctaatcacacaaagaacaaaaggcttctgtgctggaccttgcctgcttatctgtgcaggtacagtctgagttttccccaggctgctctatttttgcctgtagctgtgattttccaggcagactgcttctctgaagactagccttagctgtctaccgaactgatttttcattttctcctctctcattatgattgattcagcatccagattatagaatttttaattgcttatttctctactctgaaaacatcccaataattcaatacttactatatagtaggcatgttcaaggggtagggagataaaacaagattcttgagcttatagtctattgacaaataaaagacttcacatttggataaagcactaacaaaaaattagtttttctcctgttaaacaaaaaaaagaacccttaaactgatctctaatttagttcccacttatcttttatgtatagccacaatggcagctttcagaaccatttagaactctcggcaaataagccagtatttatctgaatgggattcacaatgaccctcagagttcaggaatgtcagataatcactaaacagcctcagaaaaaaatgaagatgccattttctttataaaatttaagtatttacaatctaatcccaattttgtaaagtagtgtgtatatgtacactgaaaaaagattggagagtattatggctaatactaggtgtcaacttgattggattgaaagatgcctggatagctggtaaagtatagtttctggtgtgtatgtgagggtgttgccagaggagattaacatttgagtcagtggactaggaaaggaagatccacctttaatgtgaataggcaccacaacacctcaggtgatcctcccacctcagcctcccaaagtgctgggattacaggcataagccaccacgtccgtcctaaagattattttttaaatattattttaaatctatcaattatctatgaagctatttcagttgctattttaagttcttgaaattaaacatagatcgagtcaatgttaaatctaccttgttctcataattaacatggaaacagagaagtaaagcagaaagtccattactgtatttggtgtctgtggaatctcaagtttccttcctctaaacttgtttttcgtttgttttgtttcattttgtttttttgagacagtgtcttcctctgtcacccaggctggagtgcagtggtgcaatcacagctcactgcagcctggacctcccgggctcaggtgatcctcccacctcagcatcccgagtagctaggaccagaggcacatgccaccatgccctgctaatattttgtattttttggtagagacagggttttgccatgtttcccaggctggtctccaactcctggactcaagcaatcctcctgccttagcctcccaaagtgctgggattacaccaagcctgattttttttaaggctggctaccgtttcctccataacactcttctgggaggtcgtgtgaaacagcagcagccctatgcgagttccccaaggacaagcttgttctgcagttaatgagcatatatttctttgtggtatttttctgcaaacagcaggatcccttatatccctgctagtatccataacagaaaaatatccacttacaagccataatatataagggaatgaaatatcttcttggaaaataataataatagctaacatctactacagacatcaccctcaccccacacacgaacccatagtgcccattctcttaggcgtggtactcttgccctcaacacccctccagagaaaatgggaatcaaggagcttaggctcatggtttacttacattcctacatttcatactctcagtatcttaggatatagagatcatcatccctattttaaagacagaaaaactttttgggtcatgtcaactgacttgccaaagattacacatctactaacccaggtctttctgactctagtgcccaattaaccacatacacccagttctggttgagaattgagcaggggtcaaaggctcacttcctttcacatggttcccagcttaagaaagttacatagaatcagcaaatagtgcttaccaaagaaagttgcatcaaaatttaatgtgtggtattattatacctagattgcaaaattaacatatggtagtagtatctacctttaaattactgtgtatcaaactatttttgagtcattatgaggaaactctaggtatatatttgcttaaaaatctatttagctcacatgtactttttaaaatattcagaaggggaaaaagggcaggcttttttagaattaaaaacaagacttttcgaagaaggaaaaagcaacaagatgcaggagatataggctaaaaaacaggaactgagagtcagagtgattggacaataactagaactcaaaaggtagttagaggctgaggaagaccagagtccggatgtgggaagtgtctttcaaattctcctaaactgagtatttattttgttaaattacagaaatacataatttactgtaccttgcactgtgtactcactctctcaagtaactatggctggagaaacctatctaatagccagaaagacagatccagatcacatgaaaatacaccctctagtatttctcatcctgtaaagtttaataggaaatacacagcacttttttctaggaatagcaacaagttttggggagtgccccaaatactttgccttgttgctcttgagatcagctgcacagagaagtgacagctaggtaggacagagaatgccttttgtggccacagaggagtctcttagcaggaagaaagaatgacacagtcattgagaatcttaagttcatttgtgctgtttcctaatgaactaagccagttgctacagattacagttggccctctatatccatgggttctgcatccatgaagtcaaccaactgtggatcaaaagtatgttttaaaaattttgaaaataaaaaataacaataataatataaataaaaagacagtacaactatttacatagtatttacattgtattgggtatcataagtaatctagagatgatttaaagtatacaggagaatgtacacaggttatatgcaaatactatgccactcttataagggacttgatcatctatgaattttgatatccacgaggatcctgcaaccaattcccttggataccaagggactatattcagatatcagtaatagacttatgatcatggttatctcatagaaaaaagaaaaaccaaaaaccaatttttaaatctggcatatgtttataaaacagcaccccagacaaaatttgaagttttgtagttttagtaagcaagtcctcaaatgacggtacatccacgtagtttttatataattatgtctgaatgaacttaactataactagtgacataaagatcccaactagacaaagactggtcttaaatatgggaacctaggactttatcgcagctctcagatttacccaaaatccttcccgctgagcctcgtccatgggccactccaggtaggtcttggtgttcattatcttccgcagcttgcagaagcgctggggaatggcttttttctcaatgggctccagaagaatgagaatggcagcatcattgttctcatcaaaaagacggaaatgggagaagtccagttcatacttgcaccactcactcttcacaaagttttcagaaagcacaaagacagttttgtggctcttttcaatggagtcaatgatattgtcaatgatccacttgccaggaatgaagtcccgcttatgaagacacaacttgaaggggggattgaagttctccagctcctggaccataaggttctccacccagtaggcatcccgctcactgtaagaaacaaatgcatcatagcagatgttcctgctgggagctttcctgggcttccttttggcctggagccaggcccacatcattttcatataccacaggccatggaaacggtggcacaggacccccgtgagcaggatcagcaggaacagagcacagcacatgccagacaccagtgctgtcctgtgacattccgacaccgagaggcggacatcctgaacctgctggccacgcacatgggatggagagtcacacaggtaatttgctggccaatcaatcaagactttggccagtgcttgctgctcctgagtgaaggagaggaattcacaggagcaaatgaagttattgccaccagcttccaaagtcttcagtgtgtgaaatgagtcaagttgctccttagaaaacgtagttattgcattcctactgattttcaatactagtaacatgggtaagagggaggcatctggtagagtcatcaac

SEQ ID NO: 17823 - DNA, 16371 bp, Homo sapiens
tatttaagccttttaaagtttctttcagcaacgttttgtagttttaagagcaaatgttttgcatttcttttgttaaatttatcctcaagtatgttattctttttgatgctattataaatggaattgttttcataattttcatttttttattgttatacagaaatacaattgttttttatgtattgatcttatatcctgcaactgctgaactcctttattagttcttagttttttaaaaaagtgttttccttaggattttccatatacaaaaaaggttaatatcatccacaaatagatgtagttttatttgttcctttccagcctggacttttaaatttccttttcataactaactgctctgaaatcaccagcataatgttaaatggaagtggtaagagaagacatttttgttttgttcctgaccttagggaggaggctttcagtgtttcaccattgagtatgatattagtggtatggttttttggatatgcgacatattttcttttacaaataatagaccaataaagtctattctaaagaatagaccaacaaacaattgtccacttttaccctgtttctttaagaaagcctgagtaagaggcaaaattttggaaaatacttgttttgctctaacgtgctgcagttattagataacatttgcttaacagacagttatttttccatccttgaatttatatattgctcatagccatagagacttaatttttatgtgtgcattttagtattgttagtgtattataaatatggctaaggtatgtatggggtcagcacaatgccactggggcccccttctgtctgtggactccttttcatctgtgttctaacaacattcacacatgtttgctttcaataaaaatggctgaagtctgttcactgcccaggtagttggtccagcctcctccacagacatcaagcagaaactcccatctaaaaagctgggcttggctgggcatagtggctcatgcatgtgatctcagcacttttggaggctgaggtggaggattgtctgagcccaggagttccagactagcctggacaacatagtgagaccccatttctgcacacacacacaaaagaaaaaaatcagctgggtgtgatggcacatacctgtagtcccagctactctggaggctgagataggcggatcacttgatctgggaggtcaaggctgcagtgagccatgataacactgctgcactctagtctgggctaccgattttgagactctgtctcaaaagtcaatcaatcagtcaataaataaataaaaagcaagacttcctggatggctaccagtgaccacaggggtctttgataaagcttttttttttatatatagcagtaataacaaccatatttgttaaacagctgctgtcttccaagaaaagtaatagtcactgtatgtacattttctgttttattttacactaatcctacatattagatattatatctccagtttttgggaaagagttttattttacactaatcctacatattagatattatatctccagtttttgggaaagaacaccagagattgaaataacttagccaagtaggccagtatgtggcaaaatgggggctcagacatactccacattgtaattctttcatccttaccacaggccggtgaatctttgtttcaccacttactagctgtgtgacattggagagtcactgattctctctggccttcagcttccacacctgggcaatggggacagtcactatggatgtctctagggcagatgggaagcctaagacaggacatgcttcaatttcttccctatgcctccatccctgattttttttcacaattgcttattgttattagtggtagaaatgcttggctggaacaaattaaatccaacagacatttggtgagtccctaccatggaaaagaaaccatgctggatattgaatacaatcagatgccgaatccaaattctagggacttgagtgttttcttttttgctaaaatttattgagagctgactacggctcctctgttctaaatgctttacatgtataacccatttaatcttcatcctaacactttgaaggagggactattcccattacacagtcaaggaaactgagctacacggggaggggttattagtcaaatcttaacaataaacaaaaacttgtgaatgccggagctgggtctccagtgcagccaagtcggctccaaagtccacactcttaattcaccctgaggctctgaggtcccccatccttgtctttgcaggtgaatgtgagaaaatcaccctggagaggacaaagaaacatctaccacaggtgctccaataagctctgggcactgtctagttacaaagcgtgctgttaggtgtaaggggatacaaaaatgtgtgggaatctggagtataagtgcagcaaaaagtgtggtatatgcatgattaggtacagggcagggagggagtggtgagtactaaagagctgagagaacgacctgtctatgggaatcacagacagatcagttctggttgggttattcagaaaacttgctgatggggaagcttgaactgggacttgaaagaatggaaagatttcagtgggtgaagagcctggcagacgagaatgttgctagcagagggagagacatgaactacagggtggagatgagcggacaaggtgcttctctgacagtgagcaggagcctcccttgccaggatgtttcctcattcatggagaccagcagaacactggtccttgaagccttgtgaggtgcaaggggtgcaggctctgggtccaaattccagcatagccccttgagtgcaaattttctcatctgtggccacagagtagaggcactatcgcgagcatcttcagtgcggaggggaaagagtatgggctctcccagcgggtgggagcagcactgagggagtatgaggatcagagtagcctcagccacggtggagagctggagagataagcagcaaggaaaagagctggggacccaactgtctcagcataaattgagaaggcaggagcagtgatcaggggaaacaagacacaaaaactaggcagtggatgaaggagagcagaaagtcaaaggcaagtgcatggtttaaaacctcagtggaccaactattgatactgggaaagatggggtaagggtcccttctagaatactccctccccaatctccttggacactgctatcactgccaggggaatgggtaagttcaccaaaaggtgggttgtaaagagatgatgaagaccaccagcaaaaccttgagaatggccactctagtgggtggtacaagaggatcccaggggcctccccaaggctcacaggagaggaagggaggaaaacatgtgtctcaaaagtaattggaggaggagccttgagaatggtgaagggtcacaagtgcaaatggcaccaaggcttctagaaggatggctgaaaacaagattttggcaacagtatttaggaccagatgggtgttcttcaagggagctgtttcaggagtaaagcaagtctgctggtgggccagagtgagggcgctgggccaggaactgggccaagcattgggaagtggatgtgttatctgcaaagggataggaaggagtggcccaccctggtgtgcagggggcacagataggaagatagggatggggcaagaacacagacaggggaccttcagtcaccagaaggtagtctaaaatatgcaaagcctccaaggtattggctggagaggaaaaacaaagcggctgagggcaggccccacaaggcaaaggtatcctgagggtcaggggtaaagcccttacaggtgggaaagccaagtgggtcatgtccacccatccttgtgtagggcaacccagacactgtggtaccccccatgggacaatgctctgcttctatctgttgttgctctagtttctttctaatacagaaacatccaacatctgcacctcctcatatagggttgatccaagtttcacagacatcactgagttcttagtggactcagctattggggctgttctcacactttttttttctttgcaagaatcagcaatgggtgcaagtggacctgtgtaggacgtccagtgaaacattgtgttggtgaatcagctagaatccatccaagaactcagccagcctggtgtggggtgagatctgatccttgaatgtccctcagtggcttttagggctggcaggttcagaagggccctctcatcacccccccagggcctcattccttgtttaacactttgctatcacagtcttgaatccttgtaattgaacaatggaccccacattttcactttgcactggtttctgattctgtaaccgatcctgtccccctctcttgtctcattcactctgggaattgtccccacattctgagacctttcagcagtgccccaacgaggttcctgcccttatctgaagctccaccctcacccccatggcggcaccgcaggcagccctgcttttgcgtcccgcgtaggcaggctgtgcaccggagtcacgaccccctgattcagcctaggcagccacagcttgactgctcccgccggacaagccctactgtgctatctgccgctcttcccttcctcttcccagggggtccgcgtcaggggaggcgcagctgtgtgcattccgggagcttcagacccccgtgtccagcagctccttcgtttcctgggtgctggggcggccttcccagcgaagagctcaactcagcgggacgtttggaggctctctgccccaaggcgctggggagtgtgcggcgggacagtcgtgcttgcctttttcactttcagagtgtccacgccccacccgtttggtcactgcaggtcagtccagtccagcccggcccaccccaccggtgcgtgtctgtcgcacgtggcagacgccatactctctgttcttgtttaaagcccaggatctactgggccctggaggcaagaggtgaacgcagcggaatccacgctgagctgcccgggaacggagcttccaaccccagaaggaggactctgtgctcctacaccttaaccctttttagcccgaaacttctccaacttccttggctttgtttagagctcgacagcgccgccccctggcgctcgttgtgaggacagtagaggagagaggcaagggtgtttttaaacagtttgcctctcaccattatgggggcgacccgagggggagacccactcttccgcattcccggtaagtgaaccaccggaagaggtcgaaagtgacggattcccatgtcctcctccagccccccccccaccctgcccatccacaggacggtggctcttcagtgccctttgccgagcaagtggcgtttctatgcacgtgggtatcaattcggactctggacgaaatggaaacctccttagccgacccgggtgggatcagctgggatcctgcgcgctcccctggggggttgccagccactctgttggggtgcaagaagcaccatccttcggaagctgggccgaaactggccaggctgactcgctcccacgcgcccgcccctacccggcgccgcagcaattcacctgccaccgcctctgagccgggtccggacttcggcgccctgacagtgtccccgcgacttccccacccgatgagatggggtctggcgttggccagtgcgtgtccagggactcgcgggtccctggccagccatggggcagagggcgctggtgttaggccagtcttccccaccctgccccgtcaccccagccacacccactgtcctgtgaggccaagcgcgctccgctggtttcctgagccaggcaccttggccgcggacaggatccagctgtctctccttgcgatcctgtcttcggggaagtccacgtcctaggcaggtcctcccaaagtgcccttggtgccgatcacccctcccagcgtcttgcaggtcctgtgcaccacctcccccactccccattcaaagccctcttctctgaagtctccggttcccagagctcttgcaatccaggctttccttggaagtggctgtaacatgtatgaaaagaaagaaaggaggaccaagagatgaaagagggctgcacgcgtgggggcccgagtggtgggcggggacagtcgtcttgttacaggggtgctggccttccctggcgcctgcccctgtcggccccgcccgagaacctccctgcgccagggcagggtttactcatcccggcgaggtgatcccatgcgcgagggcgggcgcaagggcggccagagaacccagcaatccgagtatgcggcatcagcccttcccaccaggcacttccttccttttcccgaacgtccagggagggagggccgggcacttataaactcgagccctggccgatccgcatgtcagaggctgcctcgcaggggctgcgcgcagcggcaagaagtgtctgggctgggacggacaggagaggctgtcgccatcggcgtcctgtgcccctctgctccggcacsgccctgtcgcagtgcccgcgctttccccggcgcctgcacgcggcgcgcctgggtaacatgcttggggtcctggtccttggcgcgctggccctggccrgcctggggttccccgcacccgcagagccgcagccgggtggcagccagtgcgtcgagcacgactgcttcgcgctctacccgggccccrcgaccttcctcaatgccagtcagatctgcgacggactgcggggccacctaatgacagtgcgctcctcggtggctgccgatgtcatttccttgctactgaacggcgacgscggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaagsccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgyccgccacattggcaccgactgtgactccggcaaggtggacggtggcgacagcggctctggcgagyccccgcccagcccgacgcycggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgagcggcctccgtccaggagcctggctccgtccaggagcctgtgcctcctcacccccagctttgctaccaaagcaccttagctggcatkacagctggagaagaccctccccgcaccccccaagctgttttcttctattccatggctaactggcgagggggtgattagagggaggagaatgagcctcggcctcttccgtgacgtcactggaccactgggcaatgatggcaattttgtaacgaagacacagactgcgatttgtcccaggtcctcactaccgggcgcaggagggtgagcgttattggtcggcagccttctgggcagaccttgacctcgtgggctagggatgactaaaatatttattttttttaagtatttaggtttttgtttgtttcctttgttcttacctgtatgtctccagtatccactttgcacagctctccggtctctctctctctacaaactcccacttgtcatgtgacaggtaaactatcttggtgaatttttttttcctagccctctcacatttatgaagcaagccccacttattccccattcttcctagttttctcctcccaggaactgggccaactcacctgagtcaccctacctgtgcctgaccctacttcttttgctcttagctgtctgctcagacagaacccctacatgaaacagaaacaaaaacactaaaaataaaaatggccatttgctttttcaccagatttgctaatttatcctgaaatttcagattcccagagcaaaataattttaaacaaaggttgagatgtaaaaggtrttaaattgatgttgctggactgtcatagaaattacacccaaagaggtatttatctttacttttaaacagtgagcctgaattttgttgctgttttgatttgtactgaaaaatggtaattgttgctaatcttcttatgcaatttccttttttgttattattacttatttttgacagtgttgaaaatgttcagaaggttgctctagattgagagaagagacaaacacctcccaggagacagttcaagaaagcttcaaactgcatgattcatgccaattagcaattgactgtcactgttccttgtcactggtagaccaaaataaaaccagctctactggtcttgtggaattgggagcttgggaatggatcctggaggatgcccaattagggcctagccttaatcaggtcctcagagaatttctaccatttcagagaggccttttggaatgtggcccctgaacaagaattggaagctgccctgcccatgggagctggttagaaatgcagaatcctaggctccaccccatccagttcatgagaatctatatttaacaagatctgcagggggtgtgtctgctcagtaatttgaggacaaccattccagactgcttccaattttctggaatacatgaaatatagatcagttataagtagcaggccaagtcaggcccttattttcaagaaactgaggaattttctttgtgtagctttgctctttggtagaaaaggctaggtacacagctctagacactgccacacagggtctgcaaggtctttggttcagctaagctaggaatgaaatcctgcttcagtgtatggaaataaatgtatcatagaaatgtaacttttgtaagacaaaggttttcctcttctattttgtaaactcaaaatatttgtacatagttatttatttattggagataatctagaacacaggcaaaatccttgcttatgacatcacttgtacaaaataaacaaataacaatgtgctctcgggttgtgtgtctgttcacttttcctccctcagtgccctcattttatgtcattaaatggggctcacaaaccatgcaaatgctatgagatgcatggagggctgccctgtaccccagcacttgtgttgtctggtgrtggcaccatctctgattttcaaagctttttccagaggctattattttcactgtagaatgatttcatgctatctctgtgtgcacaaatatttattttctttctgtaaccataacaacttcatatatgaggacttgtgtctctgtgcttttaaatgcataaatgcattataggatcatttgttggaatgaattaaataaacccttcctggggcatctggcgaatcccagctgtgtgtccggtgtatggtttggcattatctcctctgcgagatatccaaattcactgtagtcatgaagggtctcagtttgtggctctcattcaaatattcatttctaaacgtctcatccagtatgaaatcattctcatctcttttggagattaacaacatcatcttttcaatgcacacgtttcttgggctcacttttctaaggtggtagggctggctgaatgcaatatgcagggctcggaaagattttttaaagaagaaattaaaagcaagtagagtccaggcaaatattcagatgctttatatgtctggataatgctgaactcatgagttttagtttgactgattattgtgaagaccgggttggagattttgacatccatcgcagaagaagtaatggctttagtgtgtgtgtgtgtgtgctggggaagctccatgcacagtgccctatggagataacaagctgagccatgctccccctaagtagcagactaagtctttgtgaaggaagagctacacaaatgggggcaggacaggtgcagataaatggggctgggagaccagaggagacagtgacaccttatagttcgccccctgttacccagccttctgtttgtcaaaagagtctgctcccagtcactgtcaaactgacttgtagggcctcattgcgttaggatttcttcttattccagaagaggggcattttcttaaggaacactggaagaccaaaacacactttcaaaacctagaggcaaaaacccttcatgcagcacttgggccccaggacattagttgtgcggggccctgagcttccctgtcctcctcacttcctgctgcctgggggatcagcagttctgtttataggtctcatctgaacttgagattctcaaaacgctaaatagccatagtgcctctcagggaaagataccaggaccacataaacaaatcagttagctttaaaaactatccctgagcatttaaaatcaggatagaccttgtgaaaccagagccatgggtcaacctgtgtgatctctgctttctgttcacatcattggacatccaggtctgagggagactcccagggaccagttgctggtgaaatttcatagcacaaaagtccggggcaagaaagccaaggtggtatttctggataagccagcattcaagtttgtttgtttgtttgtttgtttgtttttcctagcctgctgttttaaagtaaacagaatgcatttttttaagtcaaatgactttgttattttttttttccagttctcacctatttcttagattagttcagcaattatttactgagcatttactctgtgcctttcatagtgataggcacaatgacaagtccctaccatataagttagactctggcaggggagaaagatgcaaaacaactgatcacccccaaattgtacttaacttagaaacagtgataagtgcaggggaagaaaagcacagcacactctgaaaaggcgcacgaggaaggcaggatttagagtggaggactagagggagcttcctggacaagctgacacttaacaccagacctgaaggggaaggaggggtttgtcaaatgcaaactggaggggaagcagtccaggtgggaaggatcacacctgcaaaggccctgtactgggaagagccctggtggagcggactgggcatagtgaacaaggtgaggtgggctgcaaggcagctgaagaggtggaaagagagatacaagcagtgggagatgactgtaggggctgtaggtcaaagacactgaaaaaaagactgaaagagtgacattgaaaaatgttctgggtgcaagtgggggcactcaaggagttttgatgagagtgcactgggattcaatttatgtactgcattgtttgggaagataacaactacttctagatgtatttacatgtccctcttgggcaggaacctgcacaatttccgctgtaagcaccccgcagggctgatatgtggtgtgaacagcatacacacctgggtgtgaccccagcctgacacctgctggtcacatggccacgggcaccacatgacccttcaaaggctgtaagacgggttcaagcagtgccgcctcacaaggtttccaggaagattagataagctcagtttctggcccatggtagatacccaataactgtttacttgtgtgccagtgaactggtagatgcataaatgagtacagaaaaaagctgtgttggaatcatgagtgtcttacgggcaaactcaaggttgcacaaagtggatactgttccatcaagggaagatgcagttgcttggagcaatgttgtcaatgctagaggaactgtaatgttggatttgcaggcatctatatcatagcttaaacaggaagatttttgtgccaggtgagaagtgagctccaacactcggtcactctaaaatccagcttcgaaggcttcagcttattttcccttctcacaaggcttagtcaagtacaggggacagagactccctccgctgttctcccaaggaggctcggaggaggaagaacatgctccagagtgcccttctccatttctcagggcccagaggagaaagagaaacatagctctggccccaacagagccagcaggaggtacggagggaagttcctgtaggtgacattcctttgagagacattatggttgtggatggggccaggggacagaagatcccccacctcctaccttctggagtcacttgctattctctgttgaatgcgattccttattatatcatctattcaaggaaaactgaggttgcaaataatacatgaaaacacattttcttcatggttatagctgagtgggggtacccaaaatacatctcctgagctttagaagcatttcttcataaaacaatgcagacaatgcccagttctttctttctttcttttccagaatgaatgccctgggttcagtgatatctctttttgttttgagtgttcccttcctcattttttttttttttggttagcaggttcagatgtaggcaaacaactgatttcttctcacaagggaagctaaatattgttttaacatcagatgctaatagaatcgaaatccttttcagggtgttttgaaagtgtgattgtgaaagacaaaagaaccctggggatgggttaactcaaggttacgcccactggagagggggagcagagagcagagggtttcagggatccaatgagaaacaccaagagtcaaagctggggtctgtgacaattatgccacctgggccacaggccagatatttccttggatctctgcctgaaggaaatcttctcttaaaatagccattttaataccgatattatcctaagacaaaacccacttatcttctgcatattcaacgcctggcaatataacctctgtgcttttggttagaggttagcacctctgtgcccatctcaaatcttctttctgacttcttgctaatgccgtacctaaatgctaagttaccccgctgttgtccagcaaagctttgttctacttggcaaagaggagaggggcttttccacattctccctaattcctccccttttcccactgcctactgccttgtttcgatttaaatcctttgggaacatggatcccaccttccacagactctttggagatcctacgccttgttcattgtccccctcttttaataaatctgttctgaaatgctcatataatcccaaatccccattttcagcgagcctttgccagggtttgactccagtctttcttcatgtattttccccctcctccaaaaaggtagcatgcagaaacccaagggtagtgccaggagaatggaaagtctgaaaagggcatggggcaagtcccagtttcactgtttaatttgtctatgactctccacagcacaggatacggccatgataaacatgagcaaactcaacagcaagctgcctggaggcccgtgacaaacggaaatggtgcttttgggatgcggctggatcttgaggagcactctgctctgtttggcggaagggagcttggagtggaatccacaccctctctccagtgcttggagtaaaggatcacgaagtcattatggaattagcagcttgcccagggacatactcaaccctctagtttctccaggtggtgtctagattccaggatacttcttttcagatccataaggtcaagagggctatagcttcctatgtaaattggttgaggtctcctagtctggggggatgaactcgggaaatggtataaccaggtggcctccatggatttggggatagcaccatctccaattctgtacctcctcaggtcctccccatgctgtctgtgtccttcctccttggccacaaatcacagccactaagagggaagtagatggtgaccaaaacagtcccgatcttgattggggcaacagttagttgccccaatgtaaaatgtaaaattgtaaaatgtaaaatgtaaaaatttgcatgtcaaaattcatagaactgtacaactagaaagagaacactctaccatatgtaaattatactccaattaaaaatagattaaaaagaaattacagcctcttcagaacactaatgaaagcctgattaaaaaaaaaaatggaaaaaaaagacacccaactgtgtaccaactccctcttcctccttctatatcatgaagtagtcaccatttgaatggtaaaccttcctcccctgggccaggaacatggcctttgtgtgtcactgtgcacctgcaggtggatactgttgctctgccctctccacacagtcatgcagccttccctgggccactgtgggctggaagtgggagagccggaactcagtcctggtttgtgtgcctctcaatttgttctttctccccatctacgacacgttcacactgggtgagtgctgacctttggcagccccactctttaggcagagccccagaaatccagtcatttcaagtgctatgttacggcaggtggatgctcatggtgtcttttgacaataggaagccacatgtttttctttgtagaaagtcaatactcccattctaggcatttttttacataagttctcccccatttcagaaggtgcccccactgttaggcactaaagtcccttccttcacaggattgaggtccctgcctttcagttcatataaagttgatgaaagttggaaagaaggacatgatcatcctgccaacccctccctgaaaagcagaggcatgttaagcctcaatttcacaaggaccccaaagcttttgataggcttctcttactaggcagacccaagcccctcattagagcctgccaccactgacccctggctcttaggacacagccctcatccttgaggtggcatagaaggcattaggctcctgctcatgtgcctgccagtgcctcacacgcccctgtggtctgtgttttggtcacattgagcccttcagtgcctcccactgcaagctctttgcacatgctgttccctctgcttagagcttacaggaacaccttgtgccccgccccttcctttcctagttaatgcctaggtacgcttcagaggaggtcatctccagccactttcctggggaaagcctgctctgagtcatgggcaacttcttttatcatcatctcttagaaagtacattcctttcctgcacagtgcttatttaggtttagaactgtactctcatttctgtgcttatttgattaatgcctgtcttttgccactaacctccaagctccatgaaggcagaagctgcctttgtagactcatcgttttgtctggaaacctgttgcaccacccgagagaagcactcagcgaactgtccacatgtatacccccatgcatgctagtcagcaagacagtttccagggtgtgctgctggctgatggtgtacaccatggtggagctgtctcagaaaacacagccctaggattctaacatttgtccttaaggaatctgaggctatgctgtc

SEQ ID NO: 17824 - DNA, 12837 bp, Homo sapiens
  misc_feature (1)...(12837): n = A,T,C or G, or insertion/deletion polymorphism (see Tables 1-2)
atcccatctaggaagtgaggagcgtctctgcccggccggccatcgtctgagatgtggggagtgcctttgccccgccgccccgtctgggatgtgaggagcgcctctgcccagccgccccatctgagaagggaggagaccctccgcctggcaaccgccccatctgagaagtgaggagaccctccacccggcagccgccccgtctgagaagtgaggagcccctctgcccggcagccaccccgtctgggaagtgaggagcgtctctgcccggcagctgccccgtccgggagggaggtgggggtcagcccccgcccggccagccgccccgtccgggagggaggtgggggagtcagccccccgcccggccagccgcctcgtccgggaggttaggggcgcctctgcccggccgcccctactgggaagtgaggagcccctctgcccggccaccaccccatctgggaggtgtgcccaacagctcattgagaacgggccatgatgacaatggtggttttgtggaatagaaagctgggaaaggtggggaaaagattgagaaatcagatggttgccgtgtctgtgtggaaagaagtagacatgggagacttttcattttgttctgtactaagaaaaattcttctgccttgggatcctgttgatctgtgaccttacccccgaaccctgtgctctctgaaacatgtgctgtgtccactcagggttaaatggattaagggcagtgcaagatgtgttttgttaaacagatgcttgaaggcagcatgctcattaagagtcatcaccactccctaatctcaagtacccagggacacaaacactgtggaaggcctcagggtcctctgcctaggaaaaccagagacctttgttcacttgtttatctgctgaccttccctccgctattgtcctatgaccctgccaaatccctctctgtgagaaacacccaagaatgatcaataaaaataaaaattaaaaaaatatatatataaaagctgaatttagatagaagttatgctatcacatgaaatgacaggagctagggttctttttttttttttttgaaacagggtctcgctctgccacccagcctgcagtgcagtggcacaatcacagcttattgcagcctaaacttcccaggctcaagtgatcctcccaccttatccaccttaccctcccaagtagctggaactacacaggcaccaccatacccagctaatttttcttctttctttcttttttttcttttcttttcttttttttttttttttgagacacagggtctccttatgttgtgtggcctggtctcaaacctctgggttcaagcactcctcccacctcagcctcccatcgtgctggaattacaggcatgagtcatcacactcggcctagggttcttatttttgggtaaaatgccttcacagcacttcctattatcagttttaaagatcagactcttcctccatgcctcgccgctcttcggttctactctgtccactgccatggcccaagctgacatcgtgctgatcggattggcagtcatgggccagaacttaattctgaccatgaaagaccatggctttgtggtctgtgcttttaataggactgtctccgaagtggatgatttcttggccaatgaggcaaagggaaccaaagtggtgggtgcccagtccctgaaagagatggtctccaagctgaagaagccccagcggatcatcctcctggtgaaggctgggcaagctgtggattatttcatcaaaaaactgataccattgttggacattggtgacatcatcattgatggaggaaattctgaatatagggacaccacaagacggtgccaagacctcaaggccaagggaattttatttgtggggagcggagtcagtggtggagaggaaggggcctggtatggctcattgctcacgccaggagggaacaaagaagcatggccccacatcaagaccatcttccaaggtgttgctgcaaaagtaggaaccctgctgtgactgagtgggagatgagggagcaggccactttgtgaagatggcgcacaacaggatagagtatggggacatgcagctgatctgtgaggcataccacctgatgaaagacgtgctgggcatggcacaggacaagatggcccaggcctttgaggattggaataagacagagctagactcattcctgattgaaatcacagccaatattctcaagttccaaggtgctgatggcaaacacttgctgccaaagatcagggacagtgcagggcagaagggcatggggaagtggaccaccatctctgccctggagtacggcatacccgtcaccctcattggagaagccgtctttgcttggtgcctgtcatctctgaaggatgggagaattcaagctagcaaaaagctgaagggtccccaaaagttccagtttgatggtgataagaaatcattcctggaggatattcagaatgtccctctatgcttccaagatcatctcttatgctcaaggctttatgctgctaaggcagggagccaccgagtttggctggaccctcaattatggtgacattgccctgatgtggagagggggctgcattattagaagtgtattcctaggaaagataaaggatgcgtttgatcgaaacccagaacctcagaacctcctactggacgacttcttaagtcagctgttgaaaaccgctaggactcttggtggtgggcagtcagcactggggtccaggctggcattcccatgccctgttttgtcactgccctctccttctatgacaagtacagacacgagatgcttccagccaacctcatccaggctcagcgggattcctttggggctcacacctatgaactcttggccaaaccagggcagtttatccacaccaactggacaggccacggtggcagtgtatcatcctcgtcatacaatgcctgatgatgatgatgctgctcctgtcaccctccacgattccacagaccaggacattccatgagcctcatggcactgccagctggccctttttttttttgagacggagtctcactctgtcgcccaggctggagtacagtggcgcgatcttggctcactgcaagctccgcctcccgggttcatgccattctcctgcctcagcctcccgagtagctgggagtacaggcgcccgccaccacacccagctaattttttgtatttttagtagagacggggtttcaccatgttagccaggatggtctcgatctcctgacatcatgatcctcccgcctcggtctcccaaagttctgggattacaggcatgagccacccctggcccagatctttttaaaaagtgttgtaagagactccagaggaaggcacacagtttatttgtaaagtagctctgtaagagctgctgtgccctctgcccttgcctcttgggactgaccaggagctgttcatgtgtgtgagagtgggaaccacctccttgcagcagtggcttccgcatgccccatgtgctggtgtggttcccatcacgcagacgggaagggtctttgtgcactctgatcaattggaacctctgtatcatgcggctgaattccctttttcctttactcaataaaagctacatcagactgataataaagaaagaaagaaagatcaacagtgattctccctgggtagccaattgaggtagtttggataatttagttctttctttatccacttttattgctgatcctctagtttcaaaaataagtaaatttaaaaataaaacaaaaaaggccaggtgtggtggctcacacctgtaatcccagcactttgggagaccaaggtgggcggatcacttgaggtcaggagtttcagaccagcctggccaacatggtgaaaccctgtctctactaaaaaacacaaaaattagcctggacgtggtggctcacgcctgtaatcccggcactttgggaggccaacatggacagaacacaaggtcaggagttcgagaccagcctggccaatatggtgaaaccccatgtctactaaaaatacaaaaattagctggacgtgtggcgggcacctgtagtcccagctacttgggaggctgaggcaggagaatcacttgaacctgggatgcggaggttgcaagtgagccgagattgcaccactgcactccaggctgggcaacagattgagtctccgtctcaaaaaaataaggccaggcgtggtggttcacacctgtaatcccagcactttaggaggccaaggcggggggatcacccgagattgggagtttgagaccagcctgaccaacatggagaaaccccatctactgaaaatacaaaattagccaggagtggtggcacatgcctgtaatcccagctacttgggaggctgaggcaggagaattgcttgaacccaggaggcagaggttgcagtgagctgagattgcacgattgcactccagcctgggcaacaagagcaaaactctgtctcaaaaaaaaaaaaaaaaattaaccaggcatggtggcacatgcctgtaatcccagcttactctcaggaggctgaggcaggagaattgcttgaacccaggaggcagaggttgcagtgagctgagatggcaccactgcactgcagcctgggggacagcgagacttccactcaaaaacaaacaaacaaacaaacaaacaaaaaaccaatttagtcatagttattggacagttcaggccaaaacaggtcatttggcttgaattacatggtttccttttcccagtttaattattctaccttgcctgggtgtggatcctatcttaaagttgctggcacggaaaagcaaatgagaggtaaaatgactcaattcactaagataaattcaccttggactttaactcactgtattagtccgttctcacgctgctaataaagacataccctagactgggtaatctataaaggaaagaagtttaattgactcacagttccacagggctggggaggcctcaggaaacttaaaatcgtggtggaaggggaagcaaacatttccttctgtacatggcagcagaaaggagaagaagaagaaggaagccacttataaaaccatcagatctcacgagaactgactatcatgagaacaggatgggggaaaccatccccatgggtcatttatctccaccttgtccctcccacacatgtggcaatgatgcaaactctaattcaagatgatatttgggttggaacacatccaaaccatatcaatcactttccatttaaaactatgtttataaagacaccaaagggaacaaaagtattaataatatatgtaacccaaaataagctctgggtatttatttacttttgcttgaagattatggtttacctgtgtaagcaatgctctagagataatcagactatcagaagacggaatccctatgccagtcttcctcattcattccctgggcaagtcccttaatctacatatatctaaattctctatttttttaaaaaaagatgatacatatctaaatattatatttacttttgtctattaattaaaattctgaaaacagaggcagacgtggcggccgcggctccgttggctctggtagctcccacctccccagcgctggcagcatacccacgccagcccggaggagcagaggatattgcaaaggatacagatgaagagatgcatagaccaggtatgggaggagtgcagagcttccatgccatacctaggcgccacccttcaagaaccttcatgtgttcagccatccagaagcttcctgaacctgtccttttatgtttgtctggaggattcattatggagacacgattgactaaatgattggccattggtgataaacttaacctttagtcccctcccgggactgatcctgcctttgcctttctggtgaccaaccccatcctgaagctgcctaggggctgccagccctcagtcaatcattcacaggcaaaaggcatcactgtggagattccaaggattttagtcttcatttctgtgtcgggcacagtgctaagtgctaggtgttcaatggtgatgaagcagatggaggttaccaaacttgtggaccagagcctcatgtaacaaacgtggacctcactgtagcctagtcatggcttccagctttttggatctgagcctccaaaggaggaaatgaccgttcagggttcttgctccagcttgattatggaaactgaaccttcactgggtgtgcacttaccaaggacaggaaagtttctctctttgaagggctttaaatttgtaacaaagaaaagtgatgactttatctatcagatagcagatgaaaaacattgtgaaaaattactcagaggcagaaatcaaagtccaggaggccaccwccaatgacccatggggcccatccagstctctgatgaccgagattgcagacctgacctacaacatggtggccttctcrgggatcatgagcatgatgtggaagcggctcaatgaccatagcaagaactggcagcatgtgtacaaggagctgctgctgctggactaccccatcaagacaggctccgagtgcatggcccagcagtgccgtgagatcatctttgccatccagaccctgaaggacttccagtacattgaccaagatggcaaggaccagggcatcaacgtgcatgagaagtcaaagcaactggtggccctcctcaaagatgaggaatgactgaaagctgagggggcccaggctctcaaaaccaaagagcacatggcccaggttgccactggcatgggcagcaaccagatcaccttgggcgaggctccagccagcccaacctctccaccagccactcggagcaggagtatggtaaggccaggtgtccccgggctcctaccatggctgtgagtaatggaagtgcttctcaccctttgccagagcagcagcaatgggtgacaggtgggatgggtgtccccaggcttagggagcggtggctcccgcagagcttgaatctatcctcggtactgagcctttggcagcccaggcaaattgtccttggtctggattgagtttggttataaagggacttttagccccttggctgctctggttcaggggtctctaaggccctttgctgctctgtgggtctcattctgtacatctgggcagaaggtgggcagaggcaggtcttgtctgcttcctcctcagagcgggtctggcagcaaagggttgtcctgctgcatatccaatgcggagttgactctggtagccaggaggaaacaaatgctttttcttgataatcttgtttcttttttttctgagacagagtctcaccctgttgcccaggctggagtgcaatggcacaatctcggctcactgcaaactctccctcccgggtttaaatgattctcctgcctcagccatccgagtagctgggattacaggcacccaccaccacgcccagctcttcttcgtatttttagtaaagacagggtttcaccatgttggctagggtggtcttgaactcctgacctcgtgatccacctgccttggcctcccaaagtgctgggattatagatgtgagccactgcacctggctgataatcttgtttgtttaatctcatattaaatgtctttccactgactgaaaaaagtaataaataaaaataaaataaaatactgaaaacagtaagaagcatactttctataaaggtctaaggttctaaaattctttttctgttcttcaaactctgtggtaagttaagaaaactggtgaggtgtggtggcttacacctgtaatcctagcactttgggaggccgaggcaggtggatcacctgaggcctggagttcgagaccagcctggccaacgtggtgaaacctcgtttctactaaaaatacaaaaattagctgggtgtggtggcatgcgcctataatcccagctacttgggaggctgaggcaggagaattgcttaacccaggaagcagagggtgcagtggagattgcaccattgcactccagcctgggcaacagggcaaaaactctgtctcaaaaaaaaaaagaagacttttgcttaattcttagaactccaagtagacatccttgaataatgatagctaccatttacagagtgtttacctaaatccaaccaatatcaaagtgttctacatgtattgattcattgaaacttcacaacaattctcagaggtaggtcttattattcacaaccgaggaaacaaaggcacaaaattaattgacttccctcagaaatcccctgtagtaagtggcagacttagaatttaaacagtatggcttgactccctactgttacttttttttttttagatagggtctcaccctgtctcccaggctggagtaccgtggcataattttagctcactgcagcctcgacattctgggctcacatgatgctcccacctcagccttccaagtagctgggaatacaggcacacaccaccacacccagctattgtattttttagtagagacagggttttgccatgttgcccaggctggtctcaaactcagggactcaagcaacctgcccacctcagcctttcagagtattgggattacaagtgtgagccacagcacctggccaactccatactcttatccattatatactatatcccttccgttgccacaatgcttcataatgtcataactggtattttggctgtatcctcaataaatacttgttaagtgggtctgaatataattcttaatatgtatttgagaaataatagagttgggattttcagagaaagaccttaagttgtaagactgttaatttgtggccattaatatatattcattgtgatatataatgagaatgctgtttctttggatatagttgaagagagctggccagcttttgcatgccctgataatctgaccttctcttgtccaaaaatacacaccttctttagcacattcctttatgtatgattttaaactccctctccattttcccactcttctatatgaatatttttgggccgggcgcagaggctcacgcctgtaatcccagcactttgggaagccgaggtgggtggatcacaaggtcaggagtttgagacaagcgtgaccgacacggtggaaccccgtctctactaaaaatacaaaaattagccaggcctggtggcgggcgcctgtagtcccagctacttgggaggctgaggcaggggaatcgcttgaacctgggaggtggagattgcagtgagccaagactgcgccactgcactccagcctgggtgacaagagcaaaactccatctgagacggagtctcactctgtcgcccaggctggagtgcaatggtgccatgttgccatctgggattacaggcgtgagccactgcacccggccaaaggcttttagttattaatttcaaaaataatactcaacatttctgctttagtttgaggaatcactggcacaagacctaaaactacattaacataaagtttattagaataaaccagaataaatatataaaatgcatcctagacccttcatgcttttaagcatttgagtgagtgtcctgaccaaactctctttggacaatattctgcacccacagaattacaaactctaactttccaaactacacagtaggctagaatgtgaggttgggaacatgatctttgtattagttattgcaggagtaaaatgcagacaacatcacggacacccactgaattcactgacctttaatgacatttgatactctgaatttggcagtcagcaagcaggtttggggcttcaaaaaattcaagaaaatattaacatttctacaatgttatgtttggttccataaaaaatgtgaaagaattttgaaaactataagatagcattgagacaaaaagtagtagtattaccatcatcagaatctgttaagtgtctccattttcaacatcaatagattgaaatctgattatacaattctcctttcatccatctaagtgtccttccagaaagggagagacacttgctttttccacagtctccttgcatgcatctttgcacaatctctgctgctctgctaaaggttctaaccaccactttctgtgacacctgccagtcctccccctctcctgctgatctgcatcctcctacttctctcctccctgccccacccccacgtatgcattgcctggatcctatgaccctcacactcatccctcactcagagcagtgcatccgtgagtaatactttctagaggcactctgcccatccactggatgcgatatacataggatatgatttccatcctccttctgaaagtcagagagcacttcccaggatgattctctgaaaactgatagcaggttttcttccagaaaattgcaggacaggttgaactcaatctatttaaaaaaaaaaatacacttgaagtttcaatttttaaaaagctggaaagctatatttctggctctgtaagtaatccatatctctgaactgtgtccttaaggtcatgagatattttatagtatttatccttggaaatatacatcagaaatacgaatgagatcaggcacaacttgcaattagttaagagcagtgagtaacagggtttcaaagaaaatacctaggtttatgtcaacttatataagctaaagcttttcaaatgtattgtagaattacaaattgtggcctaagttttcatcagattctgagtttcacattgactaaagatcaagaaggaacataaaatctaatattcaaaatagaattaaaagctacatgccaggcccggtggctcacccctgtaatcccagcactttgggaggctgaggtgggtggatcacttgaggtcaggagttcgagaccagcctggccaatatggtgaaaccctgtctctactaaaattacaaaaattagccagtgtggtggtgggcacctgtagtcccagctacttgagaggctgaggtgggagaatcgcttgaacccaggaggcaaaggttgcagtgagctgagattgtgctactgcattccagcctaggcgacagagtgagactctgtctcaaaaaaagttacaatattccagcaacgtggtagtctagtctaagcctgtttactgctgataatccagaattcattgaataccaaagcaaagacctaatctaggtcttagattgagttgaaacatgactcctcatgacttctagtctttttctgggttttactttccattgcgatatataaagagaatgctgtctctttggacatagttgaagagagctagctagcttttgtgtgccctgatcatctgcctttctcttacacacctttatttggtggggggtggagggcagggacggagtctcgttctgttgcccaggctggaatgcagtggtgcgatcttggctcactgaaacctcttcctcccgggttcaagcaattctctgcctcagcctcccgagtagctgggattacaggtgcctgccactacacccagctaatttttgtatttctagtagagatgaggtttcactatcttagccaggctggtcttgaactcctgacctcgtggtccacccgccttggcctcccaaagtgctgggattgcagggatgagccaccgtgcccagcccaaaataaacaccttctttagcatgttcgtttatgtatgattttaaactccctctccattttccccctctcttctatgagaatgtttttatttgcctgtgttgccctaaaaatgcaatgcttagaattgaacacgcagttccagatgaggtctgaccagtgtgaagtacaatgcaatgttctcttctaccatcttgacagtgtacttcttataatgtcatttaacaaatagaaagttaaagaaaaaagttttacagctattggaatgtatgtagctggcaatccaaaagtatttctgaatgttgttaaacgaaaagccaggctgggaatggtggctcatgcctgtaatcccagcactttaggaggccagtgtgggagaatcacatgagcccaggaatcaagaccagcctgagcaacatagctagacccccttctctacaaaaaaaattaaaaattagtcaggcatggtggcatgcacctgtagttcctgctactcaggaggctgaggtgggaggagtgcttgagcccaggaagtcgaggctgcagtgaggtataatcatgccactgcactctagcctggccaacagagtgagaccaaaagaaagaataaagaaaagagaccgggcatggtgtctcatgcctgtaacaccagcactttgggagtccgaggcaaatcacgaagtcaagaggtctagaccatcctggccaacatggtgaaaccccatctccactaaaaatacaaaaaaatgagctgggcatggtggcacatgcctgtagtcccacctactctggaggctgagacaggagaatcccttgaacccaggaggtggaggttgcagtgagctgaaattgtgctactacactccagcctggcaacagaatgagaatccatctcaaaaaaaaaaaaaaaaagtaaataaaagaaaaaaccaaaaatctaaccaaacaaaaaatcccagccgtgctaaaattacctaccttttgagagagaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtatttttagtagagacagggtttcaccatattggccaggctggtctcgaactcctaacattgtgatgcacc

SEQ ID NO: 17825 - DNA, 12649 bp, Homo sapiens
cacttctaaacaacccgatttcacgagaagtccaccacgagaacagcactagggggatgccgctaaaccacgcagaagaaacctcttccatgatccaatcacctcccaccaggctccacctccaacactggggattacaaccgaacaggagatttgatgggacacagatccaaaccatatcactgtgttgtcctaacaacctgggaggaaggtcttactctccattttagaatggaggagctgacgtggcttgtctccaagcagcctgatacccaaatccaaatccaaatcctaacactgtcaatcatctcctctgatagggatacggaagcagctctagaaagagtccagggaagtcagattgggttttgctgttgaatcacagttacacccttattcattagctcagaagagtcacctcaatcagtggtccccaaactttttggcacctgagaccggtttcatggaagacaatttttccatggaccaggggtgggggcaggggatgctttcaggatgattccagcacattgcatttattgtgcactttatttctattattacattgtaatatataatgaaataattatacaactcaccatcatgtagaatcagtgggaaccctgagctgctttttctgcaactagacgatcccatctgggggtgatgggagacagcgacagatcatcaggcattagattctcataaggagcaggcagcctagatccctcccatgcgcagttcacaagagggttcattctcctatgagaatctaatgccgccactgatctgacagggggcggagctcaggcagtaatctgagtgatggggagcagccgtaaatacacatgaagcttcactcactcatcagatactcatcccctgctgtgtggcccagttcctaagggttggggagagcacgtcagagagggtattggggacccctagcctaaatggagctggaggattgtgattttcttagagttacaaaaaagagaggtggggggcggtgggggtggatttagaagaaactatcaccgtcttcctctacactatgtaccttcatggaggaggacagggagggagaccttttgttagataataaaaacaaaccaggagcccagctttgttttttaactggggcaaaatacacataacataaaatttataattttaaccatttgcaattgcataattcagtggcgttaagcacattcacaattttgtacaaccatcactgacatccatctccataagtctttcatcatcccaaacagaaactttgcccaccaaacgcctcactccctaaccctccaggccccggtaaccaccattctactttctgtttctatgattttgcctattcgaattttgcctattcaaagtacacctcatgtaaatagaatcgcataatatttgtcctttagtgtctgagtcatttcacttagcataatgtcttcaaagttcatgtgatggcatgtgtcagaatgtcattccttttgaagactgaataaaatttcatttcatgtatgccacattttgtgtactgattcatctgtcgatgaacacttgggttgttcccaccttttggccattgtgaatgccgctgctacgaatgtgggtgtacaaatctctctgtaagtccctgatgaagcccagctttgtaatgatgatgctacctatgatgaggaataaagatatgccacatactgtcagcatgcaacaaatgagctaatggtaaatacagttacgttgcagctctttgtcatcactaatgaactgtgaaaacaatagaagtaagaaaccagtaagaaggcctcaagaaaacagagctgtgactatcagttgcagttttcccatgcatgttatgaaacatggccaatcacagacagggctcaactccactcaagataacgagtttgaagtaaacacttctgaaaacagtaatctaggattttggcctcctggggcatgatactgtaagaatgtagcagaatctgtgtttatgaactcagcaaaattatgtcaaagagttacaggaaaggttcccgatccagaccccaaaagagggttcttggatcttacacaagaaagaattcagggtaagtccacagttcaaggcaaaagcaagtttattaagaaagtaaaggaataagaatggctactccatagacacagcagccccgagaaccgctggttatccatttttatggttatttcttgatgatatgctaaacaaggggtggattattcatgcctcccctttttagaccatatagggtaacttcctgacgttgccacggcatttgtaaactgtcatggtgctggtgggagggtagcagtgaggatgactaggggtcactctcgtgaccattttagttttggtgggttttagccagcttctttactgcaagctgttttaccagcaaggtctttatgacctgtattttgtgccaacatccttctcatcctgtgacttagaatgccttaactgtctaggaaggcagcccagtaggtttcagcctcattttacccagctcctattcaagatggagttgctctggttcaaacgcctctaacaaaactttcaagctttccagagagttagttttattgtcataagcaatcaatgaaagcatcatggtctttcttttgaggacacaacaactagaaaaaatccagaagagacaggccataacgaccccagcctgcacagtatctgcacgtaaccatcccggtcgcaccaggagagggaaggtgcaatgacagccactaagatggcatcagcctctccactgctagagacctcctgggaagagccaggacagccattactgtcctcttgggatacagagttggggaaaggagcttaaggctgcaggaggattttcgtcagaaaaccctgagtctgcagtgtcagaagggaaggagtgcaagggatgtaatgaaatgtggaactccatctccatctcaaatgccctctctcattcttccagcttcaaagagttcactcaaggacgccacactctcaaatcacaacccagaggggcctgttttaaaaaggttgatcttaaccagtttaggcactttcaagttaactcgggttgaggaacaaaaagctctaaaaatggtgttctgaccttcttcaacgtctatacaacttcaaagaatgaaatgaggggagaagctcaagggaatttagctcttactcaggaaacaaaatttagctcaattaaaaagatcttaaatgttaaggttgagagattttaacttaaatctgaaggagtttggtctagttagattgccgaagtgcatgtagcttgagttaattccctgagtctatagtcatgcttagagaatttttgactgcaccatcaccctttcatcaaagtgggcagagatgacccctctggtagcaccggattctccaaggcaggggatggggctttttacactgcaggcattaggcaagctgaagaggtgtggtcactccctgtaggaaagaacattcctgtgggcgatgcatcagctaagacagatatcccaaattctcacagaaggatccaatgggctggaatttccctgctagccccagtgctgtccaacagaaatttctatgatgatggaaatgtccgtctagccacacgtggctattgaatacttgaactgtggctagtttgagcaaggaactaaaatttcaattttatttaaattaaacttaatttaaatagccacatgtggctagtggctctctaagtaaagtgtgaatataactcctagcagaatgtgttaaaaatatagaccctcaggccctatggctggggattctggttaaatagcggtggcgccaggcattgccccttttaacaagcgctccaggtggtcctgatgctggtggtcttgaagcaatgctctagacttcaaggagggcaggagtccatgtgtgagctcctggtagtggggaacacccactgcatggagacagactataggaaggatatggaatagggcctgggagcgatcctagaggccagaggctcacccactaggctccagcttagaattcagtggagcactgacattgccttgggttgtgacagctatttagataccgtcagggccacagctgatgcctctccatgttctgcccactgccggctcctgatctccagctcatagctgccagccactggtcagcggcaaacatccatgaacacccccttcaaaaatgccatgcccagttctacaagggccctccacaggtcacctccagagtgaattctgtgaaacccaatattcagcccctcccagactctcaggaccatgcctaccatgacccacatctttgtgtctctggccactgctcaaaggacaagttcttggtccttttccagggttctctattctcatcgaaggcatcactgttctcctggcatctcaggtaagaattgtatgccttcctttccatgatcccacacattccatcattcatcatgttctgtccattctgcctacttaacatttcttaactacttactccttcccaccaatactctcttggctcaagccatcatcagctctccctggacagcagcaatatgcagtcccttgaccacacccgctctaccctcccagctagtcttcacaggcagccagatggactttaaaagactgaattttggtggagagcagtagctcatgcctttgggaggccgaggtaggcaaattgcttgaggccaggagctcaagactggtctgggcaacatggtgaaacccggtctctacaaaaaatagaaaaactagctggatattgcagcgcatgcctgtagtcccagctactagggaggctgaggtgggaggatcacctgagcccagagcagtcaaggctgcagtgagctgtgattccacaaatgcactccagcctaggcaacagagtgagaccctgtctcaaacaaatgaaaagcagaatcttatcatgtcattgttctgcctacaggccttttcttctatggcatgccactgtatttaggaataaagtcaagatccttatcaggacacacaacccctgtatggcctggcttcctctgtctctctccttcttggtcatcagtacaaagaccttctagaatctgagaagctggacatttacttctgctcttctttctctctctacctcctgccctccttgactgggctcttccctctgtgtgcacagcttaagagctgcttcattctacattttccctccccagaccaggcattggccccataccttcccctcctgagcactgagcaatgcagtcatccagttactgtttttgtaatgatctgcttagtgttgggctccttgactaaattctaagaggacaggaactttatcttattcactactctccctccagggtcaattatactgtctggtattaaacacatatttgtgaataaataaccaggtgaagaagtgaatgagcaagtgatttaacacatcaataaagattaattaataaagataattaatatgacagatgataatcattaaagatggcagattaggccaatgttttccaacatgacctctgacatcagaagagctgacaattgttgacatgacttttataacttttgatcttgggaggcatgagcaagcacattgtcttaattagctttattaattattaatgtttagtaaagataattattaataagatattaataaagattctgataaagatcagttaatagtagaagggaagctgagagctggaaacatgagactataatttctgagatatggttccatcgacatttgtttagtcactaattagaatcaccagccagtttagaactccccattcctaagggcaggcttcagggagggggtgtgatgtccacctggtgagtcactgttggtccgggtgctgctggtctgtgtgctctgagggagggtccaggccatgtgctgcctccaggggagcccctcaggctatggtcagcattaataatgtctttcatctgtgagtggatctacaatggcttctacagtgtgctccagtttctaggactctacaagaaatctagaaaacttgttctcttgggttgggacaatgtggatgaaaccattcttcctcatatgctcaaagatggtggattgggccaacaggctccaacacgacctctgccatcagcagagctgacaactgctagcctggcttttacracttttgatcttctggggcataagcaaacacgttggwtttggaacagtgatctcccagcaacaaatgggattgcctttctgggttactgtgcagattgtcctcagatcctggaatccaaagaggagctcaatgctttaatgactgatgaaagaatatcccatgtgccagtccttatcttgattagcaaacattggacagaacaggcacaatcagtgaagaaaaactctgtctgccatttggtctttatggacagaccacaggaaagggaacttgtgaccctgaaggagccaaatgccttttccaaggaatcgttcacgttcagtgtgtacaacaacagggctatggcaagggcttctgctggtttgcccagtatattgactgatggttgggcagtgaaaataaaagtttaacttcttaaaaaaaaaagatggtgggtggggagggggtaaacagtctaggcttcttctgcaagagaagaagtaaaagggaatagcactctacactcaaagattttaaaagtccaatccctgggcatgtcaagattgtaaaggtaagaaccctacagcagctggatcccgaaggaccagcctggcgtgtctgttccaggtcttgtgagcattgagatgtttggccatcaccaagaattagaggtaaagagtaggcataacctgatttccattaatttagaaacgctgaaacagaacataatataattcggtaaaataattaagattgctggatccacagagaaatgttattgagtcattcaaacctgatcatcaaaattaacatgagctataatcttcctgcattgactggacacagatgcttattccattttgcagacaaggaggccaaggtgggcagatcgctggaggccatgaaggaagtggagagaatatcagtaacttgctgttgggagcaatgctgctttcaaagcctgggctcctaactccaaatcctgtgttcctttctggaaggttttctccttgaattgtttctcaccccacccaagtgaccttcgacctcctgggaactcacttctggcttggtccaggttgtccagactccatcatccactcatttgaggagtgctcatcgatgcctatgatgagccacgctgtcctacccctgaccgtaaggatgtcatggttggcggaagaggaaaggaaagaagcatccaatggtggaaatgagaatgaagtggcaggtggctctctgatgtcaggcttgcaacggcgaaggatgcagggttttggctgtgccccaccctgtgtagcagaagaatgacctcccctgcctaggacccaccacatatacccccacacgctcaggtggcagtcacctttttagcagccacattgcctcaggggcttgagtatgcaggtctcattcacaagaactactaacaaatttccttctgaacttgcaacatttatttttttgttaacccaagcacaggattttacatttatccccattaaatctcaccttgttagttttggcccattgatccgaactgctgaaatcttcataatccagattttgccgtgccaagcacagttattccccctagctctgcattgccaggaaatgtgatgagagcactttttatatcttcatcgagatggtccatgaaactgtgggccaggacaaggccatgcacacagccctaaggccaccggcagcaacctcagtcgccctcttcaacatgggttgggtcaaggggaacaatggcttgatatcctctggatggtgattcagccaactaaaccatctaatgccatctccacactggttacatttctccattctgtaccatgatattctgagagatgatctaagataaatgcctttccaaatatttatacccatgtttagccattttaaaatgccctttctgttattgttctagagtgaatactaattaaagttgccctgtaagagatgtctggaatcgttctaggcaaaataagtcagtgctgaagttattctatcccagagataccccaaacataaattcaatgggctatggacttcccatggcaagtgccttcaatcagtgatgggaacagaacttgaaggcatgctgggattgagagatgtaaggaacgtgatctactgccatcactcttcattatcctaaactggaaaagctgatgccaaagctggccagcctgtccaataaaacattttgatcaaagatacaatttcacagaatacctatgtaagggatggcctgagagtccacagggatctagtagaagtatgaaagttatcaacctggtttctacaggtccataggcagacagcaatattgtgcaaaatgcttctcaggggctatacaaatacagattttaagtgaacagcatccaatcttttcataaattagggatgttagaaggtaaataaaagagattccctgaaaaactatttaataaaaattcagccctgtgccatgaagaatcggttcaccacagaagcattttgagtaggattaattagatgactctcagcattagctatagacttaagagactgggaccgctttaatttaggttgtggtttctaagcaggtttttcaattacagtaaacttctggatatttaaagacccaatattcaatgagtagatattttttgctctttaaaagtcaccagaggccttccagaggcctctcaaaataacttttatcattttctttttaggaataataaatacgttagcaatcttcttttcaaccattatcaagtttttacaatagtttttttccttcaaaagaaaatgttttttcctaattttaaaagtaatattttatttttgcgaaacattaatacaataaagaaagtaaatatcctctataatcttcctactcagagatacatgtcatgtgtataattttaaaataaaaattgaatactatgtaaactattttcattttttagaaaacaaacactagcaggaaacaactattttctaacatgctagttacattgattataccatgaattttttataataaaagtctcatcattttaaattgttgtatggtatcctgtttcatagctgattattgaatcagtctcctattgatgtacttttaggtaaaacatctttaagcacagggctgactctggggctgaaggtgttggagcggtatactaaccagcttgccttctgattggtcagctgttcatcctgattgatcaggccctttattgtactcattgttaaacatgtaaatggtctctgcttatatttttatctctgggttcttatagtttcacttgtaaaaactctcggacttgactctattgggccaatggctatgcaaatttaaaattctattatatactaaatgattgattgcctttggtgtctaacagcattacatgctagtagtgcacaagcatttcactctacttgattttttttgtttttagtattcattgcgtcaaaggtatagttaatttggaataggtatgtaaccttttgcaaaaaaattgttatactgaagtatttttggtaatgcatcattaaaatagtaatattggcatcctcttattatgaaaatgttacttttcatataatggaatttctaaaattggtacaagtaatacaattaaaattatagcatatcataggaacatatgaaacattttctatgtatttttgaaaatgcagtctgacagtgaggttgcaaagagagaaataaattaaaaagatagttttgttttcaacttttataattttgagattatctcatgaaagactcagaattgaaagggaacaaattaagtcaccttttaaaacgatatttatacaaattagctactctctagcagtcaacgtgtattatagtatctgcagtaatggaaggtacatcattttcagggggaaccatggacaaggctattaagtcacattacaaactcagacaaccagacgggctctaagaaattatttatctatggaaatgtgtgtccattatgaagctaaatgaagtagcagggtataaaattgcatacagactgtgatatcaactaagaagacaaaagaaacaaaggcttatttataagaaaaaaaatccatctatataattcaccagaatcttaaacaggattgtgtttggtggtaaaagtactttttaaaaaatgttagggttatttgttcccttcccccctataatgttcagttttcttcactgggtatgtatattgttttcatagtaaaaacaacttaaggtttttatgaggtcgatttttgcttctctacctgcagtcgtaatgctccataaaacattcaggattagcctcccctcatgctgtgcaccacgtttcttccaacagcctaacaatgggagcaggtgcaataaagaacactcctaaatccagctgcccaccacaacaaccccatcgagaaaatgcatcaccaccagcagccttagatgcttttgatctttcagggaatgcctagcttcttccattgagatattttcaaaaccatacctaaaaatgtacaaaaatgtgtgcccctcgatattcttatgtaaagaaatagagtatgaaaatatgtactttgctaagggagacggatcaaaagcaatatacagttttctcttcagattcctgattatataatacatgtgtctgaatctctattttaagagcaagtcacaagaaaagctaaaaacacctcatttcttgtttccaaagcttctgatctatttaatggtgagcagtaagaatgtaagaaaaaaaacacaaaagaggcaggttgcagatcccagggagcaggtagtgtgatttttgtatacatttttatatattgcagcattagataccgaactttcgggctggctgttgattgactgtctttcgtctgtcttgcttaaaatgctcaaatcaaagcaccaacacaagtaaatgatctgagttgtttacagggagatgttgagtcaggttctgggactccacatccctgacagaactcatcccagtgagggcctgcgacctctactcttgtttcagaaaaaatcaccatcctgctgatgggtgaggaacaggaaccagtacttttggaagagagaaactgctattttgaccaagcaggacttggaaaattgagttctatctttacatacagattgcttattagaagaactaataagctcttcttttatggtactaatgaaatagaatattaaggagtcctttagatctgaggaatctgtggggatagccagggtgcaaagaataagaaaacgagttgtttgtcttacggttggaggcagacaaagttttctgctagtaaggcacacaaaatgtataatagtatccaagcggcccagaaaaagccataatgccattttctggaaatttatataatttttccacaaaaggaccaatttttaaaaataagaagatgacagaaatagtccaaatcactggagataagctttgaaagataaaataaactcttggtatttctcagggagaagataatttctatcagtttgaagctgtttcccctaatataatccaggagttgtcaaaagtcaactaattatgaaactctgttatttgaacagtacagggatgcttaaattaaatctttgaacaaccaggcactgaaaaaataaaacatcagaactatgaaaaaatagtgttgagttataaagttccttaatagagtgataaaattctttatttttccattagataattttttaaagttaattctcacctcaaatccaaatttggattacaaatccatgcatttcgttctttgtttctaaaccccaacataaatcacagagcacttttctgtccatggtgtcttaactttctcctatcatgcaataaacaagaattaacttactcatttctttccagatttatgatcagttctttgctttcccgttgtagtcgaatattcagcacttctggatgattctgaaagataaacaacaaaagtcagttgaaaaacgcttggctttgatttgcaaatagctgaataagacccacaggcgtagtcaaatgagggaataaacgatgcggtcaacctaagaaagagccaaatgccatcacaatgcagtgtataaatgaaggtttcttagcagcttaaaaagagcagtgaaggccaggcaccagaggattgcttgagtccaggagtttgagaccagcctaggtgggcaacacagtgagaccctatctctacaaaaagtaaaaataaaaaaaatcagaatattagccaggggtggtagtttgtgcctgtggtcctagctacttgggtggctgaggcgagagatcacttgagcctaggagttcgaggctgcagtgagctatggtcacgccactgcactccagcctgggtggcagagtgagactctgtctcaaaaaaaaaagaaaacaagcctgtaatcccagcac

SEQ ID NO: 17826 - DNA, 18138 bp, Homo sapiens
cattaaataattaagtcagttgaggtggctcacacctgtaattccagcactttgggaggttgaggcaggaggatcgcttaagctcaggagttcaagaccagcctgagcaacatagcaagacctggtgtcatgtctacaaaaataaaaattaaaaaatttattttttgtgtgtggtggccatgtgcctatagtcccagctacctgggaggctgaggtgagaggatcacttgagcccaggagagtgaggctgcagtgagctatgattgcaccactgcactccagcctgggcaacagagcaagaccctgtctcaaaaaaaaaaaaaaaaaaaaaaagcaagagaacaaaatccacagcagtgagcattgtattgtatatgtaacttagtacacaggcaggtattcacctgtgataagatgcctacagaaggatctgccgggcccccaagcatgtgagttttccctgctggtggggcaagtgcctgagtcctaacccggccagcacgggctttcccagtctactcagttttcgccaggagcctgtacacgtgctgattcctggcaaagctgaatgtctatctccacgtgtctgttggccagcatgtggataacctatggtgccctcgcccatcttcccccgggccgatcttccagctatgttgggggctccctgcacacttgagacgccactccttggctatacatgctggacccttcggctcccaggatgtcccttgtctccactggttttgtcctgtctttggtctgtactggcatcccaaagctgagccttgagagaccagctgatggggctgcagacgcggtggggcagagcccagcctgccaccgtaggagggagtagtagtggctcctggtgcaggtgccagtcttaaaggccaggtgagctttggtctggtctggccaggcagtggaaggacagaacctgcatgaggtggggcaagtgttgggacacccccaggctctcacccggtcctagccactccgcatgctggccttgccagtcttgccacatgaaacaccttccctctgacacccaaaatccacctgacccatgtcacagataagtgactggtgctcagcccagtcccaccactggtgggtggctgattaggggggatccagcatgtctggtgccagcccctccctgaggaagctgcctgccctcctgcctgcacctgtggtgccttcctggccgcggccacctgtcccatcccagttgcgcagatggcaggctccgcaggcctggctgggtggcaggggctcaggtcagagaggatctcagtgtagtcagcaaatgaagccctctcctccagccccctccccaccatccaccccttcctattctcagcagatggccttgaaaatagaagccaccagagcagatgtctccgagcacctttacctgtgccctcctctgtgtctgtgcccaacatgctgcccccccccaagaagaactgcccatgtcgccagcccagggtacccctcacgtgtggcaggccccactccagccggcctcctccaggttatcagctggcctgcatcgtcagcgtttttgcccatcagcgcactgcacacataatggacacacaggacacacaaatgcaggctgcagcatgctgcccacgcacacgcatgcacacacagcgtgccgcccatgatgcacagatgcatgtgtgggcctacccacgtgtctgagtgcacatacatgcatgtgcacgtgtgttatctccaccgtttcattctttaagcctgccccttcctctcctgtcctcacagctctatcccgctccccgcttgctcctgaactctctccaaacaggtttctcccctaaccccatgacattctgtaaagggcactgtgacctatggaccgagttttgctcttgttgcccgggctggaatgcaatggcgcgatctcagtttaccgcaacctcccgcctcctgggttcaagcgattctcctgcctcagcctaccgagtagctgggattacaggcatgcaccaccaggcctaattttgtgtttttagtagcgacagggtttcaccatgttggtcaggctggtcttgaactcctgacctcaggtgatctgtccgcctcggactcccaaagttctgggattacaggtgtgagccaccacatctgaatctgtcccagccgaccgctcccttatttttgggacaccttggcttcgggaagccctgtgccttcttggccccaagaccctctcccacctcctttcctggaagccccggctggggcctcgggcctctcacctcccatccctggtgcctcacactccaagcgccctctttatactcatgaccccatctccagggccatggacacctcttggctctgccatcttccaggtgctcagctttcccctaatacccgggaggcctcctagattctcctcttctgctcacaccctcacctataggtcaggggcctggcaggaggcagcacttctctccagggaccgctggtgccctccgcctgctccagcacagttggcttcagtggctgcggcctctccgtctccctgcagtgcatactcaactagagttgtcgagaaaacctaagccggccataccacccctccgagggcccttcccactccccagcgtcctcacacactttccagggcctctgtgcttgcagccccagcctccccctactgcctgtggctccctgcctgggcacacacagacccctgccctggtgggacaagccctcccagaggaagaggagtgtgcctgggtcaggtcccagcaggagcatgatggggtcaaaggtcaactcctatcccaagatggcaagacccccctccgccctccacctggggcttcctaggtgtttggaagtcatgctctgcccattcccctgccccagccaccctccccgcagcccatcctccctccctgaggaacctgccccttcacagctgttcacacgtccctgggcagcctctagtgcagcagcgatgccatgaaaccaccgtggagggcaccatcagccttggcactgctgccttaggaggtgcagcatgtccacactcatgcccacaggggacagctttcatcagaagacactgcagcagagatggcggctgcaacccaaagcagggggttcccctggggctggatctaaaagtgacctcaggagaaaaaggcaagaggctgaggtgaggcagtgctgtggagccccatggcagggagtgttactatgtctgctgccacttgcacttacagtgggaaagacgcacgcggactcacactgaggctggctggggagggaggggacaggcacgcagggcttccgatctgccgtgtgttgctccttcaactgggtcccgggctcccaggcatcatgatgctctttgtatgtgtgtctaaaataattcactagtgaaaccacttcccaacccctccacttgggcctcaggggaaaatccaggatccttgccgggcattccaggccccatgggacctggccagtcaggtggcctctgcagcctttgtgtcacactccagaccttggcccctgctttgccctctgccagaaatgcctctttctgcccatctggactttgtggctatgtccatgtccacaggaagcttctaggcagcagagaaacagggtcagacttggcttttagaaaaaggtctctggggcaggcagatcacttgaggccaagagttcgagaccagcctggccaacatggcaaaaccccgtctctactaaaaatacaaaaactagctgtgagtgctggtgcatgcctgtaattgcagctacttgggaggctgcagcatgacaattgcttgaacctgggaagtggaggttgcagggagctgagattgcaccactgcactccagtctgggtgacagaatgagactttgtcttgggaaaaaaaaaaaccctctgggatccccagtgaggagggcaggtcagggcacgggggcagggaagacatcaaggggtggagagagacccgccctgaggcccagtgcacagcctggcatccactggtgccctttcaccctcattccaccagtagccatggagacggctgtatctcaactccagccttcgaagagggcaagagagcaggggagccttgagccacagacagcccacatgggcaccatctccccaagatgtcccccagggtttggggctcccaaaggccgattgttgactccaggaccttcactcactttgctctccccgccatcgtactcagaggcatccagaaccggcagatgggagaagccctagggagataggcctagatacaggaggagacatgtggagctgaggcaaaggcgggtgcggatgccaggcccagtgccctctatacccctactcctgctgacaacctggctgctgtaagcttggcagttgccatggactccctgggagagatggcgtggcctggaacgtcccccgccctgaggtggggcagggctggtggggtctggtcatccccctggtgggtccatgcatggcagcctgggcaggatacatgtgagtgcctacctgggctggggtggcctgaccctctctgggcctcacagctttgtctgcctcatggtactgtccacctggcctctcaggactgctctgtggcgtgtgtgcttaagggattgagctcgttgggctggggacagaggcctgcctaggtctgttgagagggcccaggtaagacttccacccagactgactggctggggcacacagagaagccaggacagggctgattgtgtgtgcaggggcgtgccctctggacgaggcccctcccaccggggcgaggcagaggccttgcttggttggagcggagtgggggagtgggagggtctccctggtgagatagtactggaagggcagggacagcattctagggaaggaaccagaaagagcccctgcatggaatgtggggatttcaccatgagaccccggctgcctggcctctgagaacgtgtgtggggggattccaggtggaaggtcgtgtctgggaggatgggtggggggttgagcagtcattgcccctctccagatctgcgtccacatctgtaaaatgggcctagaattcccagccgctgggggcgagtgaggccataaattagttgagatggacccaggctcctaagccccctaggtcatgaccccaaaccttggaacccccgacggagacggtgggggtggccgaggcccaatcgaatctatcccgcccagatgtgggaagaaccgcagggcaaacccccggcttccctcctggccgctcctctctttgaggccacctctctgagccctgatttgctggcgggtgaactggggatcatcgtgtccactgtggctggtggtcgtgaaacgaagtggaaacatgagtgttgaggccgagatgggcgcagtgcgcgctcctaaacagctgtccccatccgtccgcccctccctcccttgcgcgggtcagctggagcgggggcgcgccaggcacgaccctggccgggcagaaggcggtggagcccttaggggtcgcggctcctacccccggccctcccatgtgcagatggggtagcagcctggaggtttttcccaaggtcacgtaaggtcaaagaaaaggggagctggacgcgacgaggaaagtcacgcacggcggagggcgggccacctacgcgcgcgcccgagttcgcagagcagcggcgccctcccgggctagggcagctcggagctcggagcctttcttcgcccgcagctcgggttccgggagccccgcccccgcccatcaacgccccgcccctttcgccacggccccgcccctcctctccgttctccccgccggcgctccctcaagtttctccgaagttttccgcgggtccagcggtgcgccccgcccgccggccagtgacgtaacaatggtgcagcgcggcggccaatgggtggtggcgggggccggcggcgcgggccaatggcggcggcggacggtcccgctgtcctgcctggccggggccgcactgcgccgcccgccgcccgccgcccgccgcccgccgccggcgacggcaccgccgccctgcgatccggccgcggcggctcagagcgcggctgcggcgggcgcgggcggcggtggctccctcccgtgcgtccgtcgtgggacctttgcccgctcgcccgcgggggacagcgcgcgctccggtccgcggcaggggcggggacgcccggcctgtggcccccgcgccccccatggtgagtccccgtcccccgcgccgcgcccgcggccgccgccccctcctcctccggcacacgcgcacgcaggtgcagccctcgctgcgccggccacctgcgcgcggacgccccgctcggccccgcgaccctccgccgcccgacgtctggccgtgcaggccgggaggggacgggtaggaggtggcgggtggccccgggcgcggcgctgccttcaatggcccaacccccttattcacgagccgcggccgtgactctgcccggtgacgtggggaggccgaactttacgtaacccgcccrgcgccccacgcgtgccggcwcagggcatatctggggcccggaggcccaggcttggggaaggggctccagtcacggtgttgcccacgggccacagcctacccgcaccgcgccgctctctttaactcagttactgccagtgatagtgacccagtcagtgtgtgtggacgcggcctgccttctgtcccaggccccttgtgaccaagggcttacccttgaaagaaggcagtagggaggttgggacggagccagaggtcagacgcctaggctcaggtcggggctggggactcagagggcagggtcagggcctaagctcgattgcctgtgggttgggggtccccaccaattctggaatgagcccaaactgagacgcaggggacctgagttctaggcctggctctgccgtggcttgctgaccttggagaattggagaagcttgtgccctgctggaaagtgggatggcagtacccgcttcatctagtagtcggggagatcaagagaggtatgggacctgaagaggatggcagactgtgcagtgcggtgcacaccggtctccaggttgttttcaccctcctrtctcctcccaggagctaacgtgtaagcaaacatgtttggatagagggctggtgccacgccccaggctcaccccgcccgcacagccgtcgtccacccctcccctttcttacagatraagctgaggctcggccagggactgtgatatacccacatccccggaactaggtgatcgcggtgcaggaaccaggtaggtctgagtctggatcatgcctctgaacagcccaggaagaggctccaggggcctccaagtggtctggggtcggagatcagggtcagggttgcgcttgggctggagagtggatttgcctcagcttgagatgtgggcccaagctttctcatcccctccctggccttttctttatttggggtcgtatgaacctggcttaggtgggaacagaagctcttccagtgggtccctgggttggagaggggaggggagatttgagggcatgggcagcaagggcatttccagcagaggtgccagagagcaagtcagtttcaaggagggagaacaggtacagctagatcaaggatggaggcggtggttctgggcgtcggagagatggagctgtagggtgactggaagggcctggccgaggctggaggtaggtacaggcctggtgggccaggaccggaggggctgtgtgaggggcagaggggagtccccgggcctccccagtttccccgcgcctcaccgtggcctcttcctttccccgcaggtgtgccttcgcgggatccatgccttgaggcccaggaacgccccgccgccagcatgccgtgggacgcgcggcggcctgggggtggcgcggacggcgggcccgaggcctcgggcgcggcgcgctcgcgagcgcagaagcagtgccgcaagtcgtcgttcgccttctaccaggcggtgcgcgacctgctacccgtgtggctgctggaggatatgcgcgccagcgaggccttccactgggacgagcgcgggcgcgccgccgcctactcgccctctgaggcgctgctctacgcgctcgtgcacgaccaccaagcgtacgcgcattacctgctggccacgttcccgcggcgcgcgctcgcaccgcccagtgccggcttccgctgctgcgcggctcccgggccgcacgtggcgctggcagtgcgctacaaccgcgtgggcattctgcgccgcatcctgcgcaccttgcgcgacttcccggccgaggagcgggcgcgcgtgctggaccggcgtggctgcagccgcgtggagggcggtggcacgtcgctgcacgtggcctgtgagctggcgcgccccgagtgcctcttcctgctgctgggccacggcgcctcgcccggtctgcgggacggcggcggcctcacgcctctcgagctgctgctgcgccagctgggccgcgacgccggggccactccctccgccgccggagcccccgcctcagctcccggggagccgcgccagcgccgcctgctgctgctggacctcctggcgctgtacacccccgtgggtgccgccggctcggcccgccaggagctgctgggcgaccggccgcgctggcagcggctgctgggtgaggacaagttccagtggctggcgggcctggcgccgccctcgctcttcgcgcgcgccatgcaggtgctggtcaccgccatctctccaggccgcttccccgaggccctggacgagctgccgctgcccccattcctgcagccgttggacctcactggcaaaggctaggcccggagcaccctaggcgctggattttgggacaaaactatttttcagagcgttgtaccggcactttatatatattgatctctgtacggcacaatctctgcctcatctgtcgcatgcactgggggctgggcttggatggtcaggtgagttccaagtggcaggttttctgggtgcagctgggctcgggccttcagctcgctgtccagcccctgaagggagtgaggactaacctcccaccttgatctagagcctcggacaggtgtgcgtcccagatgggtgacagctgagtgccgcaggagctcggtaggtgcaggggtggggactggcatgtccaagcagcaggacagcgtataaaaaggcctggaagccaagagaacgagctctgcagcgtagggttctcacgggaggtcctgtgcggtcagccttttgcaccctgtggactccgggccagggagggcacacagggctggcaggcccgcggtggctggtgttgaggcatgaacaaattgtaccgggtatcccccaccccactctgaccaccagttcctccttggatatcactccccctgacaggcagcccacccaggcctggatttgtccctgtctcccccttttgcttttcccccatgactaatgggcaccaggtcttgctgctcctgcttctcacctctgcagtggcagcaggcccctggccccaggtgcatgccggtcagtggggttggatgtgccttcctccaggcctgccctctgtccaagcccggagtgggcttggtgggctccctggtggcccccagtgggtgccaggtggtgcccggggttattgaggggtggttgtatcactgtagggacaggcttcttgccccagcctggagagctgttttcttcaggaaggttctggagatggagacttgtttgcgaattcaccacaactccaggctgggaggctgggtctccgctctcagagccgagacaccagggaggatagccaggctgccctgcctgggaattctgctgggccgtcaaattcaacccgcaccaacgtgggcaggagggccacagtgtcctgccaggagcagagggctgaaggtctgcaggaggaagarccactatcctggtggggggcacctgctgcccaccctgcccccagcgtgcctggggggagcacacctgggcatggaggagtccagggtgctgggccacacaagagaggtgggggagaggcctggacagtaggaagatcttgcccagggtcctggatccgccactctgggggtgaccttggacaaacctctgccttggccctcagtctccccatcaaggtttttccattcaggaggttttgggccatcttcagccaccctaccagccctgaaaaggatgtgactcctgtttctgggaagtgtgtggtgtgttaggtgggcctacagccctggttgtggggagggaaggatggagagacagcacagtgacagagcccagactgcaggctggagtgagggttccacttccccgctgctgtgtgtcctggaccagtgcctctgaaccttggcacttggggcagtggatattaacatctttccaagcccaattcttggggcatcagggcctccggtcctctgggaggtggcaggtcctcagattggagatgccatgggggggggaggtgcctctcctttggagggtatggaagtggagacaggagtggcctggcgcagctgccgtggttcttaggggctgggcccggggagcccatggggcttgtgcctagaaagcctgggctcctcactggggtctagatgtgcagacttcatgtctccccagctccagctctgttctctataggtcagcctccacaatgccagaggcccagggctagccccctccacgtccctcctagatctacagctgcccctttgatgacagcgccattgagtcccctgggctgggggggtcatgcaggggtgaggcagctgcctgccgccggtactcattgcctggccaggcaggacacaggctggcgggcactgagagtgggccccacgaaatccattgtcaggttaccaggatgaagaacccaggctggtcgtggagtgcagggcggggcctgccggaagaattatgggcactgcagcaggagggcagcctgggccattagctcctgatgtcatcgatttgggtgaggggacagggaagtcagaggaagctggccagtggctctcacgcagacttacagcagyggagtggtgcctgattcctggtacagctgctcccactgagtctccagggatctgtggttcaggaccccctgcaaccccctcccagacccctgtactggtgggaggagaggacctagaggaaaggtgctgggcagataagcagccgagggaggccctgggtttagcttatcagtcttctgggccctcctgccccaggaagggcagcgaggaccatggtgttgcccctgtcatcgttatcgtcctggccatgagcttgcaggactgggagggccggagtcagccaggcagacggcagcacagcatttgcctgttggcaggtggccttggtggcttcccaaaggcaatcgctccacgcagaacaaaactcacttttttggggggtgaagcaccttggttcatttgtttagttcgttaattccagcagtctgtttctaagggaaacatggctgcagcccgtcctgcccctccacccacccaccaggtgcccagtgttcccaagggccccgaatcccaaccttattcaggcgtcagcatctctgcaccccaaatgcctgttagggaggatagtgaaggctgagccctcctgggctcatcaaaagccagcagtgagagaacacccccatctctctgaggtgaccttgtagggcagtccgtgctgtctggctggcctgggtgaggtgggcagggaccaaggcctggcgcctgggcctcgctggccttgctctgcgtgctgacttcatcctgatagtaccttgattttcctacygtgacttccccttctgtcgacttcctcaccaactttaaaattccgtattgagagcagtttcctaagttacctcaaatcctattcagaagaaggttcttcctggaagttgggagggcggaaaacaagtttagtcacagaagactactccatgtttgagcttctgtttcaagggaagtgagtaactgccggaggagccctgcccctctgcagtgtgtggtgttgccctgatacttttcagattgaggtgttacttacatgtaataaaatgcacagacttaagtgtatactttgatgagttctgatgaatgtctacatgtgtgtaatcaccactgcaatcaagatggaaggaaaggctgggcgcggtggctcacacctgtaatcccagcactttgggaggccaaggtgggtggatcatgaggtcaggagttcgagaccagcctgaccaacatgatgaaaccccgtctctactaaaaataaaaaaattagccaggcgtggtggcaggcacctgtactcccagctactcaggaggctgaggcaggagaattgcttgaacccaggaggcggaggttgcagtgagccaagattgcgccattgcactccagcctgggcgacagagcaagactccatctcaaaaaaaaaaaaaaaaaagatggaaagacagatttctattggtgattcttaaaagtaatttatttatttatgtatttatttatttatttgagatgtagtcttgctctgtcatccagactggagtgcaatggtgtggtctcagctcactgtaacttccgcctcctgggttcaagcgattctcctgcctcagcctctggagtagctgggattacaggcgctggccaccacgcccggctaatttttgtatttgtagtagagactgggtttcagcatgttggccaggcaggtctcgaactcctgaccttgtgatccgcccgcctcagcctcccaaagtgctggggttacaagtgtgagccactgcgcctggctcttaaaagtaatttctttctgcttataaaattcatgttcactgtagaacactggggattgagtagagaggtccggccacgatgcagggaaacactgtctcaagcgccccaccgccccacatggtccccagagacagggcccctaagcgctcacgtacaagtaaaggcgctgactgagtgcgtcatctgcacgcatacaagcactgctagcattctggcatatgtttctttcagcttttttctgtgcagatatatattacatttttttctgtgtatatttatatatatatgaaaccagatcagttacacaatttagtatttttttaaccttaatgtagtataagcatttcccccattgtactttgtaaatatgatttttaagaagtcattggtgtctactttgtgatatttgactcaaccagccttgataacaaagagtagttagagacaactgaatttttaaaatgtaaatctgctttatttttggaataaataatacatttacatggctggaaattcaaaggatacaaaaaggcatatactccaggcaaccactatgaccagctgctgatcacaagtagagaacttgtttcttttcacccctcttgctcctccccggagttatgaaaaatttcaaacctgccaaaagtttgaagtttacaacaaataccctccaacgtttgggttgtctccctcccccttctctccctttctccctctgatttcttacagaaccacgctttcatgaccatgcccgggaacttcacgctggcgcggtgaggtcctgcgcctccgcttcctgcacacacgtgcttcttaatagctgcaggctatttcatgagaggaatttgctcacgttaacatggctgttcccaaatgccaggctgttttaagtgtttcctaattataaacaggctgtgctgtttcccttgacctaggacttgttcttgaggacagaagtggaggtggcgagatgcaaggcctacgtacggaccggcttccccagtagggcggcgccaatggggggctcccaagctgctcccatctcacctctgcttccggggtgctgggggtttgggccagtgttccttctgcttttgtgaagggcccttacactcgactcgaagtgctcctcctattggtttttaataaatatatttatggaaagctttatgaatttgcgagtcatccttgtgcaggggccatgctaatctctgtatcgttgcaatttttgtatacatgctgctgaagggcgcactcctcttattgttgtataggtttttaaggtaaatattcaacatcaattcccatttgttgcaattatttcccttctttgaggtttttaatttgcagcatttttacatttatttccttctatttatttatttttgagaaacaaggtcttgctctgtcgccgaggctggagtgcagtggtgtgatcatagttcattgcagcctcaaactcctgggctcaagtaatcctcctgccttggcctcccaagtagctgggactataactgcacatcactgtgcccagcagcatttctgtattttggagaaatcaaatctatgtacttattttcctctgtagcttgtcctatcacttttgagtttagaaagcctttgccatccagaaatcagacagttttcccactggttttagattctttaatccatttaatattattttgcccagagaatgaagcagtggccacattagttgtgacaccccccatgccccgcccccgccgctccttaagcgcatctgagatgccctctccattctgctccctccctgtgggccttgctagcctgttgcctggccctccgagggtctgggccatgccattcaatagagtggcccctgctggggctccacctgtcatcacttagcagttctcacccgtttcttcttcccaggagtgacgggacagtgaggaggcatcaaacagcacaggtctgcagttctacagagctggcttccagtcccagtgctgtgtgaccttgagcaagttacctaacctctctgagtctcaaggggctaatgagacttccccttgcagggctctggtgagaagcacattgggcacagtcatgggcatttgtgggtactaacattattcctccctgcctgccccaacaaaacaatcccagtggggatttgaactgaaatcaagctacacctataaattcctttggaaagaatgaggtctttccataatgtgtgtagtcctccatccaggaatgtggaacatatcttcctttattcaagtttccttttatgccttctggaaagctttgctgctcttcacacggcctgaggtttcttgctgaggtcatttcctggcacatggtgtgtcctgctgctgtgctgggcgtcatcttttgcgtgtgctggtttccagcagctctggtttgcgatatggtttcgtttgctggctgaagatacagaaccaggggctcgaacccctccaacgcctgctcacacacagctccatgaggaggcagccctggacctcaccccacagcgtcctcctcagaggctaccatggggtacagccagctctggagcggccattcccccataacagccacttgggcaaaccggtgtgtatttcaacaccagccaggccaggacaggtctgctgacgcactctccctgtggtggggctgggctggcaggttctcccttgcactgccctcgtgagtgtcggctgaggacacttctcacagctcaggcaccacactcggccaggtttggaaaaagtctagtttattgcactgactcaaagcacaactaaaaattaaaaccagaaagaaaactgtacaaagcacgaagctacaactttaaaagcatcacctagacgcgggtttaattgcactacagtcccatgggtgaggagagctttgccatccgtgaggcgccgggcaaggcacaacagacacagagagatgcagcccggcctggggctgcctctgctgccaccaacttttacaaaaggttctagaaaagggaagtgtgaagtcagatctgggatttcggcatcttgacctcatttggacatggaaaacctccacctatgtggctggctgggtcctgtcagagaacatattttatcaccctccacctgcggcctgggggctccctgacaccaaggactgggcctgggccaggggcaggctaaaaaaagcagccagcctggtgtcctgtcctgaagctgcctccgggagggggcgggatgtgtggcagggcggcctagccctcacacgcagatgccagtgggcggggtgggcactgcccattgtctgaaggggccacagcagccgtccatagaggcactggtttcaacctgtcaagtgtcaacccataccccgcagaaggcatgggctgccactcggagccagcccgcaggtcccgtgaccgccctgccagtcaagtctgtgcggggatgcctgcccctctgaggctgcaggcgaggacagtgcaggctcaggacaaacccgggaaggaacaaagggcttccactgttttcggaaaacatatctctcttctaaatttgtaagatttgatttgaaatgaggtattttatgcagatttgtaatacaacaacaaaggcaataattagtagactcgtcctctgaggatgcatctggttttaggatgtccgccagcagcattagttaaacaccattccaaagacatttctaagtgagcgacccttgctcagctcccccacgccccatgcaccctcctgtgccgtccctacctgggacacacgtgcacacatccaggttccatttgcacccatcaggctttactgtttcagctgaagtgtgctctccaggaggcgggcagcctgcgccgtgtgtgggcagtgaggtgtggtgtggtgtggtgtggtgagatgtggcgaggtacggtgcggtgcggtgcggtgcagtgcggtgtggggtgtggtgtgttgtgtggtgaggtgtgctgtggtgtggtgagatgtggtgaggtatggtgcagtgcggtgtggtgtggtgaggtgtgctgtggtgtgaggtgaggtgtgttgtgtgttgtggtgtgcatgtgcgtgggttctctcctggcatggccagcgctctcctctcaagcccggcctcagcttcctggccagagcgtctggcatggaatgtgctctgcagctttgtctctggggggacacccccctatgatgggacaaagccatcaccgagcacatcccgcgctgcagagagctgacctttggctccatctggccctggggctactaatgtggaaggaggccctgggccaaaccagctgcccggctacccttggttctgggaggcctccggagaccactcccaccaacaaaagctggagctatctgtggatgagaccaggacggcagcacgtgggtaatcggagtgcatgcagccgggcagtcgccactgtcctgagctaggaggcgccactgctgcagcaatcacgccagccacgggtggaggctgtgggttctggaacgagacagaaaccaacatagatgaaagtaagtgtgcgggtccaacctggccagaggtgtctggacaagtgttgaggcagcgcgtccaccagggagtcactccgaagcccctgtgcccgccacagacgccgggcccctccgcgtgactcggccagggctccttcagatgacctcccactcgtcctccaggtcctcagggtggggcatggcggcctggctgctcttctgggtgccgtgcgagtggctgaacgtctttgtcagccgttggaggaggtagccgggcgggcccacagcccacagctcatctgacgcagtcactgcagggacaagagccaatcacatacttgtcaatcacacagcctgtggggtgggcacagatggagctgggagcttgggcacagatggagctgggagcttgggcgcaggtctgggcttgccacattctaggtgggggacactggacaagccaccatctccatgtgaacttcgtaccctcagctgtaagtggatgtcaacagcaccttgtccttgcccaggagactctggcagagcccaggtgtccagccccttccctccctgggacacactcctggctttgccctcagttcttgctttgagagattggagcccagtggggtcggcttcttcgagagccccccgacatcgtccacaggagccctgggaaccccaaggggccttaagcccactggccccgggcacctgcctgtgaaacacgacacgctgccgggaattttcttccagtagtcccc

SEQ ID NO: 17827 - DNA, 24477 bp, Homo sapiens
ggcaggtctggggaggtcagagcgtgggtgagaaccgtggccatgggtgggatccacatcccagcctgcagggcctcctggtgatggttctccagaattctgcgattggagctgtgctcacagagtcactgtccccgacctcccaggggcgcggacataacccagcctcagctgcagacagcagagactctgcacaactgcagaagctgagcaatcagcctcatcagtggcaattcctggaactccaacctcaactgtaacatgagctgtggcagaccttcagtaaccccagacgaggagtgaggcagagcctgatagctcagggaccagctgggatgctcagtaaacaagagctccagaagatacgcggaacaggagaaggtgaagtgtggggacagcaggcgctgcaggccacccagaaggaggaggagaggggacaagaaacactgaccaggccttcaagatgaggagtgagcagagaggacagcagaacatgggaaaacctacctggcactatgagggtggagaggggagtgttggagggtgtgcatttgagtgcaagtgtgtaaaagaggccctggacaaggagtgaagaatctcatcagatggttaaagtgagggagcaccaagtaaaccataatgaaccataagtcatgtggaccccaaccctaatgctaatcataaacctaaacctcgtgtggcctggaaccctaacctgaacccaaatcctaaccataaccctaaccataaccataaatcatgtggactccaaccctaatgctaaccataaccctaaaattcaggcagaaccgaacctaactcgaacccaaaccctaacgaaaactctaaccctaaccctaactcaattcaaaccttaaccctaaacctaaccataacactaactccaccctattccgaaccttaaagctaattaacaatgcctcatatggacccgaaccctaaccctaaccgaaaccctaactctaaccctaaccctaactcaacccaaaccttaaccctaaccataacactaactccaactacaaccataaccctaaccaaaactctaaccctaaccctaactcaacccaaaccttacccctaaccataacactaactccaacaaccataaccctaaccgaaactctaaccctaaccctaactcaacccaaaccttaaccctaaccataacaccaactacaaccctaaccatatcccgagccctaaacctaattaacaatgcctcatgtgggccctaacgctaaccctaaccatgcctcatatggacccgaaccctaacccctaattccaaccctaaccctaagcctaaccctaacactaaccctagccaaaaccctagcactaaccctaactccaacccaaaccctaatcctaagtctcatgttgaccataacctggctcaaaccctaacctgaaccctaaccctaagccttgtattgaccacagcctggctctaaccctaaccctgactctagtcctcactgtaattctacctctagccttaattctaaccctaactccaatcctaaccctaatccaaatgcaccctctgatccaaacaactcttcagccaatgtcagacctcaccttaaccgtcaccttcacgatcaccattccagttctcccttcagacttcccagggacttgagccagcccctggcccccaggccttggtttccccacctgtgcagcatggatttggggctgagggtacaaagactggcacccacctgagccgttggaacaggcctgcccctggtcccgaggaggactctgctctcccggttctccccttgcccatgtggaagggggctcatcccccagcatgggtgcttcctgcctggtgtccatctctgtgtgagttcctttagggagggaccgggtaggcgcagttggcatggcaccgccatgcccctggctcgggcttatgcgggctgacagtcctgtccctccacccagaggcccctccaatgatgtagcttatcagagtgtgtgtgtatgtgcacatgtgcatgtgtgtatgttgtatgtgtatatatctatgtatgtatatgtagtatctatatatatgtgtatgtgtatatatgtatatatgtgtgcatatatatgcatttgtgtgtgcttgtgtgtatgcatgtttatgtgtgtatttgtatatgtatctatgtgtgtttatatgcgagtgtgcatgtgtgtatgcagtgcttgtgtgatgtgtctgtttttatgtgtgtgcatgtgtatagtatatgtgcatgtgtgtatgtttacatgtgtctgtgtgtgtatgtatatgcctgtgcttgtgtgtgtgtgtgtgtacacatacacgtggacaggcgagggagaagctgtattgcaccaccacccaggcccttcgagcccaagtgcagtctccccagggctcacgaggccccagcacgctgccctcctgctcagatggtgcccaaaagccccttgccgagtcctctctaagcctcatgtagacccgtgagtcccttctccgtctgtttcccctgcctgtgatgcttagggatcgttcatttcagggccagtgaggaaaccccatcttctcctgcactgccgtggagttaaaggagaaggccacaacacactcccacgttttctacagactagcagtggggtgtttggccacctttggttttgaccttttattttggaaatgttcagactgaaataagcagaagtgtaataaccccttgtgcccatcaccccacctttggcaagagccaaagagtcacaactgattgtgcttcaccacactccatctatgggctcaaaatgttttgagataagtgccagacatcatatccttctatctacaaaaaatgccacatgaataaaagataaggacttttaaaaacacatgaccacagtaagcattatcacatctagccaagaaatgaacctttccttaattgcaacaaacaggagttaacttttacattttctctacttctacaattttttagagaacagtaaggtagactttattcaacggaggctaccacaatggagttttgcagcagggaagggagatgaggctcaattcccaccttatacgtttttaaaaagagcttatttggttgaattggatctgaggagtctggctgcaggccaaaatcctctgtgtgatcattcaggcccaaccgcagttgttgccagcaggccccacaggagaagcagccctcctgccccagacggcactttccacccttagcctcctccacggttccccaggccagatccttttgtttgagccttctgtttcgcctgcttggtagtgagatcatctccccatctgcctgatgtcatccagggggcaaaaatgggacgtagaggagccggcacctttttccttctgtttgcctcttgcctgcactattgcagtcgtgaatacaggcctgagggtgaccttccattgggctcgtggtcccaacctcgacagcagtggctccacaggatgcatacgaggtccccgcggtcccggccgacatacctgttgggttcttagttggcagcttcctcctccttctctctattcccctcctaggtctcttgccctgtgcagcttcctgcagactggacttgcaaagtccagcctgtatggctggagttcccatgcctgccaatctcctgtcgactgcgagtcagctccgatacttcaccagattcaggtgagagttttggttttttgacaagcccacttcatcagcagggcatgcatttctgccaggggtctcatgatatctggtggtctctttgtgaggccagcagccaccaatgatcacgaatgtggcaggaagctgccaagagaccccccagtgggtgattcctgcctcctgctgtcatgcaattccctcctgaagggtggctggacttactcacttataacaaacaatacagtaaaaaaaaaaaaaaaaaaaaaaagtgatgtgttgtctcttccgtgattaggttgaaagagaccatggcatctgtcttggatgcatactctctctcgctggctctggggtagccagatgccatgctgtgtgctgccctgtgaagaggcatggccagtaaggaactgagggcaggaaccagggaagatttggggtcctcaggccagctgcccattgggaatgaaactctaccaacagccacctgggggagctggaagtgaatctcatcttagctgagccttctgatgagactgcagccccagctgacacctggattgcagactcatgaaagacctgaaactctaccaacagccacctgggggagctggaagtgaatctcctcgtagctgagccttctgatgagactgcagccccggctgacacctggattgcagactcatgaaagacctgaaactctaccaacagccacctgggggagctggaagtgaatctcctcgtagctgagccttctgatgagactgcagccccggctgacacctggattgcagactcatgaaagaccctgagcagaggacccagtttggcagagcccgaattcctgacccacaggaactgggagataaaactctgtggttttaatcttctcattttagaggtaatttttttgtgtagcaataggtagctgacaatgcacagctaaaataatagataattaaccctaatgctagtttcattcatccatcagggtttgcaaagtagtgatattctacttctgtcttccttcattatttattagcagaaatgtatctataaaaagaagtgttccttcattaactctttggtcatgttgaggtacagtttgcataggaaaggcagggcaaatgcttgattctttcccttcctttcctcatttataaaataatgaactgttttcctggcatctttcaacaatgactaatgagtttttaaagtataattacaagttcatgagtttaaacattttttgatgttcccattaacattattatccttattgatattcagatcttcctgtctttgtccagtgccagcctatttgatttaactcctgagcccctttggcactgccctaataatctttgacagctactttgttctctggcataagaagacattccagaattacattagacatttcctaacccagattggacagcatacacttctctccaagagcccctcttcctcttcaagagaaatggtacttagagaccacagtctgggtgttaggtgtgcttgtggttactggatttgtcgtcatttttaggccttgtcagtggacagaactaaggcttttttttttgaaagacacattatgagtacaaatggatactttctatttaaattcggatttacatagtttttacttaatcttattgataatatatctgcatctcctttctcccacaccaaaaatctcaaacaatacccaacatagttattcatttgttttatcctgtaacacacacaatattttcaaaatgactttaccaacactaccatcaacagtatataaccactgaaaatagtttaaaattatttttagatacttttaaagtccttgggttgtgtcgacgtacagacaaaacagtgttttaaaattatttggaaaatgattacttaaaataatgaaaacttcttttgccattctttcttgttgtcaggctatatggatatacatccaaatgactggattttaaaatcacttggaagagtttggtaggttcatattgtcaacccataatgcaagtcagttagtttcattttgctttcaattttaagaattccttttacaagttaatttaattaaattaagtaattacacaaacatttgacatgagtctaaatccaaatctagaaaccaagatatggtcacagaagtccgtccctatccccatcccatttccacctgtttcctacaggtaacagtttaatttaaagcaaattttgtggcttatctttccatttgtaaaacatacagctgatggctccatctaaaaacacatcaattgtctatatgtacataaacatgctttttttcatttacaaatacattctggagatgaccatatgacagtgtgtagaaatatttctccctcctctttgcaagtgctcagtgtcctgtggtgtgaacacgcttcattcaacctgggcccttgggagagatgctgagtggttcccgggctgtccccactccacaccgtggcagtgaagagctgctgaagtacatgcttcatagtccttgcgtctctctgtgagtacattcctagaagtggggttattgggtcaaagagtaaatgcatctctaatttggctaaagatattgccaaatccacctgcctgggggtttgtgccaccttagagatcagtgatcaatgggtgatatccgaggacgtctttctattgtggtcagactcttggattttgacctgactaatggaggagaaatggtgttgcagtgaacttttgatttgtgtttctctttttatgatcgttttgagcttaatttgtgtttctctttttatgatcgttttgagcatcgtttcgtatctttaaggagcaatttacatctcctctgtgagcgtctactcccatctctatcagcaggcgtcttgcctggctccggaggaagtgtctctgaaggctggtggtcccaggatagggcaaaagaacgggagtgagaactctccacacagtgcttcttctggggttaaggaccctctgcctcagtggctcctgggygtgattaaacttgccatttcctgggcccatcctagacaggctgctgcaagccagccaggccgggatcctgctgccccggggaggacgtggggaaaatccctgctggagggactgccccttccttgtccagccactgggtgtttatggttcagtttagggcggggatgacagcacacgacacacactccgctctcaagagttactcctccctccccgccagactcccccaaccggaggtctccccagagtggaggaccttccagcggctggcaggcggcctcaggcaggcagtggggagcctctgcaggttcccgagccaggaagtggcacttaggagtgaggatcttaggagcggggctcttggacaggagggcgagtgagttgggagggcctcaagcggggrcccgatggctctctctgctgagaagggagggccctagggatggggacagagagctggcagttgaagggccaaggagcaggcagcttcccagtcacagagccttgtgcagaggaaggggaaggagtccgagagggtggccctgctgtccagggccaagaaaagggaaagccgctggaaatagcagaaacctggctggggcagcacccaaggcccaccccgaggccaggtggggaccccagcggggcatctggcagcagtgggtccccaggagcaggcagtgggagccatcagggtgagtgagctggcgggggtggcccaggggctggggtcacctgccctcagcccaaggagcctcttctggcctttggtggccagggctgggatctccctgctggtggccagatgcctcgacaccccataggctgggtgaaggtggggcaggagttccaaggcgtggagacggcccctgagtgcccaggggcctcctgctgcaggtgggcagagctggaggctccactgtgagggtgcctggtgaagggaggcgtgggcacgggggaggcagggaagggccctgggtgcgacttgcagcccctcagaccctctcaggacccctcctgcccccatcgtggtcctctcagggcccctcaggatcccttccagacccctgggaccccgtgtcccctgctcgtcctgcggtggtgcccagctcctgccaagggccctgcacttgggctgtggggaccccctgtggggatggggccatcacaggaggctgagcacagggcggggtcttggctggaggggaccttaggccacaggtgctagtcttctgcagccaccccccaggacccctgcccgctacctcctctgccccacagctgacaggctttgccctcccctgcccctctgtggccacacactcagttctctatacacttttattatggaaaacatcaaatacacacaaaagcagggcatctaggacagagaccctgtgtcctggtccccagcccctcacagtgacaccgccaggctttaggcaagatcagtgggggaggggagtttcccagcaggacgtgcacttccagacctggttctgtgaagaggggaacagaaagtgctgagggtgacagggaaacctcgagaagagggaggtgtactcacatcctctctcggggtccacaactgagcccccacacagaggaccccactggtctgcctgagctgctgggtgggcaagtgaggcactggcctcgggggcacagcgcttgaagggacaccagaaaaacagtcataaagataaaccgtaatgtgttgttttatttcttatttatttatttatttatttttgagatggagtctccctctrtcgcccaggctggagtgcagtggcgtgatctcggctcaccacaacctccgcctcccgggttcaagcaattctcttgtctcagcttcccgagtagctgggactacaggcacgcgccaccacgcccagctaatttttgtatttttagtagagatggggtttcaccatgtcggccaggctggtcttgaactcctgacctcgtgatccccctgcctcggcctctcaaagtgctgggattacagatgtgagccactgcacccagccaatgtgttgttttagtaaaccaaaactatgcaaaggacgcatgaggatccaagcgactcatttaggatggcagcttcactgcaaaaggagtctcgattcagacctcaagacatgcttcktgggtctcactcaggaaggaagtggaggcaagtcagaatgtggtgagaagagagggtttattgaaagttgctccattacagagcagggtgtcgtcagaaagcaagagggggaacaccccagctttaactttttctcatacaggggtctcgtctgtgtaaagactaagctaaactgtgcctaacatgtattattctattgatttaaagaaaactgtctgtcacggggtcttgctctgttgcaaccaggctggagtgcagtagcacgatctcagctcattgcaatctctgcctcccaggctcaggtgctcctcccgccttagcctcctgagtarctgggattacaggcatgcacccccatgcgtggctrattttttttttttttactttttgtaaagatggggtcttgctatgttgcccaggctggtctcaaacttctgggctcaagccaacctcccaccttggcctcccaaagtgctgggattagaggcctgagccaccgcgtccggccaagggtagttgtctggaaagcatatattgttctggataccagggcacttggacactttgctgtcatagaagtgtgtccacgcaggcgtcactggctgctgctttagctgtaaacatcgtatgaccatgggctgtggctggcaggtatgtgcctcattggtctcaaggtggagctgaacgtaaacggcttttctctggctctcccaggctcctgcttccctgacatcscctcacagacttcccttcaaagcagggctgtccaatcttttggcttccccgggccgcattggaataagaagaattgccttgggccaaacatgaaatacactaacactcacgatagctgatgagcaaaaaaaggtctctgcgtaaatctcataatgttttaagaaagtttacaaatttgtgttgggccacattcaaagcccgcagcccgagtgttggacaagcttgctgcagaggctcccctagatagggctgcaggggtggcgtccggcagctctagctggagaagcaggaggargggcaggaaggaatcctgttcggagctcctcgcgtcacacatacagcccagcggggtgaagtgggaggggctggcgctgctgcagggggctaaccttgggggtgagggggcagcctcggagaggaagctgcccaggagcagaggctgggggcggagggccccgggcagtgcccccgtgcccacagcaggaccctggctgccagttctccgcagagggccaggtggtctgaagctgcccagcagggagagaacaggcctggcctggactggaaacctgccatctggcctctcgaacctggggactccgggtgtcctcgaagaagggcctgagcagcagcagaggaccccaggcgaccgtgcctgagccgggcgccgacgacgactgagcacctgataygtccccggcactcgcagccccgcggccggagtcgctgtgggtgagcggtcgtcgagcttcacagaggccgggctctgtgccagggccccgacagggcaggaagcagatagagtcccacaagcacaagcccagtgcgcagaaagggttacttaaaaaataagttctgtgataaaatcaaacagggtgaagggctggaaacaggtcatgagggcgcaaacaggtcgtgagggcgcaaacaggtcgtgagggcgcaaacaggtcgtgagggcgcaaacaggtcgtgagggtgcaaacaggtcgtgagggcgcaaacaggtcgtgagggcgcaaacaggtcgtgagggtgcaaacaggtcgtgagggcgcaaacaggtcgtgagggtgcaaacaggtcgtgagggtgcaaacaggtcgtgagggtgcagctttggggagagaggggccctgggggtgagcggggagctaggagagaaacagcgctctggaggggcccgggcaaggcctgcctgagtgggagggggcagagcacgagggcccaggctccaggctgggtgggactgccctgaagtgcctgcggagacagccaaggggcagatggagagaggtagggggtgggctggggacagcgtttcctgtacacaggtggaacctggyggcaaggggcccttcccagagacagtcagagtctctaaatgtccagtttcttccccaagtccacacagcccagaagaatccgctgggaccatgtggccctgcccagtggggcttcccttccagtgtgtgaggagcacaggtgccaggccacgtcagggaggccaggcctggtggggacggggtgccccaggccactgctggggaggagtgatgcccagcagagggggcacggtggagttcatggctggcctggtggtggggggggtgggggagctctgcagggccctggctctggtgggctgggtaggcctgcttggggcaccatctgatctgccagaggtggaaggagcactcctgggagatgccgtgccctgcacctccagtccctgcttgacggcggccgggcttggactgatcaggtgccgtgccttctgctgaccccagaggccagaccctgtggccagagtgagggatgggagttgagatcgggcggatgaaawcccaaatctgagcctcctgcccgaggatgaggcccctctccaatgaacatcatggcccatggagactgggcagggaacccaagggcgcacactggggactgggcctggagggacagccggggaagcaggaggaagggcaggaaggacagcaggaggaagcaggaagaaagggacaggaaccaggcccgggatgacagcagagaaggaccaatgcccagccagggcttcctcacgtgcctctgggtagagagccctggtctggctcaggaggcccaggcactggtctcagacctgccaccacctgtgtgacgctgggccaagcgcttcccttccctgggcgtccgtttccaccgctgtaaagtggggaggggtgaaactgaagctctccccagcctatcccagccgttgaggagggagaggctgtggtcaggggctgtggggcccacgttgaggagacgaggctcctgccctcagggtggacagggcccaggaagggggtgctctgcaccatgggggcgcagcctgggcctacgggctcccccaccatgagctcagaaggaagatgtccgctgaggagttgggggccagggagaatattctagaccagataggggtggtctgggtaggcttctgagggggtgggcttggaggaggggccggtggccaagtcggggggaagcaggggaggagccagcctgcctgcgtgtgcctctcacctgtgtgcattggcgtgtgcatgtgtgtgtgcatgtgtgccagcgtgtgtgtgtgtattggaaggcgcccacggagcgtgtctgcatgaaccaggatgagtgtgcgtgctgcaccctgtcttggggctgggcatgaggcgctggggagggcgagctgaccgcagaccctgggagggctgggccctgggaaggtttccgagatgacagggcagaagtgggctggggaggaggaaggctccgtgggcggggctggagcgtctctggttttgctgtctgtctctcacgctgtttccagaacaaatgtgtgccctcagcaaggatgctggctcttcagaggtgtcagcacaggcagccggcaccccacttccctcccagaaatcccccacgccctctagctggggctggtgcaggagcagtggggaactcctgttacccctgacctgctgccgtcagtcagccgcccgcccccccaccttaaggaggggcagagtcagggaccagccctgaggggtggctcaccccagcttcacttcccccagcccttctcagacagccactgtgcaggctttggcagcgggggtcacacactccacccgggaggccaaagctgcatgcaggtcagtgccgcccactgccctaggggcctcccagcggggcaggggcatggtgggggtctcagagtggggtgaggctgtgatggggtctcagagcagggtgaggctatgatggggtctcagagtggggtgaggctgtgacgggggttctcagagcgaggtgaggctgtgacagggtctcagagcggggtgaggctgtgatgggggtctcagagcagggtgaggctgtgatggggtctcagagtggggtgaggctgtgatgggtgtctcagagtggggtgaggctgtgatgggtgtctcagagtggggtgaggctgtgatgggggtctcagagtggggtgaggctctgatggggtctcagagtggggtgaggctgtgatgggttctcagagcagggtgaggctgtgatgggttctcagagcagggtgaggctgtgatggggtctcagagtggggtgaggctgtgatggggtctcagagtggggtgaggctgtgatgggggtctcagagtggggtgaggctgtgacggggtctcagagcggggtgaggctgtgatgggggtctcagagcggggtgaggctgtgatgggggtctcagagcggggtgaggctgtgatggggtctcagagcggggtgaggctgtgacggggtctcagagtggggtgaggctgtgatgggggtctcagagtggggtgaggctgtgatgggggtctcagagcggggtgaggctgtgatggggtctcagagcggggtgaggctgtgacggggtctcagagtggggtgaggctgtgacggggtctcagagtggggtgaggctctgatggggtctcagagtggggtgaggctgtgatggggtctcagagtggggtgaggctgtgatggggagtctcagtgaggtgaggctgtgttggggtctcaggtgggctgaggctgttggggtctcaggggtggctgaggctgatgaagacttggagcctgtgtctgggtagcagcttgttggagtgtgggatgtgacatttaaaaacaagaatraagaataccccgtgctgtggccccgaggtgagcagctactttggtgaactcgtgtcactcacagccccatcctgggtcctggggtgtggtgtgctgtgtggggcccaggcccagtggggtcacaggtacgggggactctggtgcctgggccacagggatctgcacctcactgcgtgcccccacgtcttcagcagtggttggggcctgtggtctcaatcccaggccagccaggcactctggggtctgggcgggtcccgggtccagacagggggaagggctggggaggggctctggtgtggctggatcgcccgtctatggccaggtttctctcctggatcactcagtgcagaatcaaagggcacttttctgcttttgtgtgcagaagccgagggtgaccttgtcatcagaaggggaagyggggcctcagaggcgtgctgctggctccaatccccaaagcctcctgggcaggaagtggaagggccccatccccacggtcccyggcagcgggagctccctgaggctgatggtgctggtgtctgtcgaggaagacaggcctgaggagctgaggcgggaggccagctayggtccacggcctggacacagattcctgtgcgggactggggcagtaggtgggcatctgtgctggccatgttagctcccaggggccccatgccatctgggctaaagcctgggccttgatttcctgaacttttctgggaggcactccacgggcgagacaaggacccatgaacagggcacttcttcgaagcctacgtgcacctcraaactcttgcaacatttgcatttttctccctaatagttcagtgtttgttttattataaacaggaaaatttaaatrttgtagttagagtttttttcttcttcttagagatggggtttcactctgtctcctaaggctggagtgcagtggtgggatcatagctcacttcagcctcaacctcctgggctcaagccgtcttcctgcctcagcctcccgagtagcacgcatcaccagcccagctaattttctgtctttttttttttttttttttttttttttgtagagacggggtctccctgtgatgcccaggttgttcttaaacttctggcctcaagtcatcctcctgtctcagcctcccaaagtgttgggattacaggcatgagccaccgtgcctgcctgcagttaaacattcccccacaaaatactgggccacaccgaggctagtatgaaagttgcagccctgggtatgtgtgacctgagagccccttggcagccatggggagcgatgggggaagctggggcaatgggaaggggtctaggcacacgagccctcgggtcctcacctcccacgaggcagggtcccaggctgcctctactcaaggtggggcagcaaaagaatcgccctctagctgtgcagaccccctccccctccaggtctgcacaccgcccaaggctggccctggacttctggtggattcaagtactcaggtggggagagtaggaggccagtcgcacggagccctccccaacgcacagtgcctgcccagctcaggtgcctctgaggtgtagattctgagcaggttctgggatctcctggcccccagcgggggctgccacaggagtataggcccaacaggaagggaagatcccagcgattggttccagtgggttctggggatgtcctcggagcctggcctggctcagggtccctccaaaagtccctggaacgagggtgaagtgttgctcatgaatcagagagaaagcaagcaggaccctcaagaagggaggagagagaccaytgggcgtgcagcactttgcactcgggggaagggctcctgaaacttggaagtcagcaaatatctgctgtacttcaccagaggtgggatctaaggagacagaatgaagccagggggcagaatgtttcgtttctgtctgaaacctgtgccctscatccctcatggactggggacctggagttcccggggaccaccgtggggaaatgcgtcccagcactaatggtccccagcagctgcagtcacggggtttgggcgctctcccctcctgatttgggggaccttttgtgctcctctgggcagagggaggaggcagagggaggaggaaggcccttcgctgtgggctgagtccttcccaccttccataccagcccagcaggaagccactgcaggatgccccagaggacagcctgatggttgggggagaggcttctcccgccctcacccctccgggttcttcctggacccactgagtaacccaggtggtgggacgtgtggctgtgagtcctggactctgggcgctcaccagcagctccgtctcacacctgcctgcgtgtgacaccagcaccccttatgatgaggaaacaagtttgcccagctgcaggggtggccgagtcaggatgactctagcccgtgtcctggacaccagaccctgcccaggtccagccggggctggtctcagccttcctgggctatgtcgcggagggtgttggggacagcgagaggctggcgtggacagtggaggggtgactttgtgggtggtcctgatagtgacggagaggaggatactcagctccacccctgggcggcccctgagcagcacgrctgggcctgaaggggcagggctgccgtcacaggctctggcccctgggagctcaaggggtgaatccctgatcccaggtgtgggactgggatggggcctcaggctgatgcaggcaggacctccagagctcaggactgggtgggtgggctcacagggaggtaggggcaggccagagtcccagctgtcctggactctgctgtggggaagggctgatgcaggtgtggagtcaaatgtgggtgcctcctgcagccgggtgccaggaggggtggaggggccaccctgggctttgtccgggagcctggtcttcccgtccttgggctgacaggtgctgctgcctctgagccctccctgctaagagctgtgtgctgggtaaggctggtggccctttgggctccctgtccaggatttgygctctggagggtagggcttgctgggctggggactggaggggaacgtggagctccttctgcctcctttcctgccccatgacagcaggcagatcccaggagagaagagctcaggagatgggaagaggatctgtccaggggttagacctcaagggtgacttggagttctttayrgcacccatgctttctttgaggagttttgtgtttgtgggtgtggggtcggggctcacctcctcccacatccctgcccagaggtgggcagagtgggggcagtgccttgctccccctgctcrctctctgctgacctccggctccctgtgctgccccaggaccatgaatggcacctacaacacctgtggctccagcgacctcacctggcccccagcgatcaagctgggcttctacrcctacttgggcgtcctgctggtgctaggcctgctgctcaacagcctggcsctctgggtgttctgctgccgcatgcagcagtggacggagacccgcatctacatgaccaacctggcggtggccgacctctgcctgctgtgcacyttgcccttcrtgctgcactccctgcgagacacctcagacacgccgctgtgccagctctcccagggcatctacctgaccaacaggtacatgagcatcagcctggtcayggccatcgccgtggaccgctatgtggccgtgcggcacccgctgcgtgccmgcrggctgcggtcccccaggcaggctgcggccgtgtgcgcggtcctctgggtgctggtcatcggctccctggtggctcgctggctcctggggattcaggagggyggyttctgcttcaggagcacccggcacratttcaactccatggcgttcccgctgctgggattctacctgcccctggccgtggtggtcttctgctccctgaaggtggtgactgccctggcccagaggccacccaccgacgtggggcaggcagaggccacccgcaaggctgcccgcatggtctgggccaacctcctggtgttcgtggtctgcttcctgcccctgcacgtggggctgacagtgcgcctygcagtgggctggaacgcctgtgccctcctggagaygatccgtcgcgccctgtacataaccagcaagctctcagatgccaactgctgcctggacgccatctgctactactacatggccaaggagttccaggaggcgtctgcactggccgtggctcccmgtgctaaggcccacaaaagccaggactctctgtgcgtgaccctcgcctaagaggcgtgctgtgggcgctgtgggccaggtctcgggggctccgggaggtgctgcctgccaggggaagctggaaccagtagcaaggagcccgrgatcagccctgaactcactgtgtattctcttggagccttgggtgggcagggacggcccaggtacctgctctcttgggaagagagagggayagggacaagggcaagaggactgaggccagagcaaggccaatgtcagagacccccgggatggggcctcacacttgccacccccagaaccagctcacctggccagagtgggttcctgctggccagggtgcagccttgatgacacctgccgctgcccctcggggctggaataaaactccccacccagagtcagtcctagtggggccctctgtgtttcgcactcgtgtggtgggaggcagggagggagcgcgtggctcagagggctggcggacatcttccagggacccttcggggctcttcactttgaggtcccccttggaccctttcaccccttcccacccccacccacctggagcgtgagcaggggctgttggaagctcctggcaggaccacagtagaggcccccagcccaggtttccttgctcaagacagggctgggagcagctgatctccatgtaggggctgcacagcggtgcaagggggggtgaccaaggtcaagcaggtgagggtgggttggggtgggtggcagtgaagggggtggccagggtctgtcaaggaacccagccctcttctccttccttcagggaaaggctggaaaccatgtctggcaggggcaggggttgggtgcccactcaggtaaaggcacgatgtcctgctggtttctgcctctcctgtactcctgcatggagggcatctcgaaacccaagctggaaggacagggcactccagagacctcctgtgagtgtgggccagcacggcctgggctcaaaccccatcctgtcatcccatattgcatgtccacaggcaccgccccaccctgttccatgttccacaggactggagagagatggcagtcatgttctggcagggacatggcacaagcatgcggctgatggcatctcacaggacccaggctccggagggcccatgcccaggagagccccataagggctctgtgcctaaaagggtgcatgcccaggtgggcccatgcccaggaaggtccatgcccaggatggtccatgagcaggagggcctcattcccaggagggtcccgtgcccaggagggctctatgcccaaaagggtcccatgtccgggagggtccatacgcaagggtgtccatgcctggttggggggggtctatgtccaggagggtcccatgcctggaagggtccatgctcaggagggttcatgcccaggagagtttatgccctggagggccccatgcccgggagagtcacgtgcacagagggccctgtgctcaggaggatacatgtccaggagtgtccctgtccaggaggctccatgcccaggaggctccatgtcaagaaagattcatgcctaggagggttcatgcccaggagtgtccctgcctaggaaggtccattaccagaagggcccatgtcaaggagcgttcatgcccaggaaggtccagcccaggagggtccatgtcaaggaggttccatgcccaggagggtccatgctgaggtgggtccatgcccaggagggttcatgtccagaaaggtccatgcctaggagggcccatacacaacagagccctgtgcccaggaaggaccatgtcaaggagaaccccatgcccatgagggtccatgcccagtaagggccatgcccatgagatcctcatgcccaggaaggcccatgcccaggagggtccatgcccaggccagttcatgcacaggagggccccatgcctaaaagtgtccatgcccaggaaggtccatgtccagaagagtccatacccaggagggctgatatggttaggctttgtgtctccacccaaatctcatcttgaattgtaatccctataataaccatagtccccatgtgtcaagggagagaccaggtggaggcaattggatcatgggggctgtttcccacatgctgttctcatgatagtgagtgagttctcatgagatctgatggttttataaggggctcttcccttcacttctccttcctactgtcttatgaagaaggttccttgcttccccttcaccttctgccatgattgtaagtttcctgaggcctccctagccatgctgaagtgtgagtcaattaaacctctttcctttaaaattacccagtcttgggcagttctttataacagtatgaaaacagacgaatgcagtaaattggtaccacagagagtggggtgctgctgtaaagatacccaaaaatgtcgaagcaactttggaactgggtaatagtcagaggttggaacagtttggagggctcagaagaagacagaaagatgtgggaaagtatggaacttcctagagacttgttgaatggctttgatcaaaatgctgatagggatatggacaatgaattccaggttgaggtggtctcagatggagatgaggaatttgctggaaactggaataaaggtgattcttgctatgctttagcaaagagattggcagcattttgcccctgccttagagatctgtggaactttgaatgtgagagagatgatttagggtatctggcagaagaaatttctaagcagcaaagcattcaagagtgctcttaaaagcattcaattttatgcattcacaaagagatgatttggaattggaactcacatttaaaagggaagcagagcataaaagtttagaaaatttgcatcctgactatgggatagaaaagaaaaactcattttctgaggagaaattcaagccagctgcagaaatttgcataagtaactaggagccacatgttaatagcatagacaatgagggaaatgtctccagggcatgtcagaggtcttcacagcaaccccacccatcacaggcctggaggcttaggaggaaaaaatggttttgtcgttggggcccagggccttgctggtttgtgcagtctcaggacttggtgccccacatcccagcagtggctaaaaggggccaatgtacagcttagacctttgcttcagaggtgcaagccccaagccttggtggcttacatgtggtgttgggcctgcagatacacagaagtttgctgcactggtggaaccctcatgtagaacctctgctagggcagtgtagaagtgatatgtggggttggagcccccccacacaatccccactggggcactgcctactgctactggaactgtgagaagaaggccaccatcctccagaccctagaatggtagatccactgatggcttgaaccatgcacctggaaaagccacagacactcaacaccagcctgtgaaggcagctggaagggaggctgtaccctgcaaaacaacagaggcagagctgcccaaggtcatgggagcccacctcttgcatgagcctgacttgaatgtgagacatggagtcaaaggagatcattttggagctttaagttttgactgcccacctggatttcggacttgcatggggcctgtggccccttcattttggccaatttatcccatttggaatgggtatatttacccaatgcctgtacccccattctatctaggatataactaacttgcttttgattttataggtttgtaggcagaagggacttaccttgtctcagatgacactttggtcttggacttttgggttaatgctggaatgaattaagactttgggggacttttgggaaggcatgactggttttgaaatgtaaaagagacatgagattcggaaggggctaggagcagaatggtataattaggctttgtgtccccacccaaatctcatcttgaattgcagtccccacatgtcaagggagagaccaggtgcaggtaattgaatcatgggtgcagtctcttccatgctattctcatgatagagagtgagttctcatgaaatctgacagttttataaggggctcttcccctttggcttggcacttcttcttgctgcgttgtgaagaaggtgccttgcttccccttcgccttccgccatgactgtaagtttcctgagacttccccagccatgctgaactgtgagtcaattaaacctctttcctttataaattacccagtctcgggcagttccttatagcagtatgaaaacagaataatataaggctgcatgccaggcagtcccatgcctaggagggtccatgtctcggggtccctcccaggaaggtccatgtccaggggtccctgcccaggagggttcatgcctaggaggacccatacccagtagagtcatgttcaggagggtctattcacagcagagttcatgcccaggagggtccatgaccaggaggggtctgtgcccaggaaggtccatgccaaccaaggaggatcaatgcccaggaggacccatgtctaggagggtctacgtccaggaggacccattcccaggaggggccatacccaggaggggccatacccaggagaggccatacccaggagggcctatacccaggagacttcatgcccaggagggctcatgcctaggaggacccatgcccaggaggacccatgcccagtagagtgtccacgagggcctattcacaggagggtccacacacaacagagccctgtgcccagaagggcccatgcccaagaggatccatgaccagaaggctctatgaccagtagggtccatgccaaccaaggagggtccatgcccaggagggtccatgtccaagagagtcgatgcccaggaggactcatgtcaggaggttccatgcccaagagggtccatgcccaggaggacccatgcccaggagcgtccatatccaggagggtccatgtccaagagggtcgatgcccaggaaggctcatgtcaggagggcccatgcccagaagggtccatgccctggagggtccatgtccaggagggcccatgcacagtagggtccatggcaggagggcccaggcccaggagggtcctatgtccaggaagacccatattcagtagggtccatgcccaggatggtctatgcccaggagggtccattcctaggagggcccatgcccaggagagcccatatccaggagtgtttatgcccaggagggcctgcactctacagggtcccatgctcaggagggccatgcccaggaggccctgtgctcaactgggctgtacctactttaatgcaccactgtcctgagcttcctgatttttcagaggccctgggtttttgttttgcggggcctgcatttcctgtgacctgcagaagtagctcaggactaggcagtgtggtcccaattccagaagctctggaggcctctgtccccctctgccttcaggtgggctggctccctggcccatgcatgcgtccaggcttctgcctgcagctggaaaccctcctgtccctaactctggggcattggaggcttcagggacaagttggacccagaaccagctcagggagccagggtgcatttggtgggggggtcgggggaccagcagccctgggctcctccatctctgttctttcccctccccacagcacctatggcctttggctgagccagatctttccagggctttggtgatcctcaaagaccaaagtcaggaaacaccacaactgtatcagagcccccatcgttttctggtacccaggtcctgggggtctgcccctgccactgcacacgcatccaggcctggcccattccagcggctccctctccccacctccccacaaccatccgcatggaatgagggggtcttgaaaaccgtacacctggctcccgggcctggctgtgtccagccctgcggtgtggcctgtggtcacggcaccagcctctccccaccctcccccttctgttcctgcattcaccatcacggggcacactgcctagccaggaccaggcctgctgccaccccacccacgaggagctcacctcaaccccactaagcctctcaggctaccctctgcttggaaggcctccctatggggttccctgctcatctccccctcctcaggggcccgagcccttggttgccctttatacaggccatgcccagcctgcccatgactctccccaaaccctagatctgcaccaggtgggaccaggtcacaccattctggaaaggcccatgaaggtgaccaacagttactggtggagtagggatgggggacgcacctgcgtgagaatgagggcagcccacttgggcttttgcaccctctcctctctccatcctgcccccaccacccagcccggtttccctcctgtgttacaggaacccctggaatgggtcctggccc

SEQ ID NO: 17828 - DNA, 119136 bp, Homo sapiens
  misc_feature (1)...(119136): n = A,T,C or G, or insertion/deletion polymorphism (see Tables 1-2)
agctgggattacaggcacgtgccaccatgctaatttttgtatttttgtatttttagtagagctaaaaatactaatttttgtatttttagtagaggtggggtaatttttgtatttttagtagagatggggtttcctcatgttggccaggctgctctcgaattcctgacctcaggtggtcccgcccgcctctgcctcccaaagtgctgggataataggcgtgagccaccgtggctggactggggaatttctttctttctttcttttattgttttgagacaatgtctctctctgtcacccaggctggagtgcagtggcacgatctagtctcactgcaacctcccctccccttcctcggttcaaacaattctcctgcctcaacctctcgagtggctgggattgcaggcttgtgcctccatgcctggctacattttgtatttttagtagagttgggattttgccatcttggtgaggctggtctcgaacacctgacctcaagtgatccactcgcctcatcctctgaaagtgctgggattacaagcgtgagccactgcacctggcctgggggatctgtttctattgattggcttttcctccttcttaggagtcattgtcctgcttttggtttcgttactggatgctggacattgtgaattttacattgttaattgctggattttgttatttttcttttaaattgtgttagacttgggtgaaacatgactgaggttaaatctgtatatgatgagtgctataatgggacacatttaaggatttaatatgtagtcatcatgtaccctattttaagacttactttcatgtcttgtctccaggaaatgttgctttcccaagttcttgattgcttttctgagtgtactgcgttccagccatgatgataggcactgatgtaccatagtgagcaagtagataggttctggctctcatgaaccatgaattccagtgttgaagacacataaaaaaacaagaacacagtagaacaccaggatttcagatagcagtttaatagaggagattaactggggtgtttaggttgatgggtaagctagagctcaggagatgggcaccgcgctcataatcagaacaaacacatttttaacataaagaataattagcaagtggcagggtgtgtggctcatgcctgtaatccagcactctgggaggctgaggcaggcgggatcgcctgaggtcaggagttgggagaccagccttgtcaacgtggtgtaaccccgtctctactaaaaatacaaaaattagccaggggtggtggtgggctcccgtaatcccagctactcaggagaatcgtttgaacccaggaggcggagtttgcagtgagccgatatcacagcattgcactccagcctgggcaagaagactgcaactccgtctcaaaaaaaaaaaaaaaaaaaaagtaattaacaagtagcgacaggtcagccacccagatccgtgaagtgaatgctaaagaatatggccggggcagatttagggagcagccactaacgggagcttagggaggggactcaagaaaggaacaaacttggaagaggccctgacatggagggggtgtcattatgccccactgggtagcagagaggctccctgaggtcctgcaggctgggactgagtgctggagagtgcgtgcctctcagtcccccacacaccactgatgaggagctgcctcagggtaagagcaagatgagaaaagcacaggaacctggagggagaccccttcttcttcaccgtccctgtagtaccctccacccataggaccacacattgtacctacctgctggcagaggagaaatgtttacagggtgcagctccttcattgtaagtgtggcgaagaagggtggatttggagttgagaggcaaaaaaattaattgactcaaccagcctccctcagtaggtgatctttttgctgaggcctgatgggacagtattctacagtctaccagaagccaatcagaggctcactgactaagggtacgaggcaaagggagcaagggcagtgacttaaaagcagaactttgacctgagcaaccttgaaagctgtggtaagaaatacggtgtttgctcctaagtgaagtggaggagaacagaggttttatgtagggagctctgtgatctcactctgctgctgcttggagaatggatgattagtacatacggaaataggtgtgccactagagagagccagtgcagctgtgcaggcaagaggtaggtgatgatggcttagactgggttggaagcagcggaggaagaatgggtggattgtggaggtgcttaggattgaggtggagtggacaactttgctgttagatgggcgtgggatggaggagagcgtgaacctcgcttgttgaagggaacggactcgcttagggaacagcctcttctaccactgccctctccttgccctaccatgcctcttcagtcagaactccatggccttccagccacttttggtattggaataaccacattttcaggtactcaggtccagtctacataaaaacctaaatgtggcttagtgtggtggctcacgcctgtaatcccagcactttgggaaatgaaggtgggcggatcacttgagctcaggagtttgagaccagcctgagcaacatggcgaagccctgtgtctaccaaaaatacgaaaaattaagccaggtgtggtggcgcatgcctttggtcccagctactcaggaggctgaggtgagacgattgcttgagcctgggaggcggaggttgcagtgagctgagattgcaccactgcactccagcctgggtgatagagcgagaccctgtctccaaaaaaaaaaaaaaaaaaaaaaaaaaaacctaaatgtctcatctaattaattcaaagcctcttcccctcatgttaagtgatggcaggagtccccaagggcagagggcggtggtgtatgtcctgcttccttatgcctgtcctgttcctccaggatggagaaggggcactggagcggagacttgggggtctttgttctctgctgggttgtctaggttctttttggcccactagcgctaggcctgtggtcctaatgggtggcccagtggttgctggctctttcttgttggtggcgggggtgctgctttagcatgctcaggctgctgcaacaaaatgccatgggctaagctgcttgtaaacagcggacatttatatcttatagtctggagggctggaaggtctaagatcaaggtgctggcagattggtgcctgggaagggccaagctttggttcatagctggtgccctctctctgtcctcgtgcggtggaaggatgtggcagctctctggggccttctttataaaaggacactaattccattcacgaagactccgacctcatgacctaatcaccacctaaaggccctacttcctgatacattaccttaggggttaaaatttcaacttatgaacgggggcgggcgggggcacaaacattcagaacagagcaaaacattcagacctttgggcacttctgagaccttggtagggacttcgtgctggactgtctagtggaaactgtgtgacacaaccagcctgcccccaaccccctaccactgctgtcccgcactctgccccccttccctcatggtgtaattctggggtctgcttccccagcaggacctatttggggtgggattctttcaggatgacacaagctcttaccctcctgtgtgctggcggcagctgagctgggtcccctgctgtcttttttttttgagacggagtcttgctttgtcaccaggctggagtgcggtggcgcgatctcggctcactgcaagctctgccttcgggttcaagcaattctcctgcctcagcctcccgagtagctgggactacaggcgagcgccaccacacccagctaatttttgtgcttttttagtagagacagggtttcaccatgttggccagaagggtctcgatctcttgacctcgtgatctgcccgccttggcctcccaaagtgctgggattacaggcgtgagccaccgcgcctggccggtcccctgctgtcttaatcctctgcccacttagcaacgctcaggcttttctgctgcagggtcttacctgcaaggcctgcaccagtgtctgtgtgacccaactccacagcacctgccacaggcccttgggagtttccttgtgcttggctcagcagcagactggggtagtgcaagcatctgaacagaccttgccaagtccagcccagggtgagccccaggctccttgccacaggccaccacccgtctctctgggggcttgtctcagtggcttcatgcttgactgggggaggggttggtgaggagagcacacttttccttgtggggaccagagtgggaatagtgcaatactcaagacttaggtgaattcctttctggaagtctctcttgtgactgtatttcttttcctcatgctgtgggggtcagggggacgcaatgattatggagctggcagcccctgtcatgagcctggggaaggctctctagcaccctgcatcaccctgtgggcaccctcagctctgagacctgagccctgagcccctgttcccaaggagcagagtccttctcagggcctcttctagaaggagccttggtgccgatggaagggtaactgagcgggaggaggaacctagggttgtgttgtgttctctagttgttgttggtgaaatccttttggcgtgggacataggaaggtctttgcccaatgttctctctctctttttttttttgagacaaagtctcggtctgtttctcaggctggagtgcggtggcgcgatctcggctcactgcaacctcagcctcccgagtagttgagattacaggcgtgccccaccatgcctggctaatttttgtgtatttagaagagacggatttcaccgtgtgggtcaggctggtcttgaactcctgacctcaggtgatccgcctgcctcggcctcccaaagtgctgggattataggcgtgagccactgcccccggccaagtgttctctttcttaagcctccttgttcctcagagcaggcagtgcaggctatgggattccccaggacggagaggcctctgccccggctgcttgatgcaaggctcagagaggccactaggtttctaccatgtgctgtctcaggcaaccgtgggcatatcactttccagaggtgcccactgaggtggtcattgtgtgtgctgattaggacagtgggagtaaaactgttcctttttaaatttaatataaattaatttttaaactttttaaaaaaatttatatagagatgaggtcttgctgtgttacccaggctggtctcaaacgtctgggctcaagtggtcctcccatctcggcttcccaaaatggtgggattacaggcgtgaaccgccatgcccagccgaattgtttcctttttgtatgtatgtgtgtgtctgtgtgacaatgtctctgtcacccagacaggagtgcagtggggcatgatcacggctgactatagcctcaacttcccaggctcaagtgatcctgtcacctcagcctcctgggtagctgggactacaggcgggcaccaacacgcccggcctattttttgtatttcttgtagcagtggtgtttcaccatgttgcccagcgatccacccacctcagactcccaaagtgctgagattacaagtgtgagccactgtatctggccaagatagtttcttttcaatgtttaggttttacagttttttaaaaggcatttttcctgaacagttaataaaaaattgatgccgtgaacattttaacataactggtctattctgttctctttttaaaacagagccaagattttcttcttcactcctcgcttggtggctcccagccagaggccggcagtggtgggaggctcgctctgggtgcacagacgctgccttcagacaccgcatgctcgtgcgaggcctgcagtgagcgcaggtatgtgacgtgtgtgccacgttgctcacacctgtccayartgacatgcagacctgcatattggagctggacggagwaactgggctaatgtgacagacagcaacaagagtaaggcagttgcttcgctattgagagaaagaaccatatgagtaagacaaaaactgttgctcttgaggaactggcactaggaagcatcctcagaacaagagaaggagtccttaaataatcagaatctaagagcagcctcagtgaatgagaggagcgatgggggagagcctgactggctgcttctcagtggctgaggggagagccctggagctcatctttttttttttttttttttttttttgagacagggtctggctctgtcccccaggccggagggcagtggcgtgatctccgctcaccacaacctccgccttccaggctcaagtgatcctcccacctcagtcccggtatctgggactacaggcgcgcaccaccatgtcgggctaatttttgtatattttatagagatggggcttcgccatgttgcccaggctggtctcaaactcctggactcaaacgattagcccrtcttcacctcccagagtgctgggattacaggcatgagccaccatgcccagcccaggagcacatctaaaaatgctctgtgctctggctcaggaaggaatgcatgtagccaagtgggggccaaagggtgggggcaaagctgcccattaagtaccttggaggtgaaggccaggtcagcagtggggatgtgggtaccctaattgtggacattagccacagatgctcctgtcatctgtgcagtggctaagatcttacgcagagtgcaccctaggagctgtgctggggatgccatcacccccctgcactgacagcagcctgattgccggctcctgggagctgggcaaggtgcaagagcctgggaggtcctctgaggacagtgtgctaggtgaggaagggcagcagattgtggtgactttctaaccttcctgtgttgtctcacagagaaatttcggcagaggcggaccgggaacctcagcagctgcagaactactggtcagaagtgcgctacacggtgcgctgcatctaccgccaggcaggaaccccgctggcagatgaccaggaccagtctctggtgcctgacaaggagggagtgaaggagctcgtggataggtacatactgccctttcctgttgtggccccatgcaaacccctgccctccctgctgcacttggagccactcctttcaggatgggctttccttacagtgctcagctgggtttgcttagcctttggtgcctgtcaagactgcagcagatgaactggcaaaagtgagccccctaggtcaaacgtcttgaatttttctgattttgatgaaacgctattgcctgtataattacacaagaaatgtttctgtcacttgtttgtgtgaagactgataataataccttcctttttgagtccccctgtgccagggatgatgcagagtacttttacaagcactcttgcctttatcaacccaaggagaaaggccgagttagcccatttatgaagtgaaaaaatgggggctctgtgaggttgggtagcttgtgtatgtgcctgtggttcatgaggccaagacagctgaggcgtgcctggccgtgtggctgtttctcatgatgccgcagccgttcttcagcagataccttatgctcagtaaccacacagaatttgaggtggccataatttttattcttccttatagtttgatgtaactttttttttttttttttttgagatggagtcttgctctgtcagccaggctgtagtccaatggcgtgatcttggctcactgcaacccctgcctcccgcattcaagctgttcttatgtctcagcctccagagtagctgggattacaggtgcccaccactgtgcccggctaatttttgtatttttaatagagatggggtttcaccatgttggtcaggttggtctctaacataatccacctgccttgacctcccaaagtgctgggattacaggcgtgagccactgcgtccggcaacataacatatttttatgttttttgaaatgtttcaaatgaaagcaacttatttgagatggccatttcatgggttgattctcatttgggtttctttctcacattttgaatgcagcacatttgggaggcttttttttttttttttttttcagatggagtctcactctgtcgcccaggctgatgtgcagtggtgtaatctcagctcactgcaacctctgctgcctgagttcaagtgattctcctgcctcagcctcctgagtagctgggattacaggcgcctgccactgtgcccagctaattttttttttttttttgagacgatgtctcgctctgtcgcccaggctggagtgcagtggcgcaatctgggctcactgcaagctctgcctcctgggttcacgccgttctcctgcctcagcctgccgagtagctgggactacaggcacccactaccacgcccagctaattttttgtatttttagtagagatggggtttcaccatgttagccaggatggtcttgatctcctgacgttgtgatctgcccgcctcggcctcccaaagtgctgagattacaggtgtgagccaccacacccggctgcgcccagctaatttttgtatttttagtagagacagggttcatcatcttggccaggctggccttgaactcctgaccttgtgatccacctgcctcagcctcccaaagtgttgggattacaggcgtgagccaccgcgccccgccgggagttttataaactgatgtttgctgtgcagtagattctttcctggaggcagggatagtgattagccatagattaggttaactcattgaattcagccaagtattttcagggtttgacctgtgagccactggtattgcatgaggtccctctctgtggtatgtgcttttattagaagttaggtttccagccaagcrtggtggctcacacctgtaatcccagcacttcgggaggattgcttgggcccaagagttcaagactagcctgggcaacatagtgacttgtctctacacaaaataaaaaaaattagccaggtgtgatgaagcacacttgtggtcccggttgcttgggaggctgaggcaggaggagctcttaagcccaggagttcggtgctgcactgagctaggatcgctccactgcacaccagcctgggcaacagagtaaaatccaaagaaaaacacaaaaaaacaacaaagttaggtttcctagtgagtattaggaaaaaatgtataaccttcacgtcaaacccatgacttcacagcttattaacattgcaacttcagtactttagagtagcagccagtgtgtagttgatgtgcccgcatctgttgaatgtgtgtgtgagttagcgaatgagcttcctagcttcttcagcatattgctgtctctctctttttttttttttttttgagacggagtctcgctctgtcacccagggtggagtgcagtggcgcagtcttggctcactgcaagctccgcctggcgggttcatgccattctcctgcctcagcctcgcgagtagctgggactacaggcgcctgacaccatgcccggctaattttttgtatttttagtagagacagggtttcaccgtgttagccaggatggtctcaatctcgcctcccaaagtgctgggattataggcgtgagccactgcaccctgccccgctgccttctttttatataacttaaaaaaaaatctgtttgcaaaagtatcacatggttatttccttaaatttataaaatacagaaatagacaaaaaaaaaaaagagayctaagtccgacatgctaagagaacagtgacgtgggtgtccagtctrcttctaagtttggttgtctctgtcaaaatttgaccttctgtggctttattttaatagatgaaatgcattctgtttcagaggacagttttttatactagtagttgaaatgacagttgtcatgctcaaaaaattaatgtctgtctgaaatatactaaccataataggaatcccatccatctacactatttttttaatccacattttccataaggcttcacatgttccattgcaagattttacttggcacttgtcttttatagcctaggtaatatggcaatttaaaaatagaacaggtgacaactttcttttcttttgacataatatggtatgtaggtgaaaggatttactatgtaaaatccaggagctgtagtttaatacattttacaactcatttctgttagagtgatgaactcaaactgstttctcctggtgatgggttatggacgaatttttattattacatcagtggttttaggtttccatctagaggctcctggattaaaatacaattaaatttaaccatagcaatgccagtactgtagaatacgttttaaaatgtgcattatcggccgggtgcggtggctcacgcctgtaagtcccagtactttgagaggccaaggcgggcggatcacaaggtcaggagatcgggaccatcctggctaacrtggtgaaaccccgtctctactaaaaatacaaaaaattagccgggcgtggtggcgggcacctgtagtcccagctattcgggaggctgaggcaggagaactgtgtgaacccaggaggtggagcttgcagtgagccgagatcacaccattgcactccagcctgggcgacagagtgagactccatctcaaaaaaaaaaaaaaaatgtggattatcatacacatttgtgtcaaaaataatggattatcccaaagtttggcctgaaattcatgaaaatgctcattgcatttgtggcttagtcatgttgcatgtattttttttttcctactcttcagcctacaaattttattttacacacctttattgcttttttggtgggataattgttaaaaaaaaaagataaactgtgtctaaagtttcctcttttgataagcctaatacaaacccatttggattgtacactgaacttctagaaagaaggaaagagcaggctgccgcagatctgcagccaggtggcacctctcctgggatcagtgctttttacttgttaacatataagcctttaaaagagttgtccccagcctcgtgtctgagcatgttgtctggggccagctgctgagaagtggtagcgtgctcttccagctgtgtgagtttacgcaagtcacccaacctgtgtgggccaaaatgtcccctctgtaaagcaggcactgaacccacacacagcgaactgaattagtgcacgtgcacggacagtgctgtacagagaaagctcaataaatgtcacttgctgttccctagtgacactctgtgccccggattccccatccattaggtggggtgattgtgcttctcacaggtggttatgaggaaggtgactgtgtggtcatctagaggtggccacctgtggaagggcttcagaaaagatgctcactgacatcagagcacccatgggccctggtgggcaggccctggtgaccctcttctctgtgcaggctctgcgagagggacccctaccagctgtaccagcgtctggaacagcaagctcgagagtatgtgctggagatgaaggtccgcctgctccggcagctgtcggctgcggccaaggtgaaggcaccatctggcctgcagggcccgccgcaagcgcaccagttcatctccctcctgcttgaggagtacggcgccctctgccaggccgcacgctccatcagcaccttccttggcactctggtaagagagaaaacgtgtttttctttctgtttggatgagctgaagagaagcatgtggcaagaggaagcttctcacgcatgtgtgccgacctcgctgtcacacccccacacactgtgataggcccctcttctctacgggagaggacctgtttcctctcctctttgtctttcctctggactttgccactggataaaagcattgggtggattgataagcaggtgacacctcatggtagtactgtttggaggaccttgaggcccagggaacgaggcatgggggcagtgtgaggggagcactgatgtgtgcctttataaggagacagagaaatctccggtgtcttacttaggttgttcattctttcgttgctgtagacagagctggtattaggtgaaatgcccatgaagagcatgaaggctgtagagaacagcttgtttaccgcccagtggcgttcattcattcatgcaggcatgcatgcactcagcaagccagcactgagttaaggatctgcttgcagtctcaagacaggccctatcaccatccttgccaatggggatctgacagtcctaacaaaagagacacacagatgggtccggttgcctcaaaagaggaatcactacattgggtggaaggagcatggtatagaaatatggttacaagtaggctgcggtcaatcctcaacagcctcagtgcccccacgctttggaaggagaccagagacaagccctcaaagcttccttgactgttactaatagtctatggagtttttcatcacttaaactttattattaaataatacttaactgtatttgggtgctagttttgggtgctttctttcttttaataaagaaaaggaatttatttctcatggttaggaaggctgagaagtctaagtttgaggggccacatctggtgagagctttcttgcaggtggggacttggactctgaacagagtccaaaggtggtacagggcatcacatggcgagagggctgagcatcagttttgggtgctttcttagtggtaaacctacattttgaaacaaatacagtaagcattggccttggtctttatctgattctcaagttgatggaccctcttagaaaaatttacatacagcccgggtgtggtggctcatacctgtaatcctcgcactttgggaagccaaagtgggaggatcacttgagcccaggagcttgagactagcctaggcaacatggggagaccccacctataccaaaaaaatttaaaattaaattaaccaggcgtgatgacgcatgctactcaagaggctgtgaggcaagaggatcatttgagctcagggttgaggctgtggtgagccagtgtactccagcttgggaatagagtgagatcctatctcaaaaagaaaagaaaaaattacatacatgtaattgtaagtcatttcagggggttcacagacttcctcaagcttcactgcgccaagccatggggaggtatctattctgagaagaggtagcgaggtgaatgggtagggtgaggggtgggggtggggcaggggggcagttatcctgtttcaaggtctgagtccactgggtagtgccaccaggcttccttctggtacctcgtccttcctctggcatctctcgcagcacagcctccccgtctctacctgagagtctgcctgcccttcagaggttcaaatccagagcccctcctctgtcttctacaagaacattggctcaggttaagaaggatgctctccagcccacctaaacctggtgcccagagagactctggtagtgaagacagcagctgttgctgctctccagaaaatgctggcgaggtctgcacctcctcagatagttactgtaggatactgttttatgaagctgacaaaaattaatttgaaccatatttattagagcaaattcctagcagttgacatagaaataatttcttgtggcttgaggccgggtgcggtggctcacgcctgtaattccagcactttgggaggccgaggcaggcagatcacctgaggtcaggagttcaagaccagcctggccaatatgatgaaaccccgtctctactaaaaataacaaaaattagccgggcatggtggcgggcgcctgtagtcccagctactcgggaggctgaggcaggagaatcacttgaacccgggaggcagaggttgcattgagccaagattgtgccagtgcactccagtctgggcaacagagcgagactctgtctcacacacaaaacaaaacaaaataaaaaagaaataatttcttgtggcttgaaaaaaatgcatacacccagaagctgtttgattagtgtcttttttcacttcctttacacatagaaatacccacattgatttctaggggtccagcagactagatacccttaactattccttcctccaagggaaacaactgaatttactagataataaaaaaataagccaggcgtggtggcttacggctataatcccagcactttgggaggccgaggtggttggatcacctgaggtcaggagttagagaccagcctggccaacgtgatgaaaccccgtctctactaaaaatgcaaaaaattagcctggcgtggtggcacgcgcctataatcccagctacttgggagrctgaggcaggagaattgcttgaacctgggaggtggaggttgcagtgagccgagatggggccgctgcactccagcctgggcaacaagagcaaaactccgtctcaaaaaaaagrtgaaatcttttaaagtgtatggctgagatggcatgaaagggagtaagtcgtagtggtgaaaaaccaattgaaagctggaatcctgagaaatacatgggcttgaaagtcagcatttgctgtgggtatttcttctgatcctgggagacaagagacaacctagcccaggatggggtctgcacataatgctgggactgtaagtgacgacactagtaaggttgaagtggaaactccgagcaccgaaagggacagcagggatctgcagctctcgtggccttggggtggagatgcagggagtacagcttcccagagacttggtagctgtcagccagctgccacatgagctggagtgtgaataaatgttggtgtggtatgaacagcccaagcctggaagttacttyacagtggtccaggrttgctggtaaagtcaggcagcatgcagatcacctctggaaaccttcaatctgacctcagagaattcgaatagataaaatccccccaaatgagcagctcacagtaaaaaaagtcataaaacacaaggttcatgacagcacagttaaaagccagcagaagcagtagacagaatcacataacaaagatatttaaattttcaaaaaagaatatagagtaactttgttaactgtgcttaaagaagctttgtaaaagtttgaaattgggagttaaggattaatactctaaagaatgataattcagatttgaaaaaatatcaaaactagaaacaaaaactttttttagagatgatagctgagaaattctcagaattactgaaaaatactagtgttcagcaaggaaacgtatcagatttcccaagtaagatgttgaaaaatccttctctggttatagtataatgacagctacagaacatcaaagaaaaagtgatctcaaacacaaaacacaggactttgttgaaaatggtctgtgagatgttataatgtgtaattctggattctgggtagagactacaatgaatctatgtactccttacccagatgcgcagttaatcagcattttgccactctgacttcattatgccttctttttcttccactttctcttccctctttttgatgcagtattttagtatgggtcccagacaatgtgctttttgtcttagaatattccaataagtgtctctaaaaatagtcatccattatcttctgtagccacagttccattgtcacatccatgaagactgacggtaatagtaatttcttaccgactaatgccagccartctctttttatggttgggttattccaatcaggacccaaaaatcttcacaaattcatagccacattattacactgccatccagtgatctatgcagcaccagcttaagataaactcggtgtctcagggcagtaattctcaacagttttggacttaggcccctttatacttaaaaatttaggaccccgaagtgtgcttttttatgcagacttacatcagtacttgctgtattgaaattcaaactgagaaaattttttaaatgcttattgtcattttaaaaatgtaaactctcattagattacataaattgcatattttaacatatattagagaatgtaacaaataatacacttttacattagataatgtaacataaattacatatgtaaaaataactattttccaaaataaaacattgttgcccaggctggagtgcagtggtgagatcttggctcactgaaacctctgcctccccagttcaagcgattctcctgccccagcctcccaaataactgggattacaggtgcctgccaccacatctggctaatttttttgtatttcttttagtagagatggggtttcaccatgttggccaggctggtctcgaactcctgacctcaggtgatctgcccgcctcggcctcccaaagttttgggattatgggcgtgagccagcgcaccyggccaacatatttcttaagaagagtgggtcactcacacctctccagatctctctgtaaaagcagtgggagtctcatctgcattcagtctgttgtcataggttgtctggttgaagttattgaagaaaattcaactttttacagataatgtagttggaaaaaggacgaatttttttttttttgagacggagtcttagttggaaaaaggaataatttgtctttttgtgttttttttgagacagagtctcactctgtctcaaaaaaaaatctcgctctgtctcgctgtgtccctcatgatctcggctcactgcaacctctgcttcctgggttcaagtgattctcctgcctcagcctcccgagtagctggaactacaggtgggtgccaccacgccaggctaattttttgtatttttagtagagtcggggtttcactgtgttagccaggatggtctcgatctcctgacctcgtgattcgcctgccttagcctcccaaagtgctggaattacagccstgagccaccgtgccctgccaggaagaatattttaatagcctcttcaaatcctgatagatcttctctgagagtacaccaacgcgggagagtttcttaatggttagttgcgatgtagagtctgaaactgtatcactgaacttaccctactctgttccgttaaaatccacaggctccagctcaccccatgaatggattctctacttatacatggtttgctagtgtcattcataggtcattttgcaaatattgattcactgagtatcttctggatgttgacagttttattaatataaaaaatgatatttgtttatatcagcactgatctcatcagaaagctctttaaatgtgtaggatctttcaagccaacagcagcaaatgcaaattttctaaagttttcttttttgcttgaaagcttagattttatgattagccacagattgtgtcacttgttttctttgaagcaacatgttaatttgctgtgcaaactctgccagctagttagctcttctgaacagcacccccattctacttgtttttgctgaactcactggatactcttggacatagaaaggtattctcagaaatgcaactttactggagaatgccctcacgtgaggtttattccacactgcctgggggatcaaacaggataatgagtcatattttttgtatttactttaaatattaaagtaaaattgggggagtgggcatggtggcccacacctgtaatcccagcactttgggaggccaaggtgggtggattacttgagcccaggagttcaagaccagcctgggcaacatggtgagatcccgtctctacagaagatacaaaaattagctgagcgtgatagtgtacacctgtagtcccagccactccggaggctgaggcaagaggattgcttgagcctgggaggcggaggttgcagtgagccaagattacaccactgcactccagcctgggcgacagagtgagaccctgtctcagtcaattgaccaatcactcaatatttttttaaaagaaatctaaaaaataaamtaaaattgtcactaggcttaagttatgcttctagtcatctaggaaacacctcaccaggctataatagtgaagtctaaattttcatcgacaaagacagaaagatctcaaatgtcccgttatttcagtctattgtaggaactacattctaaacatcttctcttccttctttcaaacccccaaaccttttttgtagtgggaagtgagaacagtttgcagagcctgcccttaggtcactgacaagcctttctgcctctagctcagcagttcttccataggcctcacctctcgtaggagctgtgaggacacatcctgcagagcccacccctgcatgccccggtccagttatttgagcccctctatgctggttccacgcctgtcgatggggcatgggcagggcactaccaggttcacagggaacttactggaggcattgaattcagcgctaaggacagtgcctggccatgctaggcactcaggtgttaacatgtgttccttaagtaaactccaagttgatttccggttgtgaagtgagtctgatatctgtttgtcttgcatgcctcacctagaggtgtaattttaggttttattaaaaatgccaaatatcttcataaattagccttcacccagtgaccattagcaactggcccagaaagccagacttgtgattccactcatagacaggcaggtggaaatggctatcccagaggtttccaagggaggccaggcaaagcctcagctcttccaggaggcccctccctcagctagttgccaacctggtctgatccaggtgctgcattcactctcatgtactctttgtcttgtagctgaatcgtaagtcaggtcactgcctactcttctgttccccgggaactcctggagagcagcggactattgtagcaggaggtagtcttcgtgtcctcgtacctggcacagggcctgggcagcatgggcttggcatttcacctgcttattattacaagcacatttgtgggttccagcctggggctgggtatcagttacctggccctggtctcctgccacgtgcatttttcctgtaccgagtgtgcttgctctgagataatgcttggtgtgaaacaggagtgatgatgtttcaatctgggaggcactggtgaaaacacgatgaggaaaagtactggaaatgttaacaaaacggaaggttttagattttctgcagatggcatagattcattgctgaatctctcaattcttgtgtttccaggtatgaaaacagagctgtatccagcaaggctggcacacagtggtctagcagtatcactggtgtgctctctccaaatgtgtttataggtgtttactttcaatcattataatcattataatttgttctctcagcccccataccaactagggttatyaggtgacataacagtgaaatctttgtgtcgttcatttgctaaggtctccatcaactcagcttggctatattgtaaacaggagcagacctctaaacccagtccctgtgagtgacccgactcaggagacgtggagtagccaagcatgatgaagtgcagcttccagagctggcggttgttgaagtcaggaacattcacccaaagatgtaacgtgatctgaacacaagtagtgtccgtgtagttgacagagggaagcatggattcacacacgcatggttgtagcaagacttattaaatgtgaacattacatttaggaaaggtaataatggcatcaacctcagtgatcttgtgttgggggcttgctgtacatctctgctgacatcactctctatgatgactgggacacttctaggttttcgtggtattatctaaagtaattgacaagtttgcctacatttattaggaagacaaaaaaccttaactctgatagggtcttgcaagtggagaaattgtgtgtattaattagaatggaaggtttctccaaataggtaagaaaattgttatcctttagcatcgagggacttgatgtatctaaactgtttgaactgtaagggctttcattacattttaaaagtataattgtgagaaatgactctcaaacgtgcagttactgctttgtctctgtgcacacctgtcaccctgtctttgcagcccttctaaacttgccattttagaggggagatgtgctgaaatccatgtccgtgtagtcagagttctgatgcactgtgtgccttgagacatacagggagcagcacttctcataagctgaacactctgggcctgtgaagagggatgtgtgcgtggtggggggaaatggggaggggggagggaatccctctgggaattttctagtctttagcaattcactacatcttctgtttatcttttactttttcttaaccaggaaaatgaacacttgaaaaagttccaagtgacgtgggaactgcataataaacacctgtttgaaaatctggtcttttcggagccacttcttcagagcaacttgcccgcactggtgtcacagatcaggtattttgccttaacccgtatgtgtctttgtggtgtgacagcacagtcttttctcctgactggtgtgcgtgtacccgagtaccactgagtatgaaagttcttgcaggaaaaataacagggcttaaagaaaaagatagtttgggccaaaagctcaaaacctgagaagcaatacaattaaacttttaaatgataagtcaatataaatgctactaagatttaacaccacaaattcctcatacagaaaagctacagtaaatatagcacttttccttgacaagacctatccttggccgggcagctgtggtgtggttcatgctatggctcttggacatgtaggggaaatggaggagggaagaggcccaggtctgagggtgcccaaggccctccggatacagcttggtgtttcccacacattccgttgctacccgaggctctgttgctctgtctcctggtgtagcgcatccatgtggcttcttcacgcttgggaagctggctgggttctatgctttcactgagaaaaaggggtgcagagtgcagcagtcactcactgagtatttgctcggggtcagagtgagaagatttaggctgggcatgtgtttgccctgtggtaccatgttcagttagaaggcatgttcctcctgatgtgacgttactcagcagaacgctgttccctgcactgagtcatgcatgagctaccacaggtctgcagtttggtgattttgttctttggtgttttattctatttaccacatgtgagcacattcccataatacagacccatcgtgacagcagccatctacatttgaccacgttaacctatacttaggggtgtggtggctcacgcctgtaattccaacactttgggaggccttaagcaggcggatcacctgaggtcaggagtttgagaccagccttgccaacatggtaaaaccccgtctctactaaaaatataaaaattagccgggcttggtggcacatacctgtgatcctggctacttgggagtctgaggcaagagaattgcttgaaccccagaggcagaggttgcagtgagccaagagtgcaccactgcactctagcctgggtgatagagcgagatgctgtctcgggggaaaaaaagtcgttagcttcacaaagcaagggaataaattgttgttctgttgactacaccagttattgctattttatttattttatttttgagacagtgtcttgctctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttcctcctgatgtgacgttactcagcagaacgctgttccctgcactgagtcatgcatgagctaccacaggtctgcagtttggtgattttgttctttggtgttttattctatttaccacatgtgagcacattcccataatacagacccatcgtgacagcagccatctacatttgaccacgttaacctatacttaggggtgtggtggctcacgcctgtaatcccagcactttgggaggccgaagcgggcagatcacctgaggtcagatcaagaccagccttgccaacatggtaaaaccccgtctctactaaaaatataaaaattagccgggcgtagtggcgcatgcctgtagtcccagctacttgggaggctgaggcagaagaatggcgtgaacccaggaggcggagtttgcagtgagctgaaatcgtgccactgcactccatcctggaccacagagcgagactccatctgaaaacaaaatacaaaaacaaacaaacaaaaagaatacgtgtattgacccagtctttgtttcctgtattcccaaattttatttgaggggtcctgaccatctccacttcataaccttacctctagagaaagcaattaggtaaaagagaattgaggacaaaaagatcagaagctacacgtgctggctcatgcctctagccccggctacttgggaggctgaggcaggaggattgcttaagcctaggagctggagaccagactgggtaacagcgagaccccatctcttaaaaaagaaaaaaaaagggccaggtgcggtggctcatgcctgtaatgccagcactttgggaggtcgaggcgggccaggtgcagtggctcatgcctgtaatgccagcactttgggaggtcgaggcgggcagatcatgaggtcaggagatcgaaaccatcctggctaacatggtgaaaccccgtctctactaaaaatacaaaaaaaaaaaaaaaaaattagctgggcatggtggcgggcacctgaagtcccagctacccgggaggctgaggcaggagaatggcgtgaacctgggagcggaggttgcagtgagccgagatcacgccactacactccagcctgggggacagagcgagactccatctcaaaaaaacacacaaaaaaatcagaacaaggtgttacggggcgtgtggccagctggcaggtgggctgcagacccttccagtgttccctgtgccctggcctgctccttagccattccttcccttctgtggccactgtgtatcaagattggaaagtccttactctgacccttgcagaagaaaaggcatcggaagagaattcacagtggtgaatctggaatgtggagtaggctttgtccctggttatgacgttcagattcatcaaaagcacttttcatgagaagayatgcatcttgggagaggggctctgaaaacaagattccagggaatctaccttaaaaaaaatattttactggtaagccagtgagttccgtcagcctgtcagactgtgggtgggtgactgaaaccggaagtgcatcataaaactcccatctttttttttttttttttggagacagagtcttgttctgtcgcccaggctggagtgcagtggtgagatcttggctcactgcaagctctgcctctcaggttcatgccattctcctgcctcagcctcccgagtagctgggactacaggcgcccgccaccacacccggctaatttttttttgtatttttagtagagacggggtttcaccgtgaaaactcccatctttttctgtgccctagttctggattttccgtttgctcattgggtatgatggtcagactccaaccatgagccacgtctctagtgtggatgctggatctcaagctgcagtctcacttctcacttttgggacccacaggcagttgagggagaaggataaacacagacagggacagaatgaggccaaccagcacgttccctgagcagcactgacgacgccaggacacgccatgcctttgtgctctgcagctgactcccttgtcagcctgagactaattcaagataawtcagatttgcattgctaatgtacagatacgcatttaacaattcataaaaattttgctactgattacatacaaacaccccttaaagcttctgcatcctatgaaatacatatggtacaattcacccacttaaaatgtacaattcaatgacttttgatatattwcattttttaaaaattatggtaaagtatatataacataaagcttaccattttaactagtgtatatttcaataacattaattatattcatagtgtttataaccattaccaccatgtactttaaaattttttcctcacccgaaacagtaactctacccattaaacagtaactctccattgtccccttcttttttccccatagcctttgaaagtctgtaatgggcagtttccttcccttgactccccaccattttttgtcttaaaatgtatctatgaaagaactaggccatctgtcctgggggtgctttggtctggatcctgcgtgggcgtgttcacagagcagtttggccacctccatcctctktcctgcctgagaattggtggtaggatctgaaggttctggacggctctgctcagatcccctggcaggccaaggcgtaggcggggggtgtttctatcagggggtgcatccctcaggcctgcttctctttgttgtgggtatcagtagcccaatgtgggcttcactttaaatatgtattaattaggctaataaaacttacccaaaccaatgttatttcattctctttatcaataataatgtttcacatacacattggtaacattacagtaagcatattttcatgctgctgtcttgtatttgcaagctcaatatttagatggaaacctgtttgctgagccattgatttaattcaaccctgtggatagtccctgtgactcttttgatcctagcacagctttgcttgcagggaagccctgtgcctgcagattgcttttcaattataccaacaaagatatccacaaaccccctcccccacccactttgctctcccttggctcaaaataatctgaattctataacttggaagagataaattcttacttccaggaggagcgggacaaggaacacatgacagggtataatgccgcatcccaacgttccaggtggagcaagtaggggcaggatggaattgggtagaagctggattctgtgtgaagaatggaaaccagtcacggaagagcaaggctggcagagaagaagtgggagaaaaactacttcacgggctgcagtgtggcagawccctggcgccactggagtccatgtcttaaggagttttgtctcctgaggggcagaaacagccttaggagaacagctttgatgttttgaagtagcctcaatccatgtgcgtcagtattgtttctttcctttgggcttccctaaatgactgcccagttacacctaacctctgctgccttccctggagagactgcaataggtgagtgcacagatggcttcagtagctgcraggttcccaggtgcgatttacctgagggtggagataggtcagaggagaagagggagtcattcctgcccatttcacccatgaaaagatcctaatttccacatagcttgtttattataaaatcattagattgtcattacaaataaaattatgaaaatayagaaaatcgtaaacaaagttaggttttataaataatttagtatttcttatacattttttccctatgtccactatacgtatttttaaacatgctgtagtcatatctttagttaccatgagcatatttccatttcaaaatatatatgtgtatatatacatgaatgtgtgtgtgtgtgtgtgtgtgtgtkaatgggtagacataattataaaattggtaacaagtatctggttaccaagtactgattctcctagatgtgccatgatgcatttggtagcttctagtgtttttatgtaaatagtgctgatccttaaccttgcgcagaatctttgtgctcttgatatattataaacatggtatttgattctaagccatccttgtcaagatgtctttattccacttattttggctcacactgatagacttaggtattaggaacatgaattttttctggtaataatctacatgtgtctccacaccactccccgtcctcctcctgaccccagcccccagccttctgtctcccaatcgccatcttgctcagtcttttcagaaatcgaggtgttttttctcactgtccacctgcatgtgtgtcttttgtttcccatttattttctcattttccatcttgccatctttctttttttttctttctttttttctttttttattgaggcatagtttcaccctgtctcccaggctggagtgcagtggcgcgatctcggctcaccccaacctctgcctcccaggttcaagcgattcttctgtctcascctcctgagtagctgggattacaggcatgtgccaccacacccagctaatttttgtattttttgtagagacagggtttctccatgttggccaggctggtcttgaactcccgacctcaggtgatcccctcgcctaggcctcccaaagtgctgggattacaggcgtgagccactgcacctgaccgccgtctttcttaatacaatataatatagtagacagaaaactgtaactatatttcttcaagtaaatcagattttgttttgctttatttgaaaaccagatctaaattttatgtctcattaagtgttttgttttctctgagccagttgtattttcaagagtaaaataactttgtattcccatatttatttttttatcatttttatttttatctattttaattttttctttgcaattccatatttggtaaactgaattgttaagtcatagtctttagagacatgttgttcagtgctcatttttttcttagaagctgttgtttctttgagcatctcctttttttttttttttttttttttttttgagacagattctcgctctgttgcccaggctggagtgcaatggtgtgatttcggctcactgcaacctccgcctcccgggttcaagcgattctcctgtctcagcctcctgagtagctggggctatgagtgcctgccaccacacccggctaatttttttgtatttttagtagagatggggtttcaccatattggtcatgctggtctcgatctcccgacctcaggtgatccacccacctcagtctcccaaagtgctaggattacaggtgtgagccactgtgcccagctgagcatctcctttttacaagtytgtcctgggtgccttgcatggggatctrttgatccctcacagctccctgctgtggtgcagagtggcaccctgttttccacgttgggaggcgagatgacaaagcaggatagtatcagcaggaagcacatttctgatctctgcttcagagcctttgggttctttcctttgttacaaggccttctctctcctaggctaggaaccaccacacacgacacctgcagtgaggacacatacagtaccttgctgcagaggtaccagcgttccgaggaggagctgcgcagagtcgccgaggagtggctggagtgccagaagaggatcgacgcctatgtcgacgagcaggtgagtgccacccgggaccaccgcaccccgcgcacatcctcagacggccctgttgaaggcagcaccaagtcactagctttgtcctgagctgcaagccaggaattcccgactgaggyccagaggcgcatgtgggtagcccctgtgtgttagctgctggttttccggaagggatgggaaacctgttggcatcacagatggcttgggcctcctgggcctgaggtgtggtggcagcagttggtcaagttttccttggcctgggcacacctgctgtcactcacacgggctgtcaccaggctctgcaccccaggtaggaggtttttctttttttttgagatggagttttgctcttgttgcccaggctggagtgcaatggtgagatctgggctcaccccaacctccgcctcccgggttcaagtgattctcctgcctcagcctcccgagtagctgggattacaggcatgcaccaaccatgcctggctagttttgtatttttagtagagacggggtttctccatgttggtcaggctggtctcgaactcccgacctcaggtggtttccctgcctcagcctcccaaagtgttgggattacaggagtgagccaccacgcctggtccaggtaggaggttttttaagtccaggagctgtttactgagcactctgctgttgagagctcattgtccatctgtcctagtctagaagggagtgcagacacatgcacaggtggcaggtggctcaccaggtggaagacagaagagggagggcacctgctggaggtggatctgaagggagggcactcaggcagcccaagcctgtcagacagagcagggctttgagacggcgccccctccccccgcttcccacycctggcctgcctgctctcctaaagcagggttgggccaggaaggaattgagagcggccctggtttaaagatgacactagtgtgagcaagggtaaagaaggaatgactgagtttctcttttgcacttcggagactctctgtaggaaaatggaacctgggctctagcctaagacatgtgctggttccatgtctgccctggcatggtgagtgccatgtggatgccacctgtggctccttgtcagtgttccttgtcagtgctgtgagggactgggaagaaggaagggactagcatgtgcttgctccctccgagaattgtgtcattgatttcacagctacaggccgtgttttctgttgctgttctctactgcagccacagggactagagctacaaatggtctgttgtttggattttcgcgggttttctcttactccattcttctgcattctcagcctcccaaagtactgggattacatttgtgagccactgcgcctggcctgctggctttttttgaacctgcatcagcttcagtggagtaagttccaacttcgtcacatgcggaattctgtgctgttgagcttgtcttagggcaggtggccctgagactctcccatgactctgcgcctcttccttggctgctgtacgcacagcacgtcagggtgaggaggggcctcagagatcactttggtcctgggagactccctctgtgtcctgtgcctcatggtggggcctgagagagcagttgctgttttgtgttttcttcaaagtgggtgtattcctaattcatgtttttgtctgtttttgcaaccagagactttcctgctgtggcttgtcactgaccagcgacttcttagcctggactactgtgagagcagggtctggatgccaggtggggagggcagagtctcctgctgcagcagcacctcagcagccttcatctcgtgaggcctggagcatcccaggggctgcagctgtgccatgtgggggcagcacagcagagagggcgctgaaagctgcattcccctctgccatctgtgggtgcaccagcccattttcacaagtttgctgttctggtagagggagcaggagttgggggaagctaggacagtgggcattaaccttctccaggaagtgggcatcttcggcagaggctcttcagggctgtggccgtgcaggagggccagtagtgtgtccaggtcaccactccctgggatgttcttgacttgggtcccagggagaaccctgcacggcagtcaacaccagaatgtcccggatctgccccatgagtcttttccctccctacctgcaaaatgagataattatgttaggtgatgttttagtgttgtgtgagcttttaattccaaataagttttttctgtgttatttttaaaaagtaaaactggccaggtgcagtggctcacacctataatttcagcactttgggaggctaaggtgggaggatcacttgagcccaggagtttgagaccagcctgggcaacatagtgagaccttgtctctacaaaaaattaaaaaattagccaggctgggtgccgtgtgtttgtggttccggccactccagagagtgagtgggggaggatcacttaagaccaagagttagaggctgcagtgatctatgatggtgccactgcactgcagcctgggtgacagagtgagaccctgtctgaaaaaaaaaaaaaaaaagccaggcttagtggctcacacctgtattcctagcactttgggaggctgaggcaggtggattacttgagcccagaagtttgagatcagcctgggtgacatagatagaccttgtctctacaaaaatacaaaaattagcctgccatggtagtgtgcacttgtggtttcagctactcgggaggctgagatgggaggatcacttgagcctaggaggttgaggctgtggtgagctatgatcatgccaccacactccatcctgggcaacagtgagaccctatctcaaaaaatgaaaaaaatatataggcatagggacagtaaatagtccctgtgttggtattgcactgtgggctgctggttactgggtgccccacagagcaggggtccctaacccttgggtcacagaccagtactagtccatggcctgttaggaaccaggctgcacagcaggaggtgagtggccggtgagccagtgaagcctgtcagtgtttatagccactccctattgcttgcattaccgcctgaacttctcatgtccgatcagcagagacattagatcctcacagaagcatgaaccctattgtgaactgcgtgtgcaagggatctagattgtacgctcctcatgagaatctaatgcctgatgatctgtcactgtctcccatcacccctagatgggaccatctagttgaaggaaaacaagctcagggctcccactaattgtgcattgtggtgagttgtataattatttcattctatatgacagtgtaataataatagaaacaaagtgcacaataaatgtgatgagcttgaatcatcccagaaccatccccttgcctcacctggtctgtggaaaagttgtcttccatgaaatcggtccctggtcctaaaaaggttggggaccactgctctagagcacatcccatggcacccacgcagggtggtttattgagagcacagaaggagggaggagcatgagatctcaggccatcagtagacactgtgaaggaaagaccttgagaaggaaaacagaaggcgaggggccggctttcctgcccggctcactctcgtcaccggggctcaagggaacgaagcgcacctgctctggcctcacgggtgcggtaggggaagccaagaccaccctggctgggggcagagatgggagctcagggctctgaagcccagggagaggctgctgtgcagggcggggtttcaagactcccagagaggctgcttgtgggaagcacgtgaaaggctccttaatccaagagtgtctctgttgacgacatagtgccacctgctaagtctctgtcttgccaacatgagctgcagtcargttgtattgcattaggtcattgaaacctcccaagtgcataggacccygcctacctttaccaaggaccgcataaaaaaagaggagccccaagcaccttctgggtaggcatggatagccgcccayggtacactctaatggcagcaacggtatttgcctttggcccagagaacgctgtctcagggccctcctccacagtcttgttagtgtttgtagcagtaacagacgtgcagatggagaagctgagtgttggtgaatccactggagggtggcatcagacctggaggggtgtgtgtatcagtccattttcacactgctataaagaactacctgagaccgggcttgatactcacccctgtaatcccagcacttagggaggccaaggtgggcggatcacctgaggtcgggagttcaagaccagcctggccagcatggagaaaccccgtctctactaaaaatacaaaattagccgagcgtggtggcacatgcctgtaatctcacctactcaggaggctgaggcaggagagtcacttgaacctgggaggcagaggttggggtgagctgagatcatgccattgcactccagcctaggcaacaagagtgaaactctgtctcaaaaaaaaaccaataaaacaaaaaacctacctgattctgggtaatttataaagaacagagatttcattgattcacagttccgcatggctggggaggccttaggaaacttataatcatggcggaaggagaagaagaggcaaggcacgtcttacacagtggcaggagagagagagcaagaggggaaatgccacacttctgagccatcacatcttgtgagaactcgctatcatgagaacagcatgggggaaatccgcccccatgatcccatcacctcccaccaggttcctcccctgacatgtggggattacagtttgacatgagatttgggtggggacaaaggtgaaccatatcaatgtgacaggttgacatgacgtcacggcagacgtggaaggtcctgtaatcagggtgtggtagcagcctcgctgcctgtcctcaggacagctctgaccagactggatccccctggcagggaagcataagaggttgctggcctgagtcgtcaagaagtgaccattgtgaagcagacattcagctcgtcccagacagcccccaggaggagagtccagaccccgtgtagatgtgtgtgatcagaaagagtcccttgcaagggtcgttcgaaggcagagtgggctgtagtgtggagatgagttccccatgatagggaatgtggagaatagttggagaggtatttggactaggtgaccatgaggtctcatctcagatttcatttcagggacacatctgtccctgactggggctggtggcctctgtgcctggtattcattgtttmccagggatttgcagagtacccttcatgggaggcacttgtctgcaagtctaagtgcaaatcagccttgcctgtcaacaaagatgacttgggtgtgtcggtgcttcctgtcctggtgttgaacaggagacgctggcctattgcagagaagctttgagtctggaagcttttctgaatggaactcccacctccctttctcctgcatttggtgtttttcttctgtaggattgatgctgttcacttgatttatccctggtgtattagtccattcttgcattgctataaagaaatacctgagactggataatttataaagaaaagcagtttaattggctcacggttctgtggctgtgtaggaagcatggctgggaggcctcgggaaacttacaatcatggtggaaggtgaaggggaagccagcacatcttacgtggctggagtaggaggaaggggggtggggaggtgctacacacttttaaacaaccagatcttctgagcactcgctatcacgagaacagcaccttcggggaaatctgcccccatgatctgatcacctcccaccaggccccatctccaacaatggggattacagtttgacatgagatttgggcggggacacaaatctaagccatatcacctggctttcccttcatgtatcgatataagtttctgaggttgtgaataacttgtaaccttcaggtgacttcagaaaaatagtatagttagtgataacatagggaaaaagatgaaagagaaggaagatgaaccgttaccgagtgctgtgccaaaccccgtgtggctagagcctcactactgcttcctggtgttaccacatctgcagatgacaggaggctcccgagggtctcagccaggcaggcctgttggggtttaggtcagcggtgtcctacgtagcataacatcctgcccctaagagcctggggtgctgtccttagttccacatgtgatggaaatggcagataaagttctagtttcagagattcatttctccaattgaactgtaactaaacacaaaaatgcccttagggaaattcttttactaagactgaaaaatcctttgggaatagtaatttcttcaggtatctgtttcttgaaggtaaacatttattttgaaatattatatatggtattattgctgttgttctagggaaaatggtatatatgtaaaaataacacatacatgttctctctagggagaaaataacagtgtcacttaaaaagtaaagtgtatttctttaaaattgcatgttacattgcttttacaaagagaaaaccagtctcttcactaaagcaaccagaagatgctttttatttttatttatttttttttagacagagtctctctctgtcaccaggctggagtgcagtggtgtgatcttggctcactgcaacctctgcctcctgggttcaagcaattctcctgcctcagcctcccgagtagtagggactacaggcgcccgccaccacgcccggctaatttttgtatttgtagtagagacaaggtttcaccctgttggccaggatggtctagatctcttgacctcatcatccacccacctcagcctcccaaagtgctgggattacaggcgtgagccaccatgcccagccaggagatgcatttttattttcactgtcttgtgaagaaaccatgagaaacaatctgccactaatacaattgagggaaattgagccactttagtaacatccagagaataatagtcattctggaaccatgtatgcatgggtgggaggttgtggggagctgaaaacaacagaaatttatgctcacagttcttgaggccagaagttcagaatcagtatgtcagcagggctatgttcccctgaaggctttgggggcaactgcagtgacccctggagttcttggtttgtggccactccactctccactggagctgttttaatgcactatttaatttaaaacctttgaatgaacattggttgcttctaatcaataacattttagaaattttatactgattcaaaggctttaaaatgttgaatacgtgtaaaataattgagtctctgttcacaaataagtatgtatgtatgtggcaagagagttggtaggttttgtttgtttgtttgagatggagtcttactctctcaactaggcggtggtgtcatctcagctcactgcaacctctgcctgctgggctcaagcagccctcccacctcagcctccagagtagctgggatcacagcgcacaccaccatgcctggctaatttttttttttttttttttttttttgtatttttggtagagacggggtttcaccgtgttgcccaggctggaagtttgaaatcaattatttttatgtttgctgtctgaaattcattctttctctgttgtttgacacatacataagcctgcaggtacccaaatttgttccaaaaaaaaaaaaatttccctgaggctgtgaggagagagtcaaggaagaggtttttattgatgttatttatcaaacaactcttacactgtacactaagattttataataactgcagacatatacaatgaaaagggagaattggcaccaatattgaatcttcccatccaagaatatggtatgtcactcttttttaaggtttttaaaaatatattgtattatggttttatagtttgtaaatcttgacccattttgtgcctccatagtctgtagtttgaggggctgctatgaccggcatcttgagtggggaatgtgtgtttaaagcattcatgctggaaactgggaaaatggagatgccctgtgaccagtcatctcgccagatgccggcattaactcttgtagtttttgagttgagtcttgaatctgggagtctaggaaatcacggtatcttctacaaataatgataggtttatctcatcttttccagcatttgtcccctttttttggcttccactaggaccttcagaccagtgtgaataagagcattgatactggcacccttgtccagtcctggcttcgaggggctgctgtgagtgtttcaccatgaagtttgatgcttgccatacagacttttgatactttctagcaaattaaagaagtttacctttatttctagttgatttaggctatcatttaaaaaataaaacaggaagatgtcaaaattgatggtatgatttttcttatatcaatttctgtatgagttaagagtttaggttacctaattttgagacattcttgcgttcctgggatgaaaccctagtagatcatgatatgtcattctttattccattattaaatttattagctgatatttgatttaggacgtgtgtgtgtgtgcgtgtgcgcctgtgtgtgtgtgtstgtgtattcggacagctatataaaattatttttagagacagggtttcacactgctggccaggctggagtgcaatgacaagatattagttctctgcagcctcgaactcctgggctcaagctctcctcccacttcagcctcctgagtagctaggaccataggcacatgccagtgtgccagctaagttttggcttggtgcagtggctcacagctgtaatcccagcactttgggaggccaaagcagaaggatcgcttgagcccaggagtttgaggccaacctgggcaacatagggagaaccccatctctacaaggaaaaaaaaattagccaggtgtggtggtgtgtgcctgtggtcctagctacttgggaggctgaggtgggaggatcataggcccaggaggttgaggctacagtaagttgtgatcataccactgtagtccagccttggtgacagagcaagagaccttgtctcaaagataattttatttacaaacaaatgaaattttttgtagcggtgggggtcttgccttgttacctagactgttctcaaattcctggcctcaagtgatcctcctgctttggcctaccaaagtgctgggattacaggtgtgagccactgcatccagccaggacttttatatctatattctgaggtataattgagttgtcttggtctttgaggtcttacttgttttgtataaaggttgtgctagcttcatagaatgaattgagaaactctgtgtttttgcaattttcaggaatagtttaaattttctgtcccatgaagggtttgatagaacctaccgtaaaactttggggcctaattcatttttacagggaagaagaacaagaactatagatcttgtctgcctttttcatttatatgacatttattagtgtatttcaggtttccttctccctcgagtcagttttacaaatagaatttggctcaagaagttatccatatcgtttagtaaagggttgtaaactcacacctgcagggctagggaaagtcacggaaatggatgatacagggtagagcggccccagcgttcctgtggtgctcatggccgtcaccaccctcaccttgaaagtgccctcagttgggataggccctagtggagcctggggcatgggtagcgaaggccacacctgtgtgtgcgtgcgtgtgtcctcctgttctctgttaggggcagtccccacttgggtccaacagtcttcacagggccaccagagctgccaggttgtcaagagaagccagaaatctggattattaggtgaaatctcgaacacttttaaaaagaggtgaagtgcaagtcggacaaaatagcccatgagccccttgtttgtaactcttctttagatgttacaaagtatcaacttataaagagactttgtctcacagtttaaaaacaatcttctggccaggcgggcacagtggctcacgcttataatcccagcactttgggaggccgaggcaggtggatcacttgaggccaggagttccagaccagcctggccaacatggtgaaacaccgtctctagtaaaaatagaaaaatgagctgggcstggtggcgggcacctataatcccagctaactcaggaggctgaagcacaagaatcgcttgaacccaggaggcagaggttgcattgagccgagattgtgccactgcactccagcttgggtgatatagcgagactcagtctcaaaaacaaaacaaaacaatcttcatatgtacccatatcctttctcaatcctgatttttttttaatgttacctttttccccctttttcagccttgacagaagcttacagaaccgactttcggttttattaatcacatatgcttctctgtttcctcagtaatttctctttttgcctttaactcctaacttctttgttagttttgttttgctttgctttttaagtctcatatgcctgttaatagctcttcctttcctgtagtctgagctcttcgtgtggcaggaccgagttgccatcatcttgcttatttctaacacattcagggcacataatgggcattcagtaaatagtgaatgttcatccactgtattgacagatttagtcagaatatcttgatttctctttttactgtttattcatctctgtctttcatgtgagaaaagtacttgtgatgagtttgagtaaaataaagaaatacctgttaacatatttgtagtattgtatctttattctgtttgcagatgatgtttctctcatatatatcattttaagaaagtctcctcttgaaaatgtcttgtataattgtcgcaggtattaaagtttttcttttttttctgttttttacatccccttactagatgacaatgaaaamcaagcagcgcatgttaacagaagactgggagctttttaaacaaagaagattcattgaagaacaggtaagcttgtcaataagagaggcaattaaaggaagtagaaatctgtcctgacagcaaatgacttctctgcatgttgatgtgctttgttagaacagcattggaggaccacattggcatgttttgccagcgttaaaaactgttcaagatggtgtttttaatctcaagataaactaattttcacctatttccttatcttccatatacgcctcaagaaaaacccatgtgtattgagtggcctctctatcccacagcagctctgggtattttgcaaaggatattacctgagtccccacagtcccctatgaggcagatggtgccatctgcagtttacatatgaaggagggtgttagggtgaggttaaggatgttgcctgatgtcccagagctggaatgggggcccagcatccccagacagagcgctcagatctccagacattgccaggtgccatgccttcaacatggcagctggcagatctggactctcccttcctcatcttcctggcggtgcctcctccaggcaggcttgtgctccacctttgctggagctgttgggcagagcttgctagtgatgtcctgtatctggtctgggggcccttggcttcatctggaaacttggcttcccctgatctcccatccacgtgccacatcgactctcttcctgttctctgacacttctctccatctcctttacgaactccaacttcattggtctttctgcaaatattggtggttccctggccttgaccccatgcctgtctccacatttgcatgcccgtggtctcctctgggcaccacaggtatacagatggcaccagtgttgtggcatgcttacctcttccctttccccattctgcatgtgtccctgtgcttttgttgttgttgttgttttgagacaaagtctcactctgtcgtccaggctgaagtgcagtggcgtgaactcggctcactgcaacctctgcctcccgggttcaagcggtactcgtgtctcagcctcctgagtagctgggattacaggtgccagccaccacgcctggctaatttttgtatttttagtagagatggggtttcaccatgttggccaggctggtctcaaactcctgacctcaggtgatccgcctgcctctgcctcccaaggtgctgggattacaggcgtgagccacctttccyggccatcccgtccttttgagtggcccttccagctgccacctgtcccattgccagagtgggtccagagttccttctcctttgaaatgcagatgctcaccttgtctgttagaagttgaggtgccatttcctcaatagctccgaggccgaccccttgccctccacgtgccacttttcattcctacagctctgttctcagtaccttgcaagtaccaagcacatggcagacagggtaaaggccgggtttctgcatcaggtgtgtgctgtgagggcgcactgcagcatgtttgctgaagacaaaagcgattagggtctcctggtacccgagccctttgcagctcagcccccagcttgctgccgactccaggtctgctgcccctgtattcctggtcctgtcccgctgaggaagcagtgcccgtgaacatgatacatgtcagcagaattactgaaaaataatgagccatgtctcggggaagggtcttgcaagattaaagcattttaaaatttcctctagttaaccaataagaaagcagttactggcgagaacaacttcacagacaccatgaggcacrtgttatcrtcccggctgagcatgcccgactgccccaactgcaactacaggagaaggtaaggctgggttgtggtgtcagcacgactggcccattgraccttcactgggctgagtggaggcctagaaccgacccttagagagcatggtctagtcttgtgcattggttggcttggtaactgtccttaattcctgatcagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcrgggtcyggctccagctctcccatcacaattcagcagcaccccaggctcatcctcacagacagtggctcggcaccaactttgtaagttgtgactttgtaataaagtttccgaaatttaagtcgccccagtaatgagaaatacatacagtaatgtccacagaagtatgaacatcattattgtgcttttcatgacaagggaccctgaggtttttaatgcagcttttaaaacatgaaatcagtaaacccaaacttttaacactgtttatctgggaaaaaaaaaacatggtaaattaataaaggccagtaaagaaaaaacatgttggtatgcagagaagaagtgtctctaattccggcctcacatctcctcattctcctaaagggtgaccagtccgccgtctgtcctgtctccctgtcagcccagcactcatgcttgtttcatgtcttgctaagaactcaggtgatcgctttagcaagcagttgaaggtttctgtttttcatgttcccgcatgattagaagtacattgttgtgcagctgtcaccaattcacattgtagttggctgttcccagatttcttcagagttgtgaccctgtcatttggggaggcttcacatgctaatttccaaaagggttgcacttgatcatatgtagttgccaaagtcagcttaggtttagtttacgtgtatcgtagagcacacaggcatcatgttccatgtggaagtgtgcagtgggagagattgttgttcctgaccttggctatgcagcgtttctgggatttctctgaccaactgacttgtgttcattccttctgtctggatttctcatggtgactgacgttttccttcagtctttccattttcaatttgggcttgttctcagacaaaataattctgaaaggactggtttaaactcactgactctcttcatacaaagattgcaggctgctgtttattgccttagagacactgtgtactctccagggcacaagaaagagtgttgacatttttgcagctggctgttatccaacttcttactgaaacataaaaattaaacatatatagcctaatgaaaatttaagatggaaaatttcatccctgttcatttgtcacagctgctgatgtcagttatrgtctcttgtgtcacgtgtggtagtggaagaaattggctgtgggagcctttctccttgggccggaactgcccatcaccagttacggggagcctaggttctcgggacatctgggccttcagcagcttgtgatcaatgtcttccaaatgtaaactatgatttgaaaatctccagtgttatcttttcatttgtattgtctctttcttggtgccttttctaagttggttaaaaagaacaatgtgattgtagtcagtgtaccacacagtacttcctggatcttatgggttggatctttacggagctagggctggtgaagcctcctgctgtcacatggagcaaatggctgagttacttcactagaacctcagttttctcatctgtaaattgtgcctatggtcatcctcaggagtgtgtatgagcattggcccaggcagcgtcccaggtgcagtgggcctgcaggaagccctaggactctgcaccttgtgggtgctgtttgtacttacctctggtgagctccagactctagcacgttacttgtaatgtgttgaaaagacaccggaatttggtagtcctggacactcttcactcattctaggaagtgagatcacgacgagttcctagggttttgccttctggaggttgctgtgtgcccaggctgaagatggactcagtgcatgtttttgtggaccttggagcatcttattgcactgagcttaaatgtgccagctcttttaatgcaccagagctgcatcttaagtggtctctgtaggctaaagccttgaaatctgtttaaaattaatttcaggccgggtgcagtggctgatgcctgtaatcccagcactttgggaggccgaggcgggcggatcacgaggtcaggggattgagactatcctggctaacacagtgaaaccccatctctactaaaaatacaaaaaatcagccgggcgtggtggcrggtgcttgtagtcccagctactcgggaggctgaggcaggggaatggcgtgaacctggggggtggagcttgcagtgagccgagattgtgccactgtactccagcctgggagacagagcaagacactgcctcaaaaaaataataaaataaaataaaattaatttcagtaaatttttcatttgcctgttgcttagatgtcttgctaaagctgatatttaattacgatcatgagtgaccaggccatgactggccttaaagcaaaaaaaattagtcttctgttacataagtgcctttaaagttttgttcaactgactatttctgaaaatttcagccctaagttgaaaaagcaaacactaaacagctaaggtttaaaaagcaaacactaaacacctaaggttgccatcggtacccctttaattttaatcacaaattgtgttgtcttgggagtagcagagagactagttttataccagcgctcttcaggtcaaatggaaacgttaatcagtctggttaaatttttgtagtttccttaatatttctacttttggaggtttttctgtttgttttttgttttttactcttccaaatggcacaaatgttaatcttccaagcatttttctcatgttgaggttactaagaaatgttagtggtaggaatgatacttaactaatactctttgtaaatgaaagccgtgatctgtccaggaaatatctgtgcttagtggctggtttactcattgtctttcacaattgaatgacctcacagtgaccatctctgcttgtgtcagttgtagtgatgatgaagatgttgcaccattgtcagccaaatttgctgatatttatccattgagtaattatgatgataccgaggtggtggccaacatgaatggaatccacagygaattgaatggtggcggggaaaacatggccctgaaggatgaggtatggacatggcttcttcgtagcaacaataaatgacataaaatgatggtctgacattttaatattttatattactctgttttgaaaagtgcaaattacaaaagattgtctttaaagtctcctcagataagcagtaccagcagtagttcctcagaagctgatgatgaagaagcggacggcgagagtagtggggagcccccaggggccccgaaggaagatggagtgctgggaagcaggagccccaggacagaggagrgcaaagcagacagtccacccccatcctacccaacacagcaggtaggactttgcttgctgttttgccaaggatctctttttctgtgtgtattttctctaaacatgagcattactgaatacaaaattattttgtttcccataatttctgaaggttagaactgaagagagtcaaggcatacttacaatctccatttgaatcttgtttttcttgctcgaatatcaatcttgatttcgcawcaccccatagcagctctgtggaggccttttttgtctgtatagaagcaaagagaggagttaaaaaaaaatagtggaatattaaaatttcaggaaaggtttgtttttcctgttcattatctgttcttctgttagccaaaggtgagggtaccttattagctttttttctcagaatttcataaatagatgcttaaacaagtttttggccgggcgcagtggctcacgcctgtaatcccagcactttgggaggccaaggtgggtggatcagttgaggccaggaatccaagaccaggctggccaacatggcaaaaccccgtctctactaaaaatacaaaaattagctgggcatggtggtgggcacctataatcccagctacttgggaggctgaggcacaagaattgcttgaacctgggaggcagaggttgcagtgagccaagattgcgccactgcacttcagcctgggcgacaaagcaagactctgtttaaaaaataataataacaacaataataataagcagtctttaaatgaaagaacaaatgaaggtcaaagtgcttggctgatttattttattaggtaatataaatgtaacactcagatggtaaaggtgatgttgaaaggtctatctgggaagtctgaccacatctccttaccagttttttcttctacgtataatgtttttgatgtcttatccaagaaaactttgcctaacacaaaactgttttcttttagaagatttataattttagttcttagattctgtttgactcagcatttagttattgtgaggtgaggatataaattcaccttttctgcatatatagatatccaattgtttcagtacggtttgtcagaagtaccctattgaattgccttggccatttattgaaaatttattgaaaatcaatggactgtaaatgtaagagtttatatttggacattccattctgttcatttgatctctgtgtctgtccttacacccatagtgcatttgacaattgctttatggtaagtttaggaaaatgggatagggtcttccctccagcttggtacacctttctctctctcttttttctttctttttttttttttttttttttttttttgagatggagtctccctctgtcacccaggctggagtgcagtggcgcgatctcgcctcactgcaacctctgcctttcgggttcaagcaattctgcctcagcctcccaagtatctgggactacaggtgcacgccaccacgcccggctaattttttgtatttttagtagagacggggtttcactatattggccaggctggtctcgaactcctgaccttgtgatccgcccgtgttggcctcccaaagtcctgggattacaagcgtgagccactgcacccggctggtacacccttttcaaaatcgtttatgctgctcaaagttctttgcattcccatataaattttaggatctacttgtcaactacaaaacgcctccttggatcttgagggattgcatcgaattcttgaatatatatttagaattctccagtgaaatcctctggatgtggttgtggtcttttatttgtgggatgatatagatcaatttagggagaatgcaatcctaacaaaattgagtcttctaatctgtgaatatgctttatctttccatttatttaagtcatctttaatttttctcagtagttctaaaaaaattccagtctttgtgtctggaatatataagtattatgtgttttcattcacagtaaaaggtattttctaattttgatttccaattgatcattggtaatacatagaaatacaattgatttttttatattggtcttgtgttctgcagctttactaaacttgtttattctagtagggttggttctagtaggtccttttgctgttgttttggtagattactttggattttctatatacaagatcatgttgtctgcaaataaagttttagttcttcctttccaatctggatgcaatgcttttaatcttcccttccctttcccttctcttttctttttctttccttcctttcttctttttaagaaacagaatctcactctgtcacccaggctggagtgcactgctgcagtcatggctcactgcagcctcaaacagctgggctcaagcagtcttgctgcctcagcctcccaggtagctaggactacaggtgtattacaactacaggcatgcgccaccacgcccagctttaaaaaaaaactttctgtagagagagggtctcactatgttgcccaggctggtcttgaacttctggcctcaagccatcctcccatttcagcctcccaaagttttaggagtataggtgtgaggcaccatacccagtctggatgcttttaatttcartttctttttctttttttttgagacggagtctcgctctgttgcccaggctggtgtgcagtggtgctatctcggctcacggcaagctctgcctcccaggttcatgccattctcctgactcagcctcccgagtgcttttaattccttactcttgccttattgagctagctggaaactcagtacagaatagaattgttgcaagcagatatctttgccttgttcccaatcttagggggaaagcatttaatctttgaccactctttaaatgtgatatcaagtataggtttttcatagatgccctttattgggttaaggaaattctattctactcctaatttcttgagttttttcatgatttgaatattgaattgtattgaatattgaattgttcagtttttcaaatgtcttttctgcatgtgttgcgatcttgtggttttcgttttttattttgttaccgtggtgtgtcacatcagttgatttaaggatattaaatcaacctgtgttcctgggataamtcccacttggcggtggtatataatccttttcatgtgttcctgagttggtttgctaatattttgttaggatttttgcatctgtgttaatactaataaaatatattggtctgtagtttcctatctttgtgatgtmtttgtctgactttggtatcagagtaatactggcttcataggatgagttaggaaatgtttttttcacttatgttttctgaaggagtttgtttaagattgagatttattaaatatttgatagaattcaccagcaaaatcctgtaggcctggtctctttttgtgggaagatctgtaattactaattcaagtttcatttgcttgtaataggtcttttcaaatttcctatttcttactgagtgaatttcaataatttttgtctttgtaggaatttactcatttaaattgtctaatgtgttggcataaagttattctatactgttataatcctttttaattctgcagtgcctgcagtgatgctaattcttgatttgggtaattttatcttccttttaacggcttcagtcacttgggctaaagatttgtcaatttctctgttttcgtttctgtgtcattggtttccattctgaaattgattatttctttctatgttctttgggttttgcttgctcttccttttctagtttgttgaaacaaaagcttagatgactgattttagagcttccaaatttattgagacttgttgatggcctaacatatagtttacctagatcctgttctatgtgtacttgaaaataatttgaactttgttcttgttgtgtggagtgttcaagaaatgaaagtttgatcaaattggttgatggcattcttcaagtcttctgtattgtcttggtctatccaggctaccatgtaaggacagtaaccccattcctgagagtagagccttccaaagtccttatcgcctaataccatcactttggaggttaggctatcaacatatgaattttggaggggcacagatactcagatcatagtatatattcttactgattatctgtctggtggttttatcggttactgagagaggcatattgaagccttcaagtttaactgttggattatttccttctcctttcaattcttccttgttttggttcatgcatttgggggtgatgttattgaattattgttatagctcccctgatatattgccccttttatcattatgaaatgtttgactactggtgtttcttaacgtccgttttatttgttagtatagccactccaccttcttgggttactgtgtacatgtattttttcatccttttactttcagtttctttgtgtctttgaatctaaaatttgtctaacatcttttagttgggccttgcatttttatcctgtatatgtcagtatctgcctttttaaatattaaacaaaaattttagtgtactattttaattcttctgttgattctttttttaattttcttagtggctgctgtagggttacagtatgcatctcttgtgaatgtcgttataaaaaataaaaagaaacaaaaattaaaatacaatatgtatctctttttttcttagagacagggtcttgctctgttacacaagctggagtggggtggcatcatcatgcctcactgcaacctcaagctcctgggctcaagcagtcttcctgcctcagcctccttagtaagctgggactataggcatgtgccgccatgaccggctaagttttttaattttagtagagacaaggtctccctgtgttgcccaagtttgtctcaaactcctggccttcagtgattctcccgccaggaaatcccaaagtgctaagattacacttaaccagtgtacccagccacaatatgcatcttttttttttttttttttgatacagagtctcgctctgtcacccaggctggagtgcagtggcgcaatcttggctcactgcaacctctgcttcccaggttcaagtgattctcctgcctcagcctcccaagtagctgggattacagatgcgcaccaccacgcccatctaatttttgtatttttagtagagacaatgttttgccactttggccaggctggtctcgaactggcctcaagtgatccacctacctcagcctcccaaagtgctgagattacaggtgtgagccaccacgcccgcccacaatatgcatcttaatttatcacaatctactccagattactactgacttaattccagtaaaatatacaaactttgctccgcaggagctccatttccttctttctcctttgtactattattgtcctatatataattacatttgtatatgttacaaaccaataatatgttttaattactgctttatacagctttataatttctagagcaaataaaagagaaaaatgtatttatacagtgcctgcctgcctgccttcttttctttcttttccttttcctctctctctctttctctctctctctctttctcttttccttttccttttcttttcctttttcttttcctttttttgagacagagtcacactctgttgtccaggctagagtgcagtggcacaattttggctcacttcaacctccacctcccaggttcaagcagttctcctgcctcagccacctgagtagctgggatcacaggcaagcaccatggcacccggctaatttttgtatttttggtggagatgacatttcgccatgttggccaggctggtctcaaactcctgacttcaggtgacctacccgccttggcctcccaaagtgctgggattacaggcatgagctaccacgcctggcctgtatttatacagtgttttctatttgctagctggctagtcatttctggcattcttcattttaaattctgccgaatttaagttaccgtcttgtttttaccttcctttaatatgtcttacaggaccagtttgctagcagttaattctctttttgtgtaaatgtctttattttgccttcattttaaaaaatagaccaggcatgggggtgtctcacgcccagcactttgggaggcagaggcgggcagatcacctgaggtcaggagttcgagaccagcctagccaacgtggtgaaaccccatctcttctaaaaatacaaaaattagccaggcgtgctatcatgtgcttgtcatcccagctacttgggaggctgaggcatgagaattgcttgaacccgggaggcagaggttgcagtgagacaagatcgcgccattgcgctccagcctaggcgagaagtgagactccgtctcaacaataaataaataaataataaatagagtggttgtttttaggaatagctttagactcacagcaaagttgagtgagagctacagagacaccctatacccagggtccccacacacagccttcccactatcaaattccacaccagagtgttactcttgttacagtcatcagctgtcagactgttagaacaagcagtcagttctcctggcagcctggctttctcaagaaggtgttttagtagggtctggggtcatcctagggacttggcctttggctgcaggaagccttaggtggtcattgtgtgccagagttctgcagctctcagtatctctttgtttttatccatcttaaggttcactgagcttcttggatctgtagaccagtgtttctcatcacatttgggaagtggagtgtccaggtgttatttggatgctcttccccctttcctctgggacttggttctgcacatgctggagtgctggctgctctcccacaggcctctgagcgtctgcatactttcccctcatctcttctctctcttcctagatcagttccattgctcttcttcaagttcacagatgatttttctgccattttaagtttgcttttgagcccctttagtgaaattttggtttagctattgtactcttcacctatagaatttatattttactgtttttttgtttctctttttttgtagtaattccctatatgttgaatctttattttcatattttcctttaattctctgaacatgttataacagctgctttgacatctttgtgtgctaatttagtatctgaactcactcctgttaaccgtttgactatttatttcctgcatgtgggtcacacttttttttttccagacaaggtcttgctctgccacccaggctgaagtgcagtggcatgattacagctcactggagcctcgagcctggacctcctgggctcaaacaatcctcccacctcagccccccaagtacttgggactacaggcacacaccaccatgcctggatagtttttgtactttttgtagagacagggttttgccatgttgcccagactaggcttgaactcttgggctcaagtgatcttcccacctctgcctcccaaagtgttgggattacaggtgtgagccactgcgcccagcctaggtcatacttctctttaatctttgcttgtctcataattttttgttgaaaattggacattttaaataatgtgataattttgcattatcattttttcccttgagggtcctttgttgtcttttgtttgtttccttgtttttgttatttcctgggcttcagttgcaggacctgtatctcccacattatgtggctgtgggtgtctcagcttacttcttctcttctcctttttagtttggcttctagaggtctgccctttgtccacctggctgattggccagctgatgatttgggcagaggttgcccatgcaccttgaatccacaggggctccattgttggctgtggggtgaatgcgctcagcactcagccagttctcaagtcagctgtgttggccccttcctccagcccgtgaggtgtcctcagtgcatgcactgtgctctcctggtcagccagcgagttgtggacagcttaagaagcccttccgtggcgctctcatttccagggttctctctgttagatttctgtctcctttgccactcaccccagttgggacctcagtctcaagggaacagagctgcaggcttccctattcattcccttctaagttcactgcttttactgcttcaccctctgcctgaccaggctgctgtttttggtagcagggttggtttgcgctgacatccctgcagtcacagaactcctgtgcccactgccgaccgagtcaggggtggagtacaggtgcaggaaatggaaagagtcccagacaagaaagccagacttgctgttcttccttgaagttctagctgatttgcatgaataaatgtgtcgcggtattttccttgggctgatttccagagcctcagaatggttgcctttgacaattgtgttcagttttacatttgccctgagggaaaggagccactgacctcttcactccaccgtaaccggaagtcgcgtctctgctttgttttggagaatccatgtgtgactacttagaagcagtgtgagcccagtggagcacagccatcccctctctactctgtcgtcttcactagttcccttgtccctgctcacatgtgggaagagagattttctgcataggcataggattcagaaccagtggctctacctgagtctgtctgtggaatgaggtacacctttcttctctgtgcgtcttcttcagtctcagtctcttggggtccctcgttttccttgcatggaaggccctggtcaactcagggtgtcaggaaaagcccacttacctttgtatttgctttgtaactacttggcagaatgtgactgactttaattcataccatttattgtttcactaaataggtatgttttttttctttcctcttaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggtaagtcagggcaaaaagggtctgaaagctcactcttcactgagatcctacaggagtacatagtcaaacaaagaaatctgtgaattagcaacttgcataggatagcatctgctctggataggaaggtctccaagtgtttcctttcaccataatctcttaagcactgtaattktgaacctttacagttgtaacaatcattaaaaacaactgtgaaggtcatagttcttttattcagaattaaatagaacagaaggatttttcaggtgctatttctaacaggttaaacctagggaatatttccacaggagaccagtaatctacttgtgatcttccagggcttgctcttcttcttaatttgataggtaaaataatgtgaatacaacatgagtcctctaacactggctggactctacagggtctaaaatgtctatgctgctttagcatttagaaatacacgagcctaaataaaggaagagccctaagtgtgatgccacagaaaactataacgccctgcaggtgatggagcactggggaggggagggtacagaaaggagaagctgccagaaacccagtgtgaagagcccattcaggaagtggagtgaggatgtagaaataagttgatttttatgcatttcttcccagagaacctcatgtgtatacttagtatcttagactttacagtgaaattcttaggctggtttctttctttggaccttagatagctttgcctctctagttattttgagcttaactttaccagaatgactcaccgtaattctgattgttttcttttttttctttgtaccagttattcttgtccaaaggtagctctaatcagtcaaaaatataatttatttcaaaccctaatttattatttaaaacattgcttttgagctggaacagaaagggaggaggacatgacatggaatgattttttccagaccacagtttttccaaacacatgtgtgttttctcccctctaggggtcactgtgaagtggggtacatgtagcccataagtgaggtttgttgtctctttgctagggagaggcgtaggtggaagattaacagacacaggtttagaatagagtgtaataagtttgccacatctattgtaattacttggcacaaccatccaaattcatgcttaaattttgttagattgaatattgctcagtttgaacttttaatgatgtcttaataatagaatgctttttaataacatttttcaggtatgtagtcagaaccaggctatcttcatggtccgcctggtttgtagcctgattttctctgggtgtaaagtgaggaaggtttccactccctgctgtagcctgaagagagctctattacctagttccaagaaaagataatattctgttagatgtttttgctgctggaagctattcaagaattagttccgaaaaataagtaagatagtaaaattgattattactaaagactgtggggcccctttggttaaaaattgattattttcccgggcttttggccttttcttaggaaattagagatctatatatgggtaaaagaagaaaaacatgttttaggagcatcatttgtatctaatatctgttctcttgatacctgttaaactttaatcatatagaaagatttgaatagaaaagcaaatatggagtcaagccatatacggtagaggtatagaaacttagaaatttataactaaacgttatttctaccacttcagcaaactgaagactattcactgattcatttaaaatatgtggtggccattattatgtggaaacataagatacaattatcaaaatacttcatttgcatctggtatgaaaatgttcgtttctgtaaacaaacttgaattgtcacttaccaggtcttacaagattagtttgtgttatttgacttagtttggcttagttggatgctgttgaccacatctgtgcctaaatgcataatgcgttagcagccctgaaggggtctcctggtccaccagtgagttgtggacagcttaagaagcaaatgagctatatcagaattgcacaaatttcagtgacattggaggaagtttcttagagataatcaacagcaggattgttgggcaagaagttctgaatgtagggagcagaaggtgggtgctgaacgtggagggggccttgtgtactgtgtctgccatcacttttgcattgttggggccttggggagtttctgctgtgctggggtcacagtttttgccttttggcacattatgtcattgtagttgtaattcttataattcatattttaggctttgtgggtaaatatttagtacctaaaaagtttagcatgggtactatgaaaaatttattttctggctggttgtggtagctcacgcctgtaatcccagtgctttgggaggctgacgtgagaggattgattgagcctgggagctcaagaccagagcaacatagtaaaaccctgtctctaccaaaaaaaaaaaaaaaaaaattcttgaaattaaaaagacttgaagactaatttctgttttcaagtgtctccataccagtgacataccgaatttatatatggagtataagttatttgaaagttcaaagtattgctgagaaaaatacagtaatgaaatactacataaaataaaaactgtaagtgccagagaatttaatttccaaatatttggggatctcccaactatctttttgttactgatttctactttaattccattgtgatctaaaagcatgcagtgtataatctctggttttttgagtttattaaggtatgttttatggcccagaatttggtctgtcttggtgaatgttccgtgtgagcttcagaggaatatgtgttctgccgttgttcagtgaagtggtcttcagatgctcattatgtccaattgattgatggtgctcttgagttctgtcagtcagcaactatgttttgactgattctctgcctgctggatctgttcatttctgattgcgtgcccttgaagacttccattgattcatcggtttctccttgcacagttctatcagcttttgccctacaaagtttgatactctgttattagcggcacacacattgagaattgttacgtcgtcttggagaattgaccctttttcattatgtaatgctccttactaccactggtaacttcccttgctctaaagtctgctctgcctgaaattaatatagctcctctagctttcttttggttagtgctagcatggtatatcttccttcattgcttactttttgaaaagatttattatagtaaaatatgcactaacataaaatttacaatcttaaccatttttaagtgtagaattcagtggtattaaatacgttgataatgttgtgcagccatcatccgtctccataactcttttcatcttgtaaagctggaggtttttacctgttaaacaataactccacttctcccagccctgggcatccattattctactttgtctctgtgattgtgactactctaagtacctcatgtacatggaattgtacagtatttctctttttgtgactggcttatttcacttagcataatgtcctcagcgtttattcatgttgtcgcatattgcagaatctccttcctttttaaggctaaataatactcatcatatggctgtaccctattttgtgtctccatcagtgaacacgtgttgtttccatacattagctactatgaacagtgctgctgtaaacatgagtgtacaaatatttcaggaccctgctttcagttgtttggggtgtgtacccggaagtggaattgctagatcatatggtaattgtatttttaatttttggaggaactgccaccgtttcctacagtggctgcaccattttacattcccaccaacagtgcacaagggtttcagtttctccacatcctcattracacttgttattttctgttttgcttttttaatagtaaccatcctcaaggatgtaaggtggtatcccattgtagggctttttgtcttgtgtaaatgaccacagatacattgtagttttgatttgcatttccttagtgtttagtgatgttgggcatcttttcattgttcattgactattcgtatatcttctttggagaaacatctmttcaagtcctttgctcgtttttgaatcaggtttgttgttgttgcattttagttctctttctattctggatattagtcctttatcagatatatgatttgcaagtattttctcccattctgtgggttgcctttttactctgtcgatagtgtctgttgacgcacaacatttaaaaatttttcagccaggcacggtggctcacgcctgtaattccagcactttggaaggccgaggcaggcggatcacgaggtcaggaggtcgagaccatcctggctaacacagtgaaaccccgtctctactaaaaataaaaaaattagccgggtgtggtggcgggcacctgtagtctcagctactcgggaggctgaggcaggaaaatggcgtgaacccggaaggtggagcttgcagtgagccgagatcacgtcactgcactccagcttgggcgacagagcaagattccgtctcaaaaaaaaaaaaattttcatgcagtccaatttgtctattctttgttgcctgtgcctttggcgttacatccaataaatcwttgccagatccagtgttgtgaagcttttgctctctgttctctcctaagagttttgttctttccttacatttaggttggtaatccattttttagttcatttttatatatggtgttaggtaagggtccaacttcattcttttgcatgtggatattcagttgtaccagtaccatttgttaaaaagactgcccttttcctgttgaaggatcttgccatccttgtcaaaaatcatttgaccatatatctgaagttccagttttgggctttctgttctgttccattggtctgtatgtcatgctgataccacacagttttgattgctatatctttgcagtaagttttgaaatcaggaagtgtgagtccaccaggtttggtgggtttttttgttgttttgttttgttttgttttgtttttgttttttttgtagagattgtttgggttggccgggcacggtggcttacacttgtaatcccagcactttgggaggctgaggcgggcggatcacgaggtcaggagatcgagaccatccttggctaatacagtgaaaccctgtctctactaaaaatacaaaaaattagccgggcgtggtggcacgtgcctgtagtcccagttactcgggaggctgaggcaggagaatcacttgaacccgggaggcggagattgcagtgagccaagatcgcgccattgcactccagcctgggcaacaagagggaaacactgtctcaaaaaaaaaaaaaaaaagattgtttgggttattcaggatcccgtgagattctatatgaatttagggtggatttttctatttcttcaaaatacatcattggcattttgatggggactgcataactgcattgaatctgtagatcactttgggcagtatgtacattctaacagtattgtcttctaatcaacaaatatggtatgtgttttcatttatttatgtttttttaatttcttagagcagtgttttgtagtgtgtgtttgtttgtttgtttgtttgagacagagtctccctctgttacccaggctggaatgcagtggcatgatcccgctcactgcaacctccacctcctggtttcaaacgattctcctgcctcagcctcccgtacaggcacgtgccaccacgctcagctaattttttgtattttaatagagatggggtttcactgtgttagccaggatggtcccaatctcctgaactcatgatctgcctgccttggcctcccaaagtggtgggattacaggcgtgagccaccgcgcctggcctgttttgtagtttttatgatacaactcttccacttctttggttaattcccgttggtgttttgttttggttttggwggttttttttttttttttttttgagacagaatctcactttgtcgcctacgctggagtgcagtggcatgatcttggctcactgcaccctccaccacccaggttcaagcgatactcctgcctcagcctcctgagtagctgggattacaggcatgcgcctccatgcctggctaattgttgtatttttagtagagacggggtttcaccatgttggccaggctggtctcgaactcctgacctcaagtgatccgcccgcctcggcttcccaaagtgctgggattacaggcatgagccactgtgcccagccctaaattattatttttgatgctgtcgtgaatggaattgttttcataatttccttttccaactgaccattgttagtgtatagacatgcagctgatttttgagtgttgattttgtatcttcctacttygctgaattcatctattctaacagactgtttttgtggaatctttggagttctctacattgtaaaatcatatcatctacaaacagagataattttacttcttcctttccagtttagatgccttttatttctttttcttgcctgtttgctccggctgaaatttctaatactgtgttgaagagaagtgatgaaagcaggcatccttgccttgttcctgttatttaaggaaaagctttcattcgttcaccattgtttgctgtgggtttttcatatatggcttttattatgttttggtagttttccttctattcctagtttgttgggtgtttttgtaatgaatgggtgttgaatttgtcacatgctttttctgcaccagttgtgatgatctttggctttttccagtctgttaatgtggcatattaacattgattactttttatacatagaattatccttgcattctgggaatgagtcccacttggtcatggtgtatgaatcttttaatatgctgctgaattcaggttgctagtattttgttgaggatgtttgcatgaatgttcacaagcgatactcgtttgtagttttctttcttttttttttttttttttttttttgagacagagttttgctcattacccaggctgagtgcagtggtgtgatcttggctcactgcaacctctgcctcccgggttcatgtgattctcctgcctcagcctccagagtagctgggattacaggcatgcaccacgaggcccggctaattttgtatttttagtagagacagggtttctacatgttggtcagctggtctcgaactcccgacctcaggtgatccacccgcctcggtctcccaaagtgttgggattacaggtgtgagccaccgcgcccgaccctgtagtttttcttacagtgtctttggctttggtatggggatatgctcaggacatgagttagaaagtgttccctcctcttcagttttttggaaactttgagaaagattggtattaattctttaaatatttggtagaattgactagtgaagccatcaggtttggggcttttctttattgggtgatttttttttttttctttgagacggagtcttgctctgtcacccaggctggaatgcagtggcacaatctccactcactgcaacctccgcctctcagattctaagcgattccctggcctcagcctccaaagtaactggaactacaggcacatgccaccacacccagctaatttttgtatttttagtagagacggggttttgccatgttggccaggctggtctcaaactcctgacctcaggttatccacccatcttggcctcccagagtgctgggattacaggcgtgagccactgcgcccagcctattgggtggtttttgattaccagttcaatctccttactagttacaggtctgttcagacttttctatttctttatgatttcgtcttgataggttttgtgtttctaaaaattttttcatttcatctgttttatccagtgtgttggtgtacagttgttcgtaatactttcttttttctttgaaacggcatctcactctgtcacccaggcaggagtacaatgacatgatcatagctcattgcagcctcaaactcctgggctcaagcattcctcctcccttggccccccaatagctgggattacaggcatgtgccaccactcccagctaattttttttttattgttttggactcttccagagagaagacagggtctcactatgttacccagtctggactgaaactcctgggctaaagcagtcctactacctcagcctcccaaagtgctgggattataggcatgagttaccaagcccagccaatacttacttacttttttttttgagacggagtcttgctttgtcacctaggctgaagtgcaatggcaccatcttggctcactgcaacctctgcctcccaggttcaagagattctcctgcctcagcctcccatatagttgggattacaggcgcccaccaccatgcccggctaatttttgtatttttggtagagatggggtttcaccatgttggtcaggctggtctcgaacccctgacctcaggtgatccacccacctggacctcccaaagtgctgggattacaggcgtgagctacagcgcygagcccagccagtactttcttataataccttttatgtttttttcttaattttaatttaattttctgctttttagagataygcttgctctgttgcccaggctggagtgcagtagcacgatcatagctcactggagcctcgaacgcttgagctcaaatgattctcctgtgttagcctcccaagtagctatgattacaggtgtgcgccaccactcccagccccttttatttctgtgtaatcaataataatgtccccactttcatttctgattatagtaatttgagtcttttttttttcttactccatctcactaaagttttgtcagttttgtttctcttttcaaagaactatattttggtttcattgattttttttttcccctattgtttttctrttctctatttcattgatcattaatctctgctctaaattacctttcttctgctagctttgggtttagattgttctttttctaattcattaagatgtgaagttagggagggttttttgtttcattttatttgttgttgttattgagacaaagcttactcagttgcccagcctggagtgtrgtggtgcgatcttgggtcactgcaacctcgacctcctgggctcaagcaatcctcctgacccatagtctcgtagcttggactacaggtgtgtgccaccatgcccagctatctatctgtctgtctatgtatttatttacgtagggacggaggtctcaccatgttgcccaggttggtctcaaactcctgggctcaagcagtcctcctgcctcagcctcccaaggtgctggaattacaggcatgagccaccacgcctatcctagttaggttgctgatagagatctttcttgttttttgatgtgtttgtagctatacattttgctcttagtgcttgctttcactgcgtcccgtaagtttcagtatgttatgtttttgttttcatttgtctctaagtattttctgcttttctttgtaatttctttattgatccattggttgtttccatccctttacttttaacttctcagggtttttttttttttggtttttttttttttttgagacagagtcttcctcggtcgcccaggctggagtgcagtgatgcgatctcggctcactgcaagctccacctcctgagttcacaccattctcctgcctcagcctcccaagtagctgggactacaggtgcccaccaccatgcccggctaattttttgtatatttagtaaagacagggtttcaccatgttagccaggatggtctcgatctcctgaccttgtgatccgcccacctcagcctcgcaaagtgctgggattacaggcgcgagccaccttctcagggtttcatatgtaaagcaggtttcttgtagacatgtatagttgtgtttgtttgtttttttatttttagagatggactcttgctatgttacccaagctgaacttgaactcctagcctcaagcagtcctcccaccttggcctcctgagtagctgggactataggcacatgccaccatgcttgttgttttttgatgtactctgataatctttgtcttttcattggtgtatttgactattcacatttaaagtgattttttgatgtatttagattaatatcagccatgtttgtaattgtttcctattcattatgagtctttttctgccttctctacttttaattaagcgttttatggttttatctcctctgttagtatatcaattttatttatcttttttaaaatttctgcagttgccctggagtttacaatatacattttgaactaatctgagtcctttttcaactaactaatgtaaaaaaggtaacatttaacagattactcccgacccttccctattccctgtgacattgctgtcattattttcacttatccacatgtttatcacccagtacagtgwtgatgattactttcaacagttatcttttagatgaataataataagaagaagatattttactttgtctttattccttctctagtattcttcctttctttatgtagatccacgtttctgaccttctatctgaaggaaatcttttgacatttcttgcagggcaggtctgctggtgatgagctccctcagtttttgtttgtctgaggaagtctttatttctccttcacttttgaaggataatttggctggacacataattctaggttggtggtttttttctttgaacactttagaactgtttaacttccctctgtccttgctggcatggtttctgatttctgacaagatgtcctctggaattcttttcgaattcttttccctgttcttctgtaggtccacttgcccccacccagctgctttcaagattttctcttttttttttttttgttttttgttttttgagacagagtcttgctcagccgcccaggctggagtgcagtggcgcyatctcggctctctgtaaccactgtctcccaggttcaagtgatgctcctgtctcagcctcccaggtagctgggattacaggctcccgccatcatgcccggctaatttttgtattttaatagagatgaggtttcaccatgttggccaggctggtcttgaacccctgacctcaggtgatcgcctgccttggcctcccatagtgctgagattacaggcatgagccatggcacctggccaagattttctctttttctttggtattctgcaggttgaatagaatatgtcttcatgtagctttgggggtatttattccacttgatgttctctgaattctttggatctgtgctgtcagttgttaatttggagactttttagctattactacttcaactgtttctctagtctctccttccagcattccacttaccaggtgttatatctttcgaaactgtcccacaggttttggatgttttgttctattggggatattgtttctgtttttgtttttaattcttgtttctctttgccttgcagtatgggaagtttctgctgacatatcttgcagctccctgactctttccttggccgtgtcgtctcctgatgagtccatcactgatagtcttcgtttctcttagattgtttttattgccagcatttcttcccatctctctgctcacacggcccccttgttcttgcatgctgtctactttttccattagagcctttggcctaccaatcattttcaatttcctgtatgataattgccatccatgttatctccatgttcctgcaaccattcagttgtctctctcagcctctggtgagattgttgttagaccttcttctgttctgcattcctaacactctcttgcatgtttctcatctccttttctcccagttccatgttctgagaacttttttgggatcagtcctccagttaagtgattctgtagtggtgcctagcctgccacttaagtcctgattctgactatatttattatttataagttttaatttactttttttttccaaagatacttagtagctctttatattctcttgttccttgttttttttttctttctttaagcatttcacacatagttaytctgtgtttgaatgaaaccttgagcatccagattcgttttctgctgatatcacctgtgatgtattatttccttttgcggatggagtatattaggaggttatgttttgctcagcttactctgtgagaaccacagccctccatagyggatgcttccctgtgagggttggcgtctgctgatgcgagagctgcctgagacctgggctcctcttgagggcctccagactgctgcccccacacgtcactgtggcgatggtgtacggctgttccttcccctcacctccacctcgcttctctcatgacctcctgatacttcttttcatcctttgcctttgtcgatagcagttggttaccaaagtgttcagtgtcatttctctcagatctagagctaagtagcccctcttacctagcaaggcccagaccaggggggaagaacggccttcaagagaagagcaaagccgagcaggtgcggctgcattttgctgctccttccacgtggcctaggagtaggaagttaacgactacagggcctgaatctataccggaacccaaggcatgtgactttgaatcctgggtctttttcatccaacacggaggatgtactgtgaaacagttggtgtactaagaaacggcctagaagtgaagacagggatgtctctaagtctccactgagaactttgcagtggagcatttgcagtggccactgggttctggccctcaggagttcagtgtatcaagtggagcctggtgacgtggtgtaaggggaggaccgggtgccaagtagccttggtcccttgttagcttcgagggccagggtgtatctttacactccctctctgggttactttgagacttaagtaaaaccactggaaacgcatttaatacagttaaaatatgattcarttaaatatagtttaaagtataagtgcagatttagattgggcaggtaaagctatgtggataatagggtcataaataggttgcaatatggggatcacattgtgatcttcgacctgcatgttcttttagagctgagattcagctcttccagcctgaaaactggcacagccaaagcaaagatggtccttcgcctctttaccaatctctgggagaaataccaaaaaacctgttaagcagaaatacagagagtctgtcatcttaaccttttcgttactggggatacaactggaactcatttttgctcggatgcttagtgttgggaacctctcacgtgtgggcctcatgactcagtctgcggctcttgctcctcatgtcttgcacccatgttccatgtccgagtgggtgtgggtggtagaggacaggcgagtcaccyagctcctggataaactcagtgtgtgcgcagtggaaagcagtttgttgtgtttgcatatttgtgtcagagctttcatttaaagcaacagttttccttttctatggattacttcttttgtctcaaagtggataaaaatgcaaaacttctgctagttgaagctttgtgggtttgtataacgagtgaaattggtgttctgattcaatagcgtagtccacgttctgagagagttactttacagttatatcattggtggacttataaagtcatggtccaaaaatggtctaggtgacagacacctattttttcctgaaagaaatccataagctattgaggtcagtaggcatcttctgcaaaagcattaaagaaaatacaactttttttgttactgatccctgttacttttgtccctacaactgggcttccgtttttgagtgtgtggggttctgaatagtgtgtaaatcaaatgcgtagaatcattgccgtatgtttccaatattacagttatatagatgcattcccttattcctctaagctagacactgttcagcaaacacttattgaacacccaatatgtgccaggccctgtgctagactctaggaagacaaaaatcggttagtcttggcccctcttttcaaagagttcacagtctaaagagaagacaaaaacataatcaaaatatcaaaatgttgtgacttacagatgctaggcagaaaagtaacaccgaagagagaaaattttaaatgagcccacgggtggttttgcagaggaggtgatgctgatgaaatagggttttgaagcataagcaagagctctctgaacacacatgggtggtggagcccaggctctcagccaggcttttcaaacctgaaaccaaacaactcatgrtcgtgtcttgaggagtccaggaggcacttaacgtagcttcagagccctgagagtgcttctagtcatggtttaccagctgggcsggcacaatgggactgctgctcaaagctagcagtttggcatctgtcacgggcttctgccttttacaagaaggtcctcaagaccaagaagtcttctacttgttactttttgtcaattacttctcagcaaagcagctcttagcttatcgctgctttgtagaaatgggtatctattgaaatacgtttttttattttcctggctcttgtcccatggggctcccttaccaaaacratgacttcaggccctttactgtatcctgggtggcccgtctggacctgtttattcctgctgttgagtcctgagtgtctgctctaccctcctctccccctttgccttcctgggcctgttccaggtcagtggactcgctgagctgtccagcagcccagaggggagtgcttcctctctgctccgaagcactgtggaagaagggcaaggtggaaaggtttggtcggttggtcaggtgttttgtgtccagggactctatgtctatataagtagtctctatatagtagtctctaagactattgtcctagaaaatcaaagcagtgcaccatcacactcactgaatacttactatgggccaggcagtgtgctcaactcttaccatacccctggaggtaggtatttccagattacagatgagaaaactaaagcacaaaaagattgagtgatttgcctgaggtcacacagctagcaaaagggagagctggcatccgagctcgccagactccagagcccaaaggccaagacgtgggactagagttcagatctagctgtcacctgaccgtgcctcctcatagtggagccagcagtggtagctcctggactagatgtgcagtcccagctttcatcttgatagctccagaattcctcctttccttgccacsttcactgccattgcttcatcctttctcatcccctgactaacctactcgtcctccttccgccttctggttcatcmacagcattgccacaaattgatctttccacaaagctgaccaaatcatctcactctgctgtttaaatccctctgtgactccccagccccttcagaacaaagtggtacaaagttgtctttggcctggctgctgcccacactcaacctggagcctgtcagggtgtagcactgtcatccctgtacgtgcgccatccctttgctcctaacctcttcctgtcctccctctgccccagccaggccagcaggattctgccgaaccatcgcccattcttaagaaccctccagggaaccctcccrcttgagtttaaagaattcactactcatttctgcatcccagaggatgtgatgaccaggttgcccataactgggcacttctcctctccagcagacagaagtcctgctgagggagaaccgtatgtctgcccagcattagcaaggactgggggagaagggccaggacccagatgtcccacctcatcctagagcgcatataatttggggaaaggcagacatcaaaccaacaggctacaagtaggtctcgaattataactgtggtaagtgctaagagggaaaatgacggattttagtgtgttcagtgggaaggctcgccttggtcttgggtgttggttcctgggaggtgacagcaaaggcaacgccggcttctctgaggaagcgatctttaggccgaggcctgcaggatgagtgcgagtgtggtarcgagctgaggcttgcacattctagagcatggacacagcacaagcagaacttagggccaagaaggtgaataggcgtgtgccggccaaggggaggcctgtgtgtccagggctttggtgagcaggaagggtggaggtggtgggcccagctcccttggaactttgcaggccagagccttgggaagccattgctgcatcctgagcaggggagtgacatgctcgaatttacattcaacaaagatcactctggctgtagtggggagaaggactgggaagagttcgtggtgcaaatgtgcaggctgttgcactgcgccactgtgagaacatggtgctcaggatctcctaaggaggtcagcagccagggcctgttgcctggatagtggctgaggcagagggaggacccaagggggccccagcctgtgcaggagcagccagatggctagtggctcaataaatgcatggatgttggctagccagctggccagaccctgctcaccttcccttggtgccttcaacaatggtctgccccacagggcccagggcggggcttgccaatgaggcagctcctttgagaacgccctggtctttagagcacagtatacaaatttctctaggtcattagatttgtgctgtaccttgcctgggtataagaggtcagtgtaagggttttatccattttcatcagtgattccaaagttgacttattagtgatgatcattaaaatgcttgctgagattaagccgtagaaacagatcttacgacgcacatggcacactcacatgtgacccagtaggaatgtgagaagttactgagttgtctaaagtttgttcagatatactcctcaaggcatcggttgcttttcatatctacatctggttgaaatttgacctgtcgtgtacagtctcataaatcaagtccatgttttgtgagatgtgctccccctgggctgagctcagctcatggcgagcacatcccatgaggctcataatgaattgtctgtctgtagtttaactacttacctaggtaaacagaatattaattttgatatgtgattagaaaatttttttttgtaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctggtaaggaatttgttaaaactttcttgaagttttaaaataacctgagtagactgacatctttgccgtagtctcccgtggaagccctggcgcagctgtagccagctgctgctccaccacctctgtctccagtgggaggcccctcggggctgtcatcctactccatcctctcgcatctgccaccagtcggtcccactgtgtgacagagcggagcaagactctggctccatggctgcccgtcagcccggtgagccacatgggcgtggcctcagcgctgctgagggtctcgtgaccacggtcgggtgcccggccttcaattctcgagcagtggtgacagccagacctcagcccccccggtgcacaggggcaggaagaaagtgccacagttgacttaaatctgtgactcacactccttcctctggttactgcattggcgccacgtggcatctctcccctttactagctccttactccccagctgcctcagccactgaggcccagccgttacttcagtcacagggtcaggggcacctgaaaaggggctggtacctactcctcatctctgtcttcctgcggccagagctcctggcagccccacacccagcccctgcatgtgccagaacagcaggctagacttgacatcctgatctgtgcttaggaaggatttctagctgtgtgaccttgggcaagttgcttggcctctctgagcctcagtttcttcatcttcttaggatgggagtaatagtaccaacctcagaaagtaattttaagactttacgtaactttggaaagcacctagcacaggaattggcacatagtaggtgctcaatacaattttttcttagattaaaagctagttgacttagtgtcatcccagtgggatcctgacttcagtagcacccccagtatcaagtgttcagtcatcagcatgtcttttagggtttagctaagtatgattgctgtcagaagccttaattttcctgttcttctttgaagggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtaaggyttgaaggctcactggccctyggggwctgcaggaaggctgggcttactgacttctcgtctttgtaactcatctttgtaactgccttttacttggcctagccagaggcgtaagtgtaattaactgcccaaaaatgctcacacacagagagctgatcccctaggactttgattagaattttagctgttgtgctagattcctctggggcttcgctgcactgtcttgcttttgtctctgtttctgttcttctgtgatttgagttagggtctcactcttgttcgcccaggctggagtgcagcagtgcagtctcagctcattacagcctctgcctcttgggttcaagcgattctccyacctcagcctcccaagtagctgggactataggtgcccaccaccacgcacggctaatttctgtattttttggtagagacggggtttcaccattttggccaggctaggaggtcattgctttctgagcatgtggcaagatttctcagaagctgctttaggaaaatgctgagcagatgtgagctgacagggctgcctgtcacccagcctagggtacagcccctggctgtcacttagggggcccaaaagcaataatgtgatcagagaccaatggcaactcagtagctggctcgaggaggcctcactagccaaagctgggacagattgagcattaaaaggaatgaggaggctgagtgtggtagctcccagcactttgggaggctgagaggggagggttgcttaagcctgggagtttgagactagcctgggcaacatagtgagaccccgtctctaaaaaaaaaaaaaaagttaaaaaaacaggaagtttgactatagcatacaaataaagtcaagaatccataaggattgggatgctcaaacagagcagtagggtgggaagctccttcttctaaaagcacacctcctctaaatgtgtaagaaggataagagtggcaagtcagcatgctgcgcccccagggtaacagctggtgcaagtatgcagcattcatggaggttaacaagggatatcagtttggggaatggagtatttctactgttcaaaagcagcacccatagggtactgacagattacagcaggatgatgggcgcttgtgttaatcaattctcacactgctatgaagaaatacccaagactggatgatttataaaggaaagagttttaattgastcacagttccacatggctagggaggcttcaggaaatttacaatcatggtggaaagcacctcttcacgggggagagaacgagtrcacggcgaagggggaagccccttataaaaccatcagctctcgtgagaactcactcactatcactagaacagcatgggggaaaccatccccacgcttcagttgtttccactgggtcccttccaccacatggggggattatgggaacaaaattcaagatgagatttgtgtggggacacaaccaaaccctatcactgggtaccgacagattacaaaggaatggtgggtgccagactctggaggaacctagcagacagtgccatgcacaccaccatgaaacagagagacactgggtgcatcccattgccacaaactcagaaggatccaacgtaatatttgcaggatttgtgcccagaacattttatccaaatctaccaagacaagacaaatccaaattggcagacaggtrgcctattaaaaatgttaagtcttgtgaaaagagaaaagggttggaagaggctgggttagtgggaaagctataatggacatgtgaaggaaattggaaaatggaatatgggttataccttagatgagagtatcctgtcagtgttaaatgccagtgaggtgatcatggtattcagcaaaatgtcaaaaaaagagagagggagggagggagggaaagaaagaaaagaaaagagaggagagagaagggaggaaatttttaagtaaaaagctcggtacagtggctcacacctgtagtcccagcactttaggtggccctggtgagaggattgcttgagcccaggggttcaggaccagcctggacaacatagtgagacactgtctcttagaaaaasgtgattttttttttttctttgagacggagtcttgctccgtcacccaggctgctggagtgcagtggtgcgatctgtgatcctcctgcatcagcctcccgcgtagctgggactacaggtatgtgccaccacgcccagctaattttttgtatttctagtagagatgcggtttcactgtgttagtcaggctggtctcgatctcctgacctcatgatccaccagcctcggcctcccaaagtgctgggattacaggcatgagccaccacgcccggccaagaaattttttttaaaaaaccaaactgtcgatgttctgaggagttcataccgaagtgttcagaggtgagtgyaacttgcagacgttcggctaaaaagtgtgtgtgcctgtaagaaataaagtttataaatatgacagaatattaggtcgtgaagatgaagcaaggtgaaggatgaatgggtactctttgtgtgttctttcagattttctacaggtttgaacatttttgaaacaaacttggcagtgactctcgcctctctaaatgcaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcaggtgagccaagtcctgactggggacgtgggagcactttggaaaatgggtgttatgcctcactaacacagctacagaaactcccctgggaccatgcagtggaaaagtctagtgaaatgccgagggaatgcagggatgtccccagcagaggccatgggtagaggggggctcccatctcagcctgtagttttgcagagggaagagcaggggccgtgggccgccatggataggtgggccaactacgcctaaacactgacagcatcgggggtgtgcattgttttttactcattgtataagttgtatttgttatacctagggtggaatcagaggaaaatgaatgaaatgtgtatatagtaaaaacacaatacaacaaacactcaacaggtgtgtttttttgttttttgttttttttctctgagacagagtctcactctgtcgcccaggctgaagtgcagtagtgcgatctcagctcactgcaacctccacctcctgggttcaagcgattcttctgcctcagcctcccaagtagtgagactacaggcatacgccaccatgyctggctaatttttgtatttttagtagagatggggtttcaccatgttggccaggctgatctcgaactcctgacctcaagatccaccttcctyggcctcccagagtgctgggagtacagacgtgagccactgcacctggccagactttctttttaagacaaattctgttacctttgaactcgcctgtttgaagctataccccttttcgaagccccttagtatggaagctgtggtggcaggggcagtctcagaaggagtcattggagagactacgtgttcctgttcagtggcgctctgtgagcactttgagggaccgcctgcatgcatgcgcacacgccatgtctcccacgtgagcccyttgctgcttgtgtatgactccctagtaaccctgggactatgcaccctctgcgctgcctcttgtctgtgaaatgggcaggacagtgggtggtcatgtgcaacaatgtgagtcattgcctcccgggccggccacttgctgatgagcttgtatgcggttttgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcggggtgagtgcatgaggtcagcgcatcatgatgtgggaagtgtgcaacacacgggctcctttgcagaaattctgtactaggttgaattcggggtatattccacttctagggtatatccattgtaaagaaacaaagaaaaatatatgcccaaagatttagccataatgattttttttcttcattttttactttgtggtttttaaggtaactggtaaatcagcagtgaggtattcctactgaatacccattggtaggaggttgttaaccatggtgtatccatatggtggaacattgtagccagcgacagcagcgttgtgtgtgtgcagttgggtttctcttgtttgaatacagagggcgttggtacacacacatacttgtccatctttccagagctgtgatttaatttatacaaccaattatcacccactgtttaagagggatgggtgacaggaatagcaggggcttatagttgttctttttctgctttagctctgtttgcatttcctaaaatgttcacatgtttttatagcaagaaatttggcagtaggattcagggctttttttggcaccaaaaaggaaacccacaaatggatggaaagatactacagacacatttattgacatgaaaagatattcacaccatgttaaataacaggtagaggccaagcatagtggcttatgcctgtaatagcagcactttgggaggctaagggagsatctcttgagcccaggaattgaagaccagcttgggcgacacaggagaccctgtctctacaaaagataaagaaaattagctgagtgtgacagcacacccctgcttgagctcaggaggtcaaggctgcagtgagctatgatcgcaccactgcactccaacctgggtgacagagcaagaccttgtctcaaaaataaataaataaataaataaataaaatacattaatcaggatttgtaattgtttccttttcagtttaaaaaatccacttatgtgcatagctatacatgctttatcaggtttttcatgaatatgtaaaatttgagagtaggtatcaaaatgccacttttgggtgacttgctgataggtttttctctttttctgctggttgttgtatttccttatttttcacaacaaatatatactacttgagtaataaaacagtttatttttggaggtgtggtctgaaatttattatattcaaaatttttaaaacttaagcataactttgttgtttttctcagcctccagctgcaccaacaagtagaaattatgcagaaatgagggaaaagcttcgcttacggctgaccaagaggaaagaggagcaacctaaaaaaatggaccagatctcagaaarggaaagcgtcgttgaccatcggagggtrgaggatttgttgcagtttataaatagctccgaaaccaaaccagtgagcagcacgcgtgcagcgaagcgagcaaggcataagcaaaggaaggcaagtgacagttctcagcacctggaggcgccaggtctgagggcatttgaaggtgccgtgccacgccagtctctaggcagggctgagccacaggaggtcggkgctctgacgtgtgttcacttgcccacaactttgttctgagagccagcctgtctctggtggcctgaactggagactggtaaaaaacttaactttgtgttttcgggaaattacttccccttttgtagaatgggtttgttcttgtgctggccatcatgagggcagcagcagacactccagctttatctgctggagaaccttcttttcgaagaaaggagccgtcaactgtagagatgatagaagaaaggcccaggtgggcttttggggcctgtgggttcagaagtgtctttgatatgagactggggcggggcacttggcacagggaagtcttctggactcaggtctgagcatgtcccccatgctgctcttgtcccactgctgttccagatgaagaccagcacatggcattgattagaggggaggaaaataagtcttcatgggaagacatgagcagttccctccttaccagagggcatggtgtgtcacaaaaagcaaatgtcaaatacaaaaaacgttagccagtcatggtggtgtacgcctgtagtcccagctactcaggaggctcaggtgggaggatcacttgaacctcagaggtggaggttgcagtgagccgagattatgccactgccctccagcctgggtgacagagtgagactgtctcaaaaaaaaagacaacttttttctcttggaggattgtctaaatgcccctatgctggagcagttccaaagagccttctggtttcagctccctaaaagtgtcaggctccaagaaccagacctcagtgagcagatgtgggctgcatgcagagggaacttgtaggttcctggggttctgacagtaggacagtggtcttgggaagaggccaggtttctgtctgcagcatggtcaggcaaaaaggtgaggaagaggacgatcccacagtggaccagagggtgggcccgatgtcctgtgttgttacttgtatcttagctgttgtgattgttctaccctcaagagctctgctcatacctcgcagtcctacagtagatttagactgactattgggcctgattgggaggctttgggggagaagccttgtcccgtgccccagaagactagagactgctggagtgcagagaacacagtgtgtcctccattcaggagcgtccagcatcggggtacccacgatggtccaaggccctgagacstcccattgggattcactggaggcctctgggacgccttcctgagttttsagggtactctccaccccaggctcttgccctctgaccttgcaggtggtctgaatccagacttgaggcccagctgaaccttagaggctgatgtcataggccctgcccagcacccagtcccacctcgagggaccacctcctggtgctttctacgctgcacccattttacagagcagctcacagatgtgtgttgaggctcactggctggctggttgttgaagggacagcaatagttgacctatggactctgtcccgtagcaggtccaaaccgggggcctgtgctggggcagccgttctgctggagaccagggcacctgccyttacatgcttgttatttgtccatatattgacaaggcacgtgtgctggatttagatcagctctgagaggatgccaactggccagtgtgtgccagcgagtgtcctgatggagttggtctctcctctgctcccgtgcaggcccacagctcactctagacactggactscaggacccatccacgaggtggctgctgggtgctgctcctgacatacacatggagaaggatgttaaataatttttacttgaattgtcaaatgaaatttttaataacataccattgttaaatttttatcataatttttaagtttttcaaaagacaagtcaatttgcctgtttaaaatattgtgaaaaataatttacacttggggagtacttttctatttctctaggagaaatgcttttggcagagtttctcataagccccagcatttctaaaggttggtggtgggtggagccgtgctcctaacactgatgactctcatctgctttctgaacacaaagaacagtttccatttgtgcccctggagtttgtgtgcatcactactcaaatgctgtctttacttgggatgaaaattaattttccatcaagttggacagtgagtcatttgctctgtcacatctgtcacactagtgaaaatatatggcacttctgtttatctgctagggtgggaagaaggaatttctagttctttactacacattgctttttgtggtgccatcacagctcattgcagcctcaacctcctggcttcaagcgattctcaaacctcagcttcccaaatagctgggaccacagtcgtgcgccctcacatccagctaattttgatactttttgtagagacggggttttgccatgttgcccaggctgctctygaactcctaggatcacaggtgtgagccactgcaccagcctggtacacatttcttacattccctgttcaagtgaatgcattagccttcgcctggaaaggtgggtttgctcagagttctggcggcacgtgtacagcctcagtactgcccgggcagtctgtggtattggttacatcatccactcggccaggcggcatgatgccctgccgcacctgtgagggggtagctgactccctggatgtgtgctttgcagctgckttgtccttggttactgtgtttagtaccaggtcaaaggctatcgggaattttttgttaactaccacccccccccccacacacacacacacaaataagtaagcatatactttagtaaatagatgaagtttaacaatcctgcagagtaagagaattggaggtgggtgtgtgttaagttttgatttattacagcctcttcagagtttatgttccatatgtgattygtttttgaaattatcttagtttttctgtatgacttaatttttagcactcactgtagtcttaaattgccttctttttgcattggcagctggaggagaaagctcgcctagaagcagaggccagggcccgggagcacctgcacctccaggaggagcagaggcggcgggaggaggaggaggatgaggaagaagaggaggatygtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaarcatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacrtcaaggacgaaaagtcaaacccaacccctatggagcccacctctcccggtgagcatcagcagaacagcaagctggtgctggcagagtcccctcagccaaagggcaagaacaagaaaaataagaagaagaaaggagacagagtcaacaattcaattggtaaatacagaatagcgggaaggtatttctgagcgatgcctggttttccatgtgtgatgtgctagtataggaaaacactgggtttggcatgctctcgccatgtggcctccctcctgtagaaaagagcgtagaggggccaggcatggtggctcacacctgtaatcccagcactttgtgaggccagggtgggcagatcaccagaggttaagagttcgagaccagcttggccaacatgctgaaaccctgtctctactaaaaataacaaaaaaaaattagctgggcttggtggtgcacctgtaatcctagctactcggggaggctgaggcaggagaatcgcttgaacccaggaggcagagattgcagtgagccaagatcatgccgttgcactccagcgtgggtgacagagagactccatctcaaaaaatayatatagagagagagaggatttctaccccctccagttccccaactttagttccccaacatcagtatttcccatgtttgcttcgttattctctctctccctctctctcttrtttttctggacagaaggagagtcacttcatacatgatacccctttaacctaaaatacttccatgtatatttcctcaagataaagacacttataaaaccacagtacagtgatcaaaatgaagaagttgacactgatccaatgctattctctaattgtagaccttactcatgtttctccaattgtccttttaacatcctttatagcaaaaaaaaaaaaaaaaagctcttgttgtttctcctgacatgggatccaatccaggatcccatgtcgtatytctttaatttcctttccttkggatcggtttctctgtttttcatgacctttacttttttgaagagtgcagcgcatttattttttagaggatcccttggtcagggtgcatgccccatgtcttcccagtcaggttcagataccatgttttggcggcaacaccactgatgtggccagtccctgttggtatatcccaccaggaagtgggtgacggtgtctgtcccatcactggggatgggaactctgatcctsggttgagctggtctgcccattttcactacggtcaagttaatatttctcctttgctaattagtaagtgtcttatggggaaatgagtatcctgtttttattgaacattcaccgactagttgtagcatccattaatgattcttgccggaaatgtttattactgtgttgtcatatggtgatttttttttttttttgagatggagtttcgctcttgttgtccaggctggagtgcagtggcacgatctcagctcaccacaacctccgcttcccgggttcaagcgattctcctgcctcagcctctcaagtagctgggattacaggcatgcaccaccacacccggctaattttgtgtagtagagatgggatttcaccttgttggtcaggctggtctcaaactcccgacctcagttgatccgcctgcctcagcctcccaaagtgctgggattacaggcgtgagctgccacccctggcccaaatggtgaattttctaatattattctttctatatttgttacttgccattcaactgtaggaagagctttccaacctcatgtgtttttttcattcacttagttatatcaggatagatccacgaagttttacttgatgctatagatgagaatcttttacgaacactctttatgttgctgttttgattgtctgagattcggtcagtgggagccccctcggaatggctttttccttagaccatttgatgcrgccctaccagcctttaagcattttatactttgtgtcatggttcgatgctccgggctcatctcgtgtcttctctctcccagccctgaaccagccatttctccaaggagccctcctctttcttcaacagtggtgttcagaaacccagacctggacactgccatatggcattgcttttaggccctctcagtcagcagagcaggaggagtgggggtgtgagcatgtgcacacgagcgcctgccacctacacacactaattgctatgtacaagccgtgagttcccacagatatcccagccccactcctgtgctacagtgagcgttctcccttccccgtccacctttgtaactccttagacagtaagaacctggaccccatcatccatggtgcctttactgacttgctgagtcctacaacacaggtaaagggttcagaagtccctgcccttacccgatggaaaactccgggcatgctttcggtatttgttcagttctttttgtctttagcctcagggtgtggtgattacactgaatttacaaatgacttaaattagttcttttcacctttagtacaattacgttattgattgaaaacacacctgattgcgtttttccatttgtgttccatttgttttctcccctacccagttcctctttttttttaatctgttcccacccactccctgtaggtaactaatcagtttcttatttgcttttcttttttacataaaaggtagtgtattatagacataatagtgacttctgggttcttttctacttcatatattctgggaatcactgcacatcagttcgtagagattgtcctcattctttctgcagcgacacggtactccatttaaagtgtacgatgatttctgcagtcactcttctttgtgcgagcgtttaggttgtttctaatgctttggttttttgtttttgtttctgttttaaggtggagtctcactctgtcatctaggctggagtgcaatggcgcaatctcggctcactgcatcctccaccccccaggttgaagcaattctcccacctcagcctcccaagtagctgaaattacaggcacgtgccaccatacccagctaatttttgtatttttaatagagatgaggtttcaccatgttggccagattggccttgaactcctgaccttaagtgacctgcccaccttggcctcccaaagtgctgggattacaggtgtgagccaccgtgcccggactcaatgctttgttttaatcattacacccagtgctacagtaagtacttgtgtgcatatgtgtttccatattgtttggaggtgtttccttggagcactttcccagaagggagagggctgggtcaaaaggtaagtgtgttcccggtgtggtggctcacgcctgtaatcccaacactttkggaagctgaggcaggaggattacctgaggccgggaatttaagaccagcctgggcaatatagcaagaccccatctctactaaaaaaaaaaaaaaaagccacttatctgggcatggtggtgcacgcctgtagtcccagctacttgggaggctgaggcaggagaatcgctggagcccaggagtttgaggctgcggtgtgtcatgattgcaccactgcactccagcctgggtgacagagtgagaccctgtctcttaaaatttaaagcagccgggcatggtggctcacgcctgttatcccaacatgttgggaggccgagggaggcggatcacgaggtcaggagatggagaccatgctggccaacatgaaaccccgtctctactaaaaatacaaaaatcagttgggcgtggtggcacacgcctataatcccagctactcgggaggttgaggcaggataattgcttgaactggggaggtggaggttgcagtgagccgagatcacaccactgccctccagcctggcaacagagtgagactccatctcaaaaaaaaaaaaaaaaaattaaggctgggcatggtggctcacatccataatcccagcattttgagaggccaagacaggcagatcacttgaggtcagaagttcgaggccagcctgaccaacatgtggaaccctgtctctactaaaaatacaaaaattagtcgggtgtggtggcactcacctatagtctcagctactggagacaccgatgcaggaggatcacctgagcctgggaggcggaggttgcagtgagtcaagatcacgccactgcattccagtctgggcaacagagcaagaccctatctgaaaaaaaaawaaaataaaaatttttaaaaaggtaagtgctttcatagtttttttgctagctacgtccaagttctccaaaccctccagtcagcccacccaccagcagcatctgagtgcctgtttggccacagccttgcttatagagtagttgtcaggctttttaactgttgccaatccgttagctacagtaagccctcagtgtagttttcatttgcatttttctcctctaattacaatgaggtcaatatattattaagggctatttctttttgtgtgtatgaattttctattcatacctatttctcatttcttactaggtttttggtcttttcccttttgtatttaagaattttgtttttgtttttgagacggaatcttgctctgtcgcccaggctggagtgcagtggcgcgatctcggctcactgcaagctccgcctccgggggtcacgccattctcctgcttcaacctcctgagtagctgggattacaggtgcccactaccacgcccggctaatttttatatctttagtagagacggggtttcaccgtgttagccgggatggtctcaatctcctgacctcacaatccgcctgtcttggcctcccaaagtgctgggattacaggcatgagccaccgcacccagccaagaatttttttatatggtagggacattagccttttactcatgcagtatgctgcagacattctctcccagttcataagttgtcttttgactttgtrtatgcttttcagtcaggtggaaatgttcttccttttatgcggtcagcttcttgattttttattgcctctggattttgaataattgttagaaagctttacgctaacattgtgattaaagaggaacacacccatgctgccttccagtgtttgtgtagtttctttttttttcatttatatccctaatatgtttggaaatttttcttctctgtggtgtgaaatatggatccaatttctctttttccaaatggttagcgagtggtcccagcacattattattatttattcttttttttgggaagtggggtatagggtcttgctctgtcacccaggctagagtgtggtggtgcggtcatagctcactgcagcctggaactcctgggctcaagtgattctcccgcctcagcctcctgagtagctgggactacaggcacgtgccaccatgctggctaatttttttttttttagtagaaacagggtcttgctacattgccttagctggctataactcctgggctaaagcagtcctcctgcctcagcctcccacagtgctgggatyacagacgtgagctaccatgcccggccttagcaccagttattagaaagttcatcctggaccaggtgtgagggtgatggctcatgcctgtgatcccagcactttgggaggccaaagcaggaggatcattcgagcccaggagtttgagactagcctgggcaacatagtgagaccccatctctacagatattttttttaaaatagcagggcatggtggtgcacaccagtagtctcagccacttggaaggctgaggcaggaggatcacttgagcccaggtgtttgagattacaatgagctataattgtgccattgcactctagactggtctataatgagaccttgtttctacaaaaacaaaaataaataaataaaatcatcttgtcccagtgattcaagatgccacctttgtcctacaataaatttctttctttctttyttttttttttttttttttgagacagagtttcactcttgttgcccaggctggagtacaatggcatgatctcagctcactgcaacccctgcctcctgggttcaagcgattctcctgcctctgcctcccaagtagctgggattacagccatgcaccaccacacccggctaattttrtatttttagtagagacagggtttctccttgttggtcaggctggtctcaaactcccaatctcaggtgatctgcccaccttggcctcccaaagtcctgggattacaggcgtgagccaccgttcccgtcctgtcctacagtaaatttcaatatgcacttgggtctgtttctggaatttctcttcctttcctctctgtttacttgtgtcattattgcatttagttagttatttttagaggctctacatgttgtaatatctcgtagggctgttctctcctcatagcttttccagctcagtatttcccaggctatttcatgtttgtagttctatatgaactttagcatcaatgtgcctggctccatttaaaaaaagcttgttggggccgggctcacacctgtaatcccagcactttgggaggcctgggcaggcggatcacctgaggtcaggagttcgagatcagcctggccaacatggtgaaacaccatctctactaaagataaaaaaaattagccaggtgtggtggcgagcgcctgtggtcccagctgctcgggaggctgagatgggagaattgcttgaacccaggagccagaggttgcagtgagccaaggttgctccactgcgctccagccgaggcaacagagtgagactctgtctccccccacaaaaaaaaaagttgttggtatctttgtcaggattccattacacttatacattaatttagggagaattgatgtctttatgatattgatcattccttccaagaacaagggatgtttttccatttgttcaagtttactttcaggtcattcaggaatattttaaattttctcttaaatatttttcacatttcttactgagtgtatttctcagcatttaatcaccattgtttttaatttaaatgggatcttctccaccattatattttataattctgaactatccaatacagtagccattagttatatgtcattatcgagcacttgaaatgtggccagtccaaattgagaagtgttataagtgtaaaatatatactggattttgaaaacctagtgtaaataaaagaatgcaaaatatctcagtataatttttaatattggttacatgtttaaatcataatattttggatatattaaatatattactgcaattaatttcacccgtttctttaaaaaaaattttttttaatgtggctgttagaagaatcttttgtgtgtggctcagactcagatttcagattatatttcttatttttttttttttttttgaggcagagtctcactccatcacccaggctggagtgcagtggcgcaatctcggctcactgcaacctctgcctcactgcggactttatttcccaggttcaattccacctcctgggttcaagcagttctcatgccccaccctcccgagtagctggaattacaggtgccgcaccagcacactcaactaatttttgtatttttagtagagaccaggttttactatgttggccaggctagtctcgaactcctgacttcaagtgatcctcctgccttagcctcccaaagtgctgggattacaggcgtgagccactgtgcccagcctcagattgtatttctattggatagtgctgccctaactggttatttatttgtgtatgaaagctattgatttttgtttgtttgtttgtttatttcgagatggagtttcgctcttgttgcccagtctggggtacaatggtgcaatcttggctcactgcaaccttcgcctcccaggttcaagcgattgtgctgcctcagcctcccaagtagttggaattacaggcaagcaaaaccatgcccagctaattttttgtatttagtagagatagagtttcaccatgttggtcaagttggtctacaactcctgacctcaggtgatccacccatctcggcctcccaaaatgctggaattacaggcgtgagccaccacgcccggctgtatgttaactttatttttttattttttattttttttaatttttatctattttttgagatggagtttcattcttgtcgcccaggctggagtgcagtggcgcgatcttggatcactgcagcctacgccttctgggttcaagcgattttcctgcctcggcctcccaagtagctgggattacaggcgcacaccaccatgcccagctagtttttgtatttttggtagaggtggggtttcaccatgttggctaggctggtctcgaactccagacctcaagtgatctgccctccttggcctcccaaagtgctggaattaacaggtgtgagccccctcgccctgcctgtatgttaactttatatattttactttactgaattttattgtttgagtcttactgttgattctctggggttttccaggcattctattatatatgtgtacaaatagagaaagttttacttctactttttcaattcttacgcctctaattgttgkcttttacttaactgcatcttttctgatcttaacagaaatgtctctggtgtttccacattaagtaagatgttggctttagggttaaggtttatatattataagataattatttaaaattagccacattaaaaaaatttaatgttaaaaaaaaatccagcgattcctcatctcttgagtgtttttcattaggaatgggtgttatgggtgttaaacttcaaaggttttctagcatctgtggagataaccatgatgtttctccttagatgtattaatacgatgttttacattatttgatttttaagtattgaactgaacttsaattcctggaataaagctcacttgattatggtatatccttttgttttggaatctgtttacattatttaatatatttacatctatattatttttaggagagatgggtctgtgacttccgtttttgttctgtctgtattagctttgagtatcaatattatacttgcctcataaaaagaattaggaagtttttggctgggcacggtggctcatgcctataatcccagcattttggaaagccgaggaggggtgcggatcacgaggtcaggcgttcgagacaagcctggccaacatggtgaaaccccgtctctactaaaaatacaaaaatttgccaggcgtagtaacacgcacctgtaatctcagctactcragaggctgaggcaggagaatagcttgaacccgggaggtggaggttgcagtgagccgagaacacgccactgcactccagcctgggacagagagactccacctcaaaaacaaaacaaaacaaaacaaaacacaggaaattttcttgttttttacattttcagtgatctggaacaattcacattgggaccatccaggctttaaaggtttgatagaaatccctttgcaagccccctggacctggtgtgttttctgtggtccttgctagcagtcttctctcctctctggaaattattctatctctagtgaggttaattttggtaaaccatctttctgtagtaaattattcttttcaactagattttcaaatttatttgcatagatgtctgcaaggtagtctagtcatagttttaaatttctttgcaatgattattttcgcctgtcatttcttagtttgtgtatttttcctttctccctattttgcttaagttaatagtttatgtattttgttagttttttaaaatcatctgagtttattatttaggtttactgttcttcttttgtttttttttttttttctttttttttttttttgagacagagtctcgctctgtcccccaggctggagtgcagtggcgtgttctcggctcactgcagcctccacctcccgggttcaagctattctcctgcctcagcctcccgagtagctgagattataggcgcgtgttactacgcctggctaatttttgtatatttagtagagatggggtttcaccatgttagccaggatggtctccatctcctgacctcatgatccacccgccttggcctcccaaagtgctgggattacaggtgggagccactgtgcctagcttactgtttttctttacctcctttctttcttttttattttttattttaagacagagtctcactcatgttgcccaggctggagtgcagtggcacactcacagctcactgcaacctcaacttccctgggctcgggtgatcctccccactcaccttctcaagtaggtggtaccacaggtgggcaccaccacactcggctaattttttygtagtttttgtaggaacagcattttgccagattgtccaggctggtctcaaactcctggtctcaagccatctgcccacctaggcctcccaaagtgctaggattacaggcatgaaccaccgtgcccagcctaccttgttaatttctgctttcgtctttattttctttctgtgctttcttttttttttttttttttgagacagagtctcgctctttcgcccaggctggagtgcagtggtgtgatcttggctcactgcaaactccgcctcccgggttcatgccattctcctgactcagcctcccaagtagctgggactacaggcgcycrccacywcgcccggctaattttttgtattttttagtagagacggggtttcaccrtgttagccaggatggtctcgatctcctgaccttgtgatccacccaccttggcctcccaaagtgctgggattacaggcgtgagccaccacgcccggccactgtgctttcttttgttttactttcttggggttttttctaactttttaatttagaaattcagttcattttgttttttcttccatttttattgataaaagtgttcagcacgtggaactttcctctsatctttttcttaacaatatcccatggaatctgatagataatttttccttttttgtttgtttgtttgtttgttttgtttttgagatggagtctctctctgtcgcccagattggagtgcagtggcatgatctcggctcactgccacctctgcctcctgggttcaagcaattctcctgtctcagcctcccgagtagctgggattacaggcatgcaccaccacgcctggctaatttttgtatttttagtagcgacggagtttcaccatcttggccaggctggtcttgaactcctgacctcaggtgatccacccgcctctgcctcccaaagtgctgggattactggcgtgagccaccacgccgagcctccattattttttttaaagaaattctgggctgggcgctatggctcatgcctgtaatcccagcactttgggaggccgaggcgggcagatcacttgaggtcaggagttcggaaaccctgtatctactaaaaatacaaaaattagctggacgtggtggcacgtgcctgtagtcccagctactgtggaggctgaggcagaagaatcgcttgaatttgggaggcaaaggttgtggtgagctgagatggtgctgctgcactccagcctgggagacagagcgagactccatctccaaaaaaaagaaattatgtaatttccatgcgtcttttttctttcactcgatagtgtaataggcagcttttaaatttccaagaggagaaactttgttgttgttaataatttacaggtttttttcattgtgatcagagaatattgcttttgttttgcaaaacctattgatactttctgaggcccagtgtatgtcagcttttgtaactcctccatgtgtacttgatagaagtgtattttcttgggtcttggtatagagttcactgtgtgtgtgtgtatatatatgtacgtatgtatttacatatggagatacatatatgtatacacctccatgatacattaattctgttgtttagtcttctgtatatccttaytttgtgtcctcatggcctgtcttctgtggcttattattaatatgtttctgtgttttcttgcatctcctgtttccgtgttgtttggtgcacattcctgttatatatttttagttacttgtggctttttgtgttgagaagcggccacsttctggtcgtgctttgtgcctgcggcctaagtcctgctctgtctgcgttgtgactgctgcccctgctctccttcggcccatttgcctgacgagacagccttgtccttggccctttgtttccagcctttttctgagtgccttggttttaggackttctcttgtgtgaagcaaacctgaggcttgctttgtgagccaaattgaaaatcttcttttcagtcagttaagcccattcacacttagtgatataactatgtggttggtctcaaccctgtcattattttataatttctgtattttctatttactgttttgytttttgggtttttttaaaatgtgttgtggggttttttgcttttttatttaaaaaaaaaattgtggggctgggcgtggtggctcatgcctgtaatcccagcactttgggaggctgaggcaggcagatcacctgaggtcaagagttcaagaccagcctggccaagatggtgaaaccccatctctactaaaaaatacaaaaattagcccaggtgtggtggtgcatacctgtagtcctagctacttgggaggctgaggcaggagaattgcttgaacctgggaggtggaggttgcagcgagctgagattgtgccactgcactccagcctgggcgacagagctagactctgcttcaaaaaaaaaaaaaaaaaattgtccaggtgctgtggctcacgcctgtaatctcagcactttgggaggccgaggggggcagatcatgaggtcaagagatcaagaccatcctggccaacatggtgaaaaccctgtctctactaaaaatacaaaagttagccaggcgtggtggcgcgcacctgtagtcccagctactcgggaggctgaggcaggagaattgcttgaacccaggaggtggaggttgcagtgagctgagatcgtgccactgcactccagcctggcaatagagcgagactccttatcagaaaasaaaaaaaaattggggtattaggaaaatgggtgcttttttcctagtgcattcctatagacttgcataccccactcatgctccttgggcctgggttccctgtgtaccccctcgtggcctgctgtgttggcattagggggtcctctgacacccactcattgcctccacagcaggcagtgagtgaattccattctttgtgttttctctttcctgtctccctgtctctcctcttcccattttttgttggtggtgtttctgctctgtcagaacacacggtattcttaggtacacaatttactacaacagggctcccgcttgcctctgctgagtgttcccaggtgtcttcaggttggtgaagctcatcctcaggcagtggccttgagtagggccacagaattctctgagttctggagaagtaaactttgacctgttgtgttgtcaatgaacagatagtttggttggatataaaatccttggatcaactgatttctcctgtttaatatagtgtggttgttgtaaaaaaattttttcctgataccaaattggttaaagttgtgtttcctgtttttcttacaccaagattttatagactgattattctagttctagtcaggaaaagagartattagaaatctattatgacagcacttccagcagacatgccagctctttttcctcctcaagttggagctcttttcttctagaacttcttgtgggcggctgctgacatcatgctttcttagatcttcactttttgtacatctgtaaatgctccggccctctctcacccttgcttgtgcatcagtttcctgcatcagcagacggtgttctgtgcttcctttctgctgcttgagtttttaaaaatcgagactcagaatgctttcccatgccctgaagcacctctctgtacaaacatgtggagcctgctgtggctgggggctgtcctcactctccagtcacatccgctattctgtgccaggattgagctattggctgcgtttcctttaacctaatctttcccttcctcctgagtgtagattaccaaaggttgactttcccaggcctttccctgaacacacccagccttcattcctagaccacccagtcccagtggcaccagtgattgtggcctccaccccgctgtgtgccctcagggatacagttgggatccgagatagccaaggctgtcatagagcaggtccctagagagagactcctaagtgacatgtctgtgaacaaacacacttgaaagcacttgcctggtgctgtgtgagttgtcaaaaatattagctgctattatgcgagtaaaacgtgcctcatgctaccatggaaattccccagtggtagaaagaaatggagtgtttattaaaggttctgaaaaattgtcccgtgttgagggctgcagggaaatggagactcacctttaacaaagaaatgtcagtggctcctgtcctctttgttcacatcgatgaggctgaatgctgtgtgcactgcacccccccaaccccgccccagcccagatgtgtgctgctggaccctctttgatacttaaggctcacataagcctccgggaatgtattcacgattgaattagataagtgaccagaacagaacagagaagtagaaattctcaaacttgcctgagagtctaggaaattgagtaattctcaatcaatgatttccctgctatcctgcctgttttcaaagatggttgtgtaattgcagcatgaaatgtagccttggtttttgtttggaacaacttgaaagtgtttggccaggcacagtggctcacgcttgtaatcccagcactttgggaggccgaggtgggtggatcatttgaacccaggaattcaagaccagcctgggcaacatggtgaaaccctgtctctaccaaaaatataaaaattacacaggcatggtggtgtgcacgtttgatcccagctactcaggaggctgaggcaggaggattacttgagcctggaagatggaggttccagtgagccgagatcatgcctgggtgacagaatgagacttcatataaaaaaaagaaaaaagtttttgatgaaatctctggatgtcatatgggtgagatgaatgcctgggagaaccaccttcctgtagggttgatgtctgggtcctcttcctgtcaagggcacattcgagggacagccctttccttaacatgggcctgycccctgggcagcttctgctggcagctgtgctctgcctgactccaacggagacttagggcagtccctgggcttgcgtgcgarttagatttctgggaatcttcttgctaaagggctctctgatgggctgcctgtcatataatgaccagtcacatggggagtctaggttctggcaaacatgtcttctaacgggacctgaagccacagttgctttgcttagtggacatgtgagttctgcagtttccaggtcagacctgggtgttcataagcacaccaaagagatctgtcctctaaaatctcattttagaaaaaatgtttacaatttttgaagttgtttaaattgagcgaagacaaatgatttcttccgttctgataagatagcctgctgctgtaatttgacttgctgcttctcttttgttttacagatgatgtctttctacctaaagatattgacctagacagtgtggatatggatgagacagagagggaagtggaatatttcaaaaggtaaatgtggaggctgtgtctgaaaccgtggtgactgtgtgcttgccatacatgtttggttttctgtctttccatggcacttctagttgtcttggacgaagttacatcaagcaagccagacaacatggcttctgaagagccttgtagtaggacaggccagccacacacacccctcccatactcccaacactcacacaatcacttctgctccccctcacatgctagaaaaatagttgatggcagtggcttcccccccacccttccccgccaactggctgttgcgcttctgaggcggtggctctccaggtgtcctgggccagcagcgtctcctggggatacaggcccctacttagacctgtcggatcagattctgggaaggggccggcatctacgttcttgacagccttccgggtgaccctcacatatgctgatggttgaacacactggagtggtatgcttttgagaagaaaagtaacattttacatacttgctgttttcctgatgggcaagttttatcagtgcttgttctataatgttttaactactatgtgaattattaatggcaacaaaattttatttattttatttttaagagggaatctcactctatcacccaggctggagtgcagtggcacgatctcagctcactgcaacctctgcctcccgggttcaagcaattctcctgcctcagcctccagactagctgggattacaggcgcccacaaccacaccaagctgatttttgtatttcagtagagacagggtttcaccgtggttaccagactggtctcaaactcctgacctcaggtgatacacctgccttagcctcccaaagtgctgtgattacaggcgtgagccaccgcgcccagcctatttatttcattttttttattttttgagacagagtctctgtcacccaggctagagtgcaatgttgtgatctgggctcactgcaatccccacctcctacgttcaagcgattctcctgcctcagcctcctgactaactaggattacaggggcctgccaccacgcctggctaatttttgtatttttggtggaaacagggttttgctatgttggccaggcaggtctcaaactcttgactttaagtgatgcactcacctcagcctcccaaagtgctgagattacaggtgtgattaagcgtgcatttgtattataataaaaacaacaaaactggactagaggctgcgcctggtggctcacacctgtaatcccaacactttgggaggccaagacaggcagatcacttgatcaggtcaggagttcgagacgagcctggccaacatggtgaaaccccgtctctactaaaaatacaaaaattacctggacgtggtgacaagagcctgtaatcccagctactcaggaggctgaggcaggagaattgcttgaacctgggaggcacaggttgcagtgagccgacatagcaccattgcactccagcctgggaaacagagagagactttgtctcaggaaaaaaaaaaaaaaaaagccaggcatgcacttgtagtccaagctactcaggaggctgaggccagaggatcacttgaacctaggagtttgaggttgcagtgaactatgatcacggcacttgcactctagcctgggcaacagagcaagaccctgtctgaaaaaaaaaaaaaaaaattccccgagtagctgggattacaggcgcctgccaccacacccagctaatttttttatttttagtagagacgaggtttcaccatgttggccaggctaatcttgaactcctgacctcaggtgatccacccccccttggcctcccaaagtcctgggattacaggtgtgaaccaccacgcccagactgtcaaaatttttaaatacacagamctaaaaagataattaaaacattgcatatgaaaacctgcgggatatcgaaaaacgttaactttttagagctgtttatgtaaggctataattgcctaaattagtttttaaaaatcctgaaacataatgagttaaagatttcacttgagaaattaggaaaagaacaatagaayaaaccaaagaatatataaagaaggagataagagagataatgaaatagaaaacaaagatttggtagagaagatcaacaaagctaaaatatgattgattgaaaacaccaaataaatctttaggagacagattaagaataatagagaaaaaaagacacaaaaaatagcataattagatggaagaagaattaagatgttgataaytatcaaagtcaggtgatggctatgttcattatgctatactatctgtttttgtgtgtgtttgaaaatgtcagtaattaaaaaaaaaaaaagttttgtccgggtgctgtggttcatgcctgtagtcccagcacttcgggaagccmagacaggcggatcacttgaggtcagttcaagaccagcctgggcaacatggtgaaatcctgtctctacaaaaaatacaaaaaaagtaagccagatatggtggcatgcgcctgtagtcccagctactcaggaggctgaggtgggaggatgggttgagcctgagaggtggaggttgcagtgagccaagattgtgcatctaccctccaacctgggtgacgagagccctgtctcaaaaataaatttttttttttaagtgtgtaaatatataagtgaaaaggaggaaataactacagatactggagagattaaaataagagaacactgggaacaacttcattacaattgactttaaaactatgaaatgcaaaatcaacctgaggtaaaaatagcctgaatggtccagtaactactaaagaaatgaaaacaatagctgtaagtctcagtgagaaaactacattttaacagttttaccgagaattctaccaaactttcagactttgaaagaatggattatccagtcttgagcaaactctaccagtgaatttaaatgagtgagacatcacacacacaagtgaatactccctactttgttttatgagacaagtaaaattctgataccaaaatctgcccaaaacaataccagaaaaaatgaaaaatcacaggtttatctcactcatattagattcaaaaatcctaaagaaaatattctccaggaggctgaggcaggagaattgcttgaacccaggaggcagaggttgcggtgagttgagatcacgccattgaactccaatctgggcaactagagcaagactccgtctcaaaaatattctcatacctacatcagtgtaattttcaaaaaaaagaaacaatataccaaatcgagcagtgtattttaaaaagcagtataccatgagcaaattggtttatcccaggaacgcaaatagtgtttcatattagaaaatccactttattggccaagcgtggtggctcacgcctgtaatcccagaactttgggaggcccaggcgggcggatcacctgaggttgggagtttgagatcagcctgaccaacatggagaaaccccatctctactaaaaatacaaaattagccaggcatcgtagcgcatgcctgtaatcccagctactcgggaggctaaggcaggagaatcacttgaacctgggaggcggaggttgtggtgagccaagattgcaccattgtactccagcctgggcaacagagagacactctcaaaaaaaaaaaaaaaaaatcctccttccttcctccctccctccctccctccctcccttccttccttctgacagggtctcactcttgtcacctaggcttgagtgccatgacacaatcactgttcactgcagccttgacctccccagggtcaagcagtcctcccacctcagccctccaagtagccgggactacaggcacatgcaccatgcctggctaattttttttttcttcttttkgtagagacggggtttcgccacattgcccaggctggtctcgaactcctggcctcaagtgatctgcccacctcagcctcccaaagcgccagaattacaggtgtgagccccygcacccagctagaaaatccactaatgttagttgctacattaatatattaaagaagagccatatgatcatggcttagtagatcatggatcagtagatttccaaaaaaagtattttatattcaaccttaaattgtaattcctaggctaaaggagtataaaagaggaactaaaaatcaattttacaggtgatctaattgtctacataggaaatataaaagaacttacagcaaggggctaactgtgtaggatcagtacagaagttatttgcttttgttttttgtttttaaacagagcacggtggctcacacctgtaatttcaacattttgtgaggctgaggtggaaggatcacttgagcccaggagtttgagaccagcctgagcaacatagcaagatactgtctctacaaaaaataaaataattagccaggtgtggtgacatgcacctgtggtcccagctactcaggaggctgaagtggcaggatcccttaaacccaggagaccaaggctacagtgagccaagatgcaccactgtgctccagcttgggcaacagtgagactctgtctaaaaaaaaaaaaaaaacagttatttttctctatacccacaccacaaataattggaaatgtagctcaaaagagcatttataatagcaccaaaatctctcactatccacagataaatctggcaaaagttgcataagacttgtatacaaaagactgaaactttattggaaaacattaaagaagatctaaatcacagagattcattatccaaagacaggaagggttagtatcataaaagctgtcaaggaccgggcatagtggctcatgcctgtaatcccagtgctaggagaccgaggcaagaggattgcttgaagccaggagtttgagaccaacctggacaacatagaccacaactctacaagaaaattaaaaattagccaggcgtgggccgggcgcggtggttcatgcctgtaatcccagcactttgggaggccgaggcaggtggatcacgaggccaggagctcgaaaccatcctggctaacacggtgaaaccccgtctctactaaaaatacaaaaaattagccaggcgtggtggcgggcacctgtagtcccagctactcgggaggctgaggcaggagaatggcgtgaacctgggaggcagagcttgcagtgagccgagattgcaccactgcactccagcctgggcaacagagcaagactccgtctcaaaaaaaaaaaaaaaaaaaaaaaaaaaaagccaggcatggtggtrcatgcctgtagtcccagctactcaggaaattgacacaggagtatcccttgagctcaggagtttgaagcttcagtgagctatgcttacgccacctcactccagcytaarcaatagagagatcctttctccaaaaaaattaaaacaaaaggcaaaccattaggattmcacagcaagcttttgamcactaaactacaaagaggtcttcagcctgaccaaggagccccatggcaagaccagaggaggtgctgctgcttcatgggtttgcagctagcgagccctccctctctcctgctggaggaaggtgtgaagcgacgggagtccctaaccactgctccggggagcataactgttaaattactttggaaaagagtttggcagactctagcaaaattgaagttgtgcctcccgtgcaaccccacaaacagctgcacacttgtgtgcacgacyagaggttctcctgcatgtcccgggggcggggcaaacgtgaggcaagcagcagcatctgtctgttcactgccatgtgttcataccgcagtgaagacgaacagactgtcacctcatggagaactctcacagacataacattgagtgaaataagaagctgtaagaccatgtacatacagtgcagttccctcgatatgaggccacacagcacaaccatactaacatttaggatgtcatagagaagtcacgaaattaccaagaactatggtgaactaattactccaaaccctagggctgtgactacctcttgggagaggacagcacggcgccacggttagcaktgtcaggttttgtgacctgggggtgctgtgactcaggattctccctgctggttatgtggctgtcctgtgtgtcagacaccgtgtgcatgtctcacgtagtctgcagtcgacaaaacaggcctgatgcagaggccactgtgtctcgggtgcaggtggtgtggggagggacaaagccaggtcacactgggcctgggaccttagagagcagcgtgagctctgtgcccatgctgcaagaacctgtggaagctgtgcagtggtttggattggatttcttccttgaatggcttggagcaggaatgtggttgatgttcttgagcattctattccagctgctgtgtccagaaggggctgggggacagggtcacacatgcactaatggaaacaggattagtgattgtcagagttaggaggggacagcagaggcagaaggtaacatcacaaactcagggcttgaccagctagggacagggaaagagaatttggattctgggagatgacacagtcagcccttccagtttaggggagtgaggggatcagtctcatagaggctgcaaggcaagaacgctgttgggcattcacgaatgtttgtggttgaataaacaagccacagtttaagcaaccataattaaacctaatggatgggtgacagtaataaccattttcaggtttcattcaagtttagagacaaataagtaagtaagtaagagacagggttttgccacattgcccaggctggtctggaactctggagctcagaggattctcaaaccttccagagtgctgggattgcaggaatgagccaccacacctggtccagtgtttcaattttgcttacaaaagtatactttaggccgggcgcagtggctcgcacctgtaatcccagcactttgggaggccaaggcaggaggatcacgaggtcaggagatcgagaccatcctggctaacacggtgaaaccccacctctactaaaaatacaaaaaaattagccgggtgtggtggcaggtgcctgtagtcccagctagtcaggaggctgaggcaggagaatggcgtgaatccaggaggcggaagttgcagtgagccaacatcacgccactgcactccagcctgggcaacagagcgagactctgtctcaaaccaaaaaacagtatcctttaggccaggcacggtggctcatgcctgtaatcccactttgggaggccaaggcgggtggatcatgaggtcaggagttcaagaccattctggccaaagatgttgaaaccccctctctactgaaaatacaaaaattagcaagatgtggtggtgggtgcctgtaatcccagctgctcgggaggctgaggcagagatttgcttgaacccaggaggcggaggttgcagtgagttgagatcgtgccactgcactccagcctgggcaacagagcaagactccgtctcaaaaaaaaaaaaagtttgaagtaaaaaagactaatttagaatttaaaatttgattttaggaagtatgtcagatatcaaaggtttaaaacacttgatatcaaaataagatcatcacaaaagaagttattcatttaaccaaactaataattcaaaggtttcaaaaagcaaaaacctttatgttttgataggagactctggttttggagggttggggtttctgggttttttgtttgtttgttttgttttgtttttttgagacagggtctcactccattgtccaggcagtggtgcaatcacggctcactgcagccttgaccaccaggcccaggtgatctttccacctcagcctcctgggtagctgggaccacaggcgtgctccaccacccgctgcctgagactcagttttctcaacagtcagaagacataatgaaaatggcatgaggccaacagaatgtcttttttttttttttcagcttactcaaaagataattgacaaagtattttattatctcttattaatactacatgaaatcttattgaaaagagaaaaccagttgcatcagtgtattactattaattgtagtaaaatcttttaaacagatccatctaatttcaatcagctttgaccacacaggatttccataaatcttttataacctcttagaattttcccattcacttccttttcccaactttctatattcatttattttcttttccatctgtttttcaacttaagaccacttttaaataacctctaaactagtcaaaatcactttttcctttgacaaaaccacatcctcatgtttttcttataaccttccttaccaaaacacatcttactttttcttatgtattttatatgtagaactgttttcctgcttatctctactttgagttaccatgttagtcagaattttagcttttagtaaccttaaattatagtgaaaacttaagaaataagcaattattaatattttgtttatctgaaataagccaggcacagcgttcacaccttgtaatcccagctctttgggaggctgaggtggaggatcacttgagcccaggagtttgaggtgtgagctgcgattgtgccgctgcactccagcttgggagatagagtgagaccctgtctcaaaaaccaaacagaggataaagaatttaagctttccagtcaatgaagctttacattattggcagaaatcatgtcaacaaacagaaaagcgggctgagaaagtgcatatcgttatcaagggttacggaagagaggaattcagtcaactgagaaggtttttttattatgaattttttaactttttgagatggagttttgctcttgtcacccagactggagtgcaattggtgcaatctcggctcactgcaacctccgccttccagattcaagtgattctcctgcctcagcttcctgagtagcctctattacaggcacccaccaccatgcccagctaatttttttgtgtttttagtagagacagagtttcaccatgttggccaggctggcctctaactcctgagctcaggtaatccacctacctccgcctcccaaagtgctgggattacaggcgtgagccaccacacctggccctgtctctattttttaattaaattaaaaactatatatatatgtatgtatatacacacacatatatatggtgcttgcctgggcaacacagcaagacgtcatctctacaaaaagtaaaatcagctgggcatggtggcacactactgtagtagttccagctacctgggaagctcaggttggggagggtcgcttgagcccaggaggtcgaggttgcagtgagctgtgatcgtaccactgcactccagcctgggcaacagagtaagaccctgtctccaaaaaaaaaaaaaaaaaaaaaaaaaagtaatcacaccagagaggcagtgaaatgtgagagcgggtacatcctaccccttcccccacctcaagctgagtaatccacctgctgtattgtatagactctagatagagtgtggccaaagtagctgtaaattaacctcttaatgttgtcatagggataactcatatcctgtagttcaacagtttatagccaatcactatcaatataatttctgtaaagcaatgagaattcttgacaactttttttttttttttaaggcaatagtcttgctctgtcacccaggccggagtgcagtggtatgatcttggctcactggacccttgacctcccaggctcacttgatcctcccacctcagcctcctgactagctgggactacaggcgtgggccaccaatctcagctaatttttatttttatttttattttattattattattttttgagatggagtctcgctctggcgcccaggctggagtgcagtggcgcgatttcggctcactgcaagctccgcctcccaagttcacgccattctcctgcctcaggctcctgagtagctgcgactacaggcgcccgccaccacgcctggcaattttttttgtatttttagtagagacggggtttcaccgtgttagccaggatggtctcgatctcccgacctcgtgatccgcccatctcagcctcccaaagtactgggattacaggcgtgagccaccacgcccagcctcagctaatttttaaaatgtttagtagagacagttctcattatgttgtccagggtggtctcaaactcctggattcaagtgatctatctgcctcggccttccaaacgttgggattagaggcgtgagccaccaagcctggccctgataaacaacttttgtaatcacctcctctcctaatttgttctttttttcttaaaaacttgagttgttctttctaacccccttccctttctaaagaggcaagagatttgggtttcagggaaaaaaaagggaaactgccttctctggccttgcttcacagcatgggatccgggtcccggtactggcagtttggctccgttcctcctgtggcttctttttttttggcctaaattacacagcatgcttttaaaattgctgcttcctactgtttgtaattcagaccttttttcctccttaaatttgtgaccaaggccaggtacagtggctcatgcctgtaatcccaatactttgggaagccgaggcgggtggatcacttgagggtcaggggtttgagaccatcctggccgacatggtgaaaccccacctttactaaaaataccaaaaaaaaaaaaaaaaaaaaaaaaaagccgggtgtggtggtgcacatctgtagtcccagctactctggagtctgaggcaggagaatctcttgaacccaggaagaggaggttgtagtgagcccagatcgtgccattacactccagcctgggcaacaagagcaaaactccgtcccaaaaaaaaaaaaaaaaaaaattgtgaccagccgggcgcagtggctcctgcctgtaatcccactactttgggaggccaaagcgggcggatcacgaggtcaagagatagagaccattctggccaacatrgtgaaaccccgtttctactaaaagtacaaaaattagctgggcgtggtggtgctcgcctgtagtcctagctactctggaggctgaggcaggagaatcgcttgaaccccggaggcggaggttgcaatgagccgagatcgcgtcactgcactccagcctggcaacagcaagactccgtctcaaaaaaaaaaaaattgtgaccaattgctgttagttttaaactggtgcatgaaggtgagttctctccctggccctcaagagatttggaagtttgttttagagagtgctctcagtcacttaaggatgtaaatcttacttacttatttatttattattttttgagacacagtctctcactctgtcatccagggaattagcagcattcccgctgagactggatttgaaacaaagttacagttccttagagccactacagatttctttcctcaatggatacctttagcttaggataaccactaataggaattaatttgaatttacttgaaattatttatgactcttgaccatttgggatacccatttgtcatcttttctactaaaggaaactaaaatattgctctctcaaatactgggtattgttgagctgaagacagagtgcaggggctctctctacctctcctttgtttgcctaaaggtaggacataaatccttttttactgaagacagctactccgcagcccacagatggtgccagtggggcagaggaatctgtgagcagactttaaaccccaaaagactttctaaaaatgaagtctcagttcaggccgaagtgaagtggcttgatcacagttcattgctgggactacagatgcgccaccatgcctagctaattaaaaaaaaaaaaattattttatttattttttttttgagatggagttttgctctagttgcccaggcacgatcttggctcaccgcaacctccgcctgccgggttcaagcgatgctcctgcctcagcatcctgggtagctgggattacaggcatgcgtcaccacgcctggctaattttgtatttttagtagaggcagggtttctccatgttggtcaggctggtctcgaactcccgacctcgggtgatctgcccaccttacctcggcctcccaaagtgctgggattacaggcgtgagctgccacacccggcccaattttttttttttttttttttttttttggtagagaaggcatctctttatgttgcccaggctggcctctgagtatctttccacctcagtcttccaaagtactaggattacaagcatgaactacctccccagcccaaccccacaggtttaccttccctcatttttggcactagtcccatgggcagtttcgtttttctattttcctgtctctttaaatcttccacctggcatttgtgcatagactgtcagctgagaagctgagaccttagaaaatatggcctgacagatgtggcttgcaccctattcgcagctagcaagactttctttaagctgttcttgagaggggcctggggctgaaattttgttccctcttcagagaccttggttaaagccataaagggattcttaattttggtctcatgcatgtctgtgtgtgttggctttgagtcgtttgtgcaggtatgcccttgaatgattataaatttctggtttatatttagaatatgataggggttttttgttgttttgtttagccttctcctaagctaaatgaaaccatatactcagaaagtaaacagtttattaaaacattcaaagacaaacagctttaaatagtggttaccctagacctctaataagcaaatatgttccmcctccaaaacttttttttttttttttttttttttttggtgggagcacaaagtctggttctgtccgtccaggccgtagtgcagtggcgcattctcagyttgttacagtgggtagctagtcaggtgtgagcagggcaggggagggcctcctccatccaccagggatgtcaggtgaccatcaggtgatggttaggcagttgtcacactgcctctctaaaataataattggtcatagccagcaccagggaaactgaagctggtgatcagcagcttcccgataagatctcaggaattgggcaagtgggctcaagcatgtgcactaaggcacagaatggtggagtttaactggtgtgtgaccttccaggtactttacaccgggaagggaagatcgcctcaggtgagcatgcgcatgctccagtaaacacactacgcatgctccctcccaagtgctagcaggccagtgtgtgtgcaggcagcccaccccaagggaggaattgsgagaagggacgcgaggccctgaagtatgccaacacctagaaccctacatcagaggccggatggggcacttgcctctcgagttgcccacttggcctcttccaagtgcactttccttccttttgtttctgctctagagctttgtaatgaacttccactcctgttctaaaacttgcctcagtctcttcttctgccttatggcctttggtcagattctttcgtctgaggaggcaataattgaggctgctgcagacacatacggattcgccaccggcaactcaggtacctgccaccggcaacaggctcgctcagcctctgcccaccaggctgaagccatgctcccaccacagcctcccgagtagctaggaccacaggtgtgcgccaccacacctggctaatttttgtgtttttttgtagagatgaggttttaccatgttgcccaggctggccttgaacttgtaagctcaagtgatccacgcacctcagcctcccaaagtgctgggattataggcatgagccaccacagcaaggctttattatttttgagacgggtctcacctttgtcacccaggctggagtgcgggggcaccatcacagctcactgcagccttgacctcccaggctcaaggatcctcccacctcagccccgagcagctgggactataggcacatatgtgtactgccactcctggctaactttttactttttgtaaagatggagtctcactgtgttgcacgggctggtctcaaacgcctgggttcaagtgattctccaacctcagcctcccaaagtagtaggaaaacaggcatgagccaccatggccagcttcagatctcctctttggtgtcagtttcaggaaggaaaaaccaagaaacaagaatgttgactatttgcctggctaagacctgacacaggaatccttttaaacagctttagagttgaaagttgacttaattagaagctgatatttaggatatatgtgtatacaattttttcgaggcctctgctttctataaaagcttcttggaggccgggcgcggtggctcacgactgtaatcccagcattttgcgaggccgaggagggcagatcacaaggtcaggatattgagagcatcctggctaacatggtgaaaccccatctctactaaaaatagaagaaattagctgggcgtggtgataggtgcctgtagtcccagctacttgggaggctgaggcaggagaatggcatgaacctgggaggcgaaggttgcagtgaaccgagatcacgccactgcactccagcctgggcgacagagcaagactccgtgtcaagaaaaaaaaaaaagcttcttggccagggaagaagctacaaaaaatacaaaaattagctgggtgttgtggtatgcacctgtagtcctaactatttgggaagctgaggcaggagaatcgcttgaacctgggaggcagaggttrcagtgagccaagatcgtgccactgcactccagcctgggtgacagagactccatttgaaaaaaattaaaaattagctaggtgtggccaggcacagtggctcacgcctgtaatcccagcactttgggaggccraggcaggcggatcactttaggtcaggagtacagatcagcctggtcaacatggtgaaaccctctttctactaaaaatacaaaaatcagctggacgtggtggtgggcacctgtaatcccagctacttgggaggctgaggcaggagaatcacttcaacgtgggaggcggaggcttcagtgagctgagattgtgccattgcactctagcctggatgacaagagcgaaactccttctcaaaaaaaaaaaaaaaaaaaaaaaaaaamccggtgtggtggtacatgcctgtagtcctagctacttgggaggctgaggcagagaattgcttgaaccttggaggtggaggttgcagtgagccgaaactgccactgaactccagcctgggcaagagagtgagaccctgtctcaaaaaaaaaaggatttcaccatgttgcccaggctggtctcgaactcctaagttgaagtgatttgccctcctcagcctcccaaagtgctgggattacaggtatgagccaccacaccctgcctgggcctgataatttaagggsgctcacagctctcagattaaacgtttcttttctttctcaggactccttccgcccacccattcctcctcccgagtcctttccccttctcaagtgcagcctgtagcagggcctggaggggacccttgacactgtgcccctcaccgagaatctaaacccctgaccccgcagtgagtttctggcaagaacaggagtgtgatgggctttgccaagcaccagcttggttgtgggctgtttccttcagtgactgtttggctttttgtctttgcaggttctgcttggattctgctagacagacccgacaaagactgtctatcaactggtccaattttagcttgaaaaaagccacctttgctgcccactgaatgaggactccctggagagggacacgcgagaggcaggccaggctgcaccaccccaagagccacgcccctcgctggcgccccagagccgtggtgcttgccaagggctgtgcggagctggtgctgcctgaaaccccagaccgagaagttgatgctcggcccacgccgttagctcgtgtgcgtgtagtctgtgcgtgagactccttcgattgtagctctgtgctgtcggattggaacagtagttcccgccaagtcctcccaccaccgcggcctcggaggcctgggccgtggccagataggagtttgcatcatccacgtggctccgttgcctctgcattgcgccctgtcctgtcatgtgtcctcaccggggtatcggccgtcactcagctctcctgtgcccctgcgtctcaccctaggcgggctgggcggggcaggcctcctttgttctccacaatctactgtctccgagtgtacacgttgcgctgtttgtgtttgatccccctgacttgtagccagcttgtgtaagatcccttgcagaaygagaaagttaaaaacaagcccacccagtactcacaccatcaartctgttatagagtgtacgactgtattaacacggaggcctgcctggctacttttttaamatattgttaagtaatattaaaatcatgtctttctttttgaaagatggaatacattagtacagcaggagacctcggctgcttctttctgctgggggagtggggggatagcgggagagggcgtgtaggtgatgtgtccgccatggggagccagggcaccaccccggagcaggtcccaggtctctccaggcaacggctcacccatcctggtgcccccaccatcctctgtgtgccaggcagagcaggcagcaggagacagaaagctcccaaggagctgcatcctggttacttcttactacctagaacactcagtagctcccacttctcccagcctcatgttcagcctgtctctgtgtgccctatcagagtatgacttcactctgagtgaaggtgaagagggcagggcctggttggggagagggtagggagagccagcttctggaggtattcggacgatgaggccacaggatttcctggtggacaggatgcaggtaggagaaagaggtgaagacctgcgctgtgtgcctggaggtgggactggagaccagttctggatggtgagtctgggatgtccaccggccacccaggtgagaggtctggaactggggactgctgttcatggacagagcctgtgtgagggccctgcaggggtgagtagatgggatgggggcccgagctgtggaaccaggaaggcagaggagggtgaggaggcttcgaggcaggtcaggggagacaaggcccagggcacccccacccaggcaccggtttgcaggagaatgaggtggggacagcaggtcctagaactctggagattgcacgaaagctggaaaagggtcaccaaccaggggaggtgcagcacgacgaactttcctcacttgtttttttttccaggtgtgaggaagagaacgttcctttgttcgtgggatgatagggcagagagtgaagcaggtcaggccatgaccacggcaacagtagtgtccttgaaaccccagtgcaggcccccgggactccagccgctgcctcttctggctgcggtggtggctggggaaaggcccaggcccgggcctcgccctatggggaagctgcctgcccaggcccccagtacctgccctgctctccccatggacagcctttaacactgtgctgaaccatgcctgttgctgaggggaactgcacagccctgagtggtgatggggaactctgggtgccccgacacactaagcatcatgctgggacctagagaccctcagacgcccaccgcacatgcccagttctgggcactcccatcacctccatggcaaccctgcctgcggcttcacagctctgcccgctctggcccctgacctgcacctgctagctttggccctcaggctcccagccattgtcctggccatgcccttgccaggaaggatcttcctctatttccctggaaaccactcatccttccagcatcccagggtgcttataggacatccagctccagggtccctgacttgatgggagcccctggggttcctgatgacatcacttccctgtgggggagggtggggccgccataggggagcctcacatttttgactcacacagtagcacagggtgagtatcccttatcccttatctggcatcctcagtaccagaagtgtgtccagtttcagacttttttggatttggagtatttacatcatgcttaccaattgagcatttctaatccaaaaatctgaaatccaaaatgctccaatgagcatttccttggagcatcatcttaacactcaaaaggatttgaattttggaacctttcgggttaggcatactcaacctgtaatagtcatgaaatgaaacaataacaatagttagaaaggaaactttaacagtgaacagttgtattgagaagcttactgttttctgcaccctcagctctgagccctgctcagagattttgcctgggtagagaaacaggcagtaaaacagatagctcctaatctcttcccaaagaaactgactttgtttgcaacaaagaatgaagaggttcaagcctgaaggcactcagaaacagtggaggccatgaaaccctgggaagagagacaagatgcaggctcagctacaggccagatagtttgcaggaggtaactgaagaaaagagctgggagaaggcatccaggggtcagaaggaatatcacacagtgttcccagaaactctctcttcaaaggagtcagaatttgattggatttgtttgtagagcatggtgccccagggcattgttgaaaacaatagaattggcaattagtggtttaatgaatgtggtcagggaaagaggaagagaactctaccaaaatgactgtcatcccagggtgactgtgggcatacgcaaagctacacaccctgaggagcaacatcatagctggaatactagtgggtagtagaaagaaaacaatgatataataaggctgcatcaaatgaatatagaaattattttaaaggaaccaaatggaaattatggaatctgaaaagttacgtgtgtatatatatacacacacatatatatacacacacacatatatatacacacacacagagagagacagatggagtcttgctctgtcacccaggctggagtgcagtggcaccattttggctcactgcaacctccaactcctgggttcaagtgattctcctgtctcagcctccgcagtagctgggactatagttacacaccaccatgcctggctaatttttgtattttttgttgagacggtgtttcactgtgttggtcaggctggtctcaaactcctgacctcaggtgagctgcccaccttggcctcccaaagtgctgagattacaggcatgagccactgcacccagcctaaattttaaaattagcagaaggaaaaataagtggatttgaagataggctgatggagattatgccagccaaagaacatagagaaaaaaataatgaaaataaagagtctcagaaaaatgtgggacaccattaagcataccagcctatgtataatgggaatatcaaaaggagagcaaagagcaaaaaaaatattcaaagaaataatagtcgaaaacctcccaaattgaaaaatagtaacatgtatcccagaagttgaaaatgtttatattaagaaacaagaaagatctcactcaaatcaataaactaacttgtcaccttaagacactggaaaaagagcaaactaggcctaaagtaagcagaaggaataaaatcataaaaattagatcagaaattaatgaaatagaggatgcaaaaataatggagaaaatcaacaaaaccaaaagttttaaaaaggtaaacaaaatagacatctgtagcaagattgaccagggaaggattcaaattactagaatcagaactggccacacagaaaaaggattttaaaggaatactagaacaattatatgccagcaaatttggtaatttagatgatatcttagtccattcatgcagctatgaccaaatatcacagactgagtaatttataaataatagaagtttatttctcacagttctggaagctgtgaagttcaagagcaaagtgcaccaacagattcagtgtctggtaagggctcactctctgcttccaaagtggcaccttgttgctgtatcttcatatggtagaagggcaaaaaggggaattaaggtgatcccttcaacctcttttataaaagctgtaatccctttcatgatgatggagcactcatgatttgaacacttcccagaaggccccacctcttaatactatcaccttgggcactaagttctaacatatgaacatataaaccatagcagatgagatggacaaatttctagacaggaagaagctacaagaactgactccagaagaaatagacaatctgaatagacctataatgagtgaagatgttgaaatagtaatttaaaacagggaaaagtacccacaaaagctcaagcctagaagtcttcactgctgcattttaccatacagttagagaagaattaaaaccaatttttcaaactttcagaaatagaagaaggaacacttcccaactaattctgtgaggccagtattaccttgataccaaaactagacaaagacatcacaagaaaactacagactattatctcatgaatattgatgcaaaattcctcaacaaaatactagaaaaccaaatccagcaatataagaaaagaaatatacaccgtgatcaagtggaatcccaggaatgtaagggtggttcaatatccaacacatacttaatgtaatcatattaatcgaaattttaattgcatgatcatctcaatagatgcaaaaaaagcatttgacaaaatccaacacttttgcataataaagacatttcaccaagtgtgaatagaagagaacttcctcaacctgaagaatgacatctacaaaaaattcactgttaatatcatccttaatgttgtgaaagaccgcatgctttccccctaagatcaggaacaaggcaaagatatctgttttgcagtttctattcaacattgtgctagaggttctagccaaagcagttaggcccaggcaggcggatcacgaggtcaggagttcaagaccagcctggccaacatagtgaaaccccatgtctactaaaaatacaaaaattagttgggtgttgtggtgcgcacctgtagtcccagctacttcggaggctgaggcaggataatcacttgagccccggaggcggaggttgcagtgagctgagattgccactgcactccagcttgggcaacagagcaagactctgtctcaaaaaaaaaaaaaaatttcagctgggcatggtggctcaagcctgtaatccctgcactttgggaggctgaggcaggtggatcatgaggtcaggagattgagaccatcctggctaacatggtgaaaccccgtctctactaaagataccaaaaaaaaaaaaaaaaaaaaaaaaaagccctgcatggtggcaggcgcctgtagtcccagctactcgggaggctgaggcaggagaatggcgtgaacccggggggcggagcttgcagtgagccgagatcatgccactgcactccagactgggcaacagagtgagactctgtctcaaaaaaaaaaaaaaaattttttttcagggaacttctatctcagtaaactttctagggctcccgtggtgtggggcctgtcaagatattccttccaaggtgaaggataagtcgcctcatttggtccctcctacaaccaagaagatccacaatgcttagtgggtctatttggattttggaggcaacacattcctcacttagatgtgttactccagcccatttatctagtgacctaaaaggctgccagttttgagtggggtccagaacaggagaaggctctgcaacaggtccaggctgctgtgcaagctgctctgccacttgggccatatgacccagcgatccaatggtgcttgaggcgtcagtagcagatagggatgctgtttggagcctttggcaggcccccataggtgaatcacagtggaggcctgtaggattttcaccccataggtgaatcacagcggaggcctgtaggatctggagaagatggccctgccatcttctgcagctaactactctccttttgagagacagctcttggcctgttactgggctttggtggaaactgaatgtttgactatgggtcatcaagtcaccatatgacctgaactgcccatcataaactgggtgctttctgacccatcaccataaagtaggtcgtgcacagcagcattccatcatcaaagagaagtggcacatatgtgattgagctcaagcaggtcctgaaggcacaagcaagttacatgaagaagtagctcaaatgcccatggtctccactcctgccaccctgcctcctctcccccagcctgcaccaatggcctcatgaggagttccctatgatcagtggacagaggaagagaagactagggcctggctcacagatgcttctgcacgatatgaaggcaccacccaaaagtggacagctgcagcaatacagcctctttttaggacatgcctgaaggacag
